United States Patent 7,868,149 (PLANT GENOME SEQUENCE AND USES THEREOF) - sequence listing, part 109

SEQ ID NO: 59446 - DNA, 21511 bp, Oryza sativa
cccctcctttcccccgtgccgctgaccagtgggccccgcctgtcggcgccgcacccctccgtgctgacgtcagccctggttaatattgcgcaataattatttaaggatttcttttatagtaataaacacagtgaatcttctaaaattcatatctaattcatccgagctccgtttaatcccattcaagtctcagtaaatcaagaaaaatgtgtagaatccattaaaaatggttttgttctctgtttcagtagtcttatagcctgttttgcttgtgtgctttgtttgtcgcgtaggtttcggccgtttcgtcgatccacggtttctcgaagacgttgctgaggtctcgtcagtgcgagagcaaggcaagtcatgcaatacgtttgatcatattgtacccaatttacaaatatcccgcatttctattaaatgttgcattcttttacaatatcatgtggaatgggtcctattactcagccatttattgtttaccatatgacattgataacctgggtatcaaaatgactagatgttggtttaggaaatgcttagccatgcttagttcaactagcacacaaatggggatcaccttattacatagactttgactatgagcatagctttggattggtgccaccgcaatggtgttagttaattaaaatacattgaatggtgggttgtgggtgcatggttttgctggtcgcacccatggcagttaaggaccggttcacgggaaaccctgggagacttaccgtgcttaccacaagcgggagtgggtaactgcttgatctgaagtatagctcgaccctttcctaggcaccggtggcgagggtgggcgtgatggagttgggtcggccggggtgtccggttgtccagctgccggattcaccgcggcgcaagaggggaccgcccactgccttttgaggggtgggggtgaaaccttagcgtggtgtggatggttaggggagggttatgtggagggtcttgtcacgatttccccctttgcagtatcatggtgatacttcggggcatggcgacatgtgtggaatcgtgtcttgtgggtacagttgtacacctctggccagagtaaaactattcgaatagccgtgcccgcggttatgggcgatcaaccagattcaccgtgattagtctcacccctagtttagcttaatgaactggtgtagttcaggtggttggttgggcctgttgcaacgtggtgtagcgttggacagtgtttggttaatattgattaattactacaactgttttactgctttcaactactgcttttaaatgctagctttatgcaaaagaacctctagcctcctttggttatatcctgcatcatacctcctcttccggtatgacttgctgagtacagtgggtagtactcagtcttgctctcttttcccccacaccagagctgaagatcttcctagttggagctgttttgtcaaatttggtttcgtcgctgccgtcaaggattgcctgtggagtggagtcgcccgctgctgaagtcaagcttcccggtttagctcgcttttatcttttccgctgcatttgtaatcttttctatttttgtaagacgtggatccgtatgtcaacaattgtcgtttgtgtaccctggctggtcctggacagggattcaatgcacattcagcttagaaattctggttcgagaatttctgggcgtgacatgtgccgtctacgtacttcttgttgttagtccaaaatacgaactcataattagtcagctgcatagtggcatcctatcatgttatatattatgtggttctgtttggtgacatcttttggaatatatggttattcaacatcttattgaaatgtcatgcatctctatgaaatactagtgcttgtttttttattgtgcatatggacaatcaacttgttaatagaacctaggataaaacattcaaacaagcaaacatattatatatttagtttccacaattacatagacgacacatgtacatagatgacaaaagtacatattatgacacaagtgcacaatagttgcctagaagttgtatgactttctcatacaactgacgatcacagcgaagggctttaggaagaatgccaagtgcctctagcctcgctttgttcatgtgagggatcttgtacttattccctccattagcttccattacttcaatgcaacagctttgtagtgtcacgaacactctattcagagtctttggatcgtagtcattatattccttctgaacattctctattagctcctccatgtttttagacaccctattagcagttaaggactgaagtgatgcaaagaagccaagatctagacaattcatatcgggggaattgggaggttgattcacgaggcgaatatcaagccccatttgagctactgcaacactgaactgctcatcgtcaattggtacatgagttctagcattgtcttgttgaataaatattgttcttcttgcatcttctagaggccaacatgctctaatagctgggagaactttagagattataaatgatctcatagtgtctctatcaaccttaattgtctttgttacaagtgtccccctctctctattacggcttctcctttgtgcgggttcctgttagtacatcaaataggctaggtttaaacataaaaaacagaagtaaataacacttgtataagaaggttgtgttacctttctaacaaaaggccaaatgcctatcttaccatcaaaagtacaattgccttcagcatcatacctaggcctcgcaactgttgatagaaacattactttctcaattgcattcttattttggacaggtctatagggttcctcctcaaggggatgcaggtagaaagttctgtcctttttggtggcattgaaccatttttcatctatgtggacaatgttttccatttcaataaacttggggtcgtttggtaacgtacgatgatctagcataccaacacaccactgcagcctttcttttttgtttgcctccttcaaataaggctttagtgagttagagtgacgtcgtagatgcccttctttgaacaacctatgcaatgtgctttttgacacacctagggcttcagcaagtgaccgtatagtgcttctttggcgcaatggaatagctgatacaaccgacaagtctattacaacctttttgcggccacaattgtaacacttcctcgagtcaacattaacttgtactccatgtgcgatgcaaagctttgctctcttccaaatacgctggactgtacggatgctgacattgaacacttgagcaactgcacgtgtggtgtctttttctagttttccatccttactttttgcaagcaacaattcataaattctttgcctttgtgtgtttgtcaattctctagaactgttttcctcatttccatttgcatctggatttggatttgcatttgcatcttcttcttcttctgagtctgacaactcctctctatcaaagacaacattgacagtatctgtatacacgccatagtcccgaagatcatcctccaaggcttccagctcatgttgcaattcattgtcattgtctacaaaaaaatttacatggtaagttaatgtgtgttaatcagattgtgtagatttattcagtcctaaaatcaagaatgtaaacatgtttgtaactgatcaaagagtaatgaacttttacccagttgaatttcttgttcctcatttccatttgcatgcatatccaggtcatgctccatgtcttgctgataattgtctaaaaaaaactacttgctggtcagtgccgcacaaagaatattgaatatgtttaggatttgcaatgtcatgactcataactgtagtttacaatagtactaactcttccatatttccatatcaagatccatgacttattcatacatctgttcgtaaggtagcattgatttgttgtcatgctaattcagttatgtatttaattctacctctagctctatttaagttctagtgttgtacaagtaatttttttcaggtacttaattcagttcttgcttattttcagtagcaggtcaacaggaatattgtgtctgggactgggagctggagttaaggatgtttcacaattcaaatttcacaagtatgtgaccatctaagcatgattcaatatttcgcatcataaacacgtgatttgttgatgaatattaaatacttaaatttggcaagacgtgtgggttcttggcaataaattggttctttgtactagcaattaacaaaattagttagtaaatcttgacatcgttctgctcaccaataggttgtgcctgttaattcttccaacatgctctggccatgaccaaagttacttcctccctaattcgatgttaggtaacaatgtgctatttacagttcatttgttttctctatcttctgtaaagtccagatgctctaggattctgaaaagaaatggtcagatgtgaactaaaatttcatactaggctctgaaatctaatctatttgtttgccaatgctttaatctgtttgaaaccatagtgacatgtcttgagttttactctctatgattactacacctgttatctagtttctaaagtgtcttctgatacatgataatggaactagaagaactaaactctgcaaaactgtcacagtagcaaccttttgttcttttcagatcgtgtgtgtgtgtgtgtgtgtgtgagagagagagagagagagagagagagagagagagcatgtgtgctgatgagggggtataatctgctgttgcatgtcatacaacaccatagttttttagagccagatttactaatgcaatcaacatgcactgagaaagaacccattttatgcattgagaaagattagatgaagtaaaaaacctggatgcagttgttcttgttcttctgttgcttccaagttgagatcaaaagctcccaagttgagatcaaaagaatgtacaacttgatcatttccatggcaagcaactcgagcaaggtcatctacctggataacataccttccaggaacttcttcttctagattggcttgtgcttcattgaggtcaggtaaagcccctccatcttcctcttcttctgctaatatgtttagatctatagccattgtgatgggtgggtgtggagttggtttgtaggatgatggatgaagtgataaaaggcttgtaactgcctcgctgcttgaggattatggagggtacccttgggtggcaaagcaccatccatggagtttttgaatttgattagaccggttggattcttttaagcccttatgttttggcgccatatcactcgaattaggtgtataacaccaatctgtagtgttgatactagtagtagcacccagcattaattggatgcttcaaatattccttttgtacagatgtggcagtgtacttgtcgtactcctactaagcattcaaatgattagccccaattctataaattgagggcaaaatggtcattttcacacaacactaatttttcctaactaacctagaacgtcctcctttctgggacggagggagtactatagatgacatggacactaattggagccagcagttggctctcttgttgaccttgctcttatacacacattacgtcttagagtccgtgctgcagctgactatagatctatagtccgatgttcttctctctcatcttttatcttattaaaatatgtttatagttggctaatagtttactattatctgctattgtacctgctcttacaaatcacggactgacgtgagagatcggaagtcgaggcacacaaatcacaaatggacgtgtgaatcgcatggccacagttccccctctctctcttgtttgctgacacgaaattcagagtcgtactgcagatattgttctgtttttcctttttattctcccctagcttttgggagtacacgtggttcaattcagaatcaagagctcgatcgttacccttttctaacatcaaacagatcctggtggtgaggaagaattaattacgaggctctctgttatatcgcgaataagagaaacgatggcttcggataattcacgatgacaaagatcgatgatgaagacgatacctatatcggtctaaaattgatactgaaatttcacctccgctaatttgtttgctagtatctctaatcagagatatatcctatacacataattattttttataagtatcatatacatcaattaaaaaatatgattaaaaaattctaaaacaatgtatataatctttcagtagttttacaaatatgtataaagtcatacctacaaatttattataaatagggagcgatgaaattctaacatattttttactttcaaatctgtcgaaacttttattttttttattacaactaaaatataatgagtctggcaagtactaagtactaaaagaatatagcaaattccttaaaattatatgtatgggtttttctaacatttttagtataatttatttcttggtgtacgcgatgtaaacaggaaaaacttatatgcacataaatgtattcccctctaacgaaaagttgttatgtcaacaatgcaaatcagatatagctggacttgagcagttaggagtttggagtcagcattattatgaaataaaatcacgcacaacacgagccgccccggcacaccgtgcatcggtgcacgtcgacgtcgcgatttggaggagcaggggaaaccgagacgaatgagacgagctgcacggtgcacgcggacgtttcccacgccgctcgcgtcttcccaaatattcaaatcgattttaagctatcgcaaacgtggccgatgccatggccctagtcctaattaaggccagtagcaccagtgtggggggtggtttggtttgataacgtattccttctgttttcctttttaatgcacccgtacgtgaccggtcgtaattagccttcttccgttttatattataaattatttttaccttttttataattaaaattctttaaatttaatatagaaatatttaataacatatagaaattaatatattttgataatatatttgttttgtgtcaaaatattgtaattttttttataaacttgatcaaactaaaagaagtttaattagaaaaaaagtcaaaacgatacaacaaacgatagactaggaggtgattaagaatacaataacgtactctctctgtcccacaatatccagattcagcatactagcatatgtcacattcacccaaaatcccttatattataggacggatggagtattactcacttggatggagggcacagactcgctaggaggacaagagggaagtatgacaactccaattcatttctatagtagcagaaattatgtcattcatttctagacaagacatttatttttccatcttgtttaaaaatttgatataaatatatgaacatataagtcatacttgaaatatctttaatgataaagtatgtaaaaacaaaataaaaatacatatatgtatttataaaaagtagaaacaacataaataatgcttatataacttttttttataaaacaaagcaaatgatgaaatatcatgtttaaaagttaataatgttatatttaaaaaataaagtataattactaagatttgggtaccgaaatctctgatgttgtttaaattttgggctgatagagtcgtagagatgtgacgataatgtttggtattaccaaaactatgtcaataatttcgacataggccgagtttagttttaaattttttcttcaaactttcaacttttcgatcacatcaaaactttcctacacacacaaacttttaactttttcgtcacatggtttcaatttcaaccaaacttctaattttagcgtgaactaaacgcacccataataattttgaaacgagtgcttaattcacttacctatcaaaaagtttaatctaaagaatttcagtaagatgataaaccgaactctcgctctcaagaatattaaattgtgccaaatgatttgagataataaattttaagcagagtatcccccactagcactcaccagtcaatcttcagtcacggccctattgtactgttcccagttacaccctcttgtggctataaatacccagcgagctcacgctcactgcaactcgattcagagcgaaacgtactgattaaagtgatcagttcatcagtccacggcaaacccaggtcgagagctcgagacatccagaagaggcgaagatgctgggagggatcatcgacaccatcacggggtcgtcgaagcagtcgcggctcaagggcacggtggtgctcatgcgcaagaacgtcctcgacctcaacgacttcggcgccaccgtcatcgacggcctcggcgagttcctcggcaagggcgtcacctgccagctcatcagctccaccgccgtcgacccaagtgagcacaccccccccccccctctcacccccttgcatctcttctcttggtcgatttacctctcttgttcatttttgtccatacaaacttaaacactgtatgggcggccattgcctagctagctcggtcctcttttgatgggacatggaaagaagagaccaacgtcgaggaaaaagacaaccagggcaggagtaccagatgctaacccaaagtacaaaagctaaaaagtaaaaaaaaaaagaagaagtagtacctcactttgaactagatgcctgaaactatagctggtgtcgcgaggtggtgacacgtagtataattaacagctggggcatgattagtcgttggtttggactaattaacgggaacggattgggcatgatcctctcatcggcgtgcagacaacggcaaccgggggaaggtgggggcggaggcgagcctggagcagtggctgacgagcagcctgccgtcgctgacgacgggggagtcgcggttcggcgtgacgttcgactgggacgtcgacaagctcggcgtgccgggggccatcatcgtcaagaaccaccacagcaacgagttcttcctcaagaccatcaccctcgacgacgtccccggccgcgccggcgccgtcgtcttcctcgccaactcctgggtctaccccgccgacaagtaccgttacgaccgcgtcttcttcgccaacgatgtgagttcttctctgctgcatactgtattatgctaccctgcatgtaaattacactattacagtaaccatttgccgttcttctttgtttggccagttcgtagatgctttatgtagtaagttgcttgattcacgtcgtttggtaggcgtccatagggaagatatttggttaggtgagaagtgaatggactttatgtaagttgtttatgtggtaggtgaagtggatttagtagcactgttcaaaaaaaagaagcagctctacaatggatatgcttcctgatgataacaacataaaagtggctatagtactagaaatctggaatagtccttggactcaggaaggcatgtgagttcacgtgagtcatcaactcatcatagttgccacagttcacagttcacacccatttagacggcattgtttcatggccccgagaagctttttcaacaagatcaacgacacagcactcgattttactttgcgaacacatgacacggtaaaagttttaaagtgaacagatagttgcctgcctcttgttcagcgtgcagccaggtgtccaaggccggtgccgtatcaagggactgatttgggcaatcaactaaccaattaagtaggagtaattagcgatgcgtattaatacgagtacgtgctataattaactttgtgatatattttctgcggcgacgcgcaggcctacctgccgagccagatgccggcggcgctgaagccgtaccgcgacgacgagctccgcaacctgcgcggcgacgaccagcagggcccctacgaggagcacgaccgcgtctaccgctacgatgtctacaacgacctcggctcccccgactccggcaaccctcgccccatcctcggcggctcccccgacaccccctaccctcgccgcggccgcaccggccgcaaacccaccaccaccggtacgcatcccccaaccaaaaattttacgattcttaaaaaaacattttaaggtctaaaaagttttttatacatttttacactagaatgtggcaccttcactcacatacctcccagttaggcccacctgtcatagtgaaacaccagaactggtccatgttcagctgcaatgtctcactgacggtgggcccggtttgtgtggttgaccgttgactttgactttgactgatgttttttgtacacgtatgcgtgcgtgcagatccggactcggagagtaggctgtcgctggtggagcagatctacgtgccgcgggacgagcggttcgggcacctgaagatggcggacttcctgggctactcgatcaaggcgatcgcggaggggatcgtgccggcgatccgcacgtacgtggacaccacccccggcgagttcgactcgttccaggacatcctcgacctgtacgagggtggcctcaagctccccgatgtccccgcgctggaggagctccgcaagcgattcccgctccagctcgtcaaggacctcctccctgccgccggcgactatatcctcaagctccccatgcctcagattatcaaacgtgagcgcaacctgtcatcgtagagacttttcatcagaatctttaggtgaaaactgacgatcgatgtaatgtttggctatgtatgcagaggacaaggaggcgtggaggacagacgaggagttcgcgcgggaggtgctcgccggcgtgaacccgatgatgatcacgcgtctcacggtgagtgatcagtgatgcgttcatgccaaattgatagtgaacacggctgctgcaacgtgaaatgtggcaaatttaactcgatgttgatcccgcaggaattccctccgaaaagtagtctcgatcctagcaagttcggcgaccacaccagcatgatcacggcggcgcacatcgggagcaacctcgagggcctcaccgtgcagcaggttggtttcgtacgtgcagattttgctatcaatcgtgacttgcaaacctgaattgttgctggcaaatggcaatagtgtgtggaaatttactgtgtcgcgatttgcaggcgctggacagcaaccggctgtacattctggaccaccacgaccggttcatgccgttcctgatcgacgtcaacggcctggagggcaacttcatctacgcgaccaggacgctcttcttcctgcgaggggacggcacgctggcgccgctcgccatcgagctgagcgagcctatgatccagggcgacgtcaccgccgccaagagcaccgtgtacacgccggcgtccaccggcgtcgaggcctgggtgtggcagctcgccaaggcctacgtcgccgtcaacgactccggctggcaccaactgatcagccactggtacgttcaaaaccagagcaatcgatcgcttcatcgacggagatttgtactcatcggttgttgttgttggttgatcaggctgaacacgcacgctgtgatggagccgttcgtgatcgcgacgaaccggcagctcagcgtgacgcacccggtgcacaagctgctgagcccgcactaccgcgacacgatgaccatcaacgccctggcgcggcagacgctcatcaacgccggcggcatcttcgagatgaccgtcttccccggcaagtacgcgctctggatgtcgtccatggtgtacaagaactggaacttcaccgagcagggcctccccgccgatctcatcaaaaggtagtagtattacacatctccattgatttttgtaaggcatcagtgggaagaatgtacaatttagtgcaaaatcgtgtgaattttttttgcaggggagtggcggtggaggacgcgacgagcccgtacaaggtgcggctgctgatcaaggactacccgtacgcggcggacgggctggagatctggcacgcgatcgagcagtgggtgggcgagtacctggcgatctactacaccgacgacggcgtgctccgaggcgacgcggagctgcaggcgtggtgggcggaggtgcgggaggtcgggcacggcgacctcaagggcgcggcgtggtggcccaggatggacgccgtgtcggagctccgcgacgcgtgcaccaccatcatctggatcgcgtcggcgctgcacgcggcggtcaacttcggccagtacccgtacgccggttacctcccgaaccggccgacggtgagccggcggcggatgccggagcccgggacggaggcgtacggcgagctggggcgcgacccggagcgggccttcatccgcaccatcaccagccagctccagaccatcatcggcatctcgctgatcgaggtcctgtccaagcactcctccgacgaggtgtacctcgggcagcgcgacacgccggcgtggacgtcggacgccagggcgctggaggcgttccggcggttcagcgaccggctggtggagatcgaagggaaggtggtgggcatgaacggcgacgcggggctcaagaaccgcaatggcccagccgagttcccatacatgctgctttaccccaacacctccgacgtcaccggcgccgccgccggcatcaccgccaagggcatccccaacagcatctcgatctgaaatctgagctcccgatcttaatctgaatatgtacctacgattacgaataattgatccttcagcacgggagcatgtagagagattagcgttgtgtggataccgaatcagtgtgccaccttataatgttgtgaagaaaaatatatgaaaaaaaaaactgataactaggaacgatcacttgctgcttcgcagcacggtagcacacgctctcgatacataggcgggtaattgagcgggttcactcttctatcattatccgctgcgcaggcagtgatgtagatgcaatcttcctccagattatccacccaatctgcatcggttctttcagcgagccgaatgttgctgtaggatcctctctgtaatccaggaaagagtcgttctccacgcatcaccttctcaaattccgtgtcacgtccatggaagctcttctcaccaggatgcacaatcctagtccccttgctctcacagtaaatgcaacggactaattctgccatacatacaaaaatgacaacacgttataaactaataatagtatggtagtgacaattgattattaacgcgagtagaattccttctgtcacatttgcacactccatattgagaacagaaatcggacgtggattttcatcccttgaggggacattccctcgttatttgcatgtcatctaaatagttattaaaaaattaaaaaaattgacaacatagattaatacgaaatatatcactccacaaacatgcaagaccaaattcaacttctataagttgcaacaaaaataacaaattaaagtgaaaataacacctaaatgccaaggattttgtacgcctagatgccatggcacccatcatttgcatacgattcaaatagttatagaaaaaattgaaaaagtttagtagcatcgattgtgatgatataagtctatggaaagtattttctacatgtatgcatgtaatttaaaaggttatataaaaattttataaaatttgataagatagattatgataatataagacactatacaaacatgaaggtctaaatttgatcaacatatgaagaaacaaaaataacaaattttatctgcgtggtacgtgtactattcactgtctgattttattgtttttgtttctctagttgtagatcaaatttagtcatgcatgtttatgtatagacttatatcatcacaatcgatgctactaatttttttcattttttcctgtaactatttgaatcacatgcaaatgatgggtgccatgacatctaggtgtagaaaatccttgtccataagtctatacacaaacatgtatgactaaatttgatctacaattaaagaaacaaaaataataaaatcagacagtgaatagtatccgtactccctttaaaactggacagatcaagaaactgtgcccttttgaaacaggacagagagagtatcacctatgtcatctatgaagcatcctgcataagtaatctatcacacgttagcatctatttaccatagacagatctaatataatctttctattggacagattttagcagcattcttttttcttttctgggcatcacatcactatttttgcttaacctttggtcctctgctatgtcggtgagttttcaactagagatatatactgatatgaaattgattacgatagcatagacaaatctacttggaagggaaatattgagatggatattgaaaggtttttcgatcgtaaggtcaagaccagagcataccagtatctcgatgcggcgaaaccacagggatgcaccaagactcctcatgaacgctatagttgctacattcagcaaagaagagcgttgcaggatcattggcagattgggggtcatcgcaaatcgccagaaagttgatatgagagtgattatatttgtaaatcctccatgggctattgcttctgaccgggccgtactccaggccagatacgcactcattgacaccacagataaaatgaagcctatatttgtgcaccttcaactaaagacacaatcgaagagagttaattggacatttgaggctaagcatatacaacaaaaatagaggggggtcaacttgaagaaaccaaaccttgtcaaggttgaatgtggccaatgcaacttccacgttcttgcagactaggtcatgatgtagccaaaacttgaaacgccggtgacaaagcgcaatgtaggcatcattgcataaccttttaggctctggctgctgttgatgtcgcaactcgaagtgacgcttgcgaaacaacaaggaaatcaaggtgacatcgtcagagcagagcctgtcaccgtgctgcaacgcatgcagatatacaaacccaagcttagccaggttgtcaggtgatgcgagaagctcttgctgcgcaagcggcgctgggtggaaagcagcagcagccgcagcagcataagcttcgtggacaccggcagacgggtaaccgatcttcttgatgcctcagctctgaaacacaaacatccaatcccaacctgcagtggcaagttacaacagaagctcatgctgatgttgtctgttctcgtaatcttattggacatataaccaagggcaggatcaacaatccgcaagtcagcgttggccatctgcagccaccccatcgcttggtcaggtgagcagtccgggtaacgagtgcacaggaaggacaggaggccatagaaagatcgggccacgattcgcatcaggcatttggtgctgatcatctgcagtgtacacggcttgctctgcgagaaggccgcctgatcgtaccagatggtgttgacgatgatgttggagacgggttccagcgggccgtagcagtggccggccttgagcatgctgcggtgataccgagcgcgcagctcgtcggccggcagcctcgccatcgcctgcaggtagaagccgcggatcgttgcgaagagcattcgcttcttggccgcccggacatgagggagaactggttgaggctttgcacgtaggagcagagattttgcgagtcgctcccatgattttgccagtttggtttttgtgttgtggtgatcaagccgagattcggcgagctcccaggattgcttcagatggagaatttcatcatctttcactgtggcgtggttcatcatggtgttgtctagtagcgccttgactcgagatttgttgggcgtgatgagcattttcaggtcaccggcgagacgagcttccaccctaacacgagcagtcgagggtcggggttgttagagataatgcaatctcctgtaatctctgtatgcgcaagatgaggaggccggtagtttgttaacctgataaggttgttagagcatgtataggagatccggttcctcccatctatggcgcatatatatctgtaaatgatcgcacgattcagtgctgaattaacacgaaccgtcgcatcgacgacattacctctagattgagttttctttcaggggtggcgggcggcgacggcggcgcaccggagggctatctcggcggtgatcacggtggcgccggagtcgaccacgaacgactgctccattccgcgccggttgacgatgagtcgggcggcgacgagggcgtccgccccggcggcgtcgaggtagcgaagtgcctccacctcggggaggtaggggaagaggcaggtcaggaaggcgacgagcccatccagcgaccgctggaacatgtccgcggcatgctctcctccgccgccgccgccgacttccggacgccgggaagaggacgtgatgacgctgttgacgacgatgttggaggtgggagaggaggccgaagcagaagccgccgctggagatgaactcctcctcgagacacttcaaccgacagtggtcgtagcacctcgcgatcttggcaagaaccggcacactctcggctttcgtgtcgcctctggagtattcgtccttgaagtttcttggcccgtagatgcggggaaggtggcggcggccgcctgggacgctccggtgtgacatctatagtcgatggtttggaggatcgggtggtggaggcggcgatgtcgtcgaggatttggagatcgggagggggtggcggcgctgcacctctcctcctctctttagtcgatcaggaggcgaaacgccggcgccggccaaaacgcgcggtgctgcttgcctgcttcctttcggtttttttttttttgtgtgtgtgtgtgtgtgtgtttcagtgtttggactgtgccgtggattgattcgtttccttactataaacatcgccgtattttctccggctgggtttccggctaattgcgcgcgcgttctctctctctcacatcttaatatttcgcaaaaaaaaaggatcttaaggaaaatcagttggctgaaaagacttttgaaattgagagaaatttatcgacagatgtttagcgatatcgttcgttttttagatgggccgtgacggaccggcacggcctgctcgccgtgccttgccggcacgcgtgggtcaggtgcgtggcccaagcatggcccaatgaaaaaagggcctctccgtgatgaaccagcactgcacaggcacggcccaggtcaaaccatcggaagaaaggtgacttgaactaaccgagttcttcctcgatagttatttttccatccaagcaggtgtacagaaatttgggttggttcgttggttcgtttcctcccattttgccaatcgtgaagatcagttggtgcaaactctgttttgcgtataggccactctgtttcgtattctgaggaacaggatcgcattgggtataaactctgttccagagtcatgaagcagttgagaacttgagatcctctaaacaagatgatatgggctaacctcaatttgccccagatccacagatctatgtcagggaatcttacacgcattgagtgaatcgcgaatctttatggaaaaataactaaatgtggtaaggaatgagtggcatgatcctgcctcccttaaggctgctgtcggcgtgtggtgttggaacaaatcccacgagcacgtaaaatagggtgactcattacacatgattaattaagtattagctattttttaaaaaatagattaatataatttttaagatattttatatagaaaacttttgtaaaaaaatgcaacgtttagtagtttgaaaaatatgtgcgtgaaaaaagaggtgagttgggaaagaagaggaaatgttactgatggatgtggtttcatccataaaaggataaaaggttactctgcatgccctctagcttatttgtttctatcaaaaacgctgcctagtggcttcatccataacttaaccgagcagttatcgattaaaaaacgatcagtttcaaataaattttgctaaaattttaaagtttactctaaatacttttgaactttgaccggtttattaagcaattccacgtattgaacagtgtcggtgaacttgcgagatatgtgtaatttagaatagtaataacttgtaaattattttttatatatatataaacttgtttggtatgtgcaaataaaggggggaaaaagcaagtcataactaatatcactaagttgaacgctaattggaatattacgtagactcctatgtcaacatgatatgatgttacctacgtatacatatgcttgatcaaacatgaaataagtaatgtttattatacgaataaaaaacgtaaaatataaagggagtatgcaacgaatacaacatgtctcatggccttatatgtgtgtgagacatcctaattagttataatatatcgttgaagacttgattcatatgtactagacaagtttatgcactagaataaatatttttattagtttatgtactaattgcacatgtatgatatttctgtgtaccgcacatgcaatttaattactccccataatcaagcatttttaagaatggtgaggtgttaacaaaattatagggacacataaaaaaatcttattgagttgtgtcatctctctttctcgataaattggcattcaattgccatgctatccttaaaagagccaaaagcccctgaagattgtgaggtgagttgtcattttggttgccggagaacacactcaattatcgcatcattaattaatgttaactattatagatttttaaaaaatacttgaatctttttaaaagccttttatatcacctttttttatcaaaaaaccgcagcgtttaagtcttgtactactgcatttccatgcattagcacatactatacaaggtactgtagcagcagtactcaaatctattattgatagtctttttctactactgctacaaagaaacctttttagacagccaaaagtattttttgctggtgggtgaagcaactgtctagctccaggtgtatgtgaaaaatcacaatattcacttgcgagcatcacaaccgcatgcgaaaccaattttcacaggtgttaagatgatcgactacagatttttttttccaaaaaaggaaaaaaaaaaagggggagagaacttagggaggactaacagaggtgtgtttgaaccagtaagaaaaggacctatttggagccatgtgtgttttacattttgtgctttttatactttctttttttttaatcccgtgtttcaaaagatgccctgggtgtcttcatgtcaagaagagacttcgttcctttgtcgacgccaaagaaagcaacatgcactctcatcttctttaacagcaaaggggtctaatcaaccacatttctgtgagtgagcaaaaagttttggtttgccggctggtgacaagcagtactagcacagcgactagatctgaagtgcccggccgctggaaaggcagatcgtgtactgattgtcccagctccgtcccgcggtctcgcggtagcttcacacaactttgcacaaagtcccagattcttcccatcagcgctgcctttctggtggtccgaccgtccctcactcactccctctcgcgtggttcacgttctgaaacttcccgagttctgagcttaccctgcctgatgttcgccctcccacgttcacaacgctgtatcaatttgccgatttgcccggtctgggatgtaatgccaaccaatcccccgcagttgtacgtaacttcttgtgcttctacctgtgcattttagggtgcagcacagcagcagacatgactccatgcacgtcatgcacggatgttaacggggccgttccaatgagtcatataattaattaaatattaattaatataatgttaaaaatagatgatctcaatttttatatagatcatttcacgaaatgtgccatttaacatgctaacgaaaaatgagagataattcaaaggtcatggtacattcaaacgcagccttgtttaaggttagtactttagtacgctaggataacatgcgcacgctttttttttattgagttgattaaggatgctgcagttgcaacttgcaatctgctgcggtccggtggtgtgttgcacggtggaacaaagaggaatcatcgacagtttcaaggtttcgctgtcgatcacacacctagagaaatcgcgctcagcttattccatacaaaattgaaaaaaaataaataaataatacatctatatcaccgatgactattcatattataactttggtcaataaatcgagcattttttattggaaaacgtatcctatacatacaaattttcttgtgtgcacaccatatacaccaactaaaaaatatgaaaaaaaaactctaaaaaatgtacatctacccttagtagtgttatatctatgtctaaagtcacaattcaaattcattacttatatatggggagaaaaaaattctgatagatttatactcttaaattgtaaaaagaatatttttgttatggccaaaatataattaattcgaggttaatatttaacacgtaagtgtaatcttatcttatcttatataatgaaagcagcaggctttcttacacgagaacgtgccacatcattataaatatattagccatcggatgaaggatttggataaacaatggtcattggatgaaaagggtacatgtataaacaaaccacagatgagctaaataaatggaaatttccggaggtttctggtacctcccctagacacatgataaaaaagagaggggataaagagagaagaaacatgaggtttctagtgatttctcttataaacatatagtacaacttagctaaatcaatagttggctagggaagtccatactttgtaaaataataacttattatgttaaaaccttcttataagtttacctaaactaatagaccatatagaaaagttcttaaacaaaatcaaaagtcgcacaaagcgtgactacgtggctagtattattggaagtacgtatacaatttttttctaaaatttttagtaaaatttgttagttcgtgtgcacggtgtgtacaaaaaaaattgtgtgtacattatatgctccctattttattgaccacaactatttatttttaacttctgtcattaataaaaaaaatctacaaccggtagttaagtggtggtataagacataattcagtaaataaaagtgaaagggcctgtaacctagtggttacaagagtctcagtagcacctgaggtcctaggtccaactcctaatggaagcgatttttttaggatttatttttcaggatttaacagggttacaagagcctcaattgtacaattctcaaaaaaaatataattcagtaagtaagagaggatgattggtttagatttatttttttaccagcaaagaccattataaaatactttaatctgaaaatagtaaaacatgccatatttagtaccggatcataatgagggaatgactccatcactaaggtttaaatcctgatgccgatcataaatattacataagcaaataagcttccaatataaatttaatttagtgagactaaagagttacctcaattt

SEQ ID NO: 59447 - DNA, 16500 bp, Oryza sativa
tttcgaggagtagactagtcgctggtatggtcattcgtctctaaaggctgaagcaagcgagcacttgagcttgtgctaacagaaacacttacaaaaacatatgatgagtggtaaacttctacttgcttatttttcgtgagcacgttaatcttatgaatatgttctttacaacaaattctataagaaagatgttttaaaagctaaattatattaattttcaggtttttatagctaatacttaattatatgctaataagccaccttatttttcatgttggagagtaggttccagacctttatattcgaacacaaccttagaacttattcagaagttatgactatagttgtacaaccagctactatagaaataaaacttacatttcttcaatcgcttgcagccacaacaagaggcgccaaacaaagtcttagtattagacaaacctattgtatgtatcataaaaaattataccacattactctttttaatatgaaaaatagaaaaataaatatttaacctttctattactttttaaaggcacaactaatttttaaagtggttttataatataagacatgcatttttatcataaataatattccgcacaacaaactcatgaatataaagtcatactatacaataaacttatacactaccaagtaccaacaatgtactccatgaatttctataattcttccgtacttaagggtaaaatggattttttttaaacgaacaactaaagctcaaccggcaaaatgagtacgtaacgtaaatcaaaatcaaattccaaacgtttatcagaaagtgagcaaaatataagcgcatacattggccgaaatttctaaggcattcgagaaaatttccccataaaaagggcagtatatattcatgaattcgtcgaaccctttgtggtggggtccctcaccctcggcacgtagccacacctgacgtgcaccgttaattttgtgcgcgtgagagagggcgcggtcacttgtatgtataccctcgctagtcaagagtcaagacgcgcgcccatggattcgagtaacgcctgtacgtaatcctccccggcctagtcgcgatcggtcggtccgatcgatcgagtccacggccatgagcttagcttgtcatgcacgtagcttaattaggcccggaacttccagtctccatcgatccgatctctcttgctcgcctccaaaaacacaatggcgtgttaacaatgatgacggttactccctccgtcaaaaaaagacaaatccttaatttccgtgtctaatatttaactgttcgtattatatgaaatttttttataattagtatttccattattgttgatgataaaacatgattaatactttatatgtgacttatctttttaattttttataatcttttttaaataagacgaacagtcaaacgttggatacggaaatccaaagtttgtctttttttttacgagggagtagctgtggctcgttctcgaggtggtgctgtcgcatcctttgaattaaacgcatgtgtaatcatttttttttctaatagaaaagggtaaggtgacgcatgctaatgagtttgtgccgattcttcgttagtttactcaagtagatatggtaaacaaccaaacaatagactgaaacatgcataaattgcatacaagatattgagttttacttttccatggagttgaatgccttggaaggagcaggcattttatacaagttcgtaaaatattcaaaattcgcaagaagccaaagcaccgtgtccacagcgcgcctaatgaggtaatgccaggtttgatgcatcggatatttgtaagaatgaattaaccagctgacgggacactgacgttgtacgaacccagcaaaattcaacattctgaatagtacccgaattcaattcctttccgggttcaaattctcttttgaactttgcgatgcatttatccttatccatcacacgcacacacggcacacgggtgtttatgctggtgtgcggcgaaacaccccgagtatttccctcgttttgatcattcgatcattccatggtttggttccaccatttggacagtcaacccggcaattgttggcatcaagcgcggcggatggcagcgaccgccgaccggtacaccgcccatgtgccacagcccgcccgcccgcgcgcgccagcggccagcctctcgcgaatcgatcccaaaaacacaacgtttacaaaaactattatgaactagagtggattttaataggagatatttataattgtttacacacttaaataattaaaaaacaatggtaaaattaaaattttgagaagatatattaacatatgatatatcaaattttaagttataccatttaaaaaaggtaaattaaacaataattaatgcatatttatagttaatttttttataatatgttgaagttaaatttaaatttgaatgtctgtgaagcgatttatattaatctatcttttcataaaaagtttaatattttttttgcgaggaaaagtttaataattatttaagtgtgcataccaacaacaagggatgtcggtaggatggtactatccaatagtttccctgttacgaactcctccgctttggtgactcgcgacggcgatgcgcgggcaccacaaagccgccgcggctggtggccgtggccgcgtcgctataaaatcccaccgcggcttcgtctctctctccatcagcccgtctcgctcttgctccgcgttccgcttggctttccggctttagcagagtagtgagagagagagagagagagagagagagagagaggaggaggaggaggaggaggaggggattgtgacttgtgatctgcgaggatgcaggtgcaggggttctttgacaggttgacggggaggaacaaggaggcgtggaaggaagggaggatccgtgggacggcggtgctggtgaagaaggacgtgctcggcctcggcgacttccacgcctccctcctcgacggcgtccacaacatcctcggccacaaggagggcgtcgccttccgcctcgtcagcgccaccgcccgcgacccaagtaagcaccgccgccgccgccgccgctcgccggccaaagcaaaacgctcatcgtgcgtgcgtttcgtttcgtgtttttttttttttggtgtgtgcgtgtttccgctccaaagcttttgcctcggcgtgattggttggttggttgattcgtttcctgaacaggagaaacagccgcgttttctctggctggggtttccgtttaattgctctcgctaatagcttaattacaaaccggtatttgcagtcttcaagcgttgtttgcaagcttttcctcggaaaaaaagcgtatagtagtagtacaaatttgaagtgtgcggtttggttgttgtcacgcattcaatgctacttccgtagagaagaaaggaagggaacattaattagtggagtgatgggaggaggcagcattgacggtcaacgtcaacacacgtcccttaacccctcaacaatctacaatcaaatgtgattaaatgtgattaaatcaaatcaagaaaaggacacccaattccattgatcgtcctgtcgatttgtcccccacttcatcgatggatctgttttttcaaaattttctttctatctctttccaattttttgtctaatttttgtggatggacaggcaatggagggagggggaagctggggaagccggcgcacctggaggagctggtggtgacgatgaagtcgacggcggcgggggagtcggtgttccgggtggcgttcgagtgggacgagtcgcaggggatccccggcgccgtcgtcgtcaccaactccaaccggtccgagttcttcctcaagacgctcaccctcgacggcgtccccggcaagggcaccgtcgtcttcgtcgccaactcgtggatctaccccgccgacaactaccagtacgagcgcgtcttcttcgccaacgatgtgagtccactcctagtcctcctcttggtcaacggtcatcttagttacagtagaagcctagtagtactactccattttcatttccagatggacattgccaatgccactgctcttctgcagtgttgctcaaagaccatagttaattcttgctaatgagcagtaccgctacatcttaagctaaagaaagatgagaacttgcttaagagccttgagctaaaccgctgacattaactatataagccttgagctcccttgctattaggaatattgaaatcaacatgcaaattctagtggtctaatcaatacgagaacatagttgtttgtgccaaagtttgcaattgatgaactatgtacggttcagtagtttggttgcagtaaggaattttcgttcaggtgggggtctttcagccgaccatgaatgcatgatgataatggatgatacttagaaaaattcaaggcaaagttttcataattgcactgaacgagggtttctgatcggatggtccatgccaagtaatcttggacacgtcacttagaaaattgattactgcagacgatggtacaataattgatgaccactttctgcagacaatatgatggctgcagagtgcagatactaatagaaacatcaggaacagtatgaatcttggacatatgacatcttacatgtgcatgaaaatatgtaaatgcctctacagtgactggagataggcggctatcaccaactcatggatttagatatcgcaatgcctttagaaatccttgaaaagctaaacaaacctatgccatttttttgtcataacatatatttatggattatatattggatcatggtcaactttcgtttttgaagtgtttgttggattaggtaccgtgatagctgtacctagatccaaatagcatatgcatatccaccttgtctcctggaaataactgtgatctagaatttgatcgtatcttttcttaatttactacacctatagattaatagatagcatccttgtccagtctgtcagcaggttaggagtatagaagctgacttgacttccactatgatctacaacagggaaagaaagttggatagaacagctgataagttgagttactagcagtttttgagcttggtgctgcagtctagtcaaccgtccaactgtccatagtgatgtccgggattcagggcttcccacaataaacatatagtggaaataacatcctgtactctacaattggctgtataaaaatgaagttgttctttttcaagttatggcatcgacaactactcgtaactcatgaatggtacatgctagtctttattattaaaatgatcctacattcctactgtcaaatcatgcaagacatcacatagctagaaaattacacctgctgagttccattttgaaaatgacagtccttttactagccactttttgtttgattcttcaaaatgattgaatgcgtcttgtgctacttgtcctagacaacaccaaactgaatgcccacagacacaaagccaccaaccgctcgttcgtccctattagcgacctggtcttacaagcaaacaaaagaatagtttagcttggtcaccactcacctgtgtgctgtttaattaagcttttgtttatgtatcatgcatggcatatgcaatcgcttgatctacaactagttgatagaaataaaaaaattgaatgcttttcttttgtttatgaaaaaaaaaaacaagtaatagctgcctcgctgacaatcaaatggaggtcattgatactgcctgtattttctttcagttttaaagcatgagtagtaatataaattcactttctaattgattaattatagtaatataaattcactttccaattgattaattaatactcctgctattagggttttcacctgtcagcttatcttcttgatgagtgactgaaactgctcattctatttactaagtttatctgttgccttattttcttgctgttttgcagacatatctgcctagcaaaatgcctgcacctttgatcccttaccggcaagaagaactcaacattctacgaggggacggtaaaattggaccatacaaggagcatgaccgtatctaccgttatgattactataacgaccttggccaaccagacaaaggcagtaaactagtacgaccagtcctcggtggcagccaagaactcccctatccccgtcgaggcagaactggccgggccccaacaaagactggtgagttatagatatcatgcattttcttcaatttgaatttatggcaccttgcaactggttccctcaaattcttttcttgctcaatattttctcagacccaaatacagaaagcaggcttcctctgctggacttgaacatttatgtcccacgcgacgaacggttcgggcacctcaagatgtcagacttccttgggtactctcttaaggctattgttgagggtgttctcccaataataaggacctatgtcgatacgacaccaaaggagtttgattcttttcaagacatcatggaactctatgaaggtggattgaaagtggccaatgcctctgcactagcagagatcaagaagagagttccctttgaacttattaagagtcttttgccagttgctggcgatcaagtcttgaagttacccctaccacatgttatcaaaggtaaccagctttctgcatgagcataactctgtatggttataccttattgggtaatttgattctgttcatatttggtattatcacaacttattgtttatgatgtttcagaggacaaatttgcttggaggactgatgaggagtttgcacgagaaatgctcgcaggagttaacccagtgatgatcaagcgtctgacggttagtaacttcatcgttgtaggatatgcaagtatgtgcatctgtgctcgcataatggagtgagtaatcttttttttgttctccaactgatcatagaatttcccggcaaaaagtactctggatccaaatgtgtacggtgaccataccagcaagatcaccgaagctcacattaagcacaacatggagggcctcacggtgcaaaatgtatgctgaatcactgacatacaaagcgaaacatttcagctctaaacatgcatgctatatctttgaaatgcaaataactcgtatatgactatactagaactgcatacactcaggagattgaccaataagtaaccatgctatgcaggcactgaagggcaacaggcttttcatcctagaccaccacgatcacttcatgccgttcctggacaagatcaacaagttggacggtaacttcatatatgcgagcaggaccattctgctcctgaaggacgatggcaccctgaagcccctggcgatcgagctgagcctgccgcaccccgatggccagcagcacggcgccgtcagcaaggtgtacactccagccaacaccggcgtcgagagccaaatctggcagctcgccaaggcttacgcctccgtcaacgactctgcttggcaccagctgatcagccactggtacagagccagcctcctctgtttcgttttctgtgttggagtatgaaaaggaggctcatgatgtttttgcatgttgctgctgcaggctgaacactcacgccgtgatcgagccgttcgtgatcgcgacgaaccggcagctcagcgtggtgcaccccgtgcacaagctgctgagcccgcactaccgcgacacgatgaacatcaacgctctggcacggcagacactcatcaacgccgatggcatcttcgagaagaccgtcttcccaggcaagtacgcgctcgagatgtcctccgtcgtgtacaagaactggaagttcaccgagcaggctctccccgtcgatctcgtcaagaggtaaaaccaaaatgaatgacatcttgcaaagctctggctgatcagaacacggcaagaacaacgatgtgaccaggatgggttttgcttttgtgtgtgcagaggggtggccgtgccggacccgacgagcccgtacaacgtccggctgctgatcaaggactacccgtacgccgtggacgggctggtgatctggtgggcgatcgagcggtgggtgggcgagtacctggccatctactaccccaacgacggcgtgctccgcggcgacgaggagctgcaggcgtggtggaaggaggtgcgcgaggtcggccatggcgacctcaaggaccaggactggtggcccaagatggacaccgtccaggagctcacccgggcgtgcaccatcatcatctggatcgcgtcggcgctgcacgcggcggtcaacttcggccagtacccgtacgcggggttcctcccgaaccggccgacggtgagccggcggccgatgccggagccgggcaccgaggagtacgcgaagctggagcgcggcggtgacgaggccgacctggtgttcatccacacaatcaccagccagttccagaccatcctcggcatctcgctcatcgagatcctgtccaagcactcctccgacgaggtctacctcggccaacgcgacacgccggagtggacgtcggacgccaaggcgctggacgcgttcaagaggttcggcagccggctggtggatatcgagaaccggatcaaggacatgaacggcaactcggcgctcaagaaccggaacgggccggtgaagatgccgtacatgctgctgtaccccaacacgtcggatgtcaccaaggagaagggccaagggctcaccgccatgggcatccccaacagcatctccatctgagtctcgcgtgcattctttagatcgatatacgtgtgctattgctagtgttgcgcgtttgccgtcgtcgatttgtttcattgtttgtatcagtgtgcattaccgtgattcttcgtagttcagggtctcagggataagtcgttgcaaatgtgagtaaccttgaggcatggataatttcattaggaattattcacatggaataatgaaagttaataaaatcattttgctttcagagtttgtttcaacttttatgatccatatattcccaaatagcgaaacaacgtcgttttagaatgcacaattgagcttttttatcattcttgagggtgagaggtaccaaaatcccatccattcattgagccagatccaagggttgacaagatttagtatcaggaggtacaagtttcatgtgcgcacggtacctcctcgcagtccgcatgcaatacttgagcggaagggaaaaattgtattttagcattcacattcgttcattctagtggataggagcgtctgcgtctccagcggtccagcccaaacaagcaaagcaaccttctcaatcccgacctcggcgggagtgacgacgacgtcaggtcggcctccttcctacacggtggctgcgtggagctggatcgattactgcggttgcgtagtgtgaaggctggttgattactgccgcggcgcctttccgcatctcagtggtccaatgcagcgcttgccactgcatccaacaagaggagagcggcgaggaacggcgcggcatggcgttgaaggggaggaagctaggacgcatagcgcagccggccagagcaaggaaggggagagatttgtggcagctgcggtgcagatagagattagcagccgagcaggttgcaagtcgccggtgcgacaaggtgatgggagaagagacacggacctatgctgtggataagagttctctctctctctctctcgttttttcatctggtccatcctcaccctgctaaatgaacgattggatttgatccagtacctcccattactagtacctcaaggtactatttcaagggtggtaaaaaagctctactaaatttgtcacaaaagatactttcacgcggctatatattcaatattgaaaatcaatcttctcttctaccttacctctatcctagtccaacagtaaattgtccttgattaatgggaaattttcagatgggggaaactcttatcttgacaacgagatacttaatgacagaccatctcatcttcccccgtctactccctccagtcgttcccctcctgtgctccccttcttcttctccctccttagccatagatacttagatactctctccgtttcacaatgtaagtcattctaacatttcccacattcatgttgatgttaatgaatctagacatatatatctatatagattattaacatcaatatgaatgtggtaaatgctagaatgacttacattgtgaaacggataaagtatttgatactccctccgtactcgtaaaggaagtcgtttaggacaatgtttaagtcaaaccttgggaatataaatcatgaataactctcaagttgtttagtttgaaaatgtaaaaattatatgaatagatttgtcttgaaaaatactttcataaaagtatacatatatcacttttcaatgaatatttttatataaataagaagtcaaagttgtgttttggagaccgtgtcgatatcctaaacgacttcctttatgagtatggagggagtatgtgaataggcatggtggtaatgggacatgccaccagcattaaatctaaaggcctaaagtctgagcgcacatggtggtaatgggacatgccaccagcattaaacctaaaggcctaaagtctaagcgcacattgatgacaaggacgatgaacgtcactggacccatggcctcctcaactccccgtcctccgtctcatgcttaaggcatgacgatgtgcaccggatttgactctcatgcagaaaagaggcaaacaaggagaattgataccgaccggcacgaattcctcctcccataaattgtcattggtgatggaaaaggagaccatgaggctgctatatatggagctttgattggcacctaacatggtgaagcgatcatgtttctcacccaccttatgtgtaggtacgtcatatgacacatcatctggttagtacccataggtaacaactagtgttgttgcttataacaccgtgtcctagcacctagccatcaacatcgatattgaccgttgccacgatctcctcctagtgatgttatcgtgcttcattgttgacgggtggctttgctcaggggcgtccttaggcccatgcgggctgtgcgaccgaacagggcccccaaatttcaagggccctaaaatattaagtatacccaatatataataatattaaatgcttcaattttagtaaaactaagcccccaaaacaatgcaaaaggtgaatgatccattttccaatttccatcgtacagtcgtccgtgtcgtcgaagtcccaacgccacgtcgcttcgtctcctctcctcagttactaggccactaggatccattttaatatttcgcacggggacccaatttgtccgggatgcccctggctttgctcatgacaaagacacgagtgtgtgtcgtgggcgtgggatgctgccaaactcacgaggaggaggcaccataatcctgcgacctagcatgggctgctgccgactgattttctcgtgtcgtctcgtctgcaagctcatcctggtgggagcacagcacagcagagagctagacgaactcacaaccccaggtgaacgtggtcaagttgctcaacatacacgtgcaaagctactttagctcctagaggttttgcatgggtttaagggtgcctctcctacgcacgacgacgacgaaaacaggaaagggtgggtgggcacgcttttgcagctgaactccccgagatagagcggtttgatggaacccgagagacaaaggagacaacggcgtgtgtttggttaattcggcagcatcttcggcacgggaccaggcgtagtatcgcgtatatgccctcgtctcgactccgccgtaatctgattcggccgcggtcttcttctggagaatattatgcttgctcattttatgctgtgtttagttggtgaaaagaaaatttttaagtgtcacattaaacttttgattggatgttaaaatgagttctcagacacgattaaaaaactaatttcataacttggttggaaaccgcgagatgaatttattaagtctaattaatctttcattagcacatatatgttactgtagcacttatgattaatcatggattaattaaactcaaaatattcgtatcgcgattttcatacaaactgtataattaattttttttaatttatatttaatgcttatatatgtgtctaaaatttgatgggaattttttgagaaaaaagtttagggaactaaggtgtccctcctttccaaacaccacctaaacaggcctttacaatctacaaaaaaggcacgggcatagcacgagctttgcccttttttctcgcgctcgcacatcctctctttccacagttccactaaaaaaatccacttcacctagcagccgctctcacctccacgcgctctccgccaccggagcacgagcgcgactgccaccacctccaccggattcatctccgcctcttgccgcggcaaagcccccccagcttggattcctctgtttttttttcctttttgcgtacgaatctcttgtatatccctctcctgtatgttgcgagaaatcaatctagtccgaatggtgtgctcctgcgtgctggagtagtctaggtataccagttttgttctccaaagcatttgggattgggttgaatggaacatctatggtccacgctaggtccgcccctggctgtgatggatggagcttagagcaggggcaacctagatcaggggtgtctccctggggggttttcatggtgctgtggatgttcactagctttggagggtttgattagggcctcttgggtcataacaggagggttttaagggacctggatttggtaaagcatttttcaggcatgtgatgcttcttggggaggatttcatggtgttgtggatgttcaccagctttggagggtttgattagggctgcttgggtcacaacaggagggctttagggatctgaatttggtagtcatttcaggcatgtgatgcttcttggggaggatttcatggtgttgtggatggatgtcccccaggtttggatggttagacttcttcgatcaccacaagagctttgaagagacctgagtggataagcatttgatccttcttggaggtgtttcatggtgttctagatgttcaccagcttcggagggtttgattagactgcttgagttaacagtgttcaagggactgaatttgataagcatgtcgggcatttgatccagtggtgtggattcgtatccatcttttgttgttataagatttgctgccacaaaaaatggaaggtgtgcacggtatagaatctctggctactggagatggttggcatcatctttcccgtacccttggaccggtgctcctgatctcgatggggtatattgaccttgggaagtgggtggaaacgatagatgccgggtctcggtttggctatgatctcgtaatactggtgttgcttttcaacttgtcggccattctgtgccagtatctgtcgatgtgtatcggcatggtcactgggaaaaatcttgcggaggtaccactttgctgacatctgtcgtcacctactcacatttcttcagtttagctcaatgaatggctgtacctttttttcctaagtggaagtatttagtgttactcagatagcatcaaccacataaaaaatagtgggggagttcttcaatttttcctcctttttttttctttaggggggtggctgatatttcatattcgtcatctatcattttcttcgagagctgttaacttttgtaacaatattacatgaacggaagatttgccgcgaggagtacagtccatcaatatgtgtcatccttggtattcaggcaggattgtccttgctaaccgcggaactaaccatggtatgttcatacactttagacaagctttcctctctcttttttttttttgttaattctttgttctagagttaatttaccaatgttatgcatagttgacctataggagcattcactaccagagaattcaggtttttgccagctttcaaacttttaatacttggttatttcagctttcaggcatatcagtcggattcaacctggtctttgaatatgatgatcctatcgcaggcttatattttgctagtgttgtggtcaatttgctaccttacactatgtcttatctggtaagcttatgattgatctcagaatatctgcagttctgcaccactaagagcaactctaagacgttatgcctttactttattatagggcaaacggatggctgggacattgaatgcatgcgtagcaggctttgcacttctttgttttgtgcttggtttattagtcagtcaaccaaaaattccagttgatatgaatgcaatgttccccaagttgagtggtgaaagtgcttattccttgatggcgcttcttggcggaaatgtaatagcgcacaatttttatgttcattcatcagttgtacaggcaagctccatttccttatgctgatgcttaagtaaatgctgagatagtggcttttgttgaacttgtactccacccataagttatatatatgagtaaatacttctttaacttgtataactattctgatcagtccatgaattctgaggacagttcattacttgccaatttttggaaaaatggtagaacctattttgtccctcattttttaaaaaaatttcccacacttggcattatagtttaaggttgggctgttcaatccaggttttgaatggactgttcaaaaccgggcaatgtcaatcttgctggccatgaagctaatcacataactgagcctgctgatttctggtttgcacaggttgacttgaccccaggctgtagtttaaagtaaccggttttcctaagttgtgttttctaatacatgattggtattagttttgaaatctgcaaggaagctaattctggttcatgctaagccatgcaagcataatcctgcaactttgtggtgtgataatagaaactggtgtgtgggttggcaaaccagaatcatgcatcctatgctaagatgtgcaagcataatcctgcaactttgtagtacattctttccatattaagaaaagagtaagaaaaatatgcatagattgatccaaatgcttgatttgttcttttgctcatgaaaaatttcttgcaattttctctaagcaatgatgatcactaaacctgcattttaaatttatatgccttttctacaatcaactaatagaaagtcaggggatccaatacagttttttgtttctgaagcttaaacttgtcataaaacgtgtaagtcggttctactgtacctttgacatttgtgctctccgtgccatgcagttttcgtaaacccacaccattttccttttttattttttaccttttgttctatctgctatgccatgtttttgttaattcagaaatcatttgtgcagggccaaagacaatctacaactctttcccttggtgctctgttccacgatcacctgttctcaatattgtttattttcactggggttttccttgtgaattatgtcctgatgggctcagcagcagttgaatccaataatactctggttacttttcaagattctgtagatttaatgaaccaggtttttgcctccagtttgcattctgcttgttttgagtatgaattctgcaccatagttccttcatgagttcctctgaatgccttctgcagatgttcatgaatccgatggcaccaattgtttttttagtgatccttatcttttcgagtcatgtcatctcattgacatctattattggcagccacgcaattttgaagaatttctttggtgtaaacttgcctcattctgctcatcatctgctactaaaggccgttgccatggttcctactatgtactatgcaaaggttgcaggttctgaagggatatatcagttactcattatctgcccagttatccaagctatgttccttccttcatctgttattcctgttttccgtgtttcctcatcaagagttataatgagcagatataaaatatctttgtacgttgaaatattggccatcctagcatttcttcttttgctgttcacaaatatcatttttgctgcggaaatcctgtttggtgatagtacctggacaaacaacttgaaagggaacactggaagccctgttgtacttccgcatgccattgtagttctaatttcttgtgcatcaattacttttacgctgttcctggctgtcactccactgaagtcagcaagtaatgaacctgaaactcaggagctatctgagcactctcagagagaagatccagatactacttatcaaagagaagcaagtaatgaacctgaaactcaggagctatctgagcactctcagagagaagatccagatactacttatcaaatagaagtaagtaatgaacgtgaaactcagcagctatctgagcactctcagatagaagatccagatactttttatcatagagaggagctttctctggttgaacagaaagaagatcatacgacttctactattaatgctattcccaggattcatcagaaagttatcaaacatcagctttggagcatactgactttcctgacatcact

SEQ ID NO: 59448 - DNA, 3298 bp, Oryza sativa
cttgcagccactgcaaaggaatgataacagggatgccaattgcatgagcctactgcccaagtgtggagatgattgtgtttggcaggcccccctgattgtcagttttggtgtttggtgcatccgccagattctgaacctgtgccttgtcgaaagtaggccagaactttgggcaagtatacatatgttcttaatcgtctccaggtatttttttttctattgctgtctattttgggcaaactgcaatatggagggtaacccagggatgcagatcatcaatggttgcttcctgcatgtagcatacatactatataggctattttggcattgttgtgaattatgcttcctacatatagcatacaaactagtactatataggctattttggtattgttgtggattacgataatctttattcgtatgatggctttaagatatttcggttttttattacctgtttttgcctaaatcaaattgacaaagatatatttcagtaaaaaagagagagagattgatttcccaataatagtagaagtggatggatatgggagaacggcaacagcttgataaccaaatttgacactctctctgatttttcaatggattgtgaaaatactccatatagcaatcctattttccataggaactttaaaaataagcactgtcagcacacataacaactgcaaactaaccatatacttgctatggtggctgggaatatttcgtgatgtatgaaagtatgaaacactgcaatagatggcattcatttatataaatttaaaatatagttgtttgcagagaactttgttttgtatgactactatcattttcttcgcctgtagatgaatcctgcaacttgtaagtgcattttgtcctactctgtgcttttaaccataagataaaccttaatcagaaatcccaactactgatttccttcagaagtgcataaaaacttgtgagtgggttcggttgcattgagaaattgacttctaatgcgacttgcatgcagcagaactgcccaaacttctgccacactgtttggacttcaagtttgctaattttctttttcatttacttgctagggaatacttgatcctgcattttccaagcctcagaaacccatgaaaggatgcgtatgccttcaaaaagttgccaagcccatctctggtactttcaccactgctggtatgatcttggagatgattaaagacgtggaacaagccatttctagccgcaagggccgaagcggcacagcagcaggagacgttgcttttcccaaagggaaggagaacctagcttctgtccttaagcgatacaagcgtaggctctcgaacaagacatctgcaggacaatagcgtggcagcgagctttcttttgtttcttgtttgtatagggttcttggggctgctccacaaagttctgtttttttgtgctcctcaaaccttgggttttttcgatgcacacgatctccagagtgcctgagagcttcttgatctttggtcatttttgcacatgttgtttatgaagtggccaagggtgaatggtataccttgtttattcatcttatcagcgagatctcaacagtagatgatatttgctggagcagcaacattgtaaagttctttttccagatgaacattctgaagtccgctggcttggctttctgaaatctccactagactcgttgttcctttcggctttcgctgttaggttgttactgagaattttctgttggtcagctaagcttgagttctggtccttctggactagacacagtggcacacgatgcagcggatacccatgtgcacggcttatgtccacttgtctgatgttaatttttcatcgtgcttgcttgttactgtagttgttactgccttactggtatcatccaggagtcatattttcgttgtttgcatctctataaccttttccagggaaatgcattgttgcagtctttctgaacatatacttgatgaattcttgagtttccatgtactacgatttattgactgtaattggatggatcctgatcagctaggaaaagctcaggatcagcagagagtacagtggacggttcactgtacagtacacacgatctatctcgctttcgacaggcaggattggtcagggtccataaaattcaggcttctgtgcagctgagctatagtgtcttggacaagggcccccacatttgcatcattgcacgtgccacaatcaatacccccaggctttgctaaagatgctttcaaggatgcaccaacttgggggcgaagatacacggtcatgtacgctggcgatttttgcacgtcgcacgcaccgaccggtagaagatgcaaggataggaccaaagatcatcggaattgtgaaccgttgttgcaacttttctgaattacccggtaaaggttgtaaaaaaaagctacttttgattatgtttccacaaatacaaattgtattttgtgtacaactattgcttatgctttcataattacagttttatattttatacgcgactatatttattaatcttcaccattataacctagatccatagtgatggaacattttttttctttaattaatatggttttttctcacataatataataaatagaccgtcgcaccaaataaatatactttttatgtgaattgagtgtagcttaaccggttaaacttctagttctacccttgacacatgtatttatatttacggttaattattcattcaatgatagataacatacccgtcagtagtgagccgtctatggcgactttgtgaatcttaaaatatatcggtacaatcttcgaaattgctcatagggatagggtgcgtatgtacactttcacaaggatgagctgcgcgtatatgggtgtttgcatctgtactgtgttttttttaaaaaaaaacttttaatcaagggttaattagatccatgccactgcaaatgtggcaaatcaaaaaaatgccacacatattcgcattatcggctggatgccacttcaaatttttaaaattgaaaccatgccactcccgtccctttttatgtctcctctcaaacgccgtccccgtttccgtctccctcttcgttctcccttcttctgcccggcgtcgagcacggcaaggtcggcggcggcggcacagcaaggacggtggcggcggtgcccgtccatctcgcctctctcccgctgtccatcttctcctccctcccgccgtccatctccatcaccgcgctcccggcgctcctggaggtgtccctcgacgacctcccccccgacgcgtatcctcaccgtcatccgccacgcg

SEQ ID NO: 59449 - DNA, 2560 bp, Oryza sativa
gttgcccctgccgtcgtcatcaatgaaggaggcggcgcaaggtcgtcatcaacgaaggaggccaccgccatccttgctgtgccgccgtgttcgacgccgggcggaagaagggagaacgaagagggagacggaaacagggacgacgtttgagaggagacagaaaaagagacgtgagtgccatggtttcaattttaaaaatttgcagtggcatccagccgataaagcgaatatgtgtggcatttttttatttgccacatttgcagtggcatggatccaattaaccctttaatcaatgactaattagaaaacagtatccccatctataatatataataggactaggatacaacttgtatcctctgagtgtatacttagttgacacctaatatttggtaaccatatatatcattttaaaaagaagaattatagtgtttgctctaccacccttgatcacatctaggcgatgatgctctatagggatgatttcaagggcggatccaaaaaatgtatagagggagggtttatctcctttctcctccaatccccctgctcttccttctctccctcttcttccccctcccacccccctttcttaatggtgatccagcgggatagagggacttgagtcctccagcacccacgttggatctgttcctgggtagtgttttgtccgtcaccaaacattgctacattacagttttaacatatcacagtgtgttagctatatgtttgctttattgtcacacttatgacattgcaactcgatttttaggctagttgtgccacacagaacgtacttttatgtttttttttcacagtttatctaatttcagttgtggcaagacgccaaccaaacatccaagaagaattcaccacgtttgtgcggacatcaggcacggcgtcctgaaaggacggcctgaattgttcatcaccgggaggcaaggacgatgatgcggcttgctggtaggcattggttgtgtgcccctgctgttgcctgttactcctcatagcctgtcggtactattgcactgggcactggctgctagtctgctacagtgcggcacgatctcctccccgatcttagctacagtaattacccatgaaacattgatatctcgtacaagtctgccccaaaacagccggttcatcattatgggtgccttttctgtccatccatgtttagaagagtcctgcatatgaatcaatatcatcccacttccaaaaacaaacacatgttttatagttattttatatatttaagagcggagtgtatattcggtcctaagcttgtatgggtgtatcatcgagacccctaaacattttcaagtttctatattgatcttcgacatcatataggtccaaacatgttccaatttgctttgtacattgacatggcatgcaacaatattttctacgtattagtgtgacccacgtaacattcatataggaaaaaaaacatattttcttctctctaccttaaaatttttaaaaatgattttttattttctttgtcttttctcctctctatctaacatgagaaaatatgtttttaaattttatttttattttagtgggtcctactaatacgtaggcgccaccgtggcatgtcatgtcaacactaaggatatgtttggtagcaagttttcccaactcatctttctcgtgttccgcgcgtacgcttttcaaactgctaaacagtacattttttacaaaaagtttttatacgaaagttgcttagaaaaactacattgatccatttttgaagaaaaaatagctaatacttaattaatcgtgtgttaatggaccgctccgttttccgtgcacagaatacttgttcccaactaatcctaatgaacacagcctaagagcgggttgatgcccgtttagatctatatggcactaagacaaattcaaagacacgaacatgtgttttgagaatttgagaatttagggttctagataacacacctgtacaaatttagagcccgcaagtgtacttaactaaaatatatacactcttgttcatatcaatatatctattaattattttattataattataaagacaactcgaaaaggaaacaacgtatttgctatgaaggcttgaaaattaccatattaatcgaaaaaaatctaagccatcattagatcgtagcgagacataagtagacactattataactacataaaaacaaaagaaaaaaaatgaacattaaatttaatcatactttcaatatctaattatacttttatatgtaagagttgcataacaaattcaattcaataaatttgtgcgccgcagtttttatttaagtttcgctcacgattaggcggaccagcgagggcgtgaaaagctacgagaaggaaaaaaaaaagagctactagtagtactaataaatcaaagagatgatggcataattaagcagcgtgagctgtgacgtgagctgctctgaatctctgattttatcataaaccacaatcccgggcccacccgtcatggaccatcaaataaccgatctccctggcccatgggccccgccctcccagcacggcacaaccc

SEQ ID NO: 59450 - DNA, 2300 bp, Oryza sativa
tgcgccgcctcatctccccggggtcgcaggcgttcgtctacccggggctctcccccgccacgcagtcctcgctccgcgcgctcctcctctccgcggcgtccgcgacggggctctccaagtccatctcgaagaagctctccgacgccgtcgccgagctcgcgtccttcctgctgccgtccaacgcgtggcccgacctcctcaccttcctctacaagtccatcgcctccccatcctcgcctccggcgctgcaggagtcggcgctcaacatcctagcccggctggcctcccatctcgccgcgggcttccccaacctccacgccctcctcctctccgcgctctcgcacccgtcgtccgcagatgtccgcgtcgcggggctcaacgccgctatcagcctcatacagtctctcccctctgccgccgaccgtgaccagtttcaggatctcctcccagccatgatgcgcgccctcgctgaatcgctcaactgtgggaacgagggctctgcacaggaggcgcttgagatgatgatcgagcttgcaggtgcagaaccacggtttctccgccgccagctgcctgacgtggttggttctatgttgcaaattgctgaagcccctggattagaggatggtacgcgacaccttgctgtcgagtttgttgttacccttgctgaggcaagggagcgcgcgcccgggatgatgagaaagctgccacggtatgtgggccggctatttgcggtgctcatgacaatgctgctcgatgtccaggatgaacctgcgtggcatgcagcggtgtcggaagaagaggatgctggggagactgggagctatgttttcgcacaggaatgtcttgatcggcttgcgattgctgttggtgggaatacgattttacctgtggcagctgagttgctcccatcattttttgcttctgaagagtggaagagacgacatgcggcactggttacgatagcgcagattgcagagggctgtgctagagtaatgattaagaatctggagcaggtagttggtatggtgctgaattccttccgggatccttatcctcgggtgagatgggcagctatcaatgcaattgggcagctttcgacggacctggggcctgagttgcaaaataaactgcaccatgttgtcctgcctgcattggcttcatccatggatgatttccagaacccgcgcgtacaggcaagttattattgaggatttacacttaagtcatctgctgcacttctttcaatattcgttatcgtattttatagtgtaaactataaagcattggtggccctgtaacccacaagtatcaggctcagaggaacttggaagttaaaaagatattatcttgacatatatgcattctaaggaatgagtagaaattgctggaaactaaaaattatatttaaagagaagttcgtagactgattaaggtctaatgctcaaagctgtcgtacttttaatagaatagtacatggaaattttctcaattatattacatatgtatcagtaaggaatgggtctatttaacccctcaactatcgtgttggtctaatttcaactctccagttatgcaagtatgcaaccttgtaaaacacaattcttgaatatcaatacccaacaatctacaaccctcaacctcaccctagttgtttgatgtttgaagtaccatacaatgtgagtgattatgctagcctatgtgcacaggttattgtcgtgatcaagtttcatgatgcaatgatttagagaggtttgatgagactgctattaatgcctaaattgtttgtagtgtgtcctcatctgagatcacaactggttacacgtttttttagttagtggccattagtttgtgccacttgctttttctttgacatatacttacaattgacttgtcattaatacccatcaagttatcagctagacatgctctaatcattgttttatattccgaatgagttcaggcacacgcagcttctgcgattctaaacttcagcgaaaactgcaggcctgatattttgacaccatacttggatgggatagttgggaaactactgtcattgcttcaggtaatccttgcatttgatcatggagccttcattttgtgcagcataaacatgaaccttttcggaaattttgtttgttttctgatagactggaaaccaaatggtgcaagaaggtgctttaactgctttagcatcagctgcagattcttctcaggtacaagaggaaatatttttgaaggttttcgggccagcattcttgctcaaagttttgcatcttattgtttcaggaacacttcca

SEQ ID NO: 59451 - DNA, 724 bp, Oryza sativa
tacaagagctggaactatgtaatcagacagttgcttaagataagattcatcccgaccttgcgatggctcttctctattgccaacttcgctgaacgtagaagctcaggcattgctagggagataacacaatgtcactttgagaaaaatgctaaaaataatggagaatacactgaaaagggtagttgcagacctgaaacggctgccttcctaacttcttcatgaaaatagaatttgaggagaggaaccagagtagttgcaacctgtacagattcaaggttcagctggagctcttcacataggcgcgtgcgtgtacacatagagttcacaaaaaatcgtaacataacctgatcaatccatgggaaaaacccttccttgagctcatcagcataacaacatagcatattacatgccgttgctttttcctccagcagactggttcggatgccaattctcttgtctcctagcgtaatagtctcaacactgcattttatgcaggcagccaggtaaaacacaaaattttacagatatcataagatcatagaatcagacaacaacaggatatcaacattcaaattaaatgctctgttatggatctgacaaatacatgcaatttgaaacagggcaacaaactaatatcatgcctacaatgataacaattcatcaatttcaatattctatcatgggaatgtgacaacattatggtaagttgccagcgtaacaaaaa

SEQ ID NO: 59452 - DNA, 21935 bp, Oryza sativa
ggcatctaaattttggtagagtagagagacaagccaacccttgataacagtataagaataggaaatatcaccaaaacataaaactcagtagtatctaacttcagacagctgctatttcgtcctgaatcaaatatacaaatgtaattcctttgttgtcaaatacatgaagcctgtttcgcgcctgaatactttaccaaaagccaaaaaaaaaaactaccacagatactatggaaatttttattaagcacggattagctaacagaccttaatagttgtcatagatgtcactgcacctccaggtttttgtattgacactatctggtctgaagaatcgagaacaatagtcacagaagtctctattattgattcttcttcagcagttggatccgctagaacattatccttgtgaagtgcacatgtaagggaaaatggaacattagtaatcgtaagcttcctcttttctctgtttaccaattcatatttggctttgccttcattgcccccaacagtaaatactctaccatcatcaccgacagataccaaaggaatttccactgcaaatataacatagtattagtaatgaaaattaactaaagcaccttgagatgttaacatgaagaaaatggaacagaccaagaacttcagatgcacaaactttctataaaatggaaaatgaacaggcatagagcagcgagttttgaccagataatacttccatgtcaaatctaacaggacttgccttgccatctgaagttttttgttgaatttcaagaatcataaatgaccaggaaataatcagtaatatcctgtacataaaaatctctttgtacctacaatgttttcatctttttttttcaccaatgcagggttggttatgataacaggatcacatatagcctcactccacactccgcccagagctcataaggtcaaaacaaaacacaccttccattactctatttaggcaagcttctcacgcacataaaccaccaaacataagaaaaaggtttgtgagacagccacatgaaaccatattaaatgaaagaccacttaacatcttcattcacgacatcgactccaacattacaatctttcaaatgatacaaaacagaatgtggatcaagttaccccaatcttgatgagtcccgtttctcaatgtttactttaggggagaattttccattgaaaattttccccgtcaacaaactttacaaatctaagaagtatggcaagtaatactccctctattttatttagcatataagaaatcatacgagtttgcataagattaaataagtctataaaaccaacagaaaatgccatgatatgataaatgaggaaaaactatacgccatgtaaaatgaaatagacgagggcatatatttatggctattaactagttttatatatacataaaaaacttgcggtcttcctgaagtttcactaggtagaatagaaaaatcaacaatatttacatgttaaactactctattttatatggttctcatctaataatctcaaaatgtgctatgaactgtctcataaaccaatgcgtacaatatttagatgattagcaataaaaaattaaactaactatggatgtttaacactcagtcacatgcaccaaccagttcaaccaaaagcttaagctgatggagaaggatggacaattcacttatcctttaacactcctcgtcaatctaggatccctcctacctcacacttacaaggcttgccagcgttttatttaaacagtgcctgacaagatttgaactcaagacctcttggtagtgatacaaaattgaattgcatgcaccagaaagttcacccaaaagcttaactaatggagaagaataggcaattccatgagtttgtagttatcaaaaagagtatttaatgggggcactaaatctgtaatttgattcatactgactgaataaagcactaactgctagcacatattacaatagcatatttacatttcaaaatgaagagtaattaagtagtgaaaaatgtcaaatcaagataagctatcagaaataaggaacgtacaatgtgtaaatgcagcaacagctgagattagtgcagcgtcgaatagagacccatcagcattcaaacaatagacatcctgtaaagttgagatgtcaagaaaacaacagaagtataaaacacatactttttgcaaacttgtttttggacgggcattgcctgaacttatttttatgccattgtttgttcctttacaagagctgtggttgtataaaacacaaatactttttgcaaacttgtttttggacgagcactgcctgaacttatttttatgccattgtttgttcctttacaagagctgtggttgatgttgtactttacacccacctctattaaagaccttcagctgacagatgtacgtagaaatgttgtgttgcttgcatttttgcaatatcttccattaaaaaagtgtattcttttaaacatgtgtgtgttgtttgcatattgcaatatcttctgcaaaaattgcaattttgcaaatatgtgcgtttaggttgttgattaatctcatctagtggtatatatgattttctgatttcagggtactagttggcatttatcacaatgctcaggtacaataatagtatactggcaaatctcacatcatgcgctcagttctattgcagcaagcaaccgcagataacagatttggtgctgccacatgaactgtattttagggaaacagcagggaaagtccctgttggagtttccgttaaaaaaggggcatatttgttcaatgccataaaaaggaaattggagtaggaaaataacatcaagaaaccaaagcttccaaagaccattaacacagaaaattcttgagaataccatccccgtaaacttttttcatccatatctaatgtttccatcctactaggacaaagataaaaataaaagatacaggttatctgacattctcctcatctcttgacgttctgggagctgctatagcgtgattgaggacaagcaccgagcatgcgcgaccacacatgacgtgctccaatgactgaaatagcaacaaatggtgagcatggcatagaacacgacaagaaggttccatttttatggacatatagaagagatcagagaaaaattgacaggagcagcatggaggtgacatggcaagattggcaatacgttctaatgtcatgcggcagttgttgagcaccaaggaaatgcgacaagtggcagtggtgatctaagattcccactttgtccacacccttttacatcatgctacagaactccagtcgctggatccatgtcacagataaaggcagtacgatgttgccagccaccatgcttgaggacctgcccaatgcggaagtcatcgctgtcatggccaagatgctctgggtggacgccaacgccatcatgaaatctgacctcacatttgctcttggtgacagtggcttcacaggatgtggcagctgggagacgctaatggcatcatcctaccacgcaccatggggagaagaggtctgtggccatgcagcatgagaagaataggcacgtctatgtgatatgaattacagagaaaaaagggaagcacatgagaaaggaggaaaaggcataatgtgggcccacctagtagaaatataagaagaaaaaagaaagaatgggtcattaacaattaggggtgggcgttcggtcaggaccgacatttcggtccggttttttcggtctttataaaaaggaaaccgaagttgtctcaagaaacttgtggaccgacagttcggttaactgatacttcggtctcggtcttcagtctgaccgaccaaactgaagtatcctttgtggcactggattgcagacttgcatatagggacgagggcgagaaaaaaaattagtatgagatgctagtcgaagcaggtagtaaatcacaagcatacacacgcaactattgctcttaagcacaaaaacccagatctgacaaaaatggaattcaatcgttcaagaaaatgggattcaatcattcaaagattacgtgttagaaatctgaaaaaaaaaacaatcgaaggatagagagtataggagaaacaatcatcaacgagagagacaatcctctcgacagcaggccacggcgctactgacaatggcgctcaggctgcacacgcacagcaggcaggatatgagcaagacgacgacgatgacctcaccgctaccgcaccgacggagacccctcagcagcagccacagccatcatcttgtgccgtcctgccaccagatctcgcgctgcctctgtggatcagatgaagcgccgccgccaaagacgggagggagcaggcgccaagctgctaaccctagcactggcggcactgccgctctactcccctttcttgttttttttttttttagagatgttgcccaccagctgaacgtatatgtgctacgctaatgggcttgtgggccatatatacgtgagcaagagaaggtattgggccacttcggtcagtccggttacttcggtcggaaaggcctgatgaccgaatacaccgaactaagttcggtctttaaaatcgtacaaccgaactagtgaccgaagaccgtgatttcggttttttcgggttcgggttcggtcttttcgggtctggtcttcggtcctcggtttttatgcccacccctattaacaatcatgggaaaatgcactggtgatggtattctccagcatttgtggggttcgcgaatggtatttggcagcatgtcacattcactatggcattttccaactccaatttctatgcgatggtattgagcagatttgctctaaaagatttagttttatgtacaagcctagaagggaaaagaaaaagggaaaacagggtagcagactaaagcatatcattattcatacattttccaagaaaatattcagcacttttttagagaaatacttaaggataggaagcactaagaaaagagcccaaataagatatttatttagttccgacttatctgggggacaaaattcactaataataagtttgttgtcccagatgaaaagtttgttgttgcaagcaagttacttcgtgtcgatcatccgagccataaaacattggacaacttttacagtggttctattgaaagtagaactgatctagaccttctggcttttttcattaaacggaccatatttgtttatagtactgactcaataccagtggtacaaccaatgggggtataattgtccaatgaagatccttataaagctgtgagttaggttgtttctactggtagtattactggaagtagataaattccagtagagaccactatgaaagtgctctaaacattaatgtccacaatcatgacaaaataactatcatcccttgaggaaggctattgctgactacttgacattaggcaagcagcaagcaattgatgcttggaccaggcttcaaggatgagaagccttgcgcatcttatttaatgtatcacgactagatttcaggtgaagcttttcaatttgacttattggagatgcccagtaagccttacaaagagaaggaaccaataatgaaatcagtgattaccaggtatgctaaccaagatgccttcccactgatcaaacagagctccttcaaatttagcatccctgagctgcacgagaggattaaataaagccacctctgtatatgccatgtatgcaaacggatatagaagtttcacgggcatacagaaaaatagataagtcatatgatcaacaagactgattccacaaaattaaattccccatttctggttttctactaacaagtagaacaagatgaaccagccccactgtacagtatgcaaacgaactgccattttatcatgcccaatcctacatatagatcatattggctagctaaaagcgaatcaacaaaatactcttcaatagttccatttgtgctaatgcagtttcacatgactactttgctgattaaaaaggaaccccatgattaaactctaaagtccaattgctacaatatagcaaatcagcatgatttactgcagaaaataaataaattaaattcactcctgcagacaggcattcatccattcaagcaaaatgcagattatacacatggaaagcacaatgatatgcccattcagtcaaaggacatggtacgtgacgaatggagcaacagcaaggcacgatatacctcatgagaatgtcctctaggttcttggagatgactggcgccacctctgccggccgtcctggtctgacaagcggggaacagataggcggcatgtggaactccacagctgcagaacaccacggcaccacgccacaatagaaacgcagataaattagccaaacgcgcaaagcaaaagcactatgagaagataaatcaacggcaaacataccaatagatccttcgtcgggggcctcaccggagggcgacatcacctcgagcttgatcgacgcgagcatggcctgccgcaaacagatacgggaggcatttcgtcaaataggtggtgcacggacgcctaaatcaggaagagtggcggggagagggaggggtggagagcggcggcttggggggtcgtacggtgtcgccgaggcggacgagggcggagccgtgggcggaggacacggcggcgagggcgacggtggttgggcgggcctcggcggggcggcgcgcgtcggggcggacggattcgcggaggtggcgctcgaggaaggcgagggggaagaggcggcggtacgcctccacctccatctcgccggcgaggccgccggccgccgtggcttgggcctccgccgccatctcacgggtgggtgggaaaggagcttgggactggctttgtcgacaaagggggttttctttttggtttggggtgaacggtcccttgctagggtttaaggctcttccttttttgggcatcagttcgtccggtttgcattggggattttgataattttatgtaactagcaaaatgtcggtgcgttgtaacagtaaagataatatatgcatcgtattatgttatagatatagctttaaaaaaccatgatggttgtattagagggctagaaattcttacattaagaattagactttgttagttagattataacggtgtagattaatcgatatagttgtacatctttatctttacctattataaaagtttaagatgtttttgtcaaaaaaaatttcgtacgttgtccgactctatccacgcgcgcagttatttttcttcccttttctttttaccccgcatacgggtatatcgcggttcattgagatcgacttttttccgtgtgatttccttcccacgcgttggatctattacatgcaggccccaaatcgattgtatcctggcccatgtcccacatcccacgtcatccttcaattccatccttcagatgacgtggtgacctttttttcatctatccatatctctatctccatatctactgttataaaaattagaaatgtttcccctaaaaatttgatgcgtcatctgtgtttgaatcggttttcattttatgttttagttttaatttaatgtttatgtcaaatcctttccttttatcttatgtcaaagtgtccctcttatccgagacgtgcgtgaattaattgggcctgcacttttcacgtgtcccttgccgcacgcaatgccctcacgcccgtgattttctgcatgccagattaggcccgcaacgccctcgcgtgcgcgatttgcctttgccgcatgttcgattgagattgtgtcgccctcgcccgtatctgaagatgtttttgtcaaaactatggtacgtcgtccgtatctgattcccgtcacacgtaacattcattgcaaagtaataactcgtgagtgaactgcgaaagagagttcgtgtgatgtggataccaagcgaatgatactcacagaatccgtgtggatatcacatgtattgttgctcagatcatccaattctatttgtattataagacacgatttctaggatatgttagcatgatttcaagtcagtctccacacatgattgtacgtactaccagggatgtcgttacaataaactgtaataatcaattttactttcgaaaagaacatgccaactgaaataaaggatgatcaaagttgctgatttcgtccgctatcaattcatgcccaacttgagataaagctggacaacaaatcgagctcgtgtttgaaggccttattgtttggcttatgcttattcctataagccaaattttaaattttagaacttatttacacacaaatagtcttttatttgccaataagtgattttggtaagcacatgaatagatgaaacaatgggctgtgattatttttccaccgatacatatgtataaattaaattggctctacccgttgcaacgcacgggcatcttttctagtaaagtataattttatttaaattgtagaatgggatacaattatatttatgtaaacaaccattataccaattcaataatatgttgttccgtatagaaactatgtttcgtatagaaactaaaatttccatatttaaagccagcggataactaaatatgaagccagcaggtttccaaggttgttgatatttcttaatgatattactaaaaatataatttctagcaatgacacccgaaatattactcggtattctttacggttacagatataatctgcaagcgcgcggatacaccgctgtagcattttacccagaagtattttaaggtatcatatttatttaatcctaggaaaagatatgataatagagtactatgctagaaatttatatcactcgtacagatcaaagtctaatgcaggggttcatcaattcaaggatagatagattaacacacagaaggaactaaccagaatactctcactaaaataataatctaaactaagtggagaaagaataataacataatcatttttgtacttatagtatatagtcattttagtctgcacttgccattatacaattatgtagccaatatccccaaactatgccctcctggtatttcgagaaaccacccctaattgctgagtttcttacgacaatctgttatggccattcaactggtaatagatacggaagagtacccacaccaggaaaatctcttagccctatatacgcacatggaggaatactcgtggcatacatcaccatttaatgttatctaataatctaagcaccacgattacattactaaatattactctacatctttgcagatgacatagagaaatcatataaatgaatatcaaaccaataccattgcatatctccagtaagctagctacataattattacgagacaagtatgaactaaagtaggtactcaaataattatataaatgaagtaaaggaccaaaactatacaaagaagaatatttcattactgaattaaatcttacaagagagagaagagttactagagtcatactcaaaatctccagaagacttgaagaactaataaattattctaattctactccacaagcactagacacaaagtaaataaactagagaactcctgcttgatcctccttggtgtgtattgaaatggagagggagagatccttaaatagcctccatatgacggctgtggtggttggaaatgttctaaacaccccgcaaccgtcattggggagcaatctaggacgtccacatggaaggcaaggatcagaggcgccggtggtggttcggccgaaccctggtgtaggatcgagatgtcgactagaggggggtgaataggcgatttaaaattaaatgacacctaatcaaaactaacctaagttgctaggcttggtaagggataagtctaactaagcaactaagttatgttttgcaatcctagggtgaaagtggctcaaataaaagtaaatcacaattcctaagtctagtttagcaatcctagggtgatatgatctcaagtatgtctctaggaatgtaaattgcacaaatgtaaatgcaacaaataaatgagacaaggagacagtagatttttcactgaggttcggaaactcgccggtttcctactccccgttgaggcgagcccaactccaccgctcaaccacaaagccaccgcacgcccccttcgtcaaggggtgggcaaggcgggagccagcccacggagaggactacccaagcctcgatcactcggggtagttcttccttcactccgaaggtggtgaactccaaaccagtcaacaccggcgccagggcctcctccacaatcttcccagagaggtcaccgggaaactcctccacaagttgtctaggaggcggcaacctccaagagtaacaagcaatgacgcggctcggagaagatcaagtgccacactagctctacaatgaagcaatgcacttgactcttggctaaatcaaccctcaaccactacaatggatgaacattaagctcaaatgtgtgtgagagaggtgcaaggggtgtatgcaattgaattgggtgccaagagagaccccttgctgctggtgggggagtatttatactcccacccaccaaaactagccgttgggggcgaaatcccccaactcagtgctctgccggtctgacctgaggtgtatggctggtcagaccgtgctagtctacaacagctagaatacaacttctagttttctagccgttgtaggcctgtcattgggccccattgccctagccggtcagaccgacgttgagtggccggtcagactggcctcggctcggtctgaccgaatacggctccgtcggctctgtatcgtccaaaccagagcaacaccatcccagcctccaggcggccggtctggccgcacaagtgccgccggtcagactggccaatcatgccggtcagaccgccactaggtggccgatcaaaccagcctctgacctgtggtcagaccggccctggtcagggcgaacttagtgaaaaggtgtgtgttgtgaaatgtgagcacaagtctagatgcataatgacctaatgtgacaattaaaatcatctctttgctaggtcattacccctcttaatagtatggcaaagctataaataaacaagcacaattttgatcacccaacacctcgatcaatttaaaatgaaaacactagtttaccgtcttctcttccttttgctttgcgccgtcaattttaatccatcgatagacatccatgcgcacacataatgcgaacctaacttaaaatatatagctcaaaagaacagttagtccacaatttgtgtttatcattaattaccaaaattaacatcgggggcttagatgcttcacctgggttggcccatcttttctcccgtacctcgcttgatggatcctaagctcagtggcatggtggttgggcccaattgcaggtgttctagtgggtttgtgggcccattcatccataagtctgccacccgtcgagctatgattgattgaacgattattttccatcgtttctcctccatttatatgaaaatctcctgtatacaaatactttgacaagtacaagtaaaaatagattatgcttaaaccaatatgcatgcaagcattgctagttctcctttatttccatatgtattgatggtcgaaattggtatataacgaccgtcaacaaaggtccaatttgagagctgggccataggtttgtagcctgttgggctttggctttgaccatgttatgtgtggctgtgtgagcagctaggtgcagcaggctcacgtaaggagaattgactcctccgacgatcaacgcatggccgttcgttccacatggttatggactaggacttacggacacaagtgatcgtaagacgtaccaaagctcaagcacgaaaacagaacgatcgaatcggagacatggcaaagtggtgggttatacacggcatgtgtgaggatgtgaattagactggggcacgaacgacgtacgaaagtaccggtaaaaacatcttcaatttttataaagtaaagataagtccgctttgttttatttaccacctaatccgcgtgcctcccataacacgctatcgggactacgaattgttctatttggtaccactttctctacttttactgtattttcacctttttttattccattttatttatttttcacatgtttctggacttatttgcccttggccccacctgtcagatccagagaggatatcctcctctctttggatcgattgatccatccatccgccccattctttggagaaaacggacaatatgctactctatttgtggggtttcaatgaaatgccacccactaaaaagcaaaggataaaatgtcacttaataggttacctttagaatactttgccactttgagttttgagaccaaaatatccctagttgtttagaaagaggatatccacatatttgttgaagctctcgctgaaaataaagcatttgaaaacggacaatatgctcataatatactgtcgggactgtgaattgttcttatccttttcatcgcgttgaagctctcgctcgtccaaatgtctctgatagtcaagctacccattgttgtttcctctttctagtgtttgagcttcaccttgttctcgggacaagaagcttcgtcgtagccaaccaatgcgacgaacttgatggcaccagagacgtaggcgatggaacgattgtgcatttgcgctcaagaaatggcgaagtttgtgggggacatcacggcagtggggcaacggtacaaacactagcttggggccttccggcgacaagatgttgtcgcaaatctgaacttgtatgacttggttatgtataatatgggtcacattctcatatttggttaagtaatctagatggaattctcaaatttggttattcaacttgtttggcttcatgtatgaatacatattacggatacaagctgccaaaggttttcataggttttctttagttaattgacatatatgttatattatcaagaactaaacattttagttctcatttcaggtagctggcagtattgcaatatcctgtcaaaaattgatcattgcatttagatagttcccatttctttacaggtacatgctatcaaaaagttgcatttgagagcaacactgtacaacatatggttacactatacatgctaccagaaaattgcatacatcagcttgaaagggtatcatgtacacagggcaaatgagcaaaaatgaaatcaagcaattccttctgccaccatcttctcttccaattgattttgggagcaactagaagagagcatgcggcgtcatgctgcgcgaccgataaagtttcatacatagattgaacagccatttaaattttcaaagactgagaagagttgtatacaaaatgtgaacaaattggtgagaggaggttaattatcagtgtgcacagagagggccacatgtagtcgtcggtatacacagcgcgctcctcgaatgacattggctcgccgtggagcttcacccaggttgtgacatcgttcggccgttgtcgagcatgtaggtttcgtgtagtcccctgtggagaggaggagaccatggtgatatgacctgtggtgcatggtccaagcgacatgatgtggcagctcaaaaggttgcggtaagggtgaccatgtctcgccaatgccagccctggcctagtcaaccacctctaagctcggttccgtaagcaagcttgcaaattatgtctttgtggtaaatcttgctatcgagcttgatagcgttgtacttggcgaaccggtgaacactttccctgagctggtgtcagtgatgtcgctctcaacattgttggcgccgttggattttccggtgatgccgatgatcttcgaaccaaccttgatgaagtccatgccaataaggtgagcgatagggggtttggtgagctcttcaccaatgttgaagatgctatgtcaatgcagtgtgcacgacatagccgaagtggtcattgtggccatcttgcaagatcagctagaggcgtaaaaaggcttcttggtcctctaatgatggtagagccgctgatcctcatgcatcggtgttaccatctgccacaaaccagagtcgccaaagtttgttgtctagcattgaaccccaaacaacggtgggactctggctcagggaacatcaaggagatcaaaattcgtggtacatgggtgatagtgaacaccagcaatacccatagtcactatcgtcagagatgggtgacagtgaaagccagcaataaaatcgacgacctcggaagcttataattgtgtaggcgagctcggactcagagatgaacaatcatcgtcagacgctgcactcacgtggcaatcgacgcggacactgagaaaacatcttctcatacgacgtggtgaatgttggtcggagtactcctccatcgtcaacaccgacgacgaaggtgtgcacgatcctacaaaccaccgatgcaaatggagtgatagccccaagctctagggtaaagcttggaagataggcacattaaggtagacgcggtggaggaactcacctttgtgtgtaaggaaacacaagcaaacatatacgccaggagaggaaggaagaacaaacaaaattgtgacagcacacaaaggcggtaactcatcctcatctaagctagccactggactagccaatcaaagagaaacacagggagtagtaagttccaactaacaaacaaaccggcatctgcacgtgatggtaaagcagcgatgagcaacctgatgaaatggtaaataactcacccagatgtaaataaggaaaaagaaatgaagacgtgtcgcaccgtgagacaccaacagagaccaaaatctatctattgaaaaattgaaaagaaaccagcaactttgccactatcttctcttccaattgctgctttgcccttggggcctgctcctcgcctcctcttctcaaccaagggccactgcatgatgatgcgacggacgaggcgttgagatggggatagcgacgtcgggctgtgcgctcagtggctagggcagcaccaccgcagggcgcacagtggctggggtgatgctcggcggcgacagactaagattgtgaatttgggagagaacatttctttgatatgacatgtgggacaagggcaaaaatgttgacaatctaacaaggaaacaaaaaatggaattagaaaatcagaaatacataaaagaaaaggaaaaagtggtgtcaaataaaacaattcgcagtcctgattgtatattatagaaggcatgcaattaggtggtaaaaagatcaagacgcacgaattagatggtaaattatcaaaattcatgcttgcaaaagtgacagaagaaaaacttctaaatacggagtatatagaaacaatttgatactagtaatttgctcgtgctaacgctacggtaatatttagtaatacaaattaaataatcaaaggaatacaatatatgtttttgtcaaacaagcataaaatagaaggttcaaaattaaacatgagttattatatgtttgtaaaaaagtttcatgtttcgaaaacatatactccctttgttacacactgtaagacattttgacatccttgtcttgattcagtgatatgcatatcaatttggacaaatatattaaacatatatgtagatctctctatgaatctattcaaaatccaaaacgtcttattaccgtgaaacagaggaaataattcctaatgcacaacttcacaatcagtgcgtagacataaaaatcgaaaccatccatcaactctaatgtttttttgaaacgtataacggcaaaagacttgcaggatatattagaagaaataaataaaggttacaaaaaatcgcagactctcatgtagtaggggcctgtgttacgatattacaaagattgtgagcccccctaaacagatctctagctcaagagagtctagagctaataagatggcctatattttcctttatagcaaaggcgacctgcaactcattttgtgagacatgttggaagattctacggtttcgctccaaccagacattccaccaggtagttagcacggctcctaggatttgttttctcatagcggttggcattacagaacttaggatatcccaccaatctgttgtgctttcatgagtcgtttgttgaggaaagaaagaactatagcccatctaacttgaggcgtggtgccaaactctgcttgtgaaaggacactatttagctaggtgatttgaatcttcaaaagcacttctacagagactgtatatccaatcacatggccaatgtctcttgagaaggttttcagttgttagtgttctttggtgcaggatcaaccagccaaaaaaacgatgctttggttcagaatgcgttgtccaaagagttgagaaatttgtatgtgttatctccccttgaaattgcatttgatatgcactctttgccgagtattctctatttgcagtccacttccaggagatgtcgtctgttctttgttcatctaaaatgacaccctgtattttgctccctagctgaacccgttcctcaatctccgaaacagatgtaatcgggttaagcatggcaatccaatggttgtcttgcagttccacctggagattatttccctttcttttggcaagcttgaaaatagagggcgcaatgtgttgaggtgctcttccatcgagccaatggtctgtccaaaacctgattttgttcccatttcctatcgagatctatgttgccgcctgaaaaagggcatggtcgattttttcgcagggtgtctccatgttaacccacggcttagtttcatctttccatccaaaccatagccagcgaagcctgagtgctctcgagaatttttctaggtttagaataccaagcccctccaaatactttggtttgcaaaccgagttccaatttagcaggctacaacccacggaaacacttccggatcttcccctttccacaaaatatgccgtctaaagcagtcaattcttttgtaaagccatttgttagaaggaatgacaaatatgtggtaaattggcatagctgagagagtttatttcaccaagaccttgcggcctgtagctgtgaagaaacatcctttccaccctggaatatgaccccccccccaccttatcaattagtggttgtaagtctaatttcctaattttcttgaagtgcagggggagactgaggtatttgcaggggaaagatttcaggcttcctgtgaaagaagggagaaggccttcaacatcaataccagagcatgatattgggaagatttcagttttggtgagatttgtgtgcagtccacttatttgagcaaagagggaaaggatcttcttcagtgcttgaaggtcattttgtgatggtgccatgaagagagcaacatcatccgcatataaggagcatcggaatcttgcctgtctttgaggaagattagtgattacaaaggactcttcctccttctttatgatctgttgcaaaggttccatcacgagaataaacaacgttggtgatagaggatcaccttgcctgagcccacacgcgtgattgatgtgttcccctgggattccattaagcaacactctggaagatgaggttcccagaaggttggagatccagtttccccatttttgaccgaaccccagattttgcagggtttcgagaaggccttcgatatgtccaccttgatgaagagagtgccttttttctttcgatgaagcagcctaatcacattttgcatgtagaggaaattgtcatgaatagcccttttttttatgaaagcactttggttttggaagaccaaatcatttagcttgggttatgatagaatttgttatctcatttacttttctgtcatcttgcaaaagacctttgtctccgaaaaacttagcattctctactcaatgtctcgatatctatgatgaacatgtgcgtttaaacatcaatgataaggacggaacaaaagaggacctgtgtgtgtgccagcaatatttgtcgacttcaacaacacacacacagatatggttaccaatgaaaaaaaaatgaaaataatgcaattcatgtatcaaatatgaagcattatctcattaccagatggttacctattgagaagttaatatatataaaaaaaatcaatatagtaccaacactgagtagtatgttgagaacatcatcatatatttttgaaacagaaatcaatctaccatgtttgaaacaatgtaattgtatcccacaagtatatggcacactacataattgctctgtaccatatgctatgtcagtcaatactttccttgtagcctatgctatgtcagtcaatactttccttgtagcctaaaagcaagagtgtatcaaaagaatgtattaataccatgtgaggaacaccattgagctttaacattttaagaggccccatcacaaaggtcagaccgttgagaatccaacccattgctagccaagatgcagttgatgttatcagatccttcttatcatttggttgaaacagatgactgcttgtgttgaagtgtgagcctgacttccccaaactccttgcaagctgcaggcatgaccccaaacaaggaatttagtgcgacattacaaaataacatttgtttttagtgccaactaggccatgagtgtagcagcaagattgcctacattgttttcctaaatgaatctggttgttgaattgattcatgacgcaaacaattcccagaaaatcttcccaatcaggacctcggctttgagaaaaaaaacagtgagtgaatgaatattgaaaaaaaccattatgggttgctctcattgaattttgcctttgtgaacaaccatggatgtatatatcctatacaccatagaaaacaaatcggatcacttgcaccaccattggttaagaccaatgccatcactgttgcttcctccatcattcaggacaaatggtgttggaattaatgaatgggccttagcccactcgaagattaattctttggaaaatcacaaaagctcacctcatgggatgacatgcatgtggagtttagtaccaccttgcttattctaggagaggggggcctccttaaaagggaggatgccctcctagccacttaaagcatgtgtggtggagagaagaggggggaacacacgcgcgcgctcgctctcctcgcctcgcctggcagttcggttacgcgcagtggagatcgtgcgcgcgccctgatcaagcgacccttctcaatataaaccgacccgtcgtcttcacgcaatatacgcgaaatcaatctagggtttgccttcctactctgtgctgcaccgtcgctcgtagattactccatcccgctcgccggcgtgcaccggcgatcgcgagagcaggtctccggaacctctgcctttgacgtcctgcaccgggagaaggcggcaataaggtttttgggaagtgctttgcgcgactgctccctgttcatccgcgacggctcgtcttcctcttcgctcgcgtgctgcgtgccttcgtagacgcctgcgaaaagtttcgatcaagcagccagtctttccgccacctcggtacgtgttcaatatgttgcgcatatttgatctgttcatgttatactgtgtagtttacaagtgtagatataatgatgcgttcatgctaattttcatctgtaatgtcatgatttatttatggaatagattaaatcattatatgcctataatctcaacaatccaaaaacttattataggcactgtgattttactatggctggttttgccgatgcactgaggccggataaatttaccggtgtgcattttaagagatggcagatcagggtcactctgtggctgacagctatgaaatgcttctgggtgagtactggcaaacctgaaggagttcttactgctgaacagcagaagcaattcgaggaagccactactctctgtgtaggatgcattcttagcgttcttggcgatcgtctggtcgaggtgtatatgcatatgaccgacgcaaaggagttgtgggatgcactgaatactaaattcggtgctactgatgctagcaatgatctgtatatcatggagcagtttcatgactacaagatggctgacaaccgttctgtagtcgaacaggctcatgagatacaaaccatggctaaggaacttgaactccttaagtgtgttttacccgacaaatttgtggccaggtgcattattgcgaaactacctccatcttggagaagtttcggtactgcactcaaacacaagagacaggaatactccgttgaggggttgatagcgtctcttgatgttgaggagaaagctcgggaaaaagatgccgcgtctaagggcgatggtgggcagtccagtgccaatgttgtgcacaaggcccagaacaagagcaaggggaaatacaaagctcagcagaccaccaacttcaagaagcagaagaagaacaacaacaatcctaatcaggatgagaggacttgctttgtgtgtggccaacttggtcatctggctaggaagtgtccacagcgcaaggggatgaaggcacctacagggcagacttctaagtctgctaatgtgaccattagcaacactggagatggaagcgggtatggtaatttacctgctattttttcagttaatcagtctactaattggtgggttgatactaggtccaatgtacatgtttgtgctgacatctcattattttcttcttatcaggtcgcacggggttccaccgtcctaatggggaatgggtcacatgtttctgttcatggtgttggcacggtagatctgaagtttacttcgggaaagatcgtgcagctgaagaacgtgcagcatgtcccttctatcgacaggaatcttgttagtggctcccgtctgactagagctggatttaagttggtttttgagtctaataaagtagtcgtgtccaaacatggatattttattggtaaaggttatgagtgcggaggcctgttccgcttttccctttctgatttctgcaataagtctgtgaaccatatttgtggcagtgtggatgatgaggctaatgtttggcactcacgtttatgtcatattaattttggcttgatgtctcggctttccagcatgtgtttaattcctaagttttccattgtcaaaggttctaagtgccatagttgtgtgcaatcgaagcaacctcgcaagcctcacaaggttgccgaggaaagaaacttggcaccactagaactcttacattcagatctttgtgaaatgaatggggtgttgacaaagggtggaaaacgatatttcatgactttgattgatgatgctactagattttgctatgtgtacttgttgaaaacgaaagacgaagctctagactattttaaaatttataaggcagaagttgaaaatcaacttgacagaaagataaaaagacttatgtctgatcgtagtggagagtttttctcaaacgagtttgacttattctgtgaggaacaggacatcatacatgagaggacgcccccctattctcccgagtctaatgggattgctaaaaggaagaaccgcacactgactgacttggtgaatgccatgttggacactgcgggactacctaaggcatggtggggggaggcattgttgacctcaaattatgtgttaaacagagttcctaacagaaataaggacaaaacaccatatgagatatggatcgggagaaaaccatcactttcttacttgcgcacatgggggtgcttggcgcaagtcaatgtaccaataacgaataagcacaaacttggacctaagactgtagactgtgtctttctgggatatgcttatcacaacattgcctatagatttttaatagttaaatctgaggtacctaacatgcatgttggtacaattatggagtctcgtgatgctaccttctttgagagctttttcccaatgaagaatacacatagtagttcgagccaaccatatgaaataattcccagttcaatcacaccaccagaacaaattgaacatacacatga

SEQ ID NO: 59453 - DNA, 1910 bp, Oryza sativa
ccacaattcgtgtgctactttccctagcagcctcacatggtcttctcgttcatcaaatggacgttaagacagcttttcttaatggagagctggatgaggagatctatatggatcagcctgatgggtttgtagttgaaggtcaagaaggcaaggtgtgcaaattgttgaagtctttgtatggtctgaaacaagctcctaagcaatggcatgagaaatttgacaaaacattgacatctgcaggcttcgcagtcaatgaggcagataaatgtgtgtactattgccatggtggaggtgagggagttattttatgcttgtatgttgatgacatactaatatttgggacaaaccttgaggtgataaatgaggttaaatcattcttgtctcaaaattttgatatgaaggatttaggagtagctgatgttatcttaaacattaagctaattagaggtgagaatgggattacactcttgcagtcccattatgtggagaagatcttgaatcgctttggctacattgatagtaagccttctccaacaccttatgatcctagcttgttgcttcgcaagaacaagagaattgctaggaatcaactagaatactcccaaatcgttggctcgttgatgtacctggctagtgcaactaggcctgatatctcctttgctgtgagcaagttgagccgatttacctctaatccgggagataatcactggtgtgcgcttgagcgagtaatgcgctatctgaaaggtactgtggaattggggcttcactatactgggtatcctgcggtactggagggttatagtgattctaactggatctctgatgtggatgagataaaagccactagtggatatgtcttcacactgggtggtggtgctgtttcatggaggtcttgcaaacagaccattttgacgaggtcaaccatggaagcagagctgacggcactggatactgctactattgaggtagaatggctgcgtgatctattaatggatctgcctattgttgaaaaaccggtgccggctatccttatgaactgtgacaatcaaacggtaattgtcaaagtgaatagttctaaggataatatgaaatcgtctagacatgtgaaaagacgattgaagtctgtcaggaaattaagaaactccggagttataacgttggattacatccaaacagctagaaacctagcagatcccttcacgaagggactatcacgaaatgtgatagacaatgcatcgaaggagatgggtttgagacccatgtgagttatactatggtggtaacccagtctatgtgatcggagatcccgtgaattagaatctgggaagaacaaaccattagtaaactagaggagagtaccaatctataccctctctaagtgaagatgcatgtactctcgtgagctgcaaggcaggttggctatgccttaatgagttctgttggctttaattagcgaagatgttgtcctgcatagcattcttgaaagaactcacctttgtgagcttgactgttggtcgcagtctatggagattttggctgaatcttctaggaagcttactatagacctaggagtatgacttatacgctccacccgaggggtagtctacaaacggtctagtaccagataagactctgagtgaaacttgcttgcataagacttgcaattcaaggcatagtccattgttcaatttgtgagtaagtgtagcttggagttctaggtggatgttcaaccttaatcggtctccatcgaaccgctggtatataaacagtacattggaaaaggcaaatctcagtgggattttgagatttggtgggggattgttggaattaatgaatgagccttagctcactcgaagattaattatttggaaaatcacaaaagcccacctcatgggatgacatgcatgtgg

SEQ ID NO: 59454 - DNA, 16082 bp, Oryza sativa
agcacagcattaagagtgctttcgattaaaacggcaacatcctaacagatgtacctaccaaaacaatatgcccggtgaaagaattctcaagcccacgcaatggttatccaatatctcggggaaaaaaattctcaagccccaataaaggttatttgtgtttcctcttttgtcttgtaaataacattttgattcactttcataaaattatacgatgatcagaaaaaggcagtcaattttgtcttgtaggaatgtacgtaaacgatgatcagaaaaaggcagtcaatttacacacttctccaatccgtttgcaccagacagctgcaagcattctgcagcatcttctgatgaaagccccttgtgaaatgtattcagctcctcaaaaacatctataaggggaagattcacctgttattatatgccctcacaaagcacagcattaagagtgctttcgatgaaaacggcaacatcctaacagatgtacctaccaaaacaatatgcccggtgaaagaattctcaagcccacgcaatggttatccaatatctcggggaaaaaaattctcaagccccaataaaggttatttgtgtttcttcttttgtcttgtaaataacattttgattcactttcataaaattatactgtggacaaatgtctgatagttttcctaaaaaaaggttatccgcgttagtccaaggtttgggttctatgaccggcggactggatccaccagcaacctatggactagcaggtggtgtccgtcttggcgccgaggggactgtggtggtgattaacaaagagtggggctcgggcgaggcacaattttcgtctgcggaggcatgtggacaacgacaacaccgtaaatcaccaattgaaaatattaaaacttaataatcagataggttacctcatgactatatgtttcagaaccagccaaagtctacagcatgccaaagtatacaaaagtctatgccttgcatatgttatggtctctggtcacctgaaatgtagatattaccagaagattattaccggttgtagaccatgcaaaagtctaagatgcaattgaaaggtcaatcctgagagaaaatgtagaaaattattagggcaccgcatcattctgaatttaagtcttccaaacacatataatttgtgatgaactgaagcagcacatttcctctaaaagtcatagaagtgtggataaatcgacatcaaactctagtcgacagaaggttttttttgtctacaccggaagatgatagtcaaagtgtcaggaaaagctccattatgaagtaatattatagcctaatctcaaacaatcaaagcagttttgtagtttttttttgttcgatatgctttaaaaactattcagatcaaatgaaatcaatttgtttcgtaatgcactcaacacaataaacacaaataatcagctgattatagttggaactgcaattgttttcctcaacaaaattagtgtgcactctcattaggaactaaagtacaatcagtagtgctgctaaataggacagcaggagaccaaaatttggtgctgctaactggaaagcgaattacatatacatggagctagcagtactcacgattcaattcctcaattaccccattgcatgccttgccatcactacaagaaatatgatcttctgtgacgaattcctcgtgacatcggagctcttcgtcattagcacattccattttatgacgattagtatgagatgaggatggcttagtgacgaaaaaaatgtgttcgtcattaacaccaactagaaatcgtcataaagtatttcaatgggacattgtgacgaatattaatttgtcatagatatatataatgcatttcttgaaaaaaatatactccctctatcccataatataaggcgcggtaaaagctggcacggtctccaaaactaatatttagcttataatttctcatatactataagatttatagcaacaaaactataatcatatgaaagtaaatttaaatatcaatctaatgatataatttttaacaaataaaatattttatattatactaagtgttggccaaatgtttaaaagttgaatcttgaaatatgtgcacaccttacattatgggatggatggagtattaaaagttaacgcaatttaatcaagtgaattaatgaggaaactaaaattttcctttaaaaatcatggacggaaatattttttgtaatattttacgtggtctaaattattattttaaatttttcgtgaattttcagagctcaataactaattttaataccacaaaacttatttaacctattaaaataaatagaaaacaaattaaaattcctctctatgtacttgggcctttttcagcccaagtattactctatccctccctcagcccgcagcctatctctccctcttcctccctcttcgggccgccggcccagcctttttgctacccctcgccgaaaagtccattttacctccctcctctaaattcaaataacttttcaggtagcaaagatttcaaatgaaaaaattgtcaataataattgtataacttatcaagatctacaacttttttttggtcatttttctatatgactttgtttcaataatttgaatttgaatttcaaattatgacaacttcaaacatcactttcaaatactaaatgatttcaattgaaaaagtcatcaacaacaaagttgtataactcatcaatatctataagttttatttttgtcattttgctatatgactttgtttcgataatttgaatttgaatttcaaattatgacaactttaaacaacattttcaaatactaaacaacctcaactgaaaaagtcatcaacaacaaagttgtataactcattaataactataacttttattttggtcatttattcatccgataaagtgatagtaacattgttcacaaaatttacacacctctcttataatttatgaaaccatatggaagatttgtaaaatttatgaacaatgttaaaaaatactttatcagatgaacaaatgaccaaaataagaattgtagatctagatggattatacaactttgttgttgatgacttttttcagttgaagtcgttcactaataaaattttctatttgaagttctcaaactttgaatttcaaatttcaaattgtttaaatagagttagattgaggaattaccaaaatagaaattttggttcttgatgagttctacaactttaatttaggtgacttttccatttgaaatcatttattaaccccaatttttgttcgaagttgtcaaattctaaaaattcaaaatttgaattgttcaaatgaacttatttgtaaaaaagaccaatacaatagttgtagatctcgatgagttctaaaattttgttgtttgtgatttttgcatttgaaacataaaaagcagcctaaaattaaatttgatgttgttcataaattaaaattaaaaataccataagatcattcatgtttaggcccaaatggcccaactatttctgaccgtccatctccgatctaatagttctcatcgccatccctaaccttagccccatataaaaccctcctctccacccctcccccctctctctctctccaccctcagccgccacactaccatccattctcctctactctcctctcctctcctctcctctcctctccggcttactccccccctcaccgcttaccgcgccgcctccgtctctgccgctgccaggctcgggagcggcggatctgccgccgacagcgccggcatccgtctccgcctcttcacggcggcgtctgagccggggcaggtatccctcccattccctcacctcccctctcacctctcctctctcggcgcggattccggccggagcagctgccggagggcggtggcggcggcggctccaggcggttcctgcgcggaaggtggaggcggcggcggtggcggctcccctccctcctcccagatccggtggaggcggcggcggctcccctcccgcccgtgtacctcccgcgccagcccgccgcgcccctgctcctcgcgctcgacatcggctcgcgggttttcctcgctctctcacgcgcgaagtagttcggtcgtggtggagggatggactcgtgggttttttttctttttgttcgcagggactctgataaagctggtgtacacggcgagctgcggtggcggaggcgcggagctgcggtttgccaagttcgagaggcggaggctgcaggagtgttttgacttcgtcagggcgcagggtctcgtcccccctcaccgcttccccagtgtagcatcaccaccatggcgacgcagcggaggcacgcggctgtggcatggacacctactaccgccgccacctctccgggcagcagccgggagtacatgaaggccaaatgcagcatgtaatgcgctgatttaaacacgtacgaaaaggctaattctgcacaatatctttccttttcttatatggtacatgaattattcattatcccaaaatatttgtaaatgctatgtgcagattataaaagctgttctgtaggaggaaaatcattcttgaagattgagtatcatgaattcctacatctagacagtctcgatgttatataaagaactgtataatttggtaagtactgatacaatgaatgtcagtgattcccatgtagcagataactgcaataacccttcaatcaaatctgggatgaaacgtgtagttgggaattattgccatgttgattagtcctatttctgatggtgtcgaaccaagcagtacaactgtagaagtagtagctttgcttacagagttggatatgctaagcattacaaatgcataggtggctagaatattagttcatttcatggaaagtaattgtacatgtagagcttacaattgtatcctgatctgaatgattattggtgtgtctgcaattgtacatgtagagcttccaattgttaaaatttagaccatcatgtcatagaattgcttaaggtgacataaattcagtaggaccctcattcttgatgattttgggttgtcatgcatcaaaggaaccttcaggaagtttcaaaaagtcccacataattgggttattactaaatggagctgctattgcttctctctttgaagttatcatgctaattaaggcaagggcacttatgagatgtatgtgtttgtgtaatacatgaaattgtacctcttcagttctgtagttacgcagccaatggcgcagcgagcttgtttttttatgatgaaatggctagcttcggtagctgatttagagttttgcagcagcaaaataaaacgtgatagctgaaggaaaatcttggatttatggtagtattcatgcacatcaactggcattagacaatctcacattttgcttgcttaatttacacataatcaaagcttaattctatatataacatcaggattttgttgtgcctaagtaacacctcttttgctatggatagatgaatcggaagcaacaaggaagcatatgcccttttgtcgtttgattggccgcaacactcaggtcagcctcaataaggtttttgtctattctcttaatgttaccttgctaattcaagatcttttgattcgtgtgatttggatatgactttgcttaggtcaatgtgtgaacggctatttggcatttggctggatttggtggtcagtgacttgtactagtgatgtattatatctggtcagtgaacctgtgatgtaattgaacatgctttggatagtgatttgtggatgtaattagctgacttgtcatgtaactgatttacggataacctgtgatcttttttttttctgaatttatgatagcctgttttgtgattatgtattaaatgtgagctgaattttgttaattgggctataagatgtcagatttagattttaattgggctaattctgtttgatatatgggctttttgagtgtgcatggctgtcacaccctgaagttcttctctcaagcctaaattgaatttataaatggtcctaagaaaataccggtgtaaaagcaagagtgaaaccctaaaggaacaagagtgaaaccctaaaggaattaatgtaaataataatcggaattagcatgtggaatttttcttgagttttacatgtcgaaatacgctaacaagatttttagtgaaatttcagagctctaagaaataattttaaccaattaaaaatgagcacaagcaatttttaattccctggaaattcttttcctcctttttctttcttttttcccttcctttttctttttgggatgggccgccggcccattctctccttccctcctttttcccgctgggccggccgacagaaccggtcgcccgacttcctctcccggggtcgccgacaggtggggcccacctgtcgggtcctcccccaacctctagccgccgccaccgcgctccgcaaccgccgccgcgcccacgctcccgcctcctccgggccacgtcggccacgcccgcgcgtgcgcccgcgtctcccgcgcccactccctctctctcccgcccgcgcccgcgctcgagacgacgggattcgattttcgaatcccgcctctctctcctctcccacttcccccacgtcggccggccattcccgcctctcccggccacatccgagctccctttcccctatttaagcatccccactctcccctctctctttttccccattttgccaagcttccccgtgccctctatcgccctagcgccgtcgccctcctctccgccgccgccatcgccgctccggtcgccgctagccgccgtgctgagccgcgccgttgcgttcgccgttgtgcgggccgtcccgtccacccctcctccgtcggaatccactaccggaatccactccatgccgtgcgccggtgagcaccgccatggccgccgcctttggccggcgtcctcgccctctcccattttcctctctccctttaatccctctcatcttgttcgctaggtggttccagagctcgtcccgccatcgccgtcgccctccgtcgctcgccgtcgccgatcgtcgccggtgaggcccctcctcccctttctccctctctcccgcgccgcttagccgccgcgccgccgcctaaccgcttagccaccgctatcgccacccgcgtcgccgcgacgccgtcgtcttccgccgcgggccggtcgccgctgtgtgcgcgccgcgccgccgcgcgccatggccgccgggccggcttgagccgtgcccgcgcgcgccggccgcgagccgcatccgccgtccgatctaccgggcggtagatcggggccgtccgttcggccgcccgcgtggctgccgcgtcggcgccacgtcagcgccacgtggtgcgccgccccttacccggtccgtggactccgtccaccgtgaaccgccctccccgagtcactgccatgtggggcccgcatgtcggcgccacccctctctctctcccgggatttatttattgcgcaataattcaattaacgatttttctgtttatagtaaaaacgcagtgaatcttcgaaaattcatatctaattcatccgagctccgtttaagcccattcaagtctcagtaaatcaagaaaaatgtgtagaatccatcaaaaatggttttgttctctatttcaatagtcttatagcctgtttttattgtttgctttgtatgtcgcttagattccggctctcccgacgctccggtgtactttgaaatagtcgccgaggttcctccagcagcagagcaaggcaagtcatgcttgtcacttgaacatgttgatcctatattgcaaatggtctattgttttccttcaaatactgcattgttttgcaataatactatgtaatgtttacctactgttatagccatgctattcttgtaccatgctcctttgttagcttgggatgtgacatgactagatgttggaccagggattgcttagccatgcttagttcaactagcacacaatgggggaaatcatattaatgtatagactgtaggttctagtgttaatgttggattagtgccaccgtcctggtgttgcttaattaaaataaatcatatggtgggctgtgggtgcatggttttgctggtcgcgcccatggcatttaaggaccggttcgcgggatgccgtggaagaacttatcgtacttaccacaatccagcgtgggcaacggctgggcttgtagtgtagctttcctctagctgacgcatccaggcaagggtgggcgtgatggagtttggatgggccctgcgacggcctatgcggcttccggattcacctaggcacgagaggggactgcccgctgccttgcgaggagtgggggtgaaacctgaggtgtggtgtgcttggttagagggggttatgcgaagggtcctgtcacggcctctattcgttatgtcatggtggcatgtcggcgcacggaaacgtgtcgtggggctgtgtcttgtggatacagttgtacacctctgatcagagtaaaactattcgaatagtcgtgcccgcggttctaggcggtcaaccagattcaccgtgattagtctcaccctagtctagtataatggaattgaatagtctaggtggatggttgggcctgttgcaacgtggtgtagcgttggacagtggatggttaatattgattaattactacaactgtttttctgctttcaactactgtttataaatgctcgctttatgcaaaagaacctctatagctatcctttgataattccctacatcatacccctactccggtatgacttgctgagtacggtgattgtactcagtcttgctctattttccccaaaccccagagtttgagtatgcgtcagatagttgtttctccgaggagtaggctccgtccgtgccgtcgaggatgcctgtggagtggtgttcccgctgcagtccaagtcgaggcttagctccaattgccttttaattttccgctgcatttatgtaagacttttataatgtttgtaagacatggatctgtatgtcaactttatcgtttgtgtatcccggccggtcctggatggggattctaatgcacattctgcttggaattctattcgggaatttctgggcgtgacaagttggtatcagagccgaccttgaccgtaggacaagccaaatggaaaaacctaagagccctctgaatccttttcattgcatatattctttgcaattggatttgttccaggaaaattaggatctattcttgtggttcaagggaaaaatcttggtcgctagtttaagtgagatttgtcaaatcaagtcagtctagggttttagtaaaattatttgagatttatttgacagtcagtcgggatttgatgggaagaatgcattaggtcctaactcaggaatatgggttgctaggtatttatgctcttattgttattattagtaagtatataatttctcattatttgatcgctatgtaagtctgtcttatttattcgctctcatgcaaaatgatctatgcataaaattccgctcttactcgcttattttatttgagtcctttacagctttatttaaattggatttgagcatgcattgatcctacccctttgtcttctctagatggccgaccacccacccaaccaccgcggagaaggcgtggacgactttgtggcagagttggctcacatgaccctagtggtgggctaccccaacacgccagagtactcgactgttccgccgctcagtggcgagtttcctcaccgtgttcgtctggaggttcatggctatgtgggcacctgcctcgctaacatggtggttgaagcatctggaggcaccgcagatcacgcctgtcaagaggcagcatatcggatgatggccagacttcgtgggcgccacaactacatcttctgcaacacggcgtactatttccaccctcgccgagcaagtggtgacgatgtcaacacctttcgcctgacagccggtgagaacgacaccaccttcagtcacatgtgcgccgtgatgaggggaatggacaggatgcactcggatctgcacaagatgtccaaggccttgaatgatgggaagctcgtgaggatcatagctttgaaggatgagatagcacgcctgaagaaggagaacgctcagttgaagggcctcccagcgctaggaggagtccggatccgcaccacgccccgcaagtcgacgactacacccgtgcgcattcagcttgcgcccaggaaccgacctccgcccgcagctcccgcagctcctccagttccgcccacagctcccgcagttccagcagttcccgtagctccagctccagtcccggctcccgtccctgtgtcagctcccgcgtccgctctctccttcgctccagcatcagtcgccaggggtccagccggtggcaatggaggttggttgcctgctactcccagtggcagctgcgaccacagcagcagcagttccagtggcacagagccgggcagcggcgagacatatctgcaagactccaggagccgctcagagggacctggtgacgagcaggaggacgccttcgactccatcgaccgcaggagccgttccgagcattaggctcgctttcccttagtttaccgactgcttagtatttgtctattagtttgagtgtttaggtctgttcgcttgggggtcagtcgacggtcgatatcatgtgcctatgatatggctatcttaataaggatttgcttgctgttttaagtgttttaattcagatcagaacaattgcagtttaaattcctatataataaagcttagttcctgagcatctgtttttcttcttttccaccccctccgtctgctctccctccagatggtcaacaccaggaatggcagccgtgcagtaggtgagggcagcaacggcgaagaacgcaccgacggtgggcatcccaacagcgcctctggccacggtccaccaccactccccgagaacccgacgctcgcacaagtgatggcccatcagactcagatgatggcggccatgatgcagcagatgcagcagcagcaccagcagatgcaccagaggatgcagcagcaagccgagcagcagcagtttggtccccctccccctcagtccaagctaccagagtttctatgcgtcaggctacccactttctctagcaccaccaaccccatggaggtgaatgactggctccatgccataaagaagaagctaaaccttctgcaatgtaatgatcaggagaaggtcgcctttgccacacaccagctccagggccccgcgtcagcttggtgggacaatcacatggctacccgcccgccaggtacagaagtcacttgggcggagttctgtcgcagcttcaggaaggtgcaggtgccagacggggttgtggcacaggagaagagggaattccggatactccaccagggcaacaggacagtgactgagtatctccatgagttcaatcgtctagcgcgatattcaccggaggatgtccgcaccgacgccgagaagcaggagaagttcctagcaggcctggatgacgagctgaccaaccagttaatctctagagactatgccgactttgagaagctggttgacaaggcaatctgtcaggaggatcagcgcaacaaaatggacaggaagagaaaggcagcgcagttccggtccaaccaaggaagccaccagcgcccgcgcttcactcccggacagcagggtggacctaccaccatgatcgtccgccagcatcgccctttcaactcgagcagcttccaccagggcgccagtggcagccagaatcaccagggaagtcagcccaaccgcagtgcagctccgcgcctgccaatggcaccagcatagtcagctccatcagcccaagccaagaaggagactggagcaaagccaaggtcctgtttcaactgtggcgagcatggtcactttgctgacaagtgccctaagctaaggcgtgccgggccaaggtttgcccaagctcgtgccaaccacgcgtccgcagaagaggcgcaagcagcaccagaggtcgtactgggtacgtttcctattaactcaatccctacaaccgtacttttcgattctggtgcaacgcattcgttcatttcaaagaagtttgttgggatgcatgggttaagaaaagaagagattagtacactaatgagggttcataccccgggaaatagttcaacctcgatcagttatagcccttcagtgctaatagaaatacaccgatcacgatttctagccaacctcatccttcttgaatccaaagatctagatgtcatccttgggatggattggctgaccaagttcaagggagtcattgattgtgcgaatcgcacagtcaccttgaccaatgagaagggagaaactgtggtgtacaagtcactagtctcaccgaagcaaggaatctccttaaatcagattgaggtggaaaaccttgtggccaccgaggagaagagttcgcggaaattggaagatatccccatagtctgcgagtatccagaagtgttccccgaagacctcactaccatgccacccaagagagagattgaattccgggttgatttggcaccggggaccactccaatttacaagagatcgtacaggatggcagccaatgagctagcagaggtcaagaagcaggttgatgagcaactgcagaaagggtacattcgaccaagtacttcaccttggggtggtcggtcatttttgtgaagaagaaggacaggacgaagagaatgtgtgttgattatcgcgcactcaatgaggtcacaatcaagaacaaatatcctttaccgcggcttgatgatttgtttgatcagctgaaaggagctaaagtgttttctaagatagacctgcgatcaggctatcaccagttgagaattcgggaagaggatatccccaagacagccttcaccactcggtatgggttgtatgagtgcatggttatgtcttttggacttaccaacgcacctgcattcttcatgaacccgatgaacaaggtgttcatggaatttctggataagtttgttgtggtattcattgacgacatactcatctattcaaaatctgaagaagaatatgagcaacatctccgtctggtactcgagaagttgaaggagcaccaattatatgccaagttcagcaagtgtgacttctggttgtcggaagtcaagtttctgggtcacgtcattacagctcagggcgtggtagtcgatccatcgaatgtggagtcagttaccaagtggaccccacctaagaccgtgtcacagattcggagttttcttggacttgcgggttgttaccgtcggttcattgaaaatttctccaggattgccagacctatgacttagttgcttaagaaagacgagaaatttaaatagacggccgagtgtgacaagagttttgaggaactcaagaagagattagtgtctgctccagttctgattctgcccgaccaaacaaaggacttccaggtctactgtgatgcgtcccgccacgagcttggatgtgttctaatgcaagagggcagagtggtcgcttatgcctcgtggcagttgcgtccacatgaagggaactatccaacgcatgacctggaattggtagcggtggttcatgctttgaaaatctggaggcactatctgattggcaaccgctgcgaagtatacacggatcacaagagtctgaaatatatcttcacccaacctgatctaaatctccgacagcgaagatggttggaactaatcaaagattatgacatgagcattcactaccatccgggcaaagccaatgtggtggcatatgcattaagcaggaagagctactgcaatgccttatgcaccgaggacgtgtgtaaggaattgcagcaggagcttgaacggctcaacgtgggaatcgtagaacacgggttcgtagctgctctagaggcacggcctacgctcgtggatcaagtcagagcagctcaagtaaatgatccggagatagctgaactgaaaaaaaaatatgagggtcggaaaagcccgggacttccttgaggatgaacatggcacaatctggatgggagaaagattatgcgtgcctgatgacaaagagctgaaagatctgatactcaccgaggctcatcaggctcaatattccattcatctgggtagtaccaagatgtaccaagatctcaaagaaaaattttggtgggccaacatgaggagggaaatagctaaattcgtcacgctctgcgatgtctgtcagcgagttaaagcagaacaccagagacccgcaggattgttacaacctcttcagatcccggaatggaaatgggaagaaattaaaatggatttcataacaggtctgcccaggacatcatcgggccatgattcaatctgggtagtcgtggattgacttaccaaagttgcttatttcattccagtgcatacttcttatacgggcaaaaggttggcggagctctatctctcgagaatcatgtgtctgcatggagtagccaaaaagatagtatctgattgagggagccaattcacttcaaagttctggcagaaattgcaagaggaattgggaacccggctgaacttcaacacagcctaccacccgcagaccatcccgatggtcagaccgagcgggtcaatcaaatattggaggatatgttaagggcttgtgtgcttgattttggtggaacatggtacaaaagcttgccgtatgcggagttctcttacaacaacagctatcaggccagtctacaaatggcgccgttcgaagcgttgtatggccggaagtgccgcacacctctcttctgggatcaaacaggcgaacgtcaactgtttggaacagaagtgttaacggaagcagaagagaaagtcagaaccgtcagagagaggctgagaattgcccagtttcgacataagagctacgcggacaaccgccgaagggagctcacttttgaagcaggggattacgtgtaccttcgtgttactccgctccggggagtgcaccgtttccagacgaaaggcaagttagcaccacgcttcgtgggaccatacaaaatcttggaacgaagaggagaagttgcttatcagctagaacttccatccaacatgatcggcatccatgacgtgttccatgtgtcccagttaaagaagtgcttgagggtacccgaagaacaagccgattcggagcacatcgacattcaagaagatctgacttatgtggaaaagccggtttgtattcttgagaccagagaaagaagaaccagaaataaggttaccaggttgtacagggttcagtggagccaccactcagaagaagaggcaacttgggaaagggaagatgagttaaaggccgcccatccgcacctcttcgccagctcttccgaatctcggggtcgagattctgtttaaaggggggtaggtttgtcacactctgaagttcttctcccaagcctaaattgaatttataaatggtcccaagaaaataccggtgtaaaagcaagagtgaaaccctaaaggaattaatgtaaataataatcggaattggcatgtggaatttttcttgagttctacatgtcaaaatacgctaacaagatttttaatggaattttcagagctctagaaataattttaaccaattaaaaatgattacaagcaatatttaattccctggaaattcttttcctcctttttctttctttttcccttcctttttcctttcgggatgggccgccggcccattctctccttgccccctttttcccgttgggcccggccgaggcccagctgaaccggccgcccgactccctctctcccggggtcgccgacaggtggggcccacctgtcgggtcctcccccaacctccagccgccgccgccgcgcccacgctcccgcctccttcgggccacatcggccacgtcggccacgcccgcgcgtgcgcccgcgtctcccgcgcccactccctctctctcccgcccacgcccgcgctcgagacggccgggattcgattttcgaatcccgcctctctcccttctcccactacccccacgttggccggcgattcccgcctctcccagccacgtccgagctccctctcccctatttaagcatccccactctcc

SEQ ID NO: 59455 - DNA, 800 bp, Oryza sativa
accccttccccggtagccgccggtcaccgcctcgcgttgccgctataagcgccatggccgccgggccggcttgagccgtgcccgcgcgcgccggccgcgagccgtatccgccgtccgcggtagatcgaggctgtccgttcggccgcccgcgtggctgccgcgtggccgccgcgtcggcgccacgtcagcgccacatggtgcaccgcgccttccccggtccgtggactcggtccaccgtgaaccgcccccccgagtcactgccatgtggggcccgcatgtcggcgccgcccctctctctctcccgggatttatttattgcgcaataattcaattaaggatttttctgtttatagtaaaaacacagtgaatcttctaaaattcatatctaattcatccgagctccgtttaagcccattcaagtctcagtaaatcaagaaaaatttgtagagtccatcaaaaatggttttgttctctatttcaatagtcttatagcctgtttttattgtttgctttgtatgtcgcttagattccggctctcccgacgctccggtgtactttgaaatagtcgccgaggttcctccagcagcagagcaaggcaagtcatgcttgtcacttgaacatgttgatcctatattgcaaatggtctattgttttccttcaaatactgcattgttttgcaataatactatggaatgtttacctactgttatagccatgctattcttgtaccatgctcctttgttagcttgggatgtgacatgactagatgttggaccagggattgcttagggctgcaggaa

SEQ ID NO: 59456 - DNA, 722 bp, Oryza sativa
tagggtgtgccttcctactctgtgctgcgccgtcgctcgtagattactccatcccgctcgccggcgtacaccggcgatcgggagagcaggtctccggaacctctgccttcgacgtcctgcaccgggagaaggcggcaataaggtttttgggaagcgctttgcgcaactgctccctgttcgtccgcgacggctcgtcttcctcttcgctcgcgtgtgcatgccttcgtagacgcctgcgaaaagtttcgaccaagcagccggtctttccgccacctcggtacgtgttcaatatgttgcgcatatttgatctgttcatgttatactgtgtagtttatatatgtagatctaatgatgcgttcatgctagttttcatctgtaatgtcatgatttatttatggaatagattaaatcattatatgcttataatctcaacaaatggttccacataaagctaaggaacgtgatgctcttcttctactccaaaatgaagtaaagaaaaagactagaagttcagagtaggaatgtacgtaaacgatgatcagaaaaaggcagtcaatttacacacttctccaatccgtttgcaccagacagctgcaagcattctgcagcatcttctgatgaaagccccttgtgaaatgtattcagctcctcaaaaacatctataaggggaagattcacctgttattatatgcccttacaaagcacagcattaagagtgcttt

SEQ ID NO: 59457 - DNA, 1685 bp, Oryza sativa
atctaaaaaattcctgtaaaaatgccttagcccagttgttaagagaagaagaagttaaatggtatcaaagagcaaaaacaaaaagaatagtaggagataggaacaccaagtactaccatatgatcacgaatggaaaacacagaaagacaaagatttttcaattagaacaagaagaaggggtgattaagggagatgcacaactcaagaaatatgtcaccaattattataggggtctttttggagctccggatggaaattgtttctccatgtgtgaatctcaaaaggatgatatccctcaagtgtcaatggaggaaaatactttcttaacaaaagaatttacagaagaagaagtgaaacatgctgttttccaaatggaacataacaaagctccggggcctgatggtttcccagcggagttttatcaagtgttctgggaagtaattaaagaagacttaatggctgtctttagagattttcacagtggcgagttacccctacatagactgaattttggtatcattaccttgcttccgaagaataaagaggcaaaacagatccaacaatacaggcgcatttgcttacttaatgtaagcttcaaggtattcacaaaggtcatggcaaacagaattgctctagtagcacagaaagtcataagaccttcgcaaattgcttttttaaaaggtagaaatattatagaaggggccataattctccatgagacattgcatgagatgcataagaaaaagtcaaatggagttattctgaaactcgatttcgagaaagcttatgataaggtaaattggaattttcttcaacaagcgttgagaatgaaaggtttctcggacatttggtgcaagtggattgatcaagttgtgtcggggggtagtgtagctgtgaaggttaacgatgagataggccactttttccagacgaaaaagggtttgagacagggggatcccctctcaccaattttatttaatttggtagcggatatgcttgccattctcatcaatagggctcgagaccttgagactctaaatggagtaattcctcaattggtagacaatggtctctcaatcttgcaatatgcagatgataccatcttgtttatggaccatgatttggttaaagctaataacctaaaattggtactagctgcctttgaaaggttatcgggcttgaaaattaattttcataaaagtgagatgttttgttttgggaaagctaaggaggtggaaaaggattacaccactttgtttggttgtaagatgggtacttttccattcagatacctaggccttcctatgcatttcaaaagactgtcaaacaaagattggaaggatctagaagataaattccagaagaaactcagttgttggagaggcaagtttttgtcgtcaggaggaaagctggtgctcattaattcagtgttgagtagtctggcaacattcactagtaatatgcacgtgctaacgctacgacgatatttaccaatgtattgtaacacattttaaagaaaaatttctttcacaaaagaaatttattgtcataatatagttttgtagataattatatactttgattcttatctccatacagtgaatagcaacatgcagtatattatctgtttaaaatgtaatccccaacaatcagaattaagaaatcaaatctcaatttttcaacca

SEQ ID NO: 59458 - DNA, 4074 bp, Oryza sativa
attaagctggaggatgcattacaacaaaggccatggagttaaacaggttatacaataaagcagtagttctaagaaaatgcatttagttacctccaaataaccatctgccaactccatctactacacttagccaaccgtcaataactatctgccaactccatctactacacttagccaaccgtcacaacttatgagctaaatatacattttcaccacttgtatgcaccttaagattaataaagatgatgttgtcaaaaggatagaaatatgaggtttatcttgatattgcccctgctaacaaaacaacacacggagggcaactatctgagttaacgcatatgtatagaaatattaaaaagcatattagttcctataccagtttaaggtagctatattggtaaaaacaaggtgcaaaaagaataattaatatttgagggatcagagaatcaagagaataactacataattaattagttgaaaatagctcaaattggagcggtacatgtgcagctaaaataacccatgcatggaatacctacaagcatgtgcaaacaggtacatataaagggtgcattttgtagacaatttctgctgaatgaaagccccactgatggcaaccagatgcaagattgcctgagttgaccatattaataattctaagcccagccccctccataccatcaatcaatttgtaggatatgaatagtgaatattgcacatgggttttcgaggacaacctcattttcttttgatacgagtcttatctttaatatacggagttctggttgtacactcaaaagtcgaattttatataaatatcaacatgtaacagtgatataaatttgtagtttccaatttccagtacattaacagagtggtcctcatttaactataacatcagcagcagcagtgataaactcacacatataaaacctatgaaatttcatcaccaattcagaattgcatggtaaacacgaatcccattatatacctgttctactccgtacaactaatttatatatatatacttgccctactccataccaaatttagtaattgcatgctcttagggcatataatttgtacctctatctgtccatgttcaaatgtcattactgaagatataaccaattgctaaaggggagctcttatggtataatagataatgttttttttgttttgaaatgaggcattcatgagctgcaaagaatgtgaagaaattggttcacaaaggcggcacgaaggtggtggtgcccaggcgcggttccaatccggtggtggtggatggtggcaccggcattgtcggcgaagactggaacccaggcctggcggcaggcttgttacctgcaagaagaatttcactgattagtttgcctcttgacctcttattctgattaacaggaagaaaatttgatatagacaaatcaaaatatgaactcagtttggtagatcagaaataaatcaagaaaaatcacaagcagatttcagaatattaaatccacatgaacacagattctacattaagctgcattgccctcgacattatgaattcatctatgaaattattccatgaacaaacaacacatcatatctgactttggattgtacccagcaatttaagatcaacactaaaagatgtatcacatctgagctgacttcaagggtcagtgatattgtacacatttcttttacttgtaaatgacaaatccatttttcttctagggtcactgatacttgtaaatgacaaattcatttttcttctagggtcactgatattttacacattcctttttctagatattcagaagaaagatatattaacccatgccaagttttgtttttctgaattcatttttcatccgcccgattgactcgaacaagaaaaaagagaaactgaagacctggcagttcaatcaaatatatactctccatcaatttttgtacaacgaagacctggcagaagaggaggaactgaaggaggcactcacggatcggcgggcggcgtggtcgtggtcgatggggatcggcggtggcgtggccgcggaagacgtgcgggcgacggtcgatgggatcggcgacgagggaggcggcgtcgcgagggaggggatcggtggcggcgcgcgatggaggatcggcgtgaggcgtggtcgtgctcgacggggatcgacggtggcgtggccgcggaagacgtgcgggtgacggtcgatggggattggcggcgagggaggcggcggcgcgaggccggggatggagggcggcgggtagggaatcgcgaggggaggagggcgataggaatcggtggcgctgcggagcaaattgaggggcggcgcggggcgtggagatcggcggcgagattgaggcgcgtgacgggagttacgggagaaagagagaataaagggaagaagttacgggagaaagagagagggggaggggaggccaatctgcgcgcgagggagagccggagaggtgggtgatctagatcgttggttgcagagcatatgattttggccgttggatttgtccaatgatgaatgagtatgagtaagatgagttggtgcattatagggtagatgttttttttctttgaaatccctaaaggaattttaaagaagctggatttttacagatccagatttttttggcaatgtgatgagcacaaaaagaagtataggttagctaaatggagtgtgttgtgtagacctaaggaatgtggggggttgggaatccaaaacctagaaatgcagaacaagtgtatgcttagtaaatggattttcaggttgatcaatgaagacggaatttggtaaagtttgcttaggaaaaaatatttgacaaagaaaaccattttgcaagtccaaaaaagaccaggggactcacatttttgggctagtctcatgttagccaaagagtcttttcaaaggtttggttccttctttttacaagatggctcagaagtaagattttgggaggattgttagataggagttcaatcctttgagaaggagtatcctaacctctacaatctagttagaaataaaaatgaggtggtggccaaggtaatgagtggaataccaatgtgtctttcagaagatcaatagtgggaagaaacttagaagcctggtatgagctagtgtcgaaagttgttaacactgtattgacagatcagaaagatcgcttctcttggaaaaacaataaagaaggcattttcacagtaaaatctatgtacaagttgctcatgtatgaagggctggttcctaggaagaatttcatttggaagctcaaaattccacttaaaatcaaaattttcttgtggtacctcaaggaaggggtaattctcactaaggataatctagcaaagagaaggtggaagggtagcctaagttgttgtttttgtaactctaaggaaacaatacaacacattttctttgattgctcaatggctaggtatatttggagtgcgctcctttttacatttgggattaggcaaccgtgtagcatgtctcaaatgtttgggaattggctgaattttgttgaacctaggctcaagagaatattgtttgtgggcatagctgtatttctttgggcaatttggttatataggaatgatgtggtctttaatggctccaatcctacatctttcttgcaggtcattttcatggaaacacattgggcaaggacttggtctttgcttcttaagggaaccgatgaagaaatagttaagaactattgcaaagtgctggagaagcgtgtggtgaaattcttctccgtgtatggctggaaccttagaagaagatgggaagcctagtcttttcttcgtttgttgttcttaaaacctttgtgctgtcatctcttatgtaatgggagaggtcagttgatacattttgtacccttttattagggagagtcttatgtactcgtgttcggatttttggctgtgtacaccccacaaaggtgtagaggccgggtttgataatcctttatcttaaaaaaaaatggtgacgatggcggctcagtggtcgacattggctcacggcggcgcgtggcacagctcggtggtcggcgacgacgtgtggcgcg

SEQ ID NO: 59459 - DNA, 18489 bp, Oryza sativa
  unsure (1)..(18489): unsure at all n locations
ggccaaggaataaaataggatttcaaggaagtgaaaactaaaggagtttatttgtggattttgaactttagacaagaaattcaaaggatatggatctaaagaaagagattggtggactttttaaaatttggaaaagaaattataaagggatttctaagataggaaacctaagggaattttgaattgagagttttaaataaatttcaaaggagataaaatttaaaagagaaatgtttgaggtcttttgaactttataaaaagaatttaaatataaagtttttaaaacaaaaggggtttgaaatcaagatatttaattttgagttatagattttaaaaaggataaaaataaagatgctccaattttaaaagaattcaataaggatcaaaatgctccaattttatagaactcaataagatccaaatataaaacttgacgcaaatattttctttaatatttaaaaattaaaataatcaaatgggaaggaaaggcaataatttaatttctaactttggataaatttgtgatggtggcaaaataaatggaagggaagcaaataggactttagccccaatatatgtggtatggattctcggtgatttattggtgggctaaatgaaattggattttgtacggaagggattagaaataggtttcttagcacaagagcaatcattctggaaatattattctagtgccagaaagaatcaaacctaaactggcggtttgatttatagatagaagattttggatagtagaacatctaaaggagtttgtggaaggtgttgtatgaaagagaacaaggatttctaaggataggtctaggtcaagggttatatccagaataaattcccgcaaaaaggaaattataccggtttagccccaaagataaaaatggttaatgggatataacagagagtcgggtcaatcggggaaatattggcccaagctaaatagtagactttggaatcttgaatggataatttggaggaacaggatttcaaaggggaaatatttgtgggagtatataactggattcaaagaaaatataatttagagccaaagctagagattaaataaaataaatggaaaggttttataaaatttgggaaaaaacaaaatagagaataaaataaagattttaaagaagagaacttttaacttagcaaacaaaatctagatccaggttaaagaaaaaggaaaaagtaagattactccaacggaagaatcgagaagaacatgacttaaaatattccgcaaaaatttttccctgaaatttgagtccgttacacttttgtaccaagttctccacttttttgcagacaattgtcaagctctaaaggttgttgaccacttggctagattaggcttggtttgtctaaatgggattctattggtttcggtgttgatgcaatgagtagggttaatattgcccatcagaccaagaaagaaatgtgatggctcttgcaacatggggatcataatctggtttctaaggtactgaaaatagaaaaattgaggaagaagccctaagtatgaagaaatagaataggatgaagtatgaattacagaagattgatgagaagcaatggatttacctcagggacatcagaagtggtcgccatcgatcttgagcggagaggtttgccgtcagaaatttgcgtcgccaagtgttgatgtgaaaacacggcggcctgggagatctgcttaactccagtgcaggtccaaggctagactcgagtgtgtcaagggcgtgccagctggtttgatcctgcaatcagcaagagagataaaagcagaattagtcagacaatagccgatcagccggaaggttgatagtgtatcgttcgtggtctcagccgatggagttagaccaaatcggctatgtactgagtatatcaaagaatattaaactctaaacatgcctaatcggttgtcataccgtctatcaagtttaataaattggtttaagacaatattgtgaaagtagccgatgcgacaatatttagagcaagaaagataatgtactagctaatactctagtatgaacctatataaacagattgatatatataaacatatcaaatagaaatcaggcatgaaggtgcaagaaatctagccgatactgactaaagcttgacatgcatatataaaacgaagtatctatataagtggtgaatatacatgaaacaagtagtaaaacatgtatattaggtaagatcagctgaaaccccgatacttagggatgcaagtggggcgggcaagtgtgcttttttgtcccgcttatcccacttctaatttattttttcttctaaattttgtactaccatgcaaaaaatagactagcaagcgggtttttatgcgggtagtgggactacccacttgcatccctaccgatactatccttattatgtctagttgttggcttgtttgcatggttctaggctcgtttgcatggttctaagcacgactagacaatcaagcagttaaacacttttcaggatggtagatacattagctaatctaatctagcaagacaatttagccgaaaccagcataaaccctaaagcaagcagcggccgataaagctaaattgagaagctaagaatagtttaactaatacatatgatagcaatgactcgcgatatcgagcctaacacgtctaaagcaacatgttagccctgatagcgcgggccattgagacgaattagctcttgtgaagaaatcaccaaaaagaggaaaagtaaaaagggtggcgatgcgccgaagttgtattggattggctcccgtattacaatgctatggggttcatatttataccccgagtacaaactagtccattatggacacaactcgaacctttctaaagataagatacaaacaagaccataaatagtggtctcttgccaaatctctaacaaatcgactcaaactaacctaattaatagatacaattactttatccgagctctatctctaattggcaatgacggttatcctaatctaggcccatgctgagcccaaggcataccatatcagtcttctcaacttgttcaatcttcggccactgtttccagccaatgtggtatgcagcgatgcgtagtccaattctgagtccaacttggttcaacaccaaatccgcttcgatcttcttctttcttctccgaatctaatgcccgcaagttccgttgttaacaccaagaaatcaccgaagagcttgaatcgttggagaaatcaataagggctaacaaagttgttgaagcagtggcggaaaaggtgatggagtgaagttttcgagggggttcttgctatttatgagctaacggttgaaatggaaagccctaggattttgcgggattgaaagagatagtttcgccgcgtcatataacacagcggaattggggggcaagtgttaacaacaaaatttgacaagatagattcagattgggagttggatatcaaagcggatttgaaagaaattggatcttgccaaaacagattgtacatcggctgacagcatatcggctagaaatagagtcgaagtttgattgagccgatatggaaagcagccgatatagttcgacttgggcacgattgagattactgtcattgccatatagagatagagctaatttaagacaattgtattcattaattaggatactaatgtcgttttgagttagaggtatggtaagagtccaccatgtagacttgtttgtttttatctttaggaaagtttgagttgtgtccataatgcttgaattttgtactctaggtataaatataaaccttagatcattgtaaaaagggacgacaatccaatcaatataactttcggtgcatcaccaccatttacttttactttttcgacgagttcttacttcgagtcgggcatcgacagcgatctctcaacaagaagtaaattgtctcgatggcttgcactatcgggcctattatgtagctttagatgcattggtctttttattgtcggataaggccttgttggatcctgtagagacaaaagaccatgtaagatctgccgtgtaagagttttcgccgtgcgtattaaccaagccatgtgatcagaaattgagttttccaacttcacggctgggggctaggatcagtgcttgttcaaccaaggcaggtcaagggtccaagagccttctcctccgagaacgattctctgacgacaaggctgggggctagggagagtgtatgactcaacaaactgactgatcgaagtcggtaagagagaagacgctcatatacaaaacattggacccaccacataccatgtcttatacggaaactgacttcagatatggagggagttccggataaggaaagacaactagagttctacatggaaacgacaaggactactcggattgtatccatattggtttccctagttctacttggacaaggggacacctatgtgtataaatacaaggccccctaggaggagaggggagataatcaacacccaccacaatctacagaacaacagaagccacaacatataagccaacatatgccaagacaagacgtcggatattgacttcagggataagcacggctagtctcctacggtgtctccggatactgtcaggagagacgaaagcgctatccctgatctcgttgggcacggattcgaggaggaagactaccctattgtcgactacgagtcagatcttcaggccgccatgtcgacaacagttagataggctaccccaaatattgaactggtgtgattatgatgaataagagcaacaaccggcttcggccaacaggatgtagggttattacctgacaattcaggggcccgatcctgtataaaaatcctcgtccccatctcttttgcctcaatctcgcatatatcctagtaccaacgatccccatactatgcaaataccggaatcgtgacatcaaacgtcgacaacttgattgtttagactttaggtttctctacatactttgagttgcgtcaaccctagtcttgtctagaaccctaaaaactaacctggaattatacataactagtaacagcattggagtttcagccgatattacctaatatacatgatagtgcatgtctcataatctattttgtgtatatttgccacttatatagatagatcactctaagtaaatatatcaagtttgattgatctcgactaatccatcatatatggtgatcgattattacttgatatatttatctagattaatttgtttatataagtttgtattggagtaatagccaatacattatctattcttgctctaaatattagattatcggctatttctataatattgtctaaaagtgattgataaaaacaaaagagatagtattgcaatcgataggacatatttagggttttgttttacttatctatcataaagccgcaaccgatttggtttatctgtatcggctgggtcctgacgatacgtcgttggctgtattagccgatcggctatcgttcatctaattacgtttggtgtctttcttgctggttgcaggatcaaaccagctggcacgttcttgtcactcaaggaaagccttggacctgcactggagtgaagcaaatctcctaggctgttgtgtttctcgtcaacacgcttttggcacgcccagtggccggggccacttcaccattcatcattccaccatctttcactgaaatcacagacgacaacatcgtcctcgtcactattgagcacttgtctgatgaacagaaagcagagatgaagaaacttgttcaacagatgcaacatatgtgtcttggttgttacagtatgactcgacaagggaagctgattcaaaagaataaagtcgagttcccaaagcttattgaagaaaagactgataagaagcctgatggtgaacaagatggggatagagaagaatccaaaccaactctgcaagatcacattgactcagccgtgcatcatgcattgatcaaccaatctagtgtgcttgtcaatacattgacgggcatgatcaaatcagtggtagatgggtccattgatgaggagaaaactaaggggccaatatattttccaaatcttgtttttccatcttacaaaactgtaaggactaagttgggaagtggacagcatcaaacgactcctacatcggttccaattgcgccaggagttgatacaattttactcacaaggcaacagccgatatcaggggtgcagacatctaatactttggctctagagtagctgatgcagatgttgaagctaaagcaaccaagtactgaagtacaaccatcagccactcaaccaagctcaagtcagccacctttgattcttcagcagccagctcaacagccaattgggtcatcacagccgatcggcccatagtatgtgaatgtggattgatgaaccctgagttcctctcaacactcaaggctgttgttggcccgatctttcggtgagttgtgataactacgatttgggagaaacgttgacgatccgactacaaccgtacgagacgttatgttgcgccttagcgatcgatacacctctccgtgggttgttgatcttgccggtgcagatcaaccctattcctgcaagcaaatcgaagaaacaagcaagaacaagaataaagcaatctgatattgcaaataggaatttaatacaaatgataagttggggttccgaagaactagcagacggacggtctagccgacacgcgcgctgcaagcaagtagcaatggctaaactttaatctaacaaaacccgagaaaccctgaaggggtaactagctatatatataggggtgggaggacgacctaggggtgcctagggtcgtgctccaccagcttggggcgcaccccacatgggccccacctgggccggggtcccaaatgaagttacaagcccataggcatagcttggggcgcaccccacatgggccccacctgggccggggtcccaaatgaagttacaagcccataggcccattataggtgatgcaacaccttgttcctgtgattctggccacacgagatagaattcagagaagaggctggatccgttagaaagaggactccgagagctttccatcaagtactcacgggccgaaaacggaggtcgtatgcagattcggtggccgtttgaagtcagcagtgtagtaggtggccgaatcggattccagcacttggagtacttgatctcgatatcttcttgttcatccatgatgtgagcaatggttgcatccgtggtagccatggtcacatcatcctccccttcttcacggaaaaccgtcctcggtttttccatatggtgctctttgcatagtccatttacaacaacctgtttcttccaattaaaacaaggcaaactcgagacaatttggttagcaataacatttttctctagcttgcatattttatccacatgtacaggaggttctaaatccgagcagatgtaaactctatgcacaaaatatattccaagatcattatattcaccaaagatgtgaaatataacattggttggatatggcaaatcagacttagcaaataatttctccttgaaattatcgagctcacaaaaatcatcaaactgaacatagcccaaagtatttaaagaagatctcaattcacgctcctctacttcattagcaatgtgaacaacatgcttaaaatcagtgcagtatgaattaacagtaggaatagcatgttcattcacaagttgtggcatggatataagtgaagcattatcgcataactcttctttatcacaaggaacagcaaacaaatcaatttgtgacaaaggaatctcagcagttggttccactaatggttgctctgctatagcatgaaaagtggacaaattcaattcattaacaacacactcacctttattaatttcagcaccattaagtttacctttgatgccctcttcagataatggaggtgcctcgactttgagtgtgatcaatgggactggcggctctttcatgtctctctcctcctttttatgattatgcacttcctgcaaatggttagtaatagaagacaaaaacatagcatgttgcttcttcatgtcctcctctattttactttcagcattgcaagcaagttgtaacaaatgagaaagagatgtatatctttgacaatcaagcatgtcctgaatttctttgttaagcccacataaaaacctcaattctttagcttcttcgcattcatctaaaccacaacgtaataaacaagcttgcatatcatgatagtatgaagtaacagttctggtatcttgttttaaacattgcagtttgttgaacaaaatgtcagcataatacatgggaacataaacatctctgaaatatcgtttcaggtctttccaagattgtggtattttgttatgcctacaaagatgtttccaatcattagaagcatgtttaattaaaacactagaggcacacataaccttttgtttctccgacaagacatgcttttgaaattcactatcaaccgctagctcccaattaatgtaagcacgaggatcatagtctccctcgaaataaggcagtgcagatttgatcttacctagaacatcatcacttacctcataatggtcatgtggatccctcctcatgtctcgacgaagatgtcgatgttgagcgcagctatccccaattatcttgcgtatccctgccattgttagtagaaaacaagaaacatacacaaaaatatgcgcgttcctattaactactaggtagtggcagctcaaaaatcgcacacactcaagcttttaaccaagctcttacaagatcttacctatgcaagtggaatggtgacatacaccgactcaaccaagcaccccaatgaaggttggatgtatcgatgccttggcaaacacttgcggtacagctgtaatcaaatatgtggagctctgggtaggcttaaatatgtagcaaaggaatagcaaatgctcaaatcagataatgcaaagttgaataattgttcaaagtcaagtaccgtgctggtcctaggctagaacgtactagagacgcgagcctagacacaaacgataccacaagatagcactagaaacaactcatgcacaactctgatatatgaagttcagctcaaacataacagtattttctcttttctttctttcttctttcttcttttcttttttttctttccttttcttttctgtttttttttggtgcggctttttttttcttttttttttgcacctttctgcctttttttcactttttttcttgattttttttaacaaaaactgactcaaggaccttaatgtaagattacagggactcaaacataaatataaaatttacagggactcaaatgtaaaagtctaaacccaaaattaaaattatacaaaaaatggaatgctgaatttatgccggttccgtttttccaaacagatctcgaaaccgacaccaaacaaaaattcgccaaggtgtttgacacaactcggaaccgtggaagagagggagggagtcggactcggccaaaggggcgagtgggactcggccaggaggtggagtggatggcagccgaatttggtgtatgggataaaaaggaaactgatttttaaccaatccaatctactatatctttccaaaacaatcttgactacttccaaaatcagatatggtaattcaccttcctcctctcgtgcacgacacaggcacggccagaacaaacacacacaaggatcggcaaactctagatgcaactcaagaactccaaaactaaccgacagaaacttctgaaaactacaaaaatagaaccgtggcagcgagccgattccgttttcgtaggtcccgacaacaacagagacatggtggcagcgacgactgtggtacaaaacgtgaccagaactcgaaactctaaacgaactagacgctaagaccagcaacacgacgtgacgatgcaacacaaaattcaacaaagcaaaaactgaaaagaacaatgcaatggcacaatatggctaggtaaatgatacgaatttttttgtatggctattttctggttataggaagataaaaactcaccgagcaacaaaagctctgataccacctgatgaaccctgagttcctctcaacactcaaggctgttgttggctcgatctttcggtgagttgtgataactacgatttgggagaaacgttgacgatccgactacaaccgtacgagacgttatgttgcgccttagcgatcgatacacctctccgtgggttgttgatcttgccggtgcagatcaaccctattcctgcaagcaaatcgaagaaacaagcaagaacaagaataaagcaatctgatattgcaaataggaatttaatacaaatgataagttggggttccgaagaacaagcagacggacggtctagccgacacgcgcgctgcaagcaagtagcaatggctaaactttaatctaacaaaacccgagaaaccctgaaggggtaactagctatatataggggtgggaggacgacctaggggtgcctagggtcgtgctccaccagcttggggcgcaccccacatgggccccacctgggccggggtcccaaatgaagttacaagcccataggcccattataggtgatgcaacaccttgttcctgtgattctggccacacgagatagaattcagagaagaggctggatccgttagaaagaggactccgagagctttccatcaagtactcacgggccgaaaacggaggtcgtatgcagattcggtggccgtttgaagtcagcagtgtagtaggtggccgaatcggattccagcacttggagtacttgatctcgatatcttcttgttcatccatgatgtgagcaatggttgcatccgtggtagccatggtcacatcatggatccacaaggctataaatataaacctcaacagccaaatatgggattcaatttcaataatcactatcaacctttttcaccaatgaagcatcggccagaaggatctccttttgttcagttttcacctcaacctatgtataaccagtttgaacagcaattaatataaatgaggtgtgcaacagtagccattggccgatatgattgctgatgtgatgagagaacattttggccttaggcctaaggatagtgggatcatatatcggcatccctatccagaatactttgatagagtacctttgccaaaccgatacaagattcctgattgctccaaattcttagggctagacaatgtttcaacttatgagcatattagccgatttttagcacaatgtgatgaagcatcagctgtggagggcttgagagttaggtttttccccttgtcgttatctgggtcgacttttacttagttttcttctttcccatacaattctatcagaagttgggccgatctagaaaagcagtttgacaagtatttgtttagtggggttcaagagatgaagttgtcggatttgactgcaactcagcaaaaagttaatgaatcggtgccagattatattcagagatacaggaaataggtgctatagcttgaacttaatcgattcacaaatcacaactagctgatttggcttttcagggatcaatagttgcgtaagctgatcttgagttgactgttaagatgcctgccccctgcattggttgttgctaactctacataaatgtggaaggagccaaagaagagggaatagaagcaatcagttgcctatggccagccaactcagtcttgatggttctgtaaggtgggaaaatattatttagaaaatatgtatgccccttaactttctcctcaactattgatcatatctgataatgtattgaccaaaacaccagattggttgatcaaagcatgatgaactgcataatcactggttccttcttcaatcttcgacttcgacattgttacttttcccttttgtataattgttccttgtcaagtcatgctgaaggatcccaagtacatcttctgaaattgttgaataatttgttccatctctaccctctgctcatcggacagcttgttgggtgtaactgggattaaattctattatgtaataatcaggaatcatatgaatggcttgatgtcctattgggtgtgccaaaagtgtgttgatgagaaaacacggcggcctgggagttcagcttagctccagtgcaggtccaaatctcgctttcgggttcagggcgttctagacgaaaaatccgcgctcagccgatggtgccgggactgtgttggcatgcactaagtcgacgaacacaacgacctgggagatcttcttagccccagtacaggtccaaaatattgatgagatgcgggtgtgccaatcagtttgaccctgtaactgacaagatagacaaatatgttgatcaccagagagccgatcggttgacaagccgatggagtaattccagctgatgccgatactagtcgatactccctccattccataatataaggcacaaccactttttttaatgttccataatataaggcatgcatgtatgtaggcaattaactatggcctattctccattaaattattacttttttaaatcctccactctcatgttctctaattctattggatgcatgcattgtatttattaggatgatccaaactacaagatgataataattatttcttggtcattgagttaggggtggttatgccttatattttggaatggagggagtaggtttttaaacaatcggctatatgtccaatgtagataatgatataaagaaaatcagttgatgataataaaataataatataatacagtagaatccaatcggctaacaatgatatgatagaataagtgatcccatggttaaataatacatcagctgatggtatgatgtcattaaatccaaatgattagataaacaatgaaacctttgttgcgatcggctaaatccaacttatatgtaatccttataagccgatgcaataactcatcggctgaaaccccaatgaaacccttattttcaatcaaaagcaggttagtattttatggttctaagcacgactaaagtcgatacaactcgaagtatgcaaagaaacataaagtctaaacaataaagcctttgactattttttaagagtggtggataccttagctaatctaatctagcaaaacaatttagccgataccggcaaaaaccctacagcagatcccaaccgatataagtaaatcgagctactaaactagattaactaagatatatgataggtagttaggcaaatatatcaaccgaaccagagcgatccaagaggtcgaagccttgaacaacactaatgtagccgatacaattgccagggccgacggaacgtaggacttaccccttcatcgaagatcgaaaggtgatgcagccacgcgttaggtgccaagttccgccggtgataagtaaaaacctctaaaaagagggtggcaatgtgctgagagtagttgtattgatctatatgatagtttaaaatgaccccaagtgtacatatttatacccatgggtagttactagtccttattggacaagaaagaaactttcctaaagataaaaggaaaacataaagtctttgtcgaacactaaatcgcctattaggtatgggataatcaatcatgttccattggctatagatgcaatcaaacaagtaatccctaatctgatgtttctctgagatgtaagcaaacggtatagatcaaacttaaccgagacagtgtggatagctcttaaatcagatcaaatagattggagattacatgtgtttatattatagtcgatgacacaatacttaggttaaaaagatatcgtattataaatatattaagagcaagcttgtccaagatataaggactagcttgctcttaatatacttaggttacatgtgtttcaataaagacaatttagccgatgctggcaaaacccaagaaaaggcttggtcgatataggtaaattgaataattaggttagattagccaagatatataatagtcaataattgtataggatagattagaacatctacaatgacatcctaatctgctgatacaaaaccgatgcgacaagccatacctcttgttagaagatcaaaattgatgccctaactcgaagcaagaactcgtcgagaaagttgaaaaaagtaaaaaggacggcgatacgccaagattattattgaactgttgttattttcctacgagatcctgggcatatatttatacccatagaagttaacttgtccatatcaaacatgccacaaactttaaaaaacatactagccccttgtggactctaacatatatttctaaaatacataaggaaaactgaactcttattctaattaatagatacagtttccatctcaggaccttttccttgtttggcaatatctctgaagcctcaactccaattcgatacgaactcaaaatctaactttatcggctgaccgagtccgactttgtatcgaccgatacgatctccagccgatgcgctgctctgttttgggaaccacttcggatctatctttatcctcgcgtatctcaccaaattttgctgttaacaggagctcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaggtggctcttgttggttcacacaggattccacgtttcccatgtactcggggttagagcgtaagctagtgatgctttcggctactggattttatccatccttgggacaaaaatttactaaacttggcaaaaaaaaaagatccaaaataacatattattaactagcacagaagtttcccatctcaaactttggaagttttacaatctgatatttcagaatttttggccaaagatttggaagttttcgtcctaagggtatttcggtcattaggaaaaaattatacattgctaacttgaccgcaatggtatattatagaagttaagtgaaatgcgatggtataccgtagaacttgacgaacctaatgacatattctaaaataggcacaaaatcagtggcacacaatggattctctctatttttttatgcttgttcacttaatactatggtacggcatttttagaaaaagtcaaatattatactatataagtcaaacattaaattatatacacttataatataattttcaaattatacaattcactattcacattttataggagaaatatagaataatgatttattgtctattgatttatgagaaaaatattagccaaaattaacatatacctaaaaaataaaaattaatatgaaagaatgagggaaaataataaaaaataagacatagtcatgatatatagtgcagtgagaaaaggagaccacaatcgaatgctttatcattgagcaaaattgagggtattatttttttttatctttttatagtagaagtctgtattgtcatgttttaacatatcatgagattattagtaatagttaagtagaccaacccaacaataccgcatagaaacgataaaactgtaatggcttagcatagcacgagactaccgactaatggacaaaaaatagtaaattcattttgtacaacatatttttaaaaattttcatactatatcattctttaatcattattttcatttacacaacggctaactttacatttttgtttcaatttagacaaccccattctatccatcttcaagtccagtgatttccaccattgcttcacctccaaatccagtgactctacaaccactccatacacacactctctcccctttttctttttccctctgatagctgggaactgccagatcatacgaggaggagcccagatctagcgtcttcgctctcggtcaggtcagctcctgtcatcccgagtccttgcaaggccgataccctcggcctcaacgatgaccatgacaatagcgtgcatgaagacacgagacgcggaaagacaaaacggtgattagagggtgcagttgcacatgcgaagatgaagaggaggaatgatggtggctcgtgaagaaagagcggtggttggcagtgcatggagcggtactgacataaatcctcaaccaaatttgttgtgttttttctctgtgaaccatcagtcattataaacaaaatgggtaacattactaaattcgacataaaggtgaggcactcgagtatcttcccccttcccttcgcgtgaaagagaaatcccccgactcgtctcctccgctccttgcgcggttgcgccatctcgtggctgaacagggaggggagctgatctccatctggcgagcagaggaggggatcctggtgagcatcctcatcctctttttgatgattcatctctctcccaccgggagtacttctgtctggaatttgcttgcgttaaccctagcttctcttgtagatctgaaagaagctcttcttcttaatttcagagccttaaccttaatacaagtaacagtttgtttgttcccaaaaagtttgggggttcaactgaaccctcatgtcccaagttggatccgcccgtgtcacctatcatgaatttgaagagcacaacacataaaaatatgctgctaggaagcaagatgaacatattgttctaaaaaaagttggtcctaggcaccaggtagctctcccaatttggcattatccattggggctcttgtgctgctatttagtgttatattgtccaatatatgtgtcatatacttgccaattgtttggaattcattagtcatgttggaccaaggcggtggctaagtgcccctaggcggctcttaccctgtcaaccctctagtgcctcttgaaccatggatggacagcaattgtgcttttgcaccaatgtacccaacacatttttttttcaaattaccttgagacttcttagtcctggatgcttttacacaatgctcaatgcgaagttcagtaactatagggtacatgcatagtaatggaatgtcataacaagttcaatagaaacatagaacagccaaaaatgtaacacatagtataattcgtttgctgttttctttagaacactattggtttgtgttattaacaagtttagattcacattcattgttctgaatataattttggaatccaaagcataataatcatagtaccataccatctaattagagcaactgtgacatgttgctgtgatgtgtgcttagtaccaggaaattgggaatcattataggtaggttatgattttgagtgattaaaaggggagtttttgttagtctgagttctagcagcatagtgaacgacctggtatgttagctgcatgttagcattcctcttggtattatcaatcagcataaaatgcaatatgactagcgagcttcactttgaagctttaggcccttctcttttcttgagctccaaacttcaacttcctagttttcgattagcacgctttcaaactattaaatgatgtgttttttgcaaaaacaatttctatatagaagttgtttaaaaaattcaaataaatctatttttcaagtttataattaatacttaattaatcatgtgctgatgagctttctcgttttgcgtgcgctaaagatctcgagaggaatcgaacacagccttaactacatattgttgaaatgtggatgttgcaatgctttcatcaaggcaatagatgtgacatggcagatcgttgtaaatcagttttactatggcagcagtatttccctgtgtcaatttctagttgcactttagtgtattgctacagtgattgctagctcagcaccacctttgtgttgtataaatactttgggtttattatatcttgttttatttccccaaataggactaattttcatgagatttggtgtgctttctaatgcagactgtttttgtgtgcatgtaggaagctgattttatcatctgaatcaagtttatatatctacaatatctgcacaaatggaattgggggacaaggcagtaggctttattttaaccttgacaagtctatccatctttacatactatactttctgggtcatcatcctggttagtaacttctaggcgtttttcatttcaaatataacatctatgattttatttctggatgataagctgttcctctttttttcaatatagccatttgttgacagtgatcacttcgcccacaagtactttctgcctcaagagtatgctattttgatcccagtgcttgtcggcgtgattgtcctatctttcttaagcgtgttcgtgggtcttgttatgctcaagtcaaagaaaaagaagaagaccacttgattgaatttaaccatatttgttatttgattacgattgcaagctctatacaagaaagcagttttctcatatgattccgttctatgtagtggtttttgcatgtaagtcgtagtttcagctttattattattattattattattattattattattattattattattattattattatttcatttttgctgttgggttgtgaactaaa

SEQ ID NO: 59460 - DNA, 867 bp, Oryza sativa
acctttgttgtttctgtcctcgaacaacggtcgatcgaactcctgatcctttgcatcaccctcgctgacaacttctcctaccacatttttccctcttccttcctttcgagtcaccgatgctcctaaatccccagccttgttttgccatgcttccttctttcctcccaaaaccttccttgaaccttcagctgatttatcccatcggctcacaagtgtgcctcccttgttgctccctgatcccgttgttgttttctcagccctgccagtaccgctgtccattgccctttggccataactgggcagattcgaccgcccggcatgatgtgctccgctgcgacctggccttccagcaaagcctcctcttatggtcccaaaacttctagcccctcttggcctgaagccctgactcatccaacctctccctcctccctccctgttaatccctaaaccaggatgaaagcgaaaatggaagtcttctcctccacctctctcctagaaaaaattgccttcctcctcccaatgtgaatcatctcttcttccccagcctcgattgccctgtcggtctcaatcttctctatgcgccatggtggaaacctcccgaatctgttgctcgctctccgttgtctgctctgtttctgaactgcttctttgaaggatatgggtatacgttctcacgggatacgaggggccagctgtatttcttaggataccaagcgttggtggctaacccaagcgtttcttcactcgttcatgctgcccggcccatgacagcagttggcctgctccaaagtggaacttgatttggactttatgtccagaccccaagtaaaactgtttggacggcccactatccttctttagtttgaa

SEQ ID NO: 59461 - DNA, 15770 bp, Oryza sativa
cgcgccgccgcctctcttatgaagccgcgtcgtgccggcgacggtttctctccctccgccgccttcgctgcctatataaggccggcgacccctcccattttgcccgatccatctgagctccaagctctccctctctctctctctatctccctcccccactctccaatccacaccggctgccactttccctttgcttctccaccgttggccgccgtccttgcctccccactgtcggctgccgccaaccgccatcgctgccgctgacgagtgccaaccgccgggccgccgccctctgcctccactcccttgtccctctgtgctgcgcaaagaagaagaaagaagaagagaagaggtagaagaagggatgggaagagacactgacagtgggccccaccttttaaagtaacctctttttattttatttcattttaacctttgggcatccatatctttttcttatttatttatttactttctaatttcaaaattattttaaataatattttcaaaaccattttattttattcaaatacctttttatattgtaaatttatttaatttatcttaaatatatttaaatttaaatatctttgatttatttgaaaaccctttttaaattcaagtttctttaaatgactctttttatttctaaaccattcctatacaatcctttagccaccaaaaagctgctgtgggaaatttcataccttccatggggacgctcgtatggtccaaggacctcgacgttgaatcgagggtcgtgaaacccagcataacctaaacccaaggtcgaagtgttgctgttcacaccccacgcttcgacgcgtacagtggccgaagctttactactctttcgacctccacaacacgctgcacactagtccttgggctatgtccaaccctagccactctgctatcactcacgactgtagagtagcactgttcatctccaaataaaattcccaactcactagtcattgtgctacttgactgtagcatcgactagaacgagccaatattcagccggcatgctacccaaccttagcatcggctaaccaacccaaataattagccgttatgccttagcatcggctaaccaactccaaatatctagccatcgtgctactctactctagcaccgactagaaaaccaaatccaccgaataaacctcacctatccaaaattatcctttctttgattttattcaatttccaacctataaaaaccatcacctctcttttattcttcaaattaaaagtttaatttaaaacccattcctttttcctctcgcctcgctccaattttatttattccttggctttatcgtttcttgtagcaatttttcttataggctttatttgccatctttttcgtattcgtacgttagaccgtacaggaagttttatcagcatccaaggaactgacatggacccagatggctacgctgaagccacgggaaatctcgaggtgcaaggcaagacataactaaaattttgatcatatagaaaccttgatataatcttcagatttaaatttgatgcatgatatttactcttttaacatctcatgggtagatgttatactttagaataacattgtggtaattggtaatgctttcaagaattattgcatgagcctataaaaggaagcattggttatcattttatgtgatttactattccaaacaactttacaaacttaggaatccggttaaaatgggcatttatgagttgagattatgaatattgaggtttatgaatgttgatatatgatgaagtttgttggtgtggggagtttggaaagttttggggtggtttaaccggattatatttacccccttataccatggaaatgacatagttgcgtccatccacacgatcaagtaattggacttagactagtacattatcccactatatgaaagagtgttggttggctcactaggagaaggattggggtgaatgcatgtgtaaggaggttgggggcatggtttacaacggtggaacccgtgaaagcagcgaccatgtagccttgcctaggcctagcaagtgcccgactgctaggatggatcaatatcccactcgtgcagtaactagtagtaaatgggaccttcgaacggctctggtgtcctcaaccttgcaaactgttgacatcgtgtgggtaaagctggacagtctctgcagaggtgaattaaatcattcgaatgtgccgtactcccggttttggagttgtgtcatcagggtgattcctactcctgaagtataagtagttttaaaaattaaaatgttgaggataaagatgatttatgatttttattacttctttactttattattgtttaatctattcatatctatttacacctaattatttataatatgtcttgctgagtacgtacataagtactcatccttgcataatttgacatatagttaagctaacaagaagactggaaggaagcaagatctacggcaacgacaagtttttcttctaggctagtctacactcgagcttttgcctgtggagttctttggagtttattagttgaagtttaatagtttaatactttggattttccttgtattttacaataaggatattttagtttggatcttttcaacctttaacagttgtataattagcttgtataaacaaatttgtgtaaataatcgaaagctattatgtgtatcaatatgtgcgtgatcgaaatcctggacgatcacgagtggatatttggggcaccaggcctaaattgggtgtccccacaaaaaggatatcagcttctaagcaaaatcactgggaagagatgggaatagcccaatgcttagctctatccttagccgatttcaagaaagatgaactaatgctgccagcagccaactacttttggtccaatactttcaatagttttttattcaatcatggaccaatgactccaactttgttagacataaagatgctgactggctcggatatcacaacttccatcaacccctttgccttaaatatcaggtgcactcataagttaaaaaccaaaaatattggaggttcgtctgggtacatcaatgagcacatggggacagggccgatttctgacagagaacacatagccttccccaccatgtggcttgaaagaagcatcttatgtggatcaacttgtggcccaacttcaaatttccaacattttgcccaagctctagtagaaaagaaaaaattccctttgggcaaatatgtgcaaggttcaatataccaaatgatgcattcagttgtcagcgatattttgatagactcaacaatcagctatggaggtccttggtggctaattcagatatggctcaatgtacacactaccatatatagttgccgatatagctgctctgtcagtgtcatcctttccagcaatctatgccaatgatgaaaatcccagcactcgtaggtgtatgtcctttggagaggtagcatcaccttacccaggcactaactcattggctaattcattcaaagtctggttcaaccgattactgttcaactatttggaaccatgcatcacaattatacaaatatttgagtcatgccactacacgtcccttcgctgcattttttaattctttgggaccaaattgcctccatcttgttttttcatcctctcctctctactattcatcttctccacaatgggagctagatttggggcaccttgcctcaatccctccacacagtgatgaaatccacgagactgagacgagaaaacctcacctctccaacatctcgacgtcgtcctctttgctgctccaccaatatcttcgtcttcagcttgaactccctctcatcgcaatgcttattcctcttgccaatggcgtttcttcctccagcaaaatggctgtgctctgctctccctcgccattgctcaccacttccatcctgctgccttgctgctcttccccaccagatgcaaggactggcaccaccgttccacgacaccccatcggtgaggctgggttcgtcggtgcgaagccaccacggcgttcctcttcgccctcagccgccctgcttccccactggccatagggcccttgcaccaccacgcctcaaagctccgccaatgtccccatccgcgcgcctcaaaccagaaccaattagtaatggcatggatccaattaacccgtgaaaaaatgtctgccctggccaatttagtaaacttgttttcttcgcggtaatttcgtctctacatctttcaagtattgctgaatcatagatgtgttctgaatttctgcatgtttctttatcctgacttttgctttcttatacttgcatggtgaaatattttatggcccactctactagcccattccaaaaggaacaaagaaaaggaaacacaagttaactagctttatccggcaccgccgtcaaatgcttgcacgatggggctgtgccgcgttgccccgtctatctcgccatcgccaaccagtctcgcttgccctgtgccgtatccgagccactggagcatcacatttgtttcccctcccataaaagccactattgcttccaacttcaaactagaaactgccacaataatgggtagactagaggccatgcatggttaatctcatttactctcttcataaccctccttccatttctcaaatattttggatagtcatggctttatctttttgcttatgcttattgttgacagctgttaagtatcaaagtctcgccgtcaatcactgcataaaactgaaagtataaaacatccaacatagtgggggtatatttccaacaatttccacgagtgttggtgtatatttggatgcaagtgacaaactacctaagttgagaggaaatatacatgaaggaggagaatcaaactcatatccaaacttatagagttttggacccaaaaacccaattaaacacctctaaatgggcccaaccaccatgccactggactgagggcccacatatcagtgtccaggaggaaaagcggggccaacggagatggccagggttcggccgaaccctgagttcgccaaaccctgacagaggcctaggttgcattcggtagtaactgcttctcaatgacggtttctaccgtctctggcgctccaaccgtcatccaaatggacacttggcatgaggagagtgaagatgctcataagattccatggaggatatgcacactcccaaggcacctccacctataaatacccctcatcatccttcattccaacacacagcaagcatgagttgaattacaagagggggagagagtaagagagaaagagttggaggaatcccggagttattggtactttcctctgctttaatagataatatctttatcgagtaatttgagatttactttgtgatgattatctcttagttagttcctattagcgtactggaatattgtgcactagagacagtgtttactttaatgtttgatcgacattagactagtattaaaatagtgtagacgtggttgaagcatctaagcccccgttgttaattttggtaattaatgacaagcgctaattgtggactaaccgttgtctttgagataattatattgagttaggttcacatcatgagtatgtatggatgattattgatggattaaagttgacggcgcaaagcaaaaggatagatgacggtaaactagtggttgaattctaaattgatcgaggtgttgggcaatcaaaattgtgctagtttatttatagctttgccgtactattaagaggggtaatgaccgagctaagagatgatttaaattgccacattaggtcatttgcatattcacttgtcctcacatttcaaatcacattttatttctttgtgcattcactgagattggcctgaccagggccagtctaaccgcttgctccaagccggtctaaccgcaggtcagaggccggtctgactggccacctagtggcggtctaaccagcatgactggccggtctgaccggcggcacttgtgcggtcagaccggccccctggaggccgggatggtgttgctctggtttgggcgatatagagccgacggagccgtattcggtctgaccgagccgaggccggtctgaccggccagggcaatggggcccaatgacagggctacaatggttagaaaactagccgttgtagagtagcacggtctgaccggccacacacctccggtcagaccggcagagcactgagttgggggatttcgcccccaacggctagttttggtgggtgggagtataaatactcccccaccagcagcaaggggtctctcttggcacccaattcaattgcatacaccccttgcacctctctcacacacatttgagcttagtgtttatccattgtagtggttgaggttgttctagccaagagtcaagtgcattgcttccattgtagagctagtgtggcacttaatcatctccgagccgcgtcatcgcttgttactcttggaggttgccgccttctagacggtttgtggaggagttgcctggtgacctctccgagaagattatggaggaggcccggtgctggtttgtgagtggtttgaagttcactaccttcggagtgaaggaaaaactaccccgagtgatcgaggcttgggtagtcctctccggtgggccggctcccgccttgcccaccccttgacgaagggggcgtgcggtggcttcgtggttgagcggtggagttgggctcgcctcaacggggagtaggaaaccggtgagtttcagaacctcggtgaaaaatctcgtctccttgtttcatttacttgttgcatttacatttgtgcaatttacattcctagagatatactagagatcatatcaccctaggattgctaaactagacttaggaagtgtgatttactttcctagtgatatacttgagccactttcaccctaggattgcaaaacataacttagttgcttagttagacttgtccctcaccgagcctagcaacttatgttagttttgattagatgtcatgtaattttaaatcacctattcacacccctctagtcgacatctcgatcctacagtggtgtctatattatttaataccagtatttgatgtgtatcccatagttcgttagaggtaggtgtagaggtggtgacagccctcgagattacttaagtcctccctatctaggtacagagtagaacacgttctggtagcagcgagcaagccagtggctgaagtattgtgataggattaaattaagctttctgtagacacggttcctccctaggtaatcctctctaccctttgcctatttttgctttgtatccttggatgaacttgaagaggaattgaatacacacattttcttggaaaatcgataccttggaataatcccgggtgaagtgctacatcggtatctccatgcgcttgtggattttatctatgaccgtaagaaatatcaacacttatatatgctttatccgacacagccgtcaaatgctcgcacgatagggttgtgacgctcccgttgccccatctatctcgccatcgccaaccagtctcactcgccctgtgccgcatccgagccactagagcgtcgcgctcgtttccccttccataaaagccaccattgctagcagcttcaaactagaaactgccacaataatgggtagactagaggccatgcatggttaatctcatctactctcttcgtaaccctccttccatttctcaaatattttgtatagtaatggtctcatcttttcgcttatacttatacttatcagtcaaaatttgaattttcaaccttaaatttggagttgattttaggatttttttttcatcgtagtttattttttagcatttgcttttagattatcaacaacatgtatataaaagttgtattcacaaattatttttcggttgtgaatatgttgttgggcttattccatgatggggctgtcagtcatcacgcaccgtcctccatcttaggagcaggcgtattgcctccatatataccttcctgcttaacagctcaaaaaacatccgttgcactacctagaatgctccattggttcacttcctagaatgatttattagttctgttcccttatttcccttgcatgaatacattttcttaccgtatattgcaaattttaagctatccgtccgtccagtttcatctaacttactaatctgcgtgctatttacatatacaggaacaagtttgatgataaacgaggcacacaattgtgccaaacgaggcgcacaaccactcatggtaacttcttatcctaggcacaaaacatgaaaacatgctgatcgcttaatatttgcttcattttattttttttgcaccgcttgcaatccagtgtttctttttctctatctctgatctctataatagaataaggtttcttatattggtctttatcaactaagaatcctagatgatgtcccgcgctttgctacgggatatatgttagataatggagaaatgatgaaatgatttagattgaaatattatgaaaataatttgagaatgatgatttagtatgtgtatgtttagttttaaaatcaaataaattgtagatacaattattatatgcttgcatgttgagctttgtatacttaataggttgatgtggcatgtttgcatgtagattttaggctcttttttttgacaaattggcccttttgaaaaacttatttcaaaactagcccctgccaaaaacttaaaccaaaaataggccgtcagctcagcgccaagccccttggcgctgaggttgtgcatggaagctccaacgggcctggcgctgacctcgtggcagcgtggcggtcaaggagatcacccagcagatatgtcagggatgtcagcgccgaagcggttggcgctgagatggctaagctcagtgccagatacattggcgctgaggtagcggcatatatgccgctgccgcgccgccccagcccgacgccctgttttgttctgctgtgaagttagggttcatcggccccctgcgtcgccctctctcctcccctccaaaaatctccccaaatccccctcaaatcgaagctccttagtgggcgttgcgttggatattgatttgcaaggtaaatctcctccaaaaaccctaccctaatttcctcaatgttttcctcattgtttgtagagttttttggttgaaatcgtgggttgttaaatgtggctcaggctgtggtgtggattagggaatgtgggtaagtatgcgacgttatagttgtatattgatgttagtatagaggattcatatatactttttgtaagttatgcactattttgctaagagtgaagttgagacttgagagggatgtgtattgtaaatattttggggatttatattgattaattttgatgttgataggcatagatattaggaacattgtgaccggtggttgtaaattcaatatgcattagaattgttccattgacttttaagcaagcacaaaaaggatgtttttaagcaaatctcatataagacttctatatgttgattcatcgggcatgcatccatgcgttgaggaccttaaagagatattggtgtattatgtaggcaattgtcagtaccatgtaacagaagtaatggagaacattagttgagcaataactttgagtgaaaagttagttctttcactactttagatttttttttcttgtaataaattccttactcatttttaattgttccatttacttgttgtcataattttattatgttccaattgtatcaattacagatgatttgatattgaattgcaggatggagtactttccagggttggaggatttctacgaggagaagcaccgggctcccaagatagcgagcggagaggttagccccaaaatgtcatatttcaattttttgcacaacttatgtgtatcccatgaattttggaaggtaaacgataaggaagtgaggtacagtacagtcacacatcaagtaaacatacgtatagcataatttgactgaaaattggagaaaataaagattaactttgaaagtagtccagatttattaaatcattcaagatggaagtgttgttctatgaaataaaaacaaccaaaaggtaaagcactaacatttggtgactgaagtgttgttcatatgtctcatgtttttgctaacactaccatgttatttgtgtctattgatgcaacacctcaaggttcaagtcagaggtcacacatcacacatcccattcaacgaccagtacattccgtacctacgtcgagcgaaccttttggcgttcgtcaccatggcgcagcggccgatgcctctatacaacgctgcggctttgacggcccttgtggaccaatggcgcttggagaatcacatgttccacctacccaccggggagttgatggtcacactggaggacgtcgccatgatcctgggtcttcctatgcggggctaggcagtcacaggtgacataagctcaaggaactggaggcagcgggtggaggagtacctcggtgtggagcctccagtggcaccaaatggtcagaggctgacgaagacctccggtgtgccacttagttggctgcgtgccaacttctccctgtgtcccgccgatgctgacgacgacacgttgcagcgttactgcagagcgtacgcgttatacatatttggcagtattttgttccctaactcgggtggagatatggcttcctgaatgtggctgcctttactagaggactgggacgaggcgggtactttcagttgggggtctgctgccctagcctggctctacaggcaactgtgcaacgcctaccgacaaacgagcgccgatgccaatattgctggatgtgtttggctgctacattgcagggttgacagtcggaagaacaagaaggtgactgattgggcttactaccatcaagatcatatcacgcattgggagaaacttgaagcgaacgtagtaccagaccacggggagcacaacaagatggagttcgatgcgtacttggcctggctccacaggaactatcatcttgtcctacgtccggcctggatgctagccgacatagcggaagaccccgaagatgtcgaggagcagaacgagtacaacacacgtacccgtgaaggtggcatggttgagtcgggacctattcgcaatagagtggtgagtactagcacgcgtatgtaatatgcacgctcctgctttaaccttgcgacttactgtatttgtaacctacaggcacgagagctcttgcggatcgtcaacgacgcgggagtggcgcttggcatggctcctaggtcggaaggagagagcagcaccctacgcaacacccaataggtactcgtttagtaagacatgaaactatgccggttttctccaaggcgctaactgaacaatttggttgcagagactacagcaacgatgtcggaagttggcagcacggctggaatgtaggtccaacgatgccgtcgatcaacctccgggccaccaaaagggggaggaacaagctgaagtacacgtggaggcggatgaagaacaagagggggatgatgaggaggcggacgaagaagaggaagcggaggaagaagaggaagtggagaagaagaggaggcagttgagctcggtgcctcgcagctggaggatgcaccgcaatcgttacaggccggtccatcgcaaaccgggttgtctcgaccactacgcaggcgggctccttcccaggactggtggtacactcccggtgcgcctcgtcctcgcactaggggtaggaagaggtaagacttcctggatggatggactggctgaggagtagatgtgtatatacttcctggatagatgtgtatggactacggcttttgttttgtgactatggacttcatggagtgatggactagatgatggatggtttcatggcctatgtacttgtaggaaaattgatggtttaatggatggatggaatgttggatttatgcattttctggatggatttatgcatcatggctttgatggatggaatggatgtaatttatgcatttctggatgcatggaataaattgattgattgatggacgaatagtggattgtctgtgattgcctgtgaaatagtgtaatggatggaatggatgaatagtgtatttttgcctatgaaatattgttgtctgggcagagagctggttgtttctggaattttgcaatcttagcgccagactacttggcgctgagatgtccaacgtcagcaccaaatacattggcgctaacatctggatgggctgaggagtagctttgccgccttggctaagtccaaccttggcgccaaccactttggcgctgaggttgtacatctcagcaccaaggcgcttggtgctgacttccctgccacgtcggcagggggattacctcggccgccacgttggcacgtggtcagcgccaggcccattggcgcttcaatgcacaacctcagcgccaacgggcttggcgctgagccgacgacctatttttggttgaagtttttggtaggggctagtttcgaaataagtttttcaaaagggtcaattcgtcaaaaaaggggattttacgagtgctaataaatactatgtttgcatgttgggctttagatgttcagtggacattaactttacaaaaaagaagagattacatgtactctgcccattacttatatagattgtgcagataaccgttgtatgatgattaattattaagactgcgttcgggaggcaaggttggggaaacaaaagcacacgattatattgtgattaattaagtattagcctaaaaaacttgaaaaatagattaatatgattttttaaaagcaactttcatatagagaaacttttgcaaaaaatgcttcgtttagcaatttgaaaagcgtgcgcacgaaaaacgaggaaagtgtgttgggaaagaggggaaaagaacacagcctaagagcaagtataatagtgagctataagtctactataagcttatgtggaggagagaggtaataaaaaataacacaagctccaagacaaatacattaaatgtataagtgagagatagagagaggagaagaaaattatagccaaccttatagctaatctagtatatatgttggctttaagatgggctaatagtagaaagtgagctctaagcaagctatatgctaatgtggaagagagagataaaaaaaatggatagtgttagctctcctgcaagagctagctctacacaagctccaagaaatatgcatttctgtgggtctagtcgtttttgtcacaggctttttgtgtcttctgtgtatggttttgcctgtttccctttagcaaattgtgcagttgtctagtttttggacccggttttccttataaacagggtcaactctcttcttctaatatatccggtagatctcctaccatctaatgtttcaaaaaaaaaagaaatgtgcattaaattcatagagtgagaaagagagagaatggaaaaaaataaagctaaccttatagctaacttatacatgttagtactacgtaagtagtgagctctactatttaaacttgctctaagagcaagtttaatagtatagccaactactagctccaattcatctataggcaatctaatagcttattcatacaatagttacatactacactattaatatctggtcccacctttcatacacaatgcgtcttggagtccgtgctatagttggctacaaatctgtagtccactgctcttctctcacctcatttatctccttaaaatatgtttgccgctggcttataggctgctattttacctgctctaagtgttttttattggattcagtttccagaactagcagttcaaatattttcttagagcaagtttaatagtccagccaactgctggctccaaagcatctatagtcaacttaatagccaattcatataatagttacttataaacatatatactacacaatcaatatttggtcccacctatcatacacacatgtgtcttgaagtctgtgctgtagctggctacaaatctgtagcccactgtttttatttcttttcttttatcttcttaaaatatctttatagctagcttttagtctgctattgtaactgctattacccctcttaattattcaaccctcccagaaatatgactcatgttgttgtgacattcagttagtagttttatctatgaggtcgtataaaatcagatgggtttgtagttagggtacaaatttcgattatttgaacaaccaagcatagtaataaaatctttttattactctggctaatcttatgtggtttactcatctaaatatattttctttgataattaggacatttaaattccacagcaacgcgctggatattatcagttaatactacaacaactgctaattatttactctaaatgtagggattcttgttaccatgaaaaaaattacctgtttcaacattaccacctgcggatcaaattaggagcagagattatgacctaaatacctcttattaaatagaatgtttatgagtggacgtgtagcggagtaagataagaaaataaataagatgtgattaatgagacaaatagatatatatcgtttcgcttattcgtggaataaaccaaacgacatattcgcaaacaaaaagtaatatgtgaataaaacttttatatacatgttcttagtgatttaaaagtaagaatcagctctaaatttaaattgtggctgataaatacgagtataagcatacagatagagctactccgaaaactgataagtatgagtatatgattgaatctgaaattgtcccttattctaggatgcagggatgtactttaactaggagtaaagaaaatccctgtttaattaacgccaaactttccccaaattctaaacttttttaaaattatagaggcctcaccaaagtcgacagatcccgtaaaagaacaaaacttgcgggacgcctccccttacccctaatcccactccacccaacgaggagatagcgcaagagaggagagggtttctgcggcggcgatggcggcggcggcgaacctggaggacgtcccgtccatggatctgatgaacgagctgctacgccgcatgaagtgcagctccaagcccgacaagcgcctcatcctcgtaggtccgtacgcttcctccggcctcccctcatctagcttccctcccttctctttctttctccttccacgctccaagatctggtgaggaagtaggagatccaactcgtccccgtcccttccttgctctaggctccgggtgtgcaaggcttggtggttcagatcttagtcgcttcgcctttttctgccccttttgtttaatgctccatcgaaagtctagtttccgatgttttccctttcctttgcaactgtagtgacatggagaagccgttgattgtgattcgggtaaaccaggtcgaagtgcgtgtggacttggtaccaagagtagaactgtttcgctcttccagatttcttgccgttgttttgatggattatttcggcaatgagtgcttgtttgatggactgatcttctaaaacaatcttttcttttattaggtaaattgcactaaattcttttagaatgtgttttcttgctctacttttctatgcgtatgaggctgaggaaaataacgaccttattatcctgaagaaattctttatgtcattgtggtagcatggaatttgtagcaattggcttgttccatggaactgataaaaaatatttttgtatgcattgaagtcacaagggagaaaagtagtatttctcagtgttgtggaagtcagaat

SEQ ID NO: 59462 - DNA, 10924 bp, Oryza sativa
aataaaaacaattctaaattaagtaaagaaaacttctctaaatcatcatcaaattcaacgtacagctaaaaacggagttttaaggttcgtgaacgataaatgtacaccgtatcacgttaacggaatggttttactaccgttaacgtatatacggccgattaatcggttggtacggccgtttttccataacactggtatttctttaaaaaaacatgaaatgcgtagctctttgcttaatgtatttgtgattcatgacatgaggtgaagagaactctcctggacctaactatggttttatgtatccatactacaatttatgcttactaatgaaattcaaatattgtatattgtttgtcgcttagtgagtagtgagttagtgacttcagtgtagatgtaaatgacaacgaaaatcttatcttatagcttttttgacttgtattcctttaatttatagactttcttttctcttgttttggcatgactggggttgagaagagtgttcactacaattactttcaacaagaaagcatgcttagactttcttctagatacagtggtaaaaatgatacattttgattgtatgttgaatccttcacaaaagaatgaaagagagcattttatggtgaagatattaggtccttatgattatcttaattggagcttgcaaaggccttttgactgtgatgcaagtatatgaaagatgtaagaatatgcaagctagctcatatatcttgataaaagagatactcttttaagaatcaatgtagcacaaatcataccaaagtcaatcatttttcagttaatgttaataataatctcatgagaagaatgtttttattgcctttctaaggggagttattcttagtataagaattgagcaagaagtggatgatcgcccctctcattttcattgttaatctgtgtactatgtgaagaatttgttttttcctaacaaacatttaatttcatttagtaaagcattatagcaaattagcaattgattgcttgtggtagcaacaactgactttccttgttgcacttgagtgttgaatttaaaactttaacaatcaatttttagttcttcatttgatcaattttgttaataaccaaacccaaatattaggctttaaattatttgcacgagggggtccatttgtttacatctgactagaaaaaatacccgtgcgttgcaacgggtgaagtctattttaatcttattattgttatatggtttacttaagatgaaattcactgtgagagttcgcttggatatatatatttttagaaaatcataagctgcagttaggagtctgattgtctcaagttagcatgcgagtttttttaaacagatttcttatatgattccttttgtattaccaagagtgaacgatcttaaaaaccgactcaaatacggatatgtatttccaaaagcaaacgaacttaaaaaccgactcatacacggatgacgtatcaaaataccagcaaaaacatcttcaatttttataatagtagagataagatggttgaaacctagacgaataacattatcaaattcaccctagtctatattttatttcagaaaacctctttacaattcttggttttgctgactatgcaggtccacctggctctggaaagggaacacaatcgcccattattaaggatgagtactgcttatgccatttagctacaggtgatatgttgagagctgctgttgctgctaagactcctttaggagtcaaggcgaaagaagcaatggacaaggtattgcacttggaaatcacccacataagcagcagataaaagttagatggccaaatgaatagccagccagctctgaactcctgatttctcaaagcaaaacatgttccataagtatttttcactaacttcatgtttgttagggagagcttgtttctgatgacttggttgttggaattattgatgaagccatgaagaaaccttcatgtcaaaagggtttcattcttgatgggttcccacggacagttgttcaggcacagaaggtattcgatttgtacttttattaatagttcagccaataaaaatatttttctttaggcaatgtagctatgttttgaactacactgtttactttcgggttcataatatttttcttcttcagcttgatgaaatgctggaaaagaaaggtacaaaggtcgataaggttcttaactttgccattgatgattcaattttggaagaaagaattactggccggtggatccatccctccagtggcaggagttatcacactaagtttgcacctccaaaggttcctggagttgatgatgtaagttgaatacagaaatatggacttaataattattatactttccaaatttattttattttgcgtggatttttggttcagcaatttaattgttggatattttttcctatatatcttgtacaattctttagacggtcttcataaaattatgtcacggtgtttaacctatgtgatatttatgtcatggtgtcttatctacataactatattatataattctatacatcaacaactttgtaaagtattcaatattgcattatcacatattagtttgccaaacatctgttataactgcattgataatgatacaagttgcataaggatttctgttagttcattatttcctttatcaagtttttttttgtttcttaatccatttagtgacatattttgtgtggaccttgtatcccttttgagtctgcatagttgtagatattttgcttccttgcaacaaatatttttccagttaataaaggaactaatagtatataaataatttattcatccagtttactattttctttgtattgcatcaacgtttcttctgcggtactgtttctttcactgccctttttctatttaagaaaactgctataaaatgttgactgatgctttcatttgtcttattcgcctaggtcactggagaaccactaattcaaaggaaagacgacacagctgaggttttgaagtctagacttgaagccttccacaaacaaactgaaccagtatggtgctctttctagtgaattataatgttttaaagtatttaggaaaagttggttgtttttttaggcattatgacacgtgtagctatttacagttcttgagagtgtctgcctagttatatcgttctgaccgtacggttcccatttgacatcttctggattcttttctcatgtgttctatgattgcatatcctttgatagccaagacttcgggagggtttcatcttgttctctaaaatattgctgcttgtgaagattcagtattttttacttcaatgttgatttgctcccaccaggtgattgactactactccaagaaggccttggtggccaatcttcatgccgagaagccaccgaaagaagtaactgctgaagtccagaaagttctttcgtaaatgtaccaccattttgagacgaaaattcgacagattacccagacacactgggtccggcttttagatgttcaaattgacgctgacatgcaaggtgtagactgctctctttttgtattgggtactcttatcagatttgatgagcacagtgctttgcgttgttttagttctaataatctctatggcattgatggaaggaacatttttttgtaccaatatcacagggttctttcacccttgagagttcccaaaaaagctttgcttatgattatgtgctgttagtgtgttcctatagtacaacattgcgttacgctagagaattttccgctcccaatttgcattgccataatcaagtttcttcgctgcaattgtgtggttatttgcatgtttgaattattatcaatggcaatgactccattatgttacaagatctggactcacatttaagtatagaatcctatatcctatatatcataggtggttccccactaagtgcaatcttataaaccgattccaaggttagaaccctgattcttgatccccagtgggggggccctaatgagcgtctcatcgtgtgggggcgtgggtgcatgactagctcgctccaactactactacaacaacagtactactatatgtatatatacgggggcgtgggtgcatgactagctcgctccaactactacaacaacagtactattatatgtatatatacggcagatcctttaacttaactgcacatacagttgagtcactgacatgtgggtcccactttgccatggcccatatgtcagtgactcaactgcacaacagttaagttagaggatgatatatacgtatgtacatactttatatacacaactttgttatggaataggttatagacttaataaattcgtctcgcgaattagtccaaggttatggaatgggttataggctcaataaatgtctcgcagggttatgaaatgtgttttggaaatgggttttgtcagtagtctacgtttaatacttctaattagtgtcaaacatccgatgtgacaggtgctacaaatttttagccccatccgaacatccccttacgttatcaaacacctttcagagtttccgcctagaatcatgatttatgaaatttctctttcaatggccacaagtgatcaaaaagttttaatggccttgggatatctagcaacttcctcttccaatggccacaagtgataaaaaagtttaagtggccttgggatatctagcaacttccttgccattccatcaaatgactgatatttattctccttttttttaaaaccaatcgtatggccattatttatggcatgacgtgactctttcttttttcattctttgatttctcttcctttcattctcgatgcgccaattgagtttttattgagatcacctcacgaaccacttccagcgctaagccaatcgctggtgaggctcgggagttatctccaattctgttaagattgattttaccgatcacaaaaacaaccttatctcttaatttgatttctgttaggaaccggataagtgggatttatccttttccttaacaaacagaaattagcctaaaaaatcaactgcatcaaaattgtgtaatttacgtgttgtaatagtgacataattcagcagtaagtgtgtaggagtgtcatggtgtttctggataattatgcagaagatcagaggggaaaacaatccgttaggctcaataaaaagtttcaagtttcaatgcctttgccgcacaagacaaagagggcttacatagggtcaatccatcagaaattgatatcaggaactgatttccctgttcaaatagtccacaaacatcctcgttgcgctatcagcatctgctggtgggggaggtccactcaagctgtactgccctgccagcttaatgaaagtgcgtcgcaggcttcgaagctcaggcagaccgactgatctttgaagacatatgtaacaaccagttaaggatataatggttctttgcttatactccctccatcccaaaaaaacaaaaaaaagacaaaccctgagtttccgtgtccaacgtttggctgtccatcttatatgaaattttttttataattagtattttcattgttgttagatgataaaacatgattaatactttatacgtgacttgtttttttaatttttttcataattttttcaaataagacggacggtcaaacgttggacacggaaacctagtgtttgtctttctttgggacggagggagtacaacggatagaaggtgcccctacctttgaagcttacatatcaaggcttcctcgtagcataaaagtgtggccaattattattcaatgtgcaaaactaccattttggaagtattttcacctacttgattttcaaacagttgcaaggtgaaagaaatgtggataaagctctatatgaaagggtgtttttgtatcagaagattattttacactagccagttaagattgctagatcttcatatactgcacttataatatataaaaaagaatcaattgacacacaaagcttaagagtatattgtttaaacttatatgtatacaggataaaagaattggctcaaacagtaaaggatatagttggtaggtcaggaccaagagaaatcttattcacgggaagcccaagaccacaagattgtgcttcaacaattgcattgatcacctcctgcaaatcagctcaaaaggtatgctgactaaagagaaatccataattgaaatatcagatatcaaccaaaatgactgtcattacctgcgttgctttgtccatctcgtaaagggaattagcttctgttgtccgagcctaaaatatcaccaaggctgtgtttagttcagcgcaaagtttggattttggttgaaattggagatgatgtgactgaaaagttgtgtgtacgacaggttgatgtgatggaaaaggactgaagtttggatccaaactttggatctaaacacaacccaaatcaggattcaattccaacagctacaggtacaagcataaatgcaatagcactacacttccagcatcataaagagagtacagtatctgcagaaagtgactaaggcattgattcttctgattttttgtgcatttacaccatcacatttagattttgacagaaattgtttgccaggggtacaaagagctaatacacaaaaaagataggaactaagctgtaagagtatatggtagttagagtcgtattaggataggattgatttgtgtggactccttccatatctgtaatccttccttgtctcctccctatactatccaacataagcatattcattgaagaacatatggagttaagactccatatcacaataccaagccaaattatgagagaatggaataatttggaaaatgaattatttggggattatatgatcacgcggcagtttttcaagaatagattgcacttacagtctgagtggctattgtaggttggagaactttcacatctcttgtcttagagtccactttcttagtcaaatatgatacagcctcagcaataacaggagacgattccattactccatctattcaaaatagtacaaaatcagttttgagttttgacattgcataaggcaatatgcatatctatggtaggtactgatatagatatactgattacctctagatggaaacaattcaaaaagaggagaatcccaacgattgcgcctatctggcttctcaaatctacttaccagatcatcgaatctgtcacaatagaaaaaactggtgagcggacaatagtacctggttatgtattgtattaaatgccagggacacatgctttgttatattcccaaggaggcaaaaataacaatggatttcatagcctataaagaatgccaagaagcaccaaaaatttgaatcagacgtgacaaactagcagcacgttccgtagggccaatattatcagttcagtttgttgcattagtttagattcttttgtcatcatattaaattggtgttaggagttggattagtaaggatcagtgagtaatgaatggggaaagcaaggattatcaatttattcacccattcctacctttcccttctatcccctgcaacccttcccccacaatactcttcttctgctctaacctgccaaagcctccctccttccatgattacccaatatgatctctagaccataatacaactacatgcaacatatctgtagtttgtggaatcaatctatagaactaaataaaaaaaactgagaaatcatgcagcatttcctcatttgaatttaataggtcaagaagatccaaaaaatatgaaatctctcacatacatattattatcatacgtgggttctcctttctcctgacgcttggtgttccattccctacaatggtccacttctgtatcacagaaaagctgaaataaaatagaagcaggaagttatcagtctgttatatgagttttcactatatcaaatggtgtaaaaatcatagtaaattgcgtattggaccacctttctatcatagcagtgttttttttcaccttgggatagcaatttttacaaaatgttgcacttaagacctacctatctaaccttcaggtcaagattcacatgcttgatcatagttggtactggtggagatggagctcaagctccgctagcttgggacatgctcgaggtcgacctcaaccttcgttaccctgccccatgcatccgtgctcaagactcattgtgcagtgttggttatgtgccccagcccccaatcaagctggtgcagccgcggatgaggaacttgggctagcatagactccatttgactagctgttggtggggcagaagtgtggagagatgagatccatatggagttagaatatcccaccatgattcattagctatgcatgcgcttgaactcaaactagagctctgccgtgccgcatcgagctcaagctggagaccgccagtgctgcactcaagctcaggcgctaacgtaggtcaagaacgtgggtggggcctgttcattggcgtggtgagcttgaaccaaaaaaggggagagagaagagaagagggggagagccagaggaagaagaccggttcaatgtgaaaaaaattgcaaagatttctggtccaaagtgaaaacaatgccctacctatctagtccaagttgcaacaatggttaaaaagagtggcccaatatgcgcttattccaggcacacacacacacacagaaaataagaaaaaaagagtccatgcaggactgctaacatgattctcagttgcaaataagcagattctcaggcacatgaattgcctttttgagggatttttgagagagagagagagagagagagctcttaatcttgggcttgatgccaggagaggattagtcacgctaccgcaaccacctaagataactgtccggacgaaacatgcctccaggactcttatccaatacttgatcatcagggcaactcaactaatcctagaaaaacatctccaaaccaaacttatctctagtccataactcaattacagcctgttgtgcacagccagtgaagcagctgccagtaggactcatgtccatgacaaatttaccgtgtgtctgagtatcgaaggaagtaagaccgaggatgcaaagaatccaagtgagatcaataaagtagtggatgccaacagatcaaaacaagatatgtggcaattccttccgtacactttactactccctccattttattatattatataagtcgttttcacttttttcaccctgccccatgcaagttttggaggaaatttaacatgaggtagaacctcatggaaaaaatcctttagtctttatctctcctcgaattcatgtgtttttcctgcagcccaatcaaacaatcattcctatgtttttctatgttttgcaatcctctgttttacatttccattcatgtcagaatcctatgcttttcttattcctccgtttttttcattcctatgattcaaagaggcctttataatatgaatggaggaagtatcttatttctctgtaaagcttattttactttgtttctcaactgtcattctaatttgtgggtcttaaccagatcaagattatcacacattatttacaaattaatattgagttagttctcttgttattgccatcaatgttatttgatcgctgattgatcctgatcaccaagggaccgaccaggaaaattaatcgtcgatcagcctcgattagtcgacctgatcagtactatgaatactagaacctatattctatatagtgcatagtataaagcaatcacagcactaataattgatggcaagatggtcacttgccctagtataaagcaaccagcagtagtagcacatattcacatgtgctaaaccctaagaattgttcaaaaggtgatcgataggtgctctgatcggacaattaattgtgcctgatcgacgattaattggaccaacaatttatgatcgagtgaatgtccctgatcggagtagtcaggagactgatcaggatgattaagcacgattaatcggacgatcagataacattgattgccatcatacatgatctttttcctccaaattggttttgtacctaacttgtagtgttaactaaaatccataccttgatgacacgtgatttttaacgctatgctagtctttgagtaaaactaatatttaaaaatctaaaagaatagaagtagacaaacaaggcagcaagcaggttaccacacagtatcttattccagatgcccgtgcaagacaccacaactcataccggtatccctgcatattataggtggaattgattatatcaaaatatggcaacacatgcacactaatatctcaaaatcatgtttcatttgaagcatcatgcgttaacaatatgccaacaaatcacagaatttactacatattacaattttcatgagaattcgcaaagcatgtagctgtttattagtaacgatagaactgacaacagaaagcaacacatatttacaaactagattgccacttaactgattcatgaaatacccatattgaaataacttgttggttggaaagcaaactttgccagttacatatttttggtattgttcaacattggcttgcgcctaacttttgcaataactaagttcagccaagtatgtcttgacatactatttgtggccacattggaagtgaggcaaattatataggaacttctcaagatctcattggtgacgcttgagcttcaagcagaaagatcaataaaaatgcactcatcacgtcctctacatggcttcagcttgcattcatttgctaccctaactatgactacaatcatacttggcaaatatttcttatttttccaacttaacgtgctaaaaaccatcccacttaggctttgttcagttaatttttgtgccaaagaaatccgcaaagtcaccagaaatgatatcgtgcttgaaaaccatcccacttaggccttgttcggttaatccccatgagg

SEQ ID NO: 59463 - DNA, 7252 bp, Oryza sativa
  unsure (1)..(7252): unsure at all n locations
acaaaacgtagaataagtaatgaacacaagtaatggctaatacctttgtagctatcattgcgtccaagatggagtgatgactcgtcaatgatacggacagtgaggtcagatgtggaggagcagagagcagcggcgagacaagctgcagctgctgacttaccactgcaaggctgcccacatattaccacaagcgccatggaaaatgtatagacctagcatatgaagataaaatgtatcacaagtgtttccaaggtttaaactcttcactagtaaatctttcaatgatatagcaattgagaaattttcccaaaaaggtcagatgcatgccatagccagtctcaggaggtttgaagtctaactccactacaaaggagcagtaaaacaaatgagaatgcgaccagattgtgatcagtcaaatatcacaatcaggcgaatttcaacaagttcttactagttcattcaaataaaactaatttccattgggataaacatcaccaccaagcttcaattgtacacattgatgcaaaataacgtgggggcaacgggtattttgcttgcaaacaggaggggtgctattagttctacacctcgcatcaaagaaatcatcactgtccgggtggatttccaatccatatgccacgcgaggctcactgctgaggaggatgacgatgaaggggaggctacgagagaagaagcaataccttcgattccgtccgaactcagacggaggccggtggaaggaggatggccgagtcgcccctccaaacagtggcggaggacggaaaaaaatctaggtatgggtgtggcccatggactagcgcgagaattagaacataacaagaagaaagggaaaaaaacaatttcaattcacgaaattatatgacgcaacattatcccatcatgacgcaatctcaattctcaagcatggcaacaagcaccagtcataagttcacaattcatcatccatttgccaaaagtgtaaatagaagaggcactcataaataccagaagattgcagttgtcaacaatacatcacatgtaagaacgaactattgaggatagatagacatgtagtgatgtagacctgctgctgccctgcctgcctcactgcctgttgccggctgccctgctgcgctggctgcctgcctcccgcggccgccgcgccaatgcccagtgcggccgcaccgcagcgcgcccacgccgcctgcctcccagagcggccgcgcgcccgcctgccccgccggctgcagagcccccaccgaccaccgcagctccctgtcgcagtgtcgccgtcggccgtcggcccgtagcgccgcgccgccgccgcttgcctcctcagccggatgcctggattggattggggattggggattggggaattttggaggtagggtttcatgttcaacaggtcaaaaggcccattacacaaaaaaaaaagcccaattggttggcctgttcgcacgtgggctgtgggcaggattggcttcggcaatcggcagttggacgcctcgccgccggctcgagcgtccgggctgcaacggcgcagatcaatcctctgcagggtgccggcggtggcggagcggaccgtgcagaagctgggttggaggtcgtgcacaatcggggtatcacctactccctccgttccaaaaaaaaaaaactcaattcctaaattttcgtgtctaatatttgaccatccgtcttatttaaaaaaaatttaaaaaatttaaaaatataagtcatacataaagtattattcatgttttattatctagcaataatgaaattactaattataaaaaaatttcatataagacggacggttaaacgttggacacggaaacccaagaattgagtctttttgagacggagggagtatggctgaggctgatgccgacgagcccagtgatgccggacgcgctatctcagcctgacttcgccgtctcgcgccggcccagcctacttcaccccgcgctgctctgcgacgaccgtgattcggtcagtcccacgctctcgcctctcgctcgcccgcgcgcaccgccgccgctcgctaatcgctagagttagggatcgggagcagtcaacagtggcttgggttggaaagtttgcgggtagaggtgtcttcttacatgttgtcccatttaatctgggtccacctaattgacatctaaattaggagcattttaaaaagtgatggcaaaattacaaagtttagaaaatagagataaaatcatttgcattgcaaatgaaagtaggggcaagaacatgattctccctatatatattgttagagttggagaaagaaatggaggcatggtggacgaggtttagccgcgatgtcggctagtgtggaaaaaaagtcaaaaaaaagttttcatctggcttttcaactaaccgaaattaatttgattataattcggttagcactctcgattaactggcattagaaaagaggcctaattatttatctcgatgagtgttaagttgtaagttaaaattagtcaaacaacttatgttctgtctcaatttcgaccaaaattacattaagggcataacaaaatctttcaatcaaaattaagatacataattgagatacaaaattagtataaattcatgctaatttcattgccattcggtgaactattccaaatatttcaccgaatggccatgaatttggcatgaatttgtactataatgtaatgaacttatttgattactgaatttggcaaaatggcatgaattttcgcatgcatggcaataaattgtactgaatttgttctgaaatggcaaaatggcaataatttagcatgaatggcaagtcagatatagatggaactagcttaaagttgaacacaaacatagatcccacataatgtctagcacataatcttaaatttacatggtagcagcaccattaaaagtagaacacacaggtttgtgtggagcttgggataccaggagcaaaacataaaatagtctagacatcaatctacataaatagtcttgacatcagcttgggatacctggaaatgacaggccacatcacaaaatacataatatttgatattgttcaaatcgacgtcagtcttcatatcctaagcttcttccttggagtaagggtgtgtttagttctttgggtgtaaagtttttaagtatatggacacatatttgaagtattaaacgtaaactaataacaaaaacaaattacagattccgcatgtaaactgcgagacaaatttattaagcctaattaatatgtcattagcaaatgtttactatagcatcacattgtcaaatcatggcgtaattaggctcaaaagattcgtctcgcaatttacatgcaaactgtgcaattggttttcccatattaaatgccccatgcaattggtttttggccaaaaattttttggatctaaacaaggactaaactttcttggagaccatctaggtggcttataggaatgcaaattgctaaattgttagcaactgaggcagtagtaaggaatatagtagttttgataacattacctccttgtaggcccatcagtaggttttttttgtgtggctaggaatatcagagctattcccatactttacttttgtagtgttcctccttggcttcctcttcttgcaagttttcagattatgtaggacataaaggataagtagagaaattaatatagatagattaatacttgccttttctttgtcccattaagatgactgttggtattttcttaacaacattgctagaaatatgaattcccggcaatggcgcaaaaataatcctggtatatttatggttacagaagtaatccgcaagcgcatggatataccattgtagcatttcaccgaaaatattctcatatttatttaatctcaagagaagatttataagaaagaactatgctaataatttatatacattactcgtatatatcaaagtctaagcatgggttaattcagatcatatgggtagaatgacacaaagcagaaggacttagattctctcatttaaataattttagactatctggaagaagaaatagaaaaggtaattattcatatacttctaataaacactcaactttagtttacatttgctagtatacaattgtgtaaccaatacccctaatagtgccctcctggtttttcgaaagaccaccccgggttgccgagtttcttacgacaacctgtcatagtggccgtccaacggggctaaatacggaggagtaccctccccaggaaagtgtcttaggaatatatatcaatgtggaggaatacccgtgctgaattgtcaccatcagcggcccgtcactactgtcccacagcatatatgtctaattaatgatatctaataatctaagcgccatgcttacattatcaaatactactctataccctcgagaataatatagagcaatcattcgcatgaacattaaaccacaccactgcacctatctggtaggctagtcacacaactatatcggcacaaataaaaatgaaaaccagtgctcaggcaaagtaaagtactgaatatataaagaaggatattctattaattctgaaagtcttacaaaagaagaaagaaaagctactagagccatacccgaaatcttccgaagactcaaggactctgagaactattctattgtactccacttagcactagagcactaaactaaacttgagagagagatcaaagcttcttacttgaggtgtgtagaaatgaatgaagtgacccctttatatagccttccaatgacagttaaaacggttggaattgtcggaaatgccccccaaccgtcattacggaagcatcttgaacgtacacgtggagggccgagctgaggcgtcgttggcagggttccgccgaacctaggccagcctagcaggcctccaaattcggtcgggggatgataggtgggtcctcatggcggttgtggcaattatgatggttttcaggatggttacacctgacttgtgagcccttctatccttaagcttgcttaggagtgagtttttcttcatttcttcaccatttatgtgctaatgatgaaccctgagttcctctcaacactcaaggctgttgttggcccgatctttcggtgagttgtgataactacgatttgggagaaacgttgacgatccgactacaaccgtacgagacgttgtgttgcgccttagcgatcgatacacctctccgtaggttgttgatcttgccggtgcagatcaaccctattcctgcaagcaaatcgaagaaacaagcaagaacaagaataaagcaatctgatattgcaaataggaatttaatacaaatgataagttggggttccgaagaacaagcagacggacggtctagccgacacgcgcgctgcaagcaagtagcaatggctaaactttaatctaacaaaaacccaagaaaccctgaaggggtacctaactatttatagaggtgggaggacgactaagagggtccaagggtcgtgctccaccagattggggcgcaccccacatgggccccacatgggccagggtcccaaacaaagttacaagcccattggcccaatacaggagacgcagcaccttgcttttgtgattgcggccaaacgagatagatttccgagatgaggctggatccgttggaaggaggacttcgagagctttccatcaagtactcacgggcccaaaacggagcacgtatgtagatttggcggccgtttgaagtcagcaatgtaacacgtggccgaatcagattgcagcacatggaggacttgatcttgatgtcttcttgttgattcatgatgtgagcaatggtcgtatccatagtagccatggtcacatcatcctccccttcttcacagaaaaccgtcctcggtttttccatatggtgctcttcgcgcagtccactgaaaacaacctgtttcttgcaatcaaaacaagacaaactcgagacaatatgattagcagtaacatgtctctctagcttgcatattttatccggaactacaagatgttctatatctgaacaaatgtaaactctatgcaccaaaaatattcctctatcattatattcgccaaagatatgaaaaatagcattagttggacatggcaaatcagatttagcaaataatttctccttcaaattatcgagctcacaaaaatcatcaaactgaacatagcccaaagtatttaaagaagatagcattcgcgttcctctacttcattagcaatgtgaacaacatgcttagaatcagcacacaaagaaatagtagaactaacatgttcattcactagttgtggcatggatataagtgaaacattatcacacaactcttctttatcacaaggaacagcaagtaaatcaacttgtgacaaaggcaactcagtaattgattccactaatggttgctctactatagcatgaaaagtggacaagtgtagctcaccttgagaatactcaccttcatttctctcagcaccatttaatttaccttgcgaactttcttcagataatgtagctgcatcagccttctcctcattcgcgagtgatggaagtgacatctcaaacatatcgttcttctcattttggagacttttctgaacttcctgcaaaacatcagtgataggaggcacaagcatatcttgttgctccattggattctccaaaattttgcgctcaacaatgcaagcaagcatgaacaattggcctatatgattatatgtcacattaacaagcccagcctgaatattgaaattaagccctctgaaaaatctagtcattgtgttctcattagattcttgtaaaccactataagtgatacaaattttaaaatcatgaaagtactccctaacagttttgtcaccttgttttagatgttcccatttctcaaggagagcacgtctatagtatgaaaacacaaatctttttctcatcagtattttgcattcatcccaagtttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 59464 - DNA, 2752 bp, Oryza sativa
  unsure (1)..(2752): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgcccgttgtcggtgaaggcacggttggcgccggcgacgatgacggggtcaagctcatcatcagtgtcagccatgaagcgaacacaggaggtcgacgatgcgcgagcacatcaccggtggtgacggcaggagtgaagacgccttgaccgtgcgggccggtgtgatgaccgacggcagcgatgccatgatatctcccaacagaccaccgaacctcgtcatcaccgatgatccgccacccttgcgtgtatgctagctgaaatggagaagacaagagacaaagaaacaaatagcattacacatggcaggtagcagcatcaccgccatgtgctgccgatcacgacgttccacctcttcttctctgtatgtgtgtctgctctcggcggcgatatggcggcacaacttgtgctgcgtgtgtgtcagtctctcttctcgtatgcctctgcgtttctgtcttctcccctcctccttagcacgcctcctcgccggacgccgagatactgcggccaacgtcaccggccgccgagcacacgcgttcccgccggacgccgagatactccggccgaaatggcgtgtgcctctctctctctctctctctctctgtgccttttcgtgtgtgtgttctgtctctgtgtgttgtgtccctgtgtttctcctgtccccctgtaaaatgaaatggacaatcttttataggggtgataagtcggttcacaggctagctcatacatggattagtatctgctcaaccagccagccgcttccatctataagccaaatttccatttagcaaatatcatgattatgataattccattgtattgtgatatgattattgaagcttccattctatggtgatacggagagtagtatttccatgtgaaatctcaggtgcttgctgctattatctgtttcgtttccaatctgacgtgatatggatcaattttccttgtatacttatacgctcacgcactgctcatagaaagaaactttcatatagagctatcttgcccttttgatttccttggtttccatgcaagcatgtacgtggtttccatgcatatgatgtgagagattaacggccggcaaatcatgtgattaacttcctctaatgacagtgatacagtggcatatgcttccattcccatgaaaacattcacacctttttccttccatcagccaaccatgaaattggatcgatcaccctatatcaaaatgtcgcgagtacgtatatactagagcagccgacggcaagtgtctcacaatattcatacgtatacgccatgtacgccaggttgtgttattagtgataattaatcaccaatttcgttattatatcgccgttcccgaaattaatactttgacacacttcatttctttcatttataaaaaaaatgtacaaaatatcgtcgaacataaagacagaaaaatagcagttaaatctataaatgatagccgatcggccagttgccgatgacatatcatctatctttgagccaatgttgtatttgagtcgatcgcaaatataaataaacaagaacgaactaaatctattcgatcagctgtggttattaatgaaatataatcctaatatcgatatatacttaaatcaaatgattgggatagatcggtcgccatgccgagacaatataaatcacttagatcgaaatatatattaacaagaagattataagcattcatagcgtagtcgattagatagatctagcatgtatcggctaatacttcgatacaactctatattgagatactaagacaagcagaatataccaaacaagaagcttaatatacctaaatgcagtaatatcttaacataaagggcagatatagcatatcaattaagcacataaaatatgaagctaaatcaggtaagatcggttgaaaccccgacactaccctaatcggcaaccaaaagcaggctagagattatgattctaatcacgacttataagatcaaactcaactgatacagctataagtatgaaaagaacaataaaaatctagacaatcaagccgttggttgtttcataggatggtagataccctatataatctaagttaacattgatatttaacctaatcggctgccttccaacgatagatgttagccgatttgaaggttagataacgatattgtcagagattatatagagcatatgataactcgacgaattacataaacaagattagagtatcataaagatggaagcactaatcctgagaacgcaagccaccataacaagttttacctctggttgaagatcgaaaccaatgcagctcaacccgaaagcaaaaactcgtcgaaagtaaacgaaaagtaaagggtagcgatgcgccgagattgttattgaacgtgtgttatttgattacatgggttcgggtcatatttatacccaagatacaaaatatgtccttgtcggacatgactcttatctctaacaaactctaagataccataagtctttgcggcagacttttgcctaaacttatctctaaggaaattacataaaatatcctaattaatagatacaattgcctcctcaggactcaatccgtgcatggcaatccatatgaagcacattaactcaatccgacaacgtg

SEQ ID NO: 59465 - DNA, 2427 bp, Oryza sativa
cgactcgaactctggtgatcctgattgcagccgattcagactttagccgatcctcgctctgtttccgtaacgatctccatcctggattctgctttggttttatcttcatctccgatacttgaattatcaaatttggttattaacaataggtccaaggggaattcgagttttctccattttttaatggaaaatcaccacagaacttcaagcaaaatggaaatttcttttttttttgaaaaagaaaagaaaagtagctattcctcaacgcacaatcccaaccttgtaaacatttaattaggagagtaactatacatcgctagatatttttttaaaaaaaatactttcaatagtataattagtgtttaattatattaaaactatcatgtaaccaatatataactcgtatataacttaaaaaaacacgtttgtacttagttggctagcaccttgagcatccactttcaactgttgcaagttttttttcccaccctacatgactcgaagcaacccaacatttagaaatttgaaagttctagaagaccaaaaaattttctaatgtttagtgattccgataaccatcgcaagtcatcaataatactttatgtgattgatcattgatacaaaacaaatccacccgacatggtgtcagaaatgttgtagccataaaattgcttcctcattttttttgcatatggttcgtatcgccgatcagacagatgacataatagcgttgcttaattatacaaatagcacgaatacactaactaaattatttaccctactatagtttatcaactgcagtcctatagaaactttattcattaaatccaacgacctatatcgtccaacccaacgctccaaatcatctcacgttccccctcctctctctcccactttgcctgcacgggtcgcacgccacccccaccatgcgccgtatctcgcatgcgttgcaccaaatcctagctcaagtatgccgcagcccgcaggcgctgccgcgccatgccccccgaccctcttgccggtctcctcagcgccaccgtcgcgctgaccacatccccttctgtaccgcggcaccaccgaagactgtgtcgtggcaggcgtagtgctgggggacctacacccacacccagccatcgatgagctcctggaggtggagggcatctctcttgccagtggcctgacttctccctcctcggctcctcacctacgccgacctcctttcctccgcagcctacctcggagtcacagattgtcaccaccaacaaggtcagttcctatcacccctgctccacttcttgaagagctgttccatttgatgatttttgtggcagcagagcatatatgtgagcctgacagggaagctcgaggacgtcatgtggcagccatgcaggtggccaactcgacgatggcaggcacatcaggcacaactacaagagattttatgataagtgacgtttcatttacgtcacaaacagtgaaatttacgtcatgttatgtaatctgtgacattcgtcacctatcatgcgtctctaatggcgttctatgacgaaatcttattttttgtcattaatctagtgacgattcttctgtcgtgatagagttatgacatccattttcgtcaccatcaagcctaaaaatcgtaatgagattctatgtggcctattaaggtccatatagtgagcaacttgtttatggggtagacctattgtaagtccaattagattttaataaattcagcccaattatactatatccatccatattaagtgggccatacatattcaaaagggccaataggcccaaccattgcaatgaaattgaatctaggccattgtcacgcccagaaattcccgaatagaattccaagcagaatgtgcattagaatccccgtccaggaccggccgaggtacataaacgacaaagtttacatacagatccacgtcttacaaatattataaaagtcttacataaatgcagcggaaaattaaaaggcaattggagctaagcctcgacttggactgcagcgggaacaccactccacaggcatcctcgacggcacggacggagtctactcctcggagaaacaaccatctgacgcatactcaaactctggggtttggggaaaatagagcaagactaagtacaatcaccgtactcagcaagtcataccggaataggggtatgatgcagggaattatcaaaggatagccatagaggttcttttgcataaagcgagcatttataaacagtagttgaaagcagaaaaacagttgtagtaattaatcaatattaaccatccactgtccaacgctacaccacgttgcaacaggcccaaccatccacctagactattcaattccattagactagactagggtgagactaatcacggtgaatctggttgaccgcccagaaccgcgggcacgg

SEQ ID NO: 59466 - DNA, 2473 bp, Oryza sativa
ctgatggtaacgacgttgcggatgatcttggtcagatgttgcaggacgccaaggaggactgcgaaagtgaaaagggagcccataaattggacaagatgttagaggaccacagaacttcgttgtacccaggttgcgagcaggggcacaaaaacttggataccactctggagttcttgcaatggaaggcaaaaaatagggttagtgacaaggcatttggcgatttattgaaactcgtcaagaacattcttccggagggaaataaattgcccgagacaacgtacgaggctaagaagatagtctgcccgctaggactggaagttcagaagattcacgcatgtccgaatgattgtatcctatatcgcagtgaggagtatgagaacctagaagcatgccctgtttgcaaagcattacgatataagattagacgagacgatccaggagaagttgacgggcagctaacaaagaagagaattcctgctaaggtgatgtcgtatttccctataataccacggataaggcgtttgttcaggaacaaggggaatgctagaatgatgcgatggcacgctgaagagcgtcaacaggacgggatgctgagacaccccgccgatggttcgcagtggcgaaacatagacagaaatttaaagaatttggaaaggatgcacgaaacatacggtttggttttgagtacggatggcatgaatccttttggagagatgagcagcggccatagcacctggcccgttacgatgtgtatctacaacctcccccctggctatgcatgaagaggaagtacataatgatgccgattattattcaaggccccaagcaacctggtaacgacatcgatgtgtacctaagaccactggtcgaagatcttaagctgttgtggaagaaggaaggtgtccccgtgtgggacgaggacaaacaggaggagtttaacatacgagcgctgctgttcataaccatcaacgattggcctgcacttagcaacctatccggacagtccaacaaggggtacaaggcttgcactcactgtatggatgaaacagaaagtacgtatcttaagcactgtaggaaggttgtatacatgggtcatcgtcgattccttgcagcacaccactcggtacggaagaaaggcaagcacttcgaacataaggctgaccaccgtacgaagcctaaacatcgcaacgggaaaacaatgtttgctatggttaaagatcttaaagtagtgttcggaaaggggcctggaagccagcctatagagagcgaagatggtcacgcggcgatgtggaaaaagaactctatattttgggagttaccctattgggaattcttggacgtacgccacgcaatcgacgtgatgcacctcactaagaacctttgcgtaaaccttcttggcttgctaggtgtatacggaaagtcgaaagatacactagaagcacgtaataatctgaagaatatggaacaacgcggcgaccttcacccggaaccaaaggagaaaggaagccattacttgagtccagccagctacactcttagcaaggcagaaaaggaaagtatgtttgaatgcttggagagcataaaggtaccatctggatactccacgaatatcaagcgaataataagcacgaaggagaagaagttcacaaacctaaagtcccatgactgtcacgtgttaatgacacaactgctaccagttgtaataaggggtatccttccagacaatgtccgggcaataataacaaagctatgtacattcatgaacgcaatttcgcagaaggtcatcgatccggatagattagaaacccttcagaatgatgtggtgcaatgtctcatcagttttgagttgatatttccaccttcatttttcaatataatgacgcatctgctttgtcaccttgtgaaagagatcagtattcttgggcctgtgtacctacacaacatgtttcctttcgagaggtacatgggcattctgaagaagtatgttcgtaaccgtgctcatccagaggcaagcatcgccaagggttatggagcagaggaggtcatcgaattttgtgtagaatttatcaaagatcttcgcccaatcggggtacctgaatcacgccatgaagggagactacagggaaagggaactctcggaaggaaagcaataatgacggtagacaacaatttattccgtaaagcccattccacggttctgcaacaatcttcattggtagctccttacatcgaggagcacttggctctagttcgcgccaggaacatcggtaagtccgatgcatggattacacggcatcacattgatactttccccgcgtggatacgacaacatctcatgggtaacaagtcgatcaaccaacaacttgccttcctggcgaggggaccgtctggatcgatcgcgacattccaggggtatgagatcaatgggtacacattctacacgagagctcaagacatgatgagcatgaaccaa

SEQ ID NO: 59467 - DNA, 2857 bp, Oryza sativa
cgccggcccgcgtggcagccacgtaggcgccacgtcggcgccagctcggccaagaccgggtcgagtcgaccccggtcagccgctccctccggcaccgctcacgggcgcggtccaccgcgagccatgaggctgcgcgtgggcccgccgcatccgtgccctccgcgaaccgcgcgcgtgcgccgcatcccttccccaaaccctagcgcacgccgcatactccctccgcatggtgagccgagccgctgacaagcgggtcccacccgggaccacgcgaggtgagcccggtccaccggctccctctctcctcccctcccgcgcgcgctctgggccgccttctgggccggccggcccatttagctcggccgagccgccccttttctctcgggccgcgccctagccgcccgagggaagtctaattcccctccctcttccttttctttttccaaaagggtttaaataaattctttttcctttagaccaaaaaaccaataatcttagaaattcaatatgttcccaactgtaaatccgttggactccgttcaacttccataattcctcaaatctcgagatctatctaatggcatgcttagaggtcattaatagggctttatttttcgccgtttgttgagttgtcccattttgcgtgtcgtttcggagcctgaagacccgcagtgcgaggatttcgaggatcaagctcaagatctcgagcaaggcaagccacctttgaacatattgagccaatatttgaacttaattatattgcttgcaaaatattatgcattgataggattacacttaatttgtttgcgctgtctgaaaggcagaccggtgggcctacccaacttgttgcatctgatccttccattgttaattgttatatcatgttcccttgtaaccatctagctgcgcctcgatattcgtgcactctgtgcgagtatcgacggtcgccttcaaacttaaaatctgagtaacttcttgggtaaaacttgggttttacaaaagacttggaaaacccgacacctgggtcggtgcttgcgaactaaatgaatttccaaaaccgcggaccggggaacgtaccgggtgtacggtttcccgctcttgcacataaggaccgtttccttggaatttcatccaaacataagacaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttagtctgggacccctctcgtcggcatatggtaaacctgtgtcggctttcgaaatgccttgtcatgaaaacttggaggtctcccgacgtggctgatccccacgggctgggtgatccggttagtaatgtcgtgtgggtaaagtgtaccccctctgcagaggttaacaaactgttcgaacagccgtgcccacggttatgggcggatgtgaggtaattcctagcgtagttttgtttgactactgccttgtgaaactgctgttgtggaaaggggatcgatgttggaaaaatctgcagctgatgggatcagctaggcccgggtggccatttgaaagttgttgcccgggtggccgtttgaaagttgttggccgggtgccaatcttgatcaattctaaggactgatacattgcacatactccgaccggacgagacgcactgtctcatccgtgtcgtttgagaagcactcacttagttgatttcagaaaagagttcaaataaaatcaatttgcaaaaacaacagcctttccttgaagcctgcattaaacacttatttcccatggcttgctgagtactcttgtactcacccttgctctatataaatatccccccccaattgctgaagaagatgaagcggatcccgctgacgaggagttcttccaggagcaagccggctacgatgagttttagggtttcagcctagttcccaagtcacgcctgtgatgtttggtccaagtcttggcttctgcttcccttttgtaatgcagttgtgagctcgggatctgtccgcagcccaacatgactgtacctctactctataataaagagacctctgttgctgtgatattctgtcttcctgtgataccagcactgtttcctgggactggtatcgattaataggttaatttggagcatcacgggctagttccggtcgggactagttcggggcgtgacacattcatatgctaattataattgactagagaatttttaaaagtttcaaatcatgcatgtggcatttacatatgttaattagagtttttcacaatttaatttactatcattcatatgctaattatatttgactattcgaatttttaaaatttttaaatcatgcatgtggcatttacatatgttaattaaagtttttcacaatttaatttaatataattcctttgctaagtatatatgatgattacaatttttattaattttaaatcatgccgtatgtatatacatatgttaattagagcttttaccaatttaataatatcattcatatgctaagtatatatgattattagaatttttattaattttaaatcatatatttgcttattaagttttatccacttaatttattatagacaacaataatttttcgaagtaattgtcattaatctttgtactttaaataattgtaatgcattatcttctattttagaaacacatatgtaatggaaaataatatttagtgtgcttatcagtagtcccggttcttaaccctaaccgggtttaaaaagaatttggaaatagcgggaaaatatctttagtcccggttgggg

SEQ ID NO: 59468 - DNA, 9084 bp, Oryza sativa
gggactaaagatctagggctatatatattcccagtgcgcgccctcatcttctccaccaacacttagaagtttttgcccgatcgatctctctcggcttctccttcgccgccactgcctagggcatccccgcgccgacgccgccgccatatctcgccatcatctcgcgctcgtcgtcgtcgccgccgccgccgcctcctccgccgccgccgcatctctggggtgagagccgccgcgcgccgcctctctctcgatctctctctccaatctcgatctctctctctccctctcggttgccgccggccgccgagtttcagacgccgacgccgacctcgtcacgacacgacgccgcgccacgacgactccacgccacgagacgccacgtcgccgcacgccaccgccgcgccacgccgatgccgcgcgcggcgccacgccgccgccgcgctgccccgccgccgctccgctgccaccacaccgagaacgtgaacgagcgaacgaacgtgaacgagaacaaggtgaatgaacgtgaacgagaacgagcgaacgaatgtgaatgagccaacgaacatgaatgagaacgagagaacgaacgtgaacgagaacaaggtgaatgaacgtgaacgagaacgttgtcggacaaacgtgaacgagccaacgaacgtgaacgtgaaatgcaattataggcaggttaatgaacgtgaacgaagaaacgtaggtgaatgaaacgtgaccttaacgagaacgcgaacgtgaacgatatcgtgaacgaaatgtgaacgtcaaatgcaatatatgttacttcgcgtttatcctaatacatatttttgtatcttgcagaaaagacgttgtcggagtcgtccctcaagccggagtggtagagctagccctcgaaggaattcgcccaggcaagtaacgtaattatatatatatgattgatatatttgtaatgcaattaagattattagatttgtaattagacttaattagcatataagattatgtagtgttctaatatacgacagttacacttagaatacatgactatttgagttttagtagaagattattggagttttagtataagattattagatttgtaattagacttagcatgtaagattgtgtagggttctaatatacgacagttacacttagcatacatggctatttttgtcttagcatataagattatttgagttttaatataagattattatatttgtaattagacttagtatataattattgactagctagggtcctataatatacgtcacatagacttagcatatatcactatttgagttttagtataagattattagatttgtaattagacttagcatgtaagattgtgtagggttctaatatacgacagttacacttagcatacatggctatttttgtcttagcatataagattatttgagttttaatataagattgttaaaacataaatgtctcatgacttagcagatatttcctgtataaacaggtggctgatcgcgatgaggaacagatattgtacgattcaatcgcggagggaagcagccagtactggaacgaagaagaggggaacgaggatccaaaccagtatttgaacgaggaagggaacgtggagagggatgcggaggggaaccaggaggggcacgtggaaagggatgtggaggggaaacaggaggaggaggctagtggaagtcaaccctccgttggacagaagagggcacgcgggcaacgaggtgccgcgaagaagcttgagggttggcacatcataacggaagtggaagaagatggacgacctagtgccccggcagaagccgccaagaactatgtacgtcacagcggttgggttgtgcgggataacgtgcctgtcagtacggtgtactggtgaagaacaagggcacgcggagatcatgagagctttgtcctagattcggagaaagagatgctgtggaccacaatgctcgagacattcacccttcccgtgggtacagaggacaaaatggaaaggtggactctaaagaaaatggcagaacagtttcagagcttcaagggagagctgtacaagaaatatatcctgaaggggcagacaccgaacttcgacacattcccaaagctaagggatcaccgggacgagttcgttgcatataagacaggtgaacaagggcaggcgatgatggaaagaaacaaagaaaatgccaccaagaagaagtaccatcaccacttggggtcaggcggctatagcgtcgcgatgccgaagtgggaggagatggaggctagcttgcttgagaggggtatcaaaccggccaccgctaattggccggaacgatcgaagttctagtactatgctcacggtggaacgctcaacccagctgatggctcactggtcttcggcgatcagatacgagaggctgcgcgtcgactaacagatgcagttgaagcctcttctcaggacacattccgaccggatagagagagggacgagctgtcactcgccctgtagactccagagcatccaggacgaacacgaggcaaaggggtgattccttggaagattgggttcaaggaggacatccacacgtacaggagtcggatgaggagcaagagagataccgaggcgaagattgcagatcttgagttcagggtatcgagctacgagctcagcatgcaagaggaggtggcaaggaaggttgatgaacgcatggccgcacatcggtccactgatccccagccgaccattcctcctgcaatggtgagcccgttaggaaaccgtagcagctgcgcttcaacggggcaggtaggatcacagagcatggacgccatgcaaacccaggacgaatccacctgccccgttgatgacatcactcaacggacaccatgtgagctacatattcctttcaagaacttatcaataaaggtaagctcgtagtttatatattttagatttgcccattccgctagttgctgcttatatatgttgattactaataaataacctctcaccacatgaaggtggtgtcgggcatggccatcccaacggaaccttcaggtacttaccactgcaggccgattccagcaggatactcgaaggtcgaagttgagttggtcaaaggcgcgtacgaggacctcgagctggattaccctagaggagacggtgagacgcatctatgagacacaagccatgccattattctatgggcgacaagcggcgtctcgtgcaccatctcctccggccccgccatctcctcctcaggatcctgcactgtctcctcctcatgctccagcaccgtctccacctcaagctcctgcaccgactcctcctcgggctcctgcaccgactcctccgcaagctcctcttccgacaccttcaaagtcaagggccccccaagctccaccacctgcccacacaagggcaacgaagaaggcgaaagttgacgccgccaagaacaaggacccggggtacgattgcacgcaagaggagcttgacgcttacgtggcatcagaagtcaagagacaattcaagcctcgaagaccagaaaagaagattcctatagacccgagtgtcatgaacttcttcaggggtatgtctgcacctgccaaggaggccattaagctatcggactatgagcgaacgctgaagaaagcatcttctggaaagtccaaaacagtccctcagcttggagagcaaccaaaccaggacatcgagccgttggtgaccggtaaagaaatgacgatagaagaatttattactgacaccggtctaactacggatcaattgctaggagtcgcaccaatcgaaaaggcagaagtgaaatacatgtacgaactcggtaaaccgcttgtcaaccctgagcttctgcagtccctacccacacaaatgtacaagttccatcagctgtacatggagatgagcgccaccggtagagagatgatcggagcgaggatcagggacacggacttcttgcaaggagatgacattctctggatcaatttcaagggaatctacgaactataccagctggacgccctcaacgtctctattatgagttgctggattttgtaagtatatcattcagttagatttcttactacgtctcctttaattaattaagtccttgtatataagtagactatagaaaataatatactcccttttatcgttgtagaatggagattcaaagggcccgacggcggggggttttcgatactggattcatcgaccctcggaaagtaaacgtcgcaatgctcgaccaatatccgcaagccacagaggacaatatcgtccatctcctgaaggcgcagcattacaagacgttcatactgttgccgtacaacacagagttagtttaattttactgtcttcctataccaaatttcattcccgtacgaacttgctaagtgtttcatatgtaatgcatcccacgcagattgcagattccactgggtgcttttactcttcgacctgtcggcctgcaccgttaatgtatatgactcaatggataaaaaagagtctacgtttgacaaggttttcgaacttatagacaggtattgtcataagttcctctgttaattaagaaaatcttgttatgttaattgctactacgaatcgtagctttaaactccatgtagggcttggtatcagttccgtcatttggtccgtggcaaatggagagaaagacttaggtggaagttcaaatttcctgtgagtacacatgctctacatttatatttctccgattcaaatacatacaagtgtatattaattagatctctcgttgtttgtcatttatttgtagtgcgcaaagcaaaagaagggaactaacttgtgcggctattacgtgtgcgagtattgccactgccttgcagaccaaatcatcaccacaagagagctcaatgtacgtacaaataaattcaaaatttcattacgtatcgatttcttgttaattactaatcaatttcatacattcatatagtttattcgcatgagggataacctgaccacgcacaaggaatttatcgcggcggttcaagaacaactcatgggattcatcaacgaataaatccttgatcccaagggtgaattctactacgacggaaacacaattcataggtccttagcttctgagctagcgactactactacgtcgaaatcgtagctagctaggacatataatggattgtaattaatacatgactacatatgtttctatatgcatgtgtacacattttctataacgtaaatatattttggtcatatatatatatatacatatgcatttgcataacatatatatataaatacatatatattatgcatgtacatatgtattgaatcatatataaatataatataatatatatatatatatatgcatatattatatatgcatatatgtactgaaacatatatatgcatggtttatatatatatatataaaccatgcagcaacagggccatgcaaaaaaaaaggtcagctcgatctttagtcccgattgggattaccaaccgggactaaagatagcgatctttagtcccggattggtagtcccggtttagaaaccgggactaaaggagggttacgaaccgggactacaaagtgtttctccaccagtgtaccccttgcgattttctcggtgacccatgcttcgtcttgtcgactgattgataggactttcttagaaatatatgatgcaaggaactttcttttatgacggcatatcacatattgtatacattcatctaatcgtccaccacgatggttttgaaccatgtgtgaatgccacgacatggtcttttaactatagcgaccaaattctcctcatagctccatgtgcaaaaatcttaaatggccacccttactaacaaattaatttgccaccacggttttcaaatacttcattgcagccaacataccagaggacgatgtggttgttagcaagaccattacaagaagcatccggagatagacacatatatattgctgtttgagttatggtagtctcagtcctaaacaaacagccaattcaagatgttcagaaatgcaagtgtactcacaagtcacagcaactcaacaatctgcatgcatctcctgcaaatgtggcatagatatatttctctcaagctagtcaggcatgagaggcgtcgggagtttgggggcctcattttctcatcaactagtcaggaaaatgtagatgtgcagtgccgtataacatgctgagcaagcagcgttctccctgtactctaccttttgttaacgtcagtgcagcgtcgccggtggtggacgatgcacgcaggtgcttcgctgttctaactgatctcgaacagctggatgggggttcgatttcatcggcgaatcacgattgggtgcctgttcgtcagttcttgcatgctctgttaattagtgagatcagtaacgttgacacatatatactgtaaaacatgtgtaacagattgatgctgatatcaaatctattttgagatagcccttccgtattttgagacagccatatgcctctttaaatatgccggttaaaggtgccgatttttttttcgatttcaacccacggaggttgggaaaggcatataggtgccggttttatcactaccggcacctgtagaggcgatagctatttgatgttttgtagtagtgtttgctttttcctagtcttccaacaagcattgacatactacattgtgtgttcaagatagtccaatcaataggtgtttgattgcatataaatcttctttgtttgattgcattcattacaaaatcgcatcgtagtgttagcaccgcatattactagtttaacttgaatgaattgaggcaattgccacactttatagcgtacactgatgttgccagataaaatcagcggctaggaaagaacagcccggattgctagacaaaaagcgcatgccattggaatagtcaacgaaactaaattgggtgatcctatactaccagaggatccatggttggaaggcagcaggaaatcatgaattacgtactttgaactggtgttatagataatattatatgtaccagttggtgaaatggtatgctttggctagaccaaaagattatgcgatttgctccggtccaacaaaaagtatctcgagataccggtaccttatggtaccaaatcgtttgcgatcgttggatctaagaatgaccatcttacctagttggatttaggaccttagagtactactcaggtcactataattactgggctacatgctctttcgctgtcctgatccttttgtaatcctctatgagtatgtttctctcgtgcatggagatcatccctcaaggacgtgtcatctgtcgcaggtttgaaagctgacctagctagccatgttgcaagtttgacgctcgcgtacgtgcatggcaatctgtttgcaaccagccatgtttacaatactagttcgttgttatgtgtaaataaaaggaaaagatgtttggtgttatcagaattattgaatcggtacaacaacatgtatcataccatgcatcgcatcatggaggagtggtgagaccgtgagactatgagctaagagtttttaatgtttcattaagtatcttgtagtatgctttattgattgaaatttggtgttttattattcttttaactgatgtctatcttcaagtattgatgaatgttgggacaaaattaatacaacaagcatatgtgtatcacttctgtattcaatgtgcccaactgtaagcagtgtttatatatttatacaggatgtacaagagaaaattacatcgctaccctaatcgctgatttatctaggtggctggatggtgggcctgtttatggctctttggtaaactcctcggtgacaggagggctgcgcccattaagggagcggcacagattcccgagggcgcctgctattacccgggtaaaggcgtgctgcgggtaatagcgtacgctgtctgccctcgtcagcggcgtcagaggtggttggcagatgcgtactgtgtatttatggtgttccactatatatccgttcacccatcttacgcctagggctgttgaggccctagcttcttctggagcccttgtacagctccggaggacctggaaggctttgaagtccttggacagctccggagtccacggacagctccggaggccttggacacccccgtagcccttaggtggctccgaaggccttggatgaccctggagcccctaggtggctccgaaggcctgggtcggctccgaagcctatgtttagctaagctccggagtctaaatcagtagatgccttcggtcattcttctgatgtggatggctccggtaggtgctgcatcacaggacggaggctagctccgctacccggagccactccccccaacaaagcaaaccactcaaaaaaaaaaactccagctattctaaataatctgtcctactcaaataaaactaactctttgccaaattatgacactaacaagctgcactggagtaataatataatggaatttctacaattgtagcgcctcccattttttttattaatctcgttcacctttttcctatgattattctatatcctatatatatgtaagcatgctcttatctctcatatctcctcatttaagtagggtttaatatattatttttaattctaattctcttgtaccctgtgtatgaaaatatcacaatgtaaatattgaaacttacaatataatttttgaaatttacaatgtaagtgtaggtaatttacactgtaaaacaatttcattattttttactgaaacatacgattcaatatattctactccatgcagaaatatgatttactatctacgtgctcaaaattttctgaacggttgtcagaccacaaaactaatgcctgaattgtaagatcaactatttgtcttataatatcgttcctcgaggaaaatattgcacgcatcagattcagataatcaatcacggtctgatccagggattataacacgaaatccggacttcctgcactgcgtcaaacacaaaatctgctcggtttttccgggaaaatacttagtgcaaaccatatatgtagtcgaaatttagaaactaccgttggat

SEQ ID NO: 59469 - DNA, 23361 bp, Oryza sativa
atccaacggtagtttctaagtttccactatatatatggtttgcactacatattttccccggttttccgatcaagttcaaaaatgatcaaattgaattttaaatttttgacaagatttgtttggatctccttggattttgttggcttatcgacggtttccatgaaatctgaagatatagttcatgagcggtttttcatccgatattggatcaattgtgaaccgtagtcaatctggtcatttgaaatcaaatccggagacccaaattgatgtcaatctaggccatttgaaacatttcgacctaaaggcctcgagtggctggcccaccttcaaatttagatgtagtaaccaataatgcacataaacgcctataaaaatgtgaacacgtacatacgatgagtccgtctggttttccacttcccaatggcatcaatcttaacgacaatgcctccttccatcccctctttttcttagacagtcatttctccctatatcttcagttcaaccatgtatgtaagttgttgatttgcttgatctcacgtctccttttccaacaatctcataattcccttttctcgaacaaacatgaggcgaataatttcaccgcacggttgatgcacgaaactatggtgtataactagctaggcaaaggaggtattcggaatggttggaggcaacttatgacgaccatcgaccgatccgctgaaacaagaacgacaacaactaacgaggttggcgcagcggagaaaggtgagggccatgtgactcaatcacccggcgaagtaatgatgctatgaaggagtctggtgaagaggtacatggcaaagccagggccacgcgaatcttggtgatgcgatgaagcgaaatacctggtggcgaagcaaatgcaccaagtggcaaagcaggctcggctccgtcatgccaaaaccaggggaaaccatcgaccaaccagctaggccaaaagacaattgctatcctcataaatgtctccatcagagggacaaccatattaactcactagcacatcaaactatagggttgtaaatctggccagtaaacctataaatagaccttaatggcggtttaacggagaatccaaattttcaattacaccatacttattatttttcaattccttccacttagagtagagcatgtctttcggcagaggtgttcgtaattcgaccacgggaatctcatggcatatcatttgctcatcaaatggcccgggtttacaaaacttggtgtagtagcagaacgcttgccaaagtgacttccaggtaattatggtaccgatgagctgctgttcaccaattacatggatccaagatcccgcctcgccagtggggatgagttcacctcgtcctcactgatcatgatgggtcgtcggcgttccaacagtgcgttcatcagcagttgctcagagtaaattaaaggaagtgcagacctagctatacgatgctatatacgtatatatatatatagctattctaattcgttttaattagtaagtcctacaggaaccatccgccagcgtaataagctgttgtacttgtaaagaaaacgtagaatattaaagattggatagcaaaagctccatctctctcctctcaatctcaccagtgcggtaatggcccaggcggtaccaacttcacacatatataatgtactcctagctactagcacatgacactaattatgacatggaattaatttttcagggtttcttctaaactactggtaactgcgagagccggtacaataacggactatgaatcagctataaaactttctgatgaatagcgtacttaactagttattttccccgggcaaaactgcaaaattccatacgtacttcatctatctatttatgccacactaatacagttcttaacaaaatcatgtgtatatgctttgacaaaataacctttgagatgcattctgaaaaataataataaaaaagaaccctttgagatgcaagtaagcacctagctgcagaaaattaatgaccaaggtgttttgtgcgtacatgtattatttactactaggcatattctgagtatattattgcacgtacacagcagttaagttttttttttcccatggactatatatgaggaaccatggccttatctgttctgtgtcaagggtctccacacagggtaaaaaccaaaaccacaaatacttgatcttggtgctctgagtgaatcaaagtactatttgttgatgagatatcccatgaaacccaacataatgttgaataagccatatgggtttgggaggcctcaagaacttacctatatatgccgaaattcacatcagatgttagagaatcgatgacagttgcccagcatcgcttaatcttcttccgtgcattccttctctttgctctacaagataattttacatggtaaatctaccatgtgatatgacagccatcttgatcgcaactgcaagctgatggtatctcatgcaatgtgagatcattagttgtagatgaacaggttaatggtcagcagttcttcacaacatgtattttccttacaggaagaaactttgcagttaattagtatcagtattgcagtatcaaaacaaagcatacaacaaaattttgcaaaatagaaattcatatcctaaatgaagagaccaaaatgaaaagtttttcctcttgtcatagtacggttttaaatagtttaaattgataaaattaaactaaaacaaaaaccaagcaaaacaaaaaaaaacaatgaagagcgtggtattacacgatttcattcccgtgatgatggcattcattgcatataaatgggataaaaaaatgcatcaatgaccaaagtctaaaactccaattttcccctccaaggtgtcttactcaattgttttccccttctagtgtttacatacccatacttgaggatggctctcaaacctaataggattccctcacacatcttttccctaccaaataaaaccctatcacattgccggttacaaaatgctcgttgctgccgatttggaactggcattgttgctcgaatgctatcgctactggtccaaagaaacaacaatatatagtgcttctagaaaaaaaaacaccgttgtctctctaactcgcagcagcaccacatcaacgtaccaatggccatgcccgtcatcatcatttgcagcaactagcacccaaaatctgttgccatcttttcccacaccaattaagctagagaagctagatcgatagccccgaggtcggaccggtcagatctggcaaacaagagcttggtccagctacaactgacctagcttgttccctgtaaaattaaatcatgatataatggtctgaaataaatcctagaagcctaaacatcaattggcaattttgacctttggagccgaaggatttgagtggcttatatttgtccagaattgcataggtgtactctaacatgtgggacagagttcatgtggatccccatcatcatcatgatgggatgagattaatttgctccatcctgcctagctagatccaacgatcagaaacgatttggtactatgaggtaccggtacctcgaagtactttttgttgaacatgagtaaatctcatttgcaatagaggctttagaatgcaggccatccatcaattggggcagcagctttatgcaccatgaaaaggacaacaacgagctctatgtaggcctggatcttcatacaagtagtatagagtgcaccttcttaattccttttctgttcggctctccctctccataaaatttattacttccaatcttcaggttcttcgtctcccgttcttgacctcacttctctcattacaacttgctcaaatctgcctctcttcttgaagtaatattaggcataaaatttgaccacaccaatggatgcaagaggtgatatagtatgtgggcatgggaggtgtagggaatggcaccctcatcaagcaagcgtgatgcatctttcatcagtgatctcaccaaggttgcaatccaacagtgtttacatgaagctgttcgccgcctgcaccccagtatatacatagaggtttacttttaccatgcacgtatggtgccctgtcgttcggagatggttcacttcttgagttgcatgaatcgcagaatggaaagcgtatatagtctatgcagttgaggttttgttcatttggcacggtataataaatgagtgggattatcctatgctgacaaaacaaagccttagtttagtgtaggagttatgtagtggatccacaagctgtcaagagctgaagtttcagacgttcaaaaatggatccagagttagggtttgaattcatcttgacacaaacgtgggctgaattattaacttgtgctacctgtaccaaaatttcatttgtatatcacggtgacaattgtcatttctttaattttgacctcaaacgaacaaatgctaactaaaggacagatcaatcatcgcataggataaacaatctgttgaaacatagcaagtggagtagtgtctgggtattctacctctgattgggaggtgctgattagtgtagggccaacatgcatgggagcatttctatcatggtgagagatgtgtttatatgcagccaaacaccagcatgcatatatctctcaactgcgatatctaggcatgagagatgttgggaatttcacggcctcatgcagtcatgtcctgatccataagctacgggaaggaagaatctgtttgtagcataatttgactaatatttagttttatttgggtaagccacattatttagtttagttgtctagatttatcgagtggttagttaaatgtgtgtggattgctgggaggcttagcagtgatacttgtgacatagagatactatgggtcagctaagtttaaccacattcaaggaaggtttttgcgatggtactatttgcatgtacattagagagtgaagacctgtgcagttggttacttggttgctggtgaaaatttgctgcagtccaggatccttttggggctgatgatcatattcgtgcagtggagaagtctatagcgtgctgctacttgactcttctcttaaccgcttgcatgcgttggtgtgcggctgcgtgaaagatgcagctgtgacgtcggattgtaaacgatacggcatgattagagcgtgcagctgctaggaagatagagatatatattttccatcttatcagtttgtttcctttgtttgaacgttgctactttttgtgttagaccgatgaccatgctacccgtgtgtgtatatatatatatatgccggtgtacggttaattgaggatgccgaacaaattattaatctactattttcctattctttactttcctgttattttcttttttttttgtttttatggctgagttctagcaacataagtgtttggttaatctttaccgttttgcgttgaaaaacggtcgtgcttctctacgaaaacgagaaggttattatcctttgcaaacattgctaggaaactagtcatttgttgttacgtaagtacgatattatcttcttggctaattttctcgtaaattagtcgtgtttggttctacgaaagtgaattaatctcaaagtcggtttagttggccggttttgatttattgattttggtgactctgttgattacaccgtacatcgttagatgatcttgtgttgaccacgaaatatgcaacggaatatttttcactaattggcttctacacactctcgcaatcccaatggctttgtggcagatgccacacatttcttgccacagagaatattgaggatcattagggaaaaatatttaattgatgatttggttgttttgcactattttgttagtggcatacgcaatgttttaatttggtggtttttgcttcgtataaagggttaatccgggatattattagggatggcaacggggcagggcgggcgcgtgttgggctggaatgaccccacccctgacccccaactctccacctggccccggctccgagtggacatgcggggccaaatcaggccctgccactggcccctacggggccccgcaacctgacatgggccccgcattgagtagcaattccatcgaattgccgtgcgtctcagcgtttgtccatgcacgccgctcgctccctgtgcttgcgctgtgcctgtgcactgccgccgcgtctctgtggcaccgctgcaactctgtaccgcgctgctaccggaagagactaagagaggggcgtgcgacgggagtccggaggggagaggaggggagggaactggggagagcggcgagcccacgagatctggcgaccggagagagccgggagagaacgggaggggactgcggagagggcgaccggagggttggggactccggggtcgcatgagtgtgtctgcgcctctgcgggctgcagctgtgtggtggcgtggggaacaaggtgtgaggggagccggggtggtctagttagggtaggttagggtttttttccttatatatgctgacttctactgttttactaagatgggcttcttgggcctataatgggctatattttaagaggtaatatacggggccccgcgggtggaatgtctcccgtcccctcacccgtcaaaatgcggggccccggcccagacggacccacggggcagaaatgtcccccacccccgccccttagtgttgcggggacccggctccgtggggaaattgccatccctgctattatagttgaagcataaggatttaaatataagcagaccaccacctaactatatttcaaacgtggtactaaataatcatcactacagccacgcctcacgcctggatcacttggtcctaaaccagaccacgtgaacacgtcaagtgcaattgatgagctatagtagatgttacgagatttactccggtccaataaaaagtacttcgaggtacctgtacctcacaataccaaatcatttcggatctttagatttagctgggtaggatggacattgttagatccaacgatcggaaatgatttggtaccgtgaggtatgggtacctcgagatactttttgttggaccagagcaaatctcatatgttatggatctttagaagaaagtaaatttccatcaaagccaatatctaaagctagtttacaaagtcctataagaattcggcttccatcggatggtctattcaaccaaagaaaaagccaaaatttgaattttcaaacttaattttgatattgattttgagatattttcaacgtagtttctttttcagcattggcttttaagtcaccgagaacacatatataaaagttttacctataaatttatttttattctctaataagccgttttggcttattaaaagaaaagccaaacgattgggcccttcgcctcctattccacaggagcatcttttctcctaaaaggatacatataccgaaggttgttgcctaatcgataggtgcatctaattttggaagaaacttaacacaattcatggtaaaaaaaaacagaatcacatgcagtaattgcgccgaaataaattctagcttattaaaggtggtataacactacaacagtgggttaatttggatataaagacttgcatatataatgagaaaattttcctatattctctgtggaaaactaggtgatgtacaaggaactttgctctccagctagacactatagcaaaagcatccaccttggtttcatttcgaacaaagatagctaagcatgcgaataggaggtgtcgggtatttctttcctaactagaaggagaacaaaggggcatgcattttgttgctttgcatctgcagatgaactatgcagattgtaccactaacaaataaaactatgaatttacccccaaagactttgctaaatgctaattcgttgtgatgggttctgtgaaatgcatgactatagataaaatataatagtcatacattccacaatacttggttttaattagtgaatcgaatgctcgagaaaatattttttttcatatatgacaaatctctctgtagtatttatttttcaataattgagcctttttatattagcttcttattgaaccaaacagtaagaaagataaaaaaaaagtgcataccattaggggtagagtcactcccataatgttagcatggatgtgcaactggtccagatgaaccccctgccacaccacgttcacttaaccatgtcaaagtaattggtgtggctaaagacttggctgtgttcttaatcacctcttaccaactttactctctcgtttttcactcgcatacttcctaaaccgctaaatggtgtatttttcttaaaaaaatctatataaaagttattgaaaaaaatcatattaatccatttttaagtttattttagctaatgattaattaatcatacacaattagattgttctaatttgcgtgcgtggatgattaattaaagttcccaactttcacctccgaatgcagtctcaaagaggttcaattccaaatcccttctgtgctatcgtactaaatattttattgaaaacattttaaaatatgaatgagttcactttaggtcctttaattggcatgaaaataagaaaaccacaaacactggccttgaaaagagtacttataaaggtagctcatattgagagagggatctgcactcacatacatatattttttttttactaagctcccatgcatatattatatatagagagaaggcgggtgcactgtggccttgtggggatgggaggcatgaggaactcaacaaagcgcagctgtcacatataatgctctcagcactgtcatgccataggaataacctcgcaagagcaaagcaggtgttatttcttggccgatcactaatggtagctgtggcttggcgggttttgatcgagcttgtaaagcgcagatatctttgagcaattttctcggcaattgagcgtacatcgtcgtccatttctcctgtcgacactggttgatactctctctagttcatattataagttgtttgattttttttttttgctagttaaacttgtttgagtttgactaagtttatagaaaaatatattactccaatactttgatattttagatgttgctaaattttactataaatttaatcaaacataaatataaaaaaagtcaaacgatatgacataaagggaacggaaggagtaggaccgaaggatatatagtatcagggaagagagagggaaatcaacatctaacacatgtatggaaactggacatgaccaaacatacgccgttcaacaaattcattaagctatccataagtgatttgcactaacgcatacatggcttgtaacattgtagaacgttcaactcttcaagtgttttaagacccatacagatcttaaggggagagcacacatatggaggaaagattggtttcatcagagaactaaaaatcatgtcctttataaattaaccatccattcgaagtttcggtgcaagttcagggtacaaattaaacatactgttaccacggggaactattttaaactctcaatgcatgggacatcccatcgttgtttgcatgtcatcaaaatagttaagaaaaaaattgaaaaaatttaacaagaatgattaatatgtgataaattacaccataaacatacaaggttaaatttaacttctataagttgcaacgaaaaaacaaatttaattgcgaatactcttgtatgtttgtggagtgatttattatatattaatttatcttgttgattttttttaaaaaaatttataaccatttatatgacatgaaaataacgaggggatatcccctcgagggtttagaatccactcccccgttattaccacaccccacgagtgatccggtcgatcaaagttgctctgttgccaagacgcgacgaggcatatttgttgaatgttgatcatattgcataagacaatatcatatatgggtagtcttatgaacttaattatctatgctgaattttactccatgtattgcttcaacattagaaagcctgttgaacgtacagcgtgcctttgcttatttattgatgaaaaatagggcgaactgggtattttagtggcaaataaggtaccagtacagtttcaaactgtaaaaccggtctgggatttttcacgtttgttaccacagtagtatatcattggtcaagcaagcatggacagaatacctgacacaagaagttaagaagtactcctaaaaacaaaaacaattgttcagactcacaagcagttcaggacatgtactagtctgtctgtgtccagggttcgtagccagaatttaactttttttgggacggaggggtatgtccttatcttttttaaaaaatatgcgtcaataattagcatttgttgcgtcagaattgacaagtctcaaaggaaatcggattagaaaaaattatatcaaactggcaggttgatgagatttgtagttatatagttgaagctttttcgtttgagtttaacatgccagaaaagcgttataagtggtgcaatctattttgaaatacaaattttagaattgttcaaaccaactcggatggtggctatatagaagtgatagaacgctaagagatatacatcttagagatatacatctttttcatttgaaatcatgtttctttttttgcgaggaatgtattaaatttttagacaagaagagtcaaaagaattgcaacaaagaaatagataataagtgtcacgccccgaactagccccgagcggaactagcccgtgacgctccaaattaacctgttaatcgataccagtcccaggaagcagtgctggtatcacaggaagacagaatatcacagcaacagaggtctctttattatagagtaggagtacagtcatgttgggctgcggacagatcccgagctcacaactgcatttcaaaagggaagcggaagccaagacttggaccaaacatcacaggcgtgacttgggaactaggccgaaaccctaaaactcatcgtagccgacttgctcctggaagaactcctcgtcggcgggatccgcttcatcttcttcagcaactgggggagggggaattatttatatagagcaagggtgagtacaggagtactcagcaagccatggggattaagtgtttaaatgtaggcttcaaggaaaggctgttgtttttgcaattgattttatttaaactcttttctgaaacaactaagtgagtgcttctcaaacgacacggatgggacagtgcgtctcgtccggtcggagtatgtgcaaggtatcagtcttttgaattgatcaaggttggcatccggccaacagctttcaaacggccacccgggtctggctgatcccatcagccgcagattttccaaacatcgaacccaaaccacatcagcaaatttcacaaagcagtagtcaaacaaaactacgctggaatcacctcacatccgcgcatgaccgtgggcacggctgttcgaacagtttaataacctctgtagagggggtacactttacccacacgacattactaacccggatcatccagctcgtgcagaacggccacgactagagaccttaaggctttcatgacaaggcatttcgaaagccgacacaggttcaccatatgccaacgagaggggtcccagaccaacaccagattaggtcccagaccatactgtgccaggaaacccgggggttctccccgacaccaccccgttgaatccacatgtctcttggcatcatggctcccccgattagctagttactcagccaggggtgtcccattccacccatgtggtcgtacttgtcttatgttcggatgaaatttcaaggaaacggtccttaagtgcaagagcgggaaaccgtacacccggtacgttccccggtccacgattttttggaaattcatttagttcgcaagcaccgacccaggtgtcgggttttccaagtcttttaaaacccaagttttacccatggttggatattttatattttgaggggggtgttccgatgcgcatacccgaaggcccgtgcatcgaagcacaacagttaacaaaggaggtttaagtgttcaataattcaaggagggtaattgcagcaattaggattgggggccggtaggccgtctcgcaagccgcggccgaattacttgtgtaaatcctattcatgcaatatttgtggaaaagaaatacttagatttaaattataggtgcaagatgattgtcacgcctggaaattcactagtaatttccgaacttatttgtgcataaaatcctcgtccaggaatcagccgaggtacacaaactgacagtttaatatacaaatccatcataataataacgttagacacttacaaaagaaaagaaaacagcagcggaataacggtctagcgatggcttcagctccactcccacaggcagctcaactggggtataagccaaacgtcttctccttctggatcctttttcttcaactgaggttgattgattattgcaagaatgagcatatgacatactcaacaagccacacagcaaatatgcaagtgcacaaggataccaaaggatggcataatataggctcatttgcaaaagcagcatttagcaaaacatttaagagaagtaaaacagtggagtaattaatcagaaattttaatcaacactgaacaacacacccatgctgcacaggcccaaccatcctgaacaaccatacccggctgtacagatctaactccaaaccaggagctaagcaaattattaccaggtataacatccataattattgtgagaggtgtgagactaatcacgaaaaacattgctcaacccgcccataaccgcgggcacggctattcgaatagttttactctggccagaggtgtaccactgtacccacaagacacagccttaacatcatgtctaccatgcgtcgcgatactagaaagtacccgaatagaggctgtgacaataccctctgtacaacacaactcaccacagtgcaccattcctggatcataatcacccccttataaaacaaggcatggactccccagcgacccccgtgggcttatctccgccacttctcagtctggtgctccgcaatgaatcatgctatacaaaaggtaaagccgttgcccacgctggcttgtggttggcacggttaatgtttcacaatagtagctcgcgaaccggtccttaattgtcatgagcacgactctcaaaaccatgtgctcacaacccaccattatcaagttttagttggcaagtaattaattaaccaatcacgattgaccatcgtgaactatctttaaaccatcattaagtaataatgagtcataagttatcccaataatgtgctaatgtttctaagcatggctaagcaatcatatctaatatctagctgaaccaatatataaagctcaactagtcaagttataataacccaaggtatcaaggaataaagtaatcaatgcaaacaggccataacaaaggaatagattcacaccacccagtgacattcgaaaataaatgcacagttgaaataaatagagaatttaaatataggatcaacatgctctaaggattgtgtttaggatctgtgtgacttgccttgcaataatcggtcttcaattaatcttctgaacactcccgacgcactcacgaaccttcgcaacgacggaaacgacaagctaacacgcaaaacgaagaaaaagactaataaaaaccaaataaacagtacaaaaacaagcataaacagtacatgtggatatttttaacatgtagatctcgattttagatgaatttagcaacttgaaccactcaaaacagagttacgatgatttagttatgaatttttaaagattaaaccggattaaagcatttatatggattttaattgaattatgacgcaataatgaattacttttgaaaaggaaaaggaggattattgcgtcatcaaaggcagtccgggtgcatgggacggtctaaggaaacgaacggccgagatcgattctatccaaaacgggcggccgggatcaacttgatctaccgcggttcacgggacaaggcgacgatgacgtcagcggtgacgtcagcgatgacgtcagcaccggcgacagctcggcctcgcgcgctcgccggcgaacgacggcgcaacgacgcaaacggaggacaccaatgggtagaggacaacacggcgaactcaccggtgaccaaaaccacggcggaagagcaacggacggcgccgacgatgaggaagaagcggcgacggtcttcgggtcgacggtgacggcggtgctccggcggtcttcgacggcggcgaagcagtggacggggacggcgacgacctcgcgatcccgatggtggcgatggcgaccaacgacggcggctgcaacggcggcgcggcgcggctgaaccgacggcaacgacagcgacggctagggctacgcggaggcggcgctagacgctacggcgggctaaggcaaaggtgacggcggatagaggagagctcgggggtgcttttaaaggggctagcgagcggcgacggaggcccacggcgaccggcggcgagatggaaagctagggttggagggagaaaagtcgatccgaatcgagctcaaattcgtcgatttccaaacgaaattgaccgaagtttctataagagaaaaggaagagaagatcgaggagattatttcccctcaaacgatttcaccggaaacggaaaggatcgaccggattggaaagcggcggcggctagggtttcggccggcagcggcgcggggaggaagacgggcctgataggtggggcccacctgtcagcggctgagagagaggaggaaggggcgcggcggattgggccgactgggccggggagggagagagaaaaagagaggttttgggccggctttcggcccaaagccaaaagagacttttaaaaacctttttcaatttaaattattcatgaaatacttccttggctcaaataaatcccagaaaaatctaggaactatagaatcaagtaaagtatttaacaaaattttatctagcccaattttatattgagatttaacaaattaaaattagatcttctcttttaggcttttaagatcatttctaataattccttttaaacaacaatttataatttaaggatttttaaacaagaaaagctcttaacacttataattagatcattaatgatcaaataattactgaactgttctttgtatcatttaggaattgagctccgaaaaatccgagaaaatttcagagagtagacttaatcatggagaatttaataaaaattaaatccatccatgctttatatttaggaaattttatttcccacatttaacttcacttgtaaattaatgaacatttaatataaattctaataatgatttattaaataatttataaatcctgaaataaaaatcaggatgtgacaatgatcaacggtgacttgccttgctcgagatcttgaacttcatcttcgaaatcctcgcactgcgggtcttcgggctccgaaactacacgggaaacgggacaactcaacaaacggtgaaaataaagccctattattgacctctaggcgtggcattagatagatctcgagatttgaggagttttggaagttgaacggagtcaaacggtcatacgattgggaagatattgaatttctaacattattggatttttggtctaaaggaaaaggatttatttaaatcctttttgaaatagaaaagaaaagaaaagaaggagggcgggaaattagactttccttgggcgggtagggcgcggcccgagagaaaggggcggcttggccgaacttaacgggccggccggcccgagaaggcggcccaaagcacacgcgcgggcggggaggagagaggaagccgatgggccgggtccaccttgcgtggtcccgggtgggacccgcttgtcggcggctcggctcaccatgagcgaggtgcacgcggggcgtgctagggtttggggaggggaggcgcggcgcatgcgcgtggttcgcggaggacgcggtgcggcgggcccacgcacagcctcacggctcgcagttaaccgcgcgcgcgggcagggctggagggagcggcggaccggggtcagcttgacccggtcgcggccgaggtggcgctgacgtggcacctacgtggctgccaggtagacgacgacgtcggccggaacggacggcggacggcggcggcaagcggtggagcgaaccacggcgatacaggcgaaagcgagcacaccgggaggttgcacgggacgaggggagacgagccaacggctcggattcgccaggggatgctcgacggcggcggattgcggcagcggcaaccggcggggagagaagggggaaacggcgacggcgcgacgggagaccgattcgggcgagctaaagcatctacgtgactccgggaatccgttgctagcgtcggattgggcggagctacgccgagcaaggccggcgacgagcgggcgctacagagcacgggcggcgacggcggcgagcacacagcgagcggcggcaacggtcggggcggcggcagctagctacggggaggctactcgtgctactacctaagtctaaggggaggagatggaacgaggaaggagaacggagggaggcactaccgtgcggggtgatggggcgcagtgacgaggggccgacggcacgggagtgatctctccggcctcgggccggggaagaggaagaagacgagcgcccggagtccccttccgcgtcctagcgcgcaccggctcctccggcacacgcgacggtggcggtcggcgagagagatagagggacggcaatggcgcgagcgaaaaatagggaagattgggatggaaaaaggaagggagggcgcctgggtttatagggtgacaatgtcggtttggaaaccgaccttgggcggtcaaggcgcgagctggcgcttggcgctcgcggccaaaacggcgacagaggcggatgacgccggcggggaagagaaaaggaaaaaggaagggagaaagggggcttgccccttgcctattcgggaaaggaaggagggagagagggcgatgaggaggagccctgcctcctttccttggaagcacgcgcggggagaggcggggccgagttgatgacgacggcgatgacggcgggggcggtttggaaaggagcggcgacacgggcggcaggcacgggctcaggcgcggcaggcactgacggcggcggcgaccaggcggtcggccaccacggcgtgcgcgcgtgggaagcaacgggcggcgcggcgatttgggcggcgtcagcgggaagcggcagcgagggcggagggcgctcggctcggcgcggctcacgcgcacgcacgcgcagcgcacgggcagagcgggggagagagagagagagatgggggggagggagagatgggccgagaggaattcggcccatcgaacccgagggaggcaaaatagacttttgcggagggatttgatttgggaaggataattgagattagggtttggatttggattcgggacttgaacttgacgatagatcggggatttgagatccggaatggcacggagactgactgcaagcgaggaaaattttttttcgcaattaaggtttttagaaattacattttcccgctaggcgccacgacggaacgggcgctacaataagttttctacaggtgagagggtaagaatattacgtgtggagcctaggttagaatcctaaaggctgcacatgcgttgagagtgtctattgagaaattgtgtgacttgtgatgcactattccttgtaaaatacaaaatattttttctgtgcttcttttagctcttataaaattttaaaaactcatataatgcttgttgtcggtcgtccggcgttgaacggaaaatcggacgccgacgccgacagttgtagaaataattttctctctcttcattctccttcccacgcatctactatatgctttctgctatagactttatgcatgcatgtgtctctatttataagctttaaatatctttttcttcaaaacagtttatccgattgtatcattgtatttgttgtaattaaatctttacaacaagatctcacttgattgtatttagacaaaatatgtatatatatgtttcagtgtattaaaatttaatgttttgcgtgtgagaaataaatgtttcagttggaatttgactatgttgcacattttttgttcaatgttgccattgattttttttaagtgttgcacatggtgctatttgggtgatttaataaatatttttttatgtttcactagtgttggcggtatgtcatgagaccctccgaccagacctaccgagaccaagtaaccagcaaggcttcaagcccaagacggcaagttcatcggggcgaagcccgcatggcgaagactatggagcaaagacggcgaagggcgaagaatcgcgctggtatcccgcaggtccgaaggcgtctcgggcgaagaccatgtgccgaagggtgcatgccgaaggaaggtgatttcgccatgacaagtcatgctttggggaggcccaaggggccatcccagctgctctagcccattggccattggaccagcgttcgccaatcggccaagtggaggcccatgtatctcaattacatcgtgtacccatgtaagtgtccttttcatgagggcaaccatgtgaattcccctgtaaaacctaaaccctaatagggggacttgtaatgggattataaatagacccctagggccatgtaatggggggatcccaagaaaaaatcttaaatatacacactcatcgttcccaacaactgttgagtaaccacgtccttcgacgtacgcagttgtcgttttgacaacaactagtttatttacaaatgttgcatgtggtgttatttggatgtttcaatatcttatgatgttttactaattcatttataattgttgcacgtaatgctgtttgaatgtttcattaagtattttctaatgatttatcaattacaattcgttgtttcatgtataatatagaaatgtttcaaaacagaatataattatatttatattttttattataaacataatcaagtgagatcttgttgtaaatatttaactataacgaatataatggtgaaatcatatcgtcgataagataagtaatttagaaaaaaaatagtttaaagttttactaaaaatattgctaagagagataggggcttgtaaatggtattggagctcataggcatgcaacagctatcagagaatgacttagaccatttcttttgcaacgtgtagcatgcgccccgtgcagtctagcagacattgcaacgtgtagcatgtgccccgtgcagtctagcagacgtcagacatgcgtccgatatttcgtaaaatatcgtacatccgtagctctctcccgtatatgtcatccgttatgggtaataattatgacgtacggatcatcactagtggggtggtatgtcaccctgttgttttgtagtgcagtactgggtggttattagggaccgttagacaagaccatctatgggagttcacacattacatataaatctcgtcattgacccatggtctatttatggtggatatatcagttgcaagtggggtctatgacccatcacatacgatgggtttttttatatgacttttaaatatgtggtccgaggtaatccaaatgtgctttcacaatgggagaataacattatgtagaattggtcaaccctgtcttcgatctttttcttcttctttttttctttcaggaaattgctcaacacagtcatgcacgaaatttggattactcgtgtagcatggacagacacgagctgggtgtaactagtatggcaaccagggccagatggatatagactagaccctgttagatcgcacccaaaaatttttcaccctgtcaaatcgaacgtttaacacctatatgaagtattaaatataggctaaaaacataactaattgcatagattgcgattaatttacgagatgaatctgttaagcctaattactccatgatttgataatgttgtgctacagtaaatatttgctaatgatagattaattaggcttagtaaattcgtctcgcagtctacccacggattctgtaattagtttttttattagtgcctaaacaccccatgcgacatcctatataatatccgatgtgatacgccaaaactttacacccctgaatctaaacactacctcaatatacaagtgcaggactctcccatattaaaagtgaaaccattattaatgaataaacacacaggttttataaatttcaaggatggaataacccatgtacccatgtatatattttatttctacgctacgcaaattaaattgtgatgtgcacctatataaacattctccaaggagccacaagtgatatgatcaatcaaccagagatgttgctgtttatcaagacccgacactcgataatataatgctatatatgtttgtcaacagtaattgcatattttcagtaggtatgggagtcatcagaaattagctttgcaagcttagcgctttgtaagtcgcttacaggcgtcataatggagcatgctgggctcaacctgtttcagtgtctcatccagtgtgtcttctagttgttactcctacatagcacttccttagcttaaacatgcatgcaaataccagcttgttcgatcttactagaaatgcagtactagttagttcactcctgatggacatgttccagacataaccgctgcccatgctgttgtgaacacagccagctatagccatagccaatagctaaccttcaagattcaagttgcttaattcctgtgagtaataatacctaaaaaattcaaaccatatagccatagccaatagcatgtcagttctcaccaaaggaatgctgtctagctagctacttgctactgatcagcattaatcatgttaaatatctatacctatactaattaggcactttctacgagttctcacgttaaccagaaatatcagaccattgattagatatgtcatattatcgtgacggtagattaatatcaaccgtacgtggactctctctaaagcccaaccaatattgcaattgggcccacatatgaattttaggtttcatgcatgtacgtatgacagggtatatcaatctcagaaggagtcctcataggagatcgtccccaaatctcgaccgccggggcaacgccacctgcccatgcatatagaagcgatcaatctctgaagatgaaggagaacgccgagtcaccgacggcacgattccggcgtccaccacagttcctgcataaaccatcgtacgtcaccaatgaaatcactgcccaccgtgtcctgcactatgcaacatcaagcatgcagtacgagagatcagggtgacgatcatgtgcagcgtccgtatctagatcgacgtacaataaaacgatgcacatgacgtgcaccaacgatctgcttggtgtcgaacaggatggaccttggacttgcagcggctatcaactgctggcacaattatccgcaccatcacctatcacaagcaagatgaccgcatatttaatccccataggtatatattctttttgtttgaatccagcaatgtattgtctgaaaatatatatgcactctaattttgttttagcatttggcatttttgaacaaataatacatgcatgttgttcctttatcacatgattacaattttttatgttaatttctcttgataaaaaatatgttttatgtcatcctttatttttgagattgtagatttaggttccgctggttagtgttggttgggaactaatccttcacgcacgcaaacggtgagacagataataagcatgattaattaaatattataaaaaacatgaaaaacagattaatattatttttgaagcaacttttctatataaatcttttttggaaaaaacataccgtttatacgttttgaaagtgtgcgcgagaaaaataggagagtagaagttatcaaagtgaagaaaagaacacacccttaatgatttgccatcctggtgcacatatcagggcaccacaagtcgttggcatgcagtggagtggacatgaaaatctaaatagttagcaaatcattaaatttgccacacgctgcatcaaaatttatttgaacagattaactttctctaataatattaattgttattgtaaatattttgttgacaagtaatatgttttacgccattggcagcgaaatgacaagtgcacatgtaaacaattccaaaggtttcacaacaagaagaacaccatcaagttgaaaagtaaaaaaaagaaacacttaacatccgaaacattttcactgttcaagagattaacatttcacaaaatatggcaagactagaacaaattaaatctctttagatttccatgcagtcaggatatttaccaataatagcctgcaaaatatatttatctagcaacctgtaacttcggagcattatttactagaagtaaaaattatttagtttgctcacataaaaagaacttcattattcagtattcatttattttaaaagatgtcattggcagagcatattacattaccaattgaaacacatgcaagttctgggatatatgctctgaattgagtgatttcaactaaaataaattaatatatgtaatgtatattcattattaaaaacactgcattcttttcagcagcatgttttatatatttactgaaaaggctaacaacactgcctatatgtagagtattcaatatcatccacaagaaaaaaacctacattgacaaatagcggagctgcgaaacaagtataataatttattatagcaaatcaaatttccattgtctggtaactgctagaattctttaataataacccatgcaacgcacgggttggcggctagtaatgtaaatgcatgactacttccagttggacccgttcgatacatccagttggaggtatattttcagcacatgcaaaacgaatgaactcattagcacatgattaattaaatattaattattataaaattgaaaaatagtattatttatttttttaacaacttatacatataaactttttatcaaaaatacaccatttaatagtttaaataacatgctaacggaaaacgagaaagttgaaatttagagttgagaaaaagaactcatcctaatggtaagatgacaattgttctttatttttcttggtgggtcaggtaaagtgacaaattgacaatgtaatagatttttttttcaaatacacgtgtactgatctttgtagaaaggtaggacaacacacatgtgacaaccagtacgctttaaggtgccaatggagaattattaactcacatacatgcagctttgagggagtggagctttgtacaaaaatgacattaa

SEQ ID NO: 59470 - DNA, 4665 bp, Oryza sativa
cacttcagtggaaaaccactacgatcgccaaggcacggcacgcctaatcggggaaatgctctcacagctctagcacaaagcctacggagaaccatcgacactctacttgggccaacccggccgagtgcccagccagcagtgtgtgttgcagtagtcgaatcggccggcttcgtcgatcgatgctggtcctgcgggcattggcagttaaagctaatcgccaatcaattgaatcctgctatcactatccgcttcaagagtgtacttcaagtcagggtcctctttcttcaacttctggaacaactctaatgttttcttgcacatcatatcatttgattgttcctttgatatatatttgatcgcaaagagtcttcagagatctcttagtgaatggaacgtcacgcattgaaacaaaaaaacttgcagttatgcagtacacctttgacaggttcacattattaatgcttctgagatgtctcacgagctctttggtgtgtatgtctatgtgcttatgggagctccagtgcttgctctcaccacatgtttctgacaacggatggttatgctatgatctgttttcgctaatgtaccatccattgtcctgccgacggtacactggtacagcctaataagagccttgcaatctgttttcgatgttaccctacataagattggtgcatacctgtcatcgactggtgcatatcacttgtcgaaaacatagtaatttcaaagcatcaatcaattttaagtatattttactgaccgcacaagcacatggcagatcctggactgatttatctgtcccaccatactttacacttcttccatacctgcaacgatgcacaccagcatactttttctcaccaatagttattactccttatgtcccaaaaaaattataaaatttagcatagttatgtcaaacatttttaattttaactatgatagcaaaaaaatgaatagcaaaaagaaaaagatcaatcatgtaaaattgatgttactagatttatcattaaacaaactatcataatatgcaacttttttatttaaaacatcttaattttatagatattatttgttaaattagcatctcgaagactgggtcgaagtccaaaatacgtatattttgggacggagggattactcattaacaaaatccatggcaaccattgaagatgcatttcttattgcgaacagttctgatctttgaagaataacttgtctttaatggtctaaaaaatctatagtagtgcaatgtactatcaaaattagactttacatacttatatctattttgttggatcactactttagatacttgatgccaaaaccaacctcctaggaatgcaaattgtagagatcgtacgcttcctgtagagagtcgaatgaaagacccactttcggttcactaacaaggtcaaccttcttctcaacaaagttttcgatacttgattccaacgcgcatacacgaccactgattaaatcttctgtttccatttttattataagcacagcccacatggttataatctctcgtcttgctcaacataatcaaacctttgtgagagatgatggaagtggtgacttgtctttctataagaccttaggacttttacgttacactatacttgcaatatatacttacaggagtcctactccggtactttctactcggagtagaaagtaatctaggcccttgatcatatttaattgtagggttaagatctagttctactcctaccagaattagtggaagtagaaatgtggaggggtgtttttgtccaggaaaaataattcgcgaaggggtattattgttttccgatccatagatcgatcaccatgtcatcctcgtcggagttggtcgtgcaagatcttaatcgatccatgtaatccatgaaacaacacagtgatcagaaacggcaagaagacgaatgagccgagacgacgccgccaagcaaatgacattgcgtgcgtgcgtgacgctgccgccgaagccaggccagaatttttaccaccgccagaactcctgctcaagattgtcgctcgctcggacgccaccacactcgtccgctcccagacggacgatgcgactgaggaagcagacaaggcggcgacggcggggaatacggatggcgacggagggggtggacaaggcggcgaggccgggggaggaatagcgaggtgactgcgtgcaacggagttcggacctgatacgatgcgaacagaagaaaacatcccatgccaaaattacctctaaacgatattaggagattacttacctgccctttaaaataaacggtcaagattaattctacttggagtagaatactgcaagtagattgcaccggagcattactctacttacagtataaacaatctaacagtgtgaatttatctgatcttctttttaccgtataaattgtgaagggtatatttgtttttccatatttttgcggaggatatttttgtattttcgcgttttattctttagtcagatccggatagtgagaaagggactcgtcccatactcccatgcgctaccaccgctgccgacagccaccgcgtcgcgccgccacactcgaacgctgtcatgtatggggagagaggaaggggaagcagcacagagcgcactggagcagcaacatcagctccgcagttgttgtgtctctctgatatagttgaacgagtgtgggtgattcttcagagttcaggctagtgtgcaagatggaggcagatgtgtgtcgttactggcttactgcatctgaacttatgtactgaatactgtaaagaaaaatgtaaaaaatgtaaaaatgtactgaatactgtttcgattggaaggaatcgctctgcctccacgctcgctcgtccgtcaacaatcgatccgccgccacgcgcaatgtattccgaagaatcactgctgctctagcccaatgtgctacgagatccagaacaaataccaactaaacaaccctttcgagattaactcccggtgcaaataaatcgcaaatttacattactaaacagccctttctatatttttaacaaatatcaaacttgccctactatatgctgcaagtatatacctgtagtagaatgtaacgtagaagttctctttcgcgaagccttgtatacatatttacaacacaaagatatgatgatatatgataccttagtaagtcagggacgaacatgcgaaacttccacataacaatatataatttgtgctgcatttatgacatcagacatatgtcgccaagccagatagagcaccaagtgcttggccaaagatttcaccaagctatcagcaagcaaccactactccttttcttcagttccacgttgtttgggagctgttctgtttgctgaaatgctgaattccatctcgttccaattaacctgctcaaatttgcactctctagagaatatgtaggcatggaaggtgtcgggaattcggccttcacgttgttcagtcttttgccatcttctgtcaaagaagtaaatgtcgttgaagccgtgaacaacgatcgttaattcaaaataagtagcaatattgatcaatcagagagaagataaggagctggaaactgcggttcggttcttgaagtttaaatgttgttctttcctctctctctcacttttaaatgggacaactaagcaaagtttattcttcatgaaaattatattaaatgttttccatcgtgtggctggcctgaacaaattcatctcaacgagtttttttttcttttattgattcagaaataaaaataatgcttgcggtatcctttcacaaattactgtttttggatgtatctaccaactatgacatgttttggccatgccccctagccacatttgagtaccaatataatccgagagattggggaccttagagccccttcgtggggccttgcaattgagccatcgaggtaggtgataggtctacagtttataggtggtggagtatttgggttattatgttgctttcggttcgaaatatttcaaaagccaaaattaaaaccagtcatgtactagctcaaaatataaaccaaacatcaaactggaaaaggaaaaccagtactacttcaggtcgttaaagctcggccttgggttcagggatgttttttttcccatccctacgtgtgctcacatctgagctagcacccttatataaactagatgataccccgcgcattgctgcggacatggtagagaaagtttaaaaatgcaataggagcatacatttgagacagaaaaagagaaaaactattaccatataattgactcgtaaaaactttataagcagtggtaattataagtaaggagtacacgatgggtgtctccactcaggtagcggttgttggccaatgcaactaacacaattgcagctgaaatatatggctattgaccggataaagctagtactaataaacaaaattgaaggccgctaaatattactggagagtgaaaaatatcatatattattatggtaaaaagaatgttaatttagtaggaaggaacatatataagagcacattagttgcatagctgatcaggaatacagtcaagtcatatagcaaacatactgaaacaccatcaatattttatatttaaacatctacagatatagtccaattatctacagacattaaaactattatgtaagaatgg

SEQ ID NO: 59471 - DNA, 5665 bp, Oryza sativa
cccccccccccatgcgcatgtgctcccctagggccccaccatgtatctccacaaaaaatgtttcacctagtgtactcacaatgtttcactatgtatagatataatgttgcagtgaattgaaacattcttttacaacaaatcacccacatattttggaaaccctctattaagataattcgtttttttttgttccaccaaaaatgtttcacctagtgtactcacaatgttttactatatatagatctaaggttgtagtgaacagaaacattctttttgctatttgctgaaacattgtttttatataagatgaaacaacgcccgatttaaacgattgaaacattttcgatctacttagtgaaacaattccaatatacttggtggaatatcgtgcaacatttaaaaataattcaataattaataagctaaaaaaatttcgtcggaatatatccatgtgtggtcttgttttaaagatttaattgcaacaaatttaatggtgcaatcggatcatgatttggataaataatttaagagaaaaaatagtttaaagtgatttgcacgaatgcgtcttgctgacgtcagcgcctgatttttcccccctccccatcgggcgcccgattctaagtcgtgtcctattgtatttgatggccgcaattttaatttcccttaactgctccctctatttcatgtaataactggtaatttttgttttggaattgtttggtttgactaccgctataaacatatgttagaatgaaccttttcactagcttgtttacaagactacaagaggtagccaaggacttgcaacatgtcaaattgtccatgttagcttaggaacaagtggactgcatgctaggtgactcttatacatgtggaaatttctctcgcaaactaattaagaatgttagccgaagaaataaaaaagaacctatatgatatatagcatgcatttccattgcgagaatttgtgataatatccaggcgtgggaggtgttgggaacttcgcggcctcatccaatcccaattctcgcaacccgggaaacggggaaagcattctgctactttccctctctgaccaggcaaacccgacagtgttggtggcacatatgactaaacgctcatatgtctatgtaattgcagtgttggtcatgttaactctgtttgccttcaatcgtatgtgttctacaacccgagtgacatccagattaggagggatccaaatgatgatgtgctttttagttttagtttaagcgtttgatctcgtttcattgctttttttaatttgtcagttgcatgcgttgtagcagtgttacgactgcttctacatgcaatggttaatttggttgtaacatgtgttttgcagtggcacatataaacctttgagaaaagtttctttcttttgcaggcataattttacctgaaaaaaaattactacttgatgaaacacaatccaaagtgaacagaaccacggcatttgaatattactcgcaataaatggcgaaaaccatgaattcaaccatattaaaggcggtacaagagtgctatatcgtggaagttgtaaactactccctccagtttcatatttcctatgatgtgaccatggctaccatggatgcaaccattgctcacatcatggatgaacaagaagatatcgagatcaagtactccaagtgctggaatctgattcggccacctactacactgctgacttcaaacggccaccgaatctgcatacgacctccgttttcagcccgtgagtacttgatggaaagctctcggagcctctttccaacggatccagcctcatccccgaattccatctcgtgtggccggaatcacaggcacaaggtgctgcatcacctataatgggcctatgggcttgtaacttcatttgggaccccagctcaggtggggcccatgtggggtgcgccccaaccaggtgaagcacgcccctaggcacccctaggtcatcctcccacccctatatatagctaggtaccccttcagggtttattgggttttgtttagatgaaagtttagccattgctacttccttgcagcgcgcgtgtcggctagaccgtccgtctgcttgtattcgaaaccccaacttatcgtgtgtattcattcctatttgcaattcagattgcttttatcttgttcttgcttgtttcttcgatttacttgtaggaataaggttgatctgcaccggcaagatcaacaacccacggagaggtgtatcgatcgcaaaggcgcaacacaacgtcttgtacggttgtagtcggatcgtcaatgtttctcccaaatcatagttatctcaactcaccgaaagatcgggccaacaacagtcttgagtgccgagtggaactcagggttcatcaggtggtatcagagctttcgttgctcggtgagtcttcatcttcctataaccagaaaatagccatacaaaaaaattcgtatcatttacctaaccatattgtgccattgcattgttcttttcaatttttgctttgttgaattttgtgttgcatcgtcacgtcgtgttgctggtcttagcgtctagttcgtttagagtttcaagttctggtcacgttttgtaccacagtcgtcgctgccaccgtgtctctgttgttgtcgggacctacgaaaatggaatcggctcgctgccacggttctatttttgtagtttctagaagtttctgtcggtcagttttgaagttgcatctagattttgcttgagtttgtagtttggccgtgagtctgtagttctatcgtgcttgtggggaggaatcggttttggaaatatgcaagattgatcaggaaggaaatagtagattggatcgtttaaaaataagtttctgtttttatcctacacaagtccggccttccatatcacagaggactgaaccactctatcttcgccatcctgtgagtccgactccctccctctctcacgtggttcctcggttccgagttgtgttaaacacattggtgaatttttgtttagtgtcggtttcgagatctgtttgcaaaaacagaacctatgggatgagcgcattccatttttgtatagtccaaatttttgggtttgcacttttgcatttgagtccctgtaatttgtatatttatagttgagtccttgtaatcttgcattaaggtccttgagttggtttttgctgaaaaaaaaattaaaaaaaaagaaaaaaaatgcagaaaggtgctaaaaataaagaaaacaaaagccgcaccaaaaaaaaagaaaaaaagaaaagaaagaaagaaaaagatagaaaaagaaagaaagaaaagagaaaaatcagttgtatctttgagtttgctttcacaaaaatactgttatgtttgagctgaacttcatatatcagagttgtgcatgagttgttcctagtgctatcttgtggtatcgtttgtgtctaggctcgcgtctctagtacgttctagcctaggaccagcacggtacttgactttgaacaattattcaactttgcattatctgatttgagcatttgctattcctttgctacatatttaagcctacctagagctccacagatttgattgcagccgtacagcaagtgtttgccaaggcatcgatacatccaacctctattggggtgcttgattgagtcggtgtatgtcaccattccgcttgccttggtaagatcttgtaagagcttagttaaaagcttgagtttgtgtgatttttgagctgccactatctagtagttaataggaacgcgcatatttttgtgtatgtttcttgtttgctactaaccatggcaggattgtgcccgcggaaacgagatggtcatgctcaacgtcaacatcttcaccatcaacgagatatagcgacttcttcacgcatcacatatgaggtacatgataatgatcttacaagggtagaatctaaattgcctggttttgatggtaagtatgattccgccgcttatgttaattgggaactagcagtagaaaaacaatttgatgagtatgatttttctaatgctcaaatgattaaggctgctagtaataagtgtaccggttctgtgtctttttggtggcatactgtgggaaataagcttgaaacttaggatgaatgcaaaatactgatgagaaaaagatttgtgttttcatactatagacgtgctctccttgagaaatttgaacatctaaaataaggtgacaaaactgttagggagtactttcatgattttaaaattggtatcacttatagtgatttacaagaatctaatgagaacacaatgactagatttttcagatgacttaattccaatattcaggctgggcttgttaatgtgacatataatcatataggccaattgttcatgcttgcttgcaatgttgagcgcaaaattttggagaacccaacggagcaacaagctatgcttgtgcctcctatcactgatgttttgcaggaagttcagaacagtccccaaaatgagaagaacgatatgtttgagatgtcacttccttcactcgcgaatgaggagaaggctaatgcacctacattatctgaagagggcataaaaggtaaattaaatggtgcagaaattactcaagatgagtatgcttctgatgaattacatttttccactttccatgctgatctagagcaaactttagtggaacctacttctgaattgcctttgtcacaagttgatttgcattctgttccttgtgataaagaagagttgtgcgatagtacttcacttatatccattccacaactagtgaatgaacatgctacttttaatcttgattctccatgtactgaatttaagtatgttattcacacgtccagcgagaatgatgaacttcaattgcaatcttctttaaatacattgggctatgttatgtttgatgattcttgtgagctcaattgtttgaaggacaaaatatttgctcattctgattagccaagtcctcgtaatgttatatttcacatctttggcgattataatgatcttggaatatattctgtgcatagagtttacatctgctcagatttagaacatcctgtacatgtggataaaacatgcaagctagagaaaatgttattgctaaccaaattgtctcgagtttgccttgttttgattggaagaaacaggttgttgtaaatggactacgcaaagagcactatatggaaaaaccgaggacggttttccgtaaagaaggggaggatgatgtgaccatggctaccacgtatgcaaccattgctcacatcatggatgaacaagaagatatcgagatcaagtactccaagtgctggaatctgattcggccacctactacactgctgacttcaaacggccaccgaatctgcatacgacctccgttttcggcccgtgagtacttgatggaaagctctcagagccctctttccaacggatccagcctcatccccgaattccatctcgtgtggccggaatcacaggcacaaggtgctgcgtcacctataatgggcctatgggcttgtaacttcatttgggaccccggcccaggtggggcccatgtggggtgcgccccaaccaggtggagcacgcccctaggcatccctaggtcgtcctcccacccctatatatagctaggtaccccttcagggtttattggttttgtttagataaagttt

SEQ ID NO: 59472 - DNA, 1585 bp, Oryza sativa
agggacaggggttgggaacacccttaaacgaacgcagccatagtgtattagtgtattcacgatcattgaccagctaagtcgtcagccagtcaaccctctcctatgctattgttgtcatgcatttacaacggatgtatctctacatatatttaagagagagagagtcggactctgactctaactataactatatcataacacatattacaactctaactaaaaaatggtaaccaactttgtatatatattcgatacaaactctaacagataccacctaatgttatttctagtgcatctggtatgttaccctaccatacatcatgaggaccatacattaataataccccctttgactagggctcctgtcccccctcctttctggaaaaacaatatcatgtgaaaccattatatatcaaaataacccatgttttataaatcaaggataacattaaccatgtatttatttgtggctcaaataaatatggtttctacctacatataccatacctgatcgaacagctagacgatgtttgtcgagacccaacaatgtaatgtcatgattgtcaacagtacttgcaacaattttcgtaggtatgtgagtcattaggaattagctttgcacgagttgtgctttgtatgggaactacacacgggcttactgagctttttgggctcaatttgtttcgatcatgtaaagtttttcttctgtaacatagtatagaattcctttagttttcccatccaaacttgtgtgaaccaaagtatcactgtccgctcattgcccactggctgttcgaaaactggcagtaatggttatgagccaggcagtgattctgtaccctgtactagtgaactatacgtcaggacatgggagtataggttactcatgcacgtatataactacattgcagttaaattgcatgcaacatgtgtgtagcttcatctgtatctttactacttaaaaaattcgtagtgatggtggtgagtcctgaacgatcgaagggttaacattcatcgaaggatcctctcacaggcatcagcggatgagattttctcccacgatccacccgtcgcaccccttctcatctccccgatccgcatcgcgctccctgtctctccgatccgtaattccgcatcgcactccccagccccccatccttcctcctcggcgcgccgcctcctcaccccaccgacgcgccgccttcccatcccgcccaacccgcgccttcttctccagttgtcctccctccgtattgtgccgtccctcgctccgcccgctcctctctctctccatcgcgccaccgcccccctccataaaccatgacctccctcaaatcccgatcatctgggcagccgtcgttatcgtcggactgagctcttcgatcatcaccctccgttgctgccgctgcttcggagccattggaatggaggatgggaatgcggacctcagtatggttgaggggttggacgagatgatggcggtggttgcaggcgcgcccaccaccacgctctctggagtgtggagaggcgcgcgcccgctgctgcaagtcaccggcggtgtcgtcggcatcatcattagctagct

SEQ ID NO: 59473 - DNA, 15053 bp, Oryza sativa
tccctctcgccggcgtcacctcctgtcgccgttttggccgctagccggagcaccagctcgtcggcttgaccgtccaatgtcggttcccctctcccaaaccgacattgctgctcctataaacccaagctcctccccctccaaatctccctcgttttcgtctctcgccgccactgtcgccctgttcgctgtcgccgttcgtcgttgcgcgtgtcggaagagccgacacgagcaaggacgcggaaggggacttcggccgcgccctcttcctcctcttcctcggcccgaggccgagacgatcacgtttcgcgccgtcggctctcgtcactgcgcccgcccgcacggtagtgcctccctccgttcttcctcctcgttccatctcctccccttagactcgggtagtagcacgagtagcctccccgtagctagccggcgccgccccgaccgttgccgccgctcgccacgtgctcgccgccgtcgccgcccgagctcgaaagcgcctctcgtcgctggcctccctcgatgcgtttcctcctaatccgacgctagggacggattcccgtagccgcgtagatgctctcgctgccgggaatcggcccctcgtgacctcgtcgccgtttcccccttcttccgccaccggttgccgccgccgcaattcaccgccgtcaagcttcctccggcgaatccgagccgttggctcgtctcccctcgtctcgtgcaaccacccggtgtgctcgctttcgcctgttccggccggcatcgtcgtctacctcccgccggcccgcgtggcagccacgtaggcgccacgtcggcgccagctcggccaagaccgggtcgagccgaccccggtcagccactccctccggccccgctcgcgggcgcgatccaccgcgagccgtgaggctgcgcgtgggcccgccgcatccgcgtcctccgcgaaccgcgcgcgtgcaccgcgtctcttccccaaaccctagcgcacgccgcatactccctccgcatggtgagccgagccgctgacaagcgggtcccacccgggaccacgcgaggtgagcccggtccaccggctccctctctcctcccctcccacgcgcgctctgggccgccttttgggccggccggcccattaagctcggccgagccgccccttttctctcgggccgcgccctagccacccgagggaagtctaatttccctccctcttttcttttcttttcttttctttttcaaaaaggatttaattaaatccttttcctttagaccaaaaatccaataatcttagaaattcaatatcttcccaaccgtaaatccgtttgactccgttcaacttccaaaattcctcaaatctcgagatctatctaatggcatgcttagaggtcattaatagggctttattttcgccgtttgttgagttgtcccgttttgcgtatagtttcggagcccgaagaccagcagtgcgaggatttcaaggatcaagctccagatctcgagcaaggcaagccacctttgaacatcttgagcctatatttgaatttaattatgttgcttgaaaaatattatgcattgataggatcgcacttaatctgttgtcccgtctgcaaggcagattggcagacctacctaattcgttgcatttgatccttcctttgttaattgttatatcatgtccccttgtaaccatctagttgcgtctcgatattcgtgcaccctgtgcgagtatcgacggacgccttcaaacttaaaatctgaaaaacaacttgggtaaaacttgggttttacaaaagacttggaaaacccgacacctgggtcggtgcttgcgaactaaatgaatttccaaaaccgcggaccggggaacgtaccgggtgtacggtttccctctctcgcacttaaggaccgattccttggaatttcatccaaacataagacaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacttgttgttggtctgggacccctctcgtcggcatatggtaaacctgtgtcggctttcgaaatgccttgtcatgaaagcttggaggtctcccaacgtggccgatccccacgggctgggtgatccgggttagtaatgtcgtgtgggtaaagtgtaccccttctgcagaggttaactaactgttcgaacagccgtgcccacggtcatgggcggatgtgaggtgattcctagcgtagttttgtttgcctactgtttgtgaaattgctgtggtggaaaggagatcgatgtttggaaaatctgcagctgatgggatcagctaggcccgggtggccgtttgaaagttgttggcccgggtggccgtttgaaagctgttggccgggtgccaatcttgatctattttaaagattgatacattgcacatactccgaccggacgagacgcactgtctcatccgtgtcgtttgagaagcactcacttagttgtttttagaaaagagttcaaataaaatcaattgcaaaaacaacaacctttccttgaagcctgcattaaacacttatttcccatggcttgttgagtactcccgtactcacccttgctctatataaataatccccccagttgctgaagaagatgaagcggaacccgctgataaggagttcttccaggagcaagccggctacgatgagttttagggtttcggcttagttcccaagtcgcgcctgtgttgattggtccaagtcctggcttccgtttcccttttgtaatgcagttgtgagctcgggatctgtccgcagcccaacatgactgtacctctactctataataaagagacctctgttgctgtgacattctatctccctatgataccaacactgtttcctgggactggtatcgattaacaggttaatttggagcgtcacgggctatttccggtcgggattagttcggggcgtgacacctagccagatccatgttgcatgttaattatgacatgggttgtgctatttcttggtggagaagatcgttaagtatctcctggcatgcatgccgctgccatcaacattctttcttgatggctgtgagcatgtcatattttatctggtgttatcccggctgatgagcatcccgttcgatttttttttctttgtttacattggttaagcttgatgtatttttcagatttgcttccatggatcagtttggtcaggtagtcttgttgcaatgcagagttttagatatgaacggttcatatacttcatatcatagttgtacacagtggtttcttctaatcattcccatctgattcttgggagtagccaaattagtacatggtcagatattaggaaggaagagcagtataatatctatgtgcagtttagttctaatttaccggctattctcacacgttggctttttttattgactgagatatcattttcactacagtccaaatgtgttggtcaattcataatcgatcagcaggcctggaatttgtctcaaggtatatacatggaatagtgttccaatatgagtagtgactaaagcagattaatttgaattgtgaacagagactctgtcaaataatcaggtcagtactaaaattctattgatcactataaaattacaatctcatttgatgttgcctttttcctggtgatcataggagtgaccccttttttcatgcttcaaaggcatatggttttgtataaaattccatttctcagtatagaagttaaaactctcatttttgtctgaactaataaactatattgttcttctccaagatttgttcactaagttgcaattgatagcaacttagatatcatttttcttctgttttcactgcagtccaaatgtgctagtcaattcataatcgatcagcaggcctggaatttgtctcaaggtatatacatggaatagtgttccaatatgagtagtgactaaagcagattaatttgaattgtgaacagagactctgtcaaataatcagactctgtcaaataatcaggtcagtactaaaattctattgatcactataaaattacaatctcatttgatgttgcctttttcctggtgatcataggagtgaccccttttttcatgcttcaaaggcatatggttttgtataaaattccatttctcagtatagaagttaaaactctcatttttgtctgaactaataaactatattgttcttctccaagatttgttcactaagttgcaattgatagcacatttctacattttcttggcgcgtccatttgtgcctccacagttgcctaatatgctaccactgacatttcttattattcattcctgtttcttagagaattgtatttatctatgcaaaattgcaactcgatgtactgaggattctataagcttttaaagattactatgaacacacagtgtactgtccagagaattactcagattcatttatgtctttaatggattagattccatgtaaattcagttgtaatcctttaagatgattttcagttttgtatatatatatagtttgttcaaggcatataacttgaaatttagcatgtaccagaagattattatcagcagaccccaaaaaggtcacactccaattttgatttatcaagtgcatgacccttgataaatttactcatgtgtgtgatgtccgtgactgcttcccgaagcaccaaccaattttgttttgaggaaaacatcaactaactatgtatcacctgagagggtaatattcagaacttgtgatcttagaaaatgaaaccgtattcttctgtgccaatgcctaatggttagagaaattcttttcaagtatacctgatagtctgatacattaaccatattcctttgtttagaggaacattagccacattctatcctcttcatttgccagtcataataggcgagatgctttaatgcatatatttttcgccgttgcaacgcacgggcacccaactagtatataacatatactgagtgagcaactgagaacaacacatcaaggggaggcagtggtttcacaactcactgccgtggcgagggtagcatagggatgggaggcgtggggaaatcagttgaaacaattgctcaaactatttcttaatgctcaaatattggaagacacaaaactcctccaccgtctgaaacatcctcagactcttccggtaaaacacttccatcttccggcaaaacacttccaactgttctactttctatgcttccgggtgctacggaagcagtgttgtcttcagacacatcccgccctcaattggaaatgccctcagaaggtgaccggaagaagctaacctatgggttgttagactgaagaatagtgaaagatgtattgtagatgtctgaaaatcaatatctaccctgatgtaatctcagtgtaaacctaatcttactttgaaacgaaattcacgtggggtccccccccctccccttccctgggcagtgatttggtaaaaaaaaataattgctcagcttcagtagtagacactgcagtgcagtgtgataacccttactgtgataatctatcaccagggttttacttttacaagtggctcattaaaagtccatttgtactaatggctaagagctccggaggggtttagaccacagttggtttgttagtcaacttttgatatagtaattaggtgccacgtgtaaaaaacaaaaataaaacagtgggcccaacatgtcagcccacctctcccatctcatatgcacttctctttctcccgatctgtttggccacgcacggcgacaactagacacctgagcaggcttccggacaattggtttgcaagacgagctcgctggccccaacctgctcatggtcatgaaattgtgagagacgacgtgagagaagcaggagaaagaatagggaggagcctatgacatgtgggccctactctttctttttaatgttttttatctgagtgtgtccatgtagaaaaaaaaaccttggtttggatgaggggtgtgatttgaatggtttcgatatatagttcgtggtgttggatattcggttttgaagttgaggttacagtacataatggttaaagagagagtataataatggttaaacagtttagataaacataatggttaaagagggtataatagatttatccccctttattaatttgccactctttagatgcgagattattttatgatttaccaatgtgactgacatatcatagcacacaaagggtcctgcgtgttattgtcatgatgaacggtgaacacagaagtactatatatgaataattttgacaagtgctttatcactgattaacgtcataatttgcacgcattacgaactgtcagaaactgaataattggattattctgcagatggaatgtgcacgtgcatgtgggggtgaaattgattctgaaacaaaaatatctatttatcgtcctgcgtagttatgactggtgagtagactagttgcatttggataagtttatattgacacaagtatcaacagcaatggccttaaaaagacagacaggccgaagattgagcagtaatctacactacatagtgtcaaactgtcttgatgaagcactgtttgtgtacatatattggctgtatggaagaacacatattacccttttttgcaaaccccagaattaatatataaaagaaactatacatgggtttgaggtccaagaagtgtgtgaagcaagatattgggtatttcttttttattttattttaaatctttctattctgaattcagttatatggcataagcttgagaggcatgaggaatatagaagccaccatcgttgtgctggtcagattgtggaggacctgtgattgtttgcccatggctgagagccgaaccagcggcatgcagaacgctcattcggtttaatctggtgtaagccgttagtttcccgtgatcacgaggttgacctccaagtctccaaccccaagtctggtttgatttcgttctgtagtaccaaatttggtacgaccgagttgctacgatatgctttaatcaaaataattgcttcttgggcacaatttggcactaaacctgatggcatgaggcaccgagaaggatcttgtctcaaaaacactacatacaaattatgagcaagcgcattctacatactaattaagggtcatagctagggattgaaaacctcggtgcgaaataaataacaggacagtaatatttttaaatacacgctatagaacatgtactagcaaagacagcggtagcgtgtgacttggagtttgctcgtgccctagcgacatccgacatcataaataaaaggaagagacaaaaaagacaacaaccaatacaaacaaagcaattacatgggcttcaccgaccatgggcccgcatgtcagcgaccatgtcagggggcagtttgcatcagaggatctgcttccctaccatctagcttcaccactgcacaacttgcttccattgagagaccaatacaggattgaaagacatggggaaccaaaccaaaccgacgaagtgatcttcggaacaggtttacacacgagattgctcatcagctttaacataagattccaaagtttaatttggtacagattggtttaatacttatacaagagtagcaatccaagagtgttctgacgatgattggtttaatacttcatgacgtgttgttccctgctcaagaaatggtcatcactattttgatgctcttctcaaaccattttgacattttgctgtcttgataaatgttcattaattatgtcacgttgccgtagtaggtatatactctgattaagaaacccaattaatatgcttttgttcaatcgactgagccagtatagcaagagaaggggaaataagaacaatctctagcatcttttgtggaacttttactacaaaacagcatgcttgtaactcactagctagtacataaccggcaatcactaccaggcaccagctcatcagtagtgatttggattgaactggcaatcaatgagtatttgtaccagttcataccgtataggaagttttcccatccaaacttgtgtgaaccagagtatcactgtccgttcattgcccactggctgttcgaaaactggcagtacgtaatgctggttatgagccagcactactacagatccgggcttcagtgacgggtcatctgtgacgggccaacgcaactcgtcaaagatgagtcatctctgacgggccgaaaaaatatcctcttcaatatatggctaccagggaggacccgtcacagatgtgaagtcatatgtgacggcttgcacttgtaacccgtcacagatcgtctgtgacggatcacaaccatggctcgtcacaaatgacatgtcatctgtgacgggtgtagtattatgaaccatcacaaaagagaccactcatctctaacgggtctttaactaacacacgtcacagataacgttatctctgacgggtggtagttatgacccgtcagtgatgagtgaaaattcaaatttttaaattttgcaaaaaaacctcggattgaaacatgtcttatataaaagttgtagctctcaatgatatccacaactttataactaacaacatttctattagagatcgtttacatccccgaacatgcattacaagtgatcagatctacttttaaaaacaaaattttgagttttttttcaaatgacatggatggatacatgccccgtatcaaagtcatagaactcaatcagatctacaacattataattgaaaatattttcatttcacaaaatttacatgtttataaagtgagatatattttgaaaaatgaaattttgaattcttcaaacaacatcggatgaagatattttctatgtaaaagttataaaacacgatgagatctataactatttagttgataatattttcatttgaagtcatttagggtgttaaatatatgttaaatgattcagacaagcatagacaaaataataacattgggttagtagtcaatatgtgttgagtaggtgagttggtaagggaactctatatggaggttgaggtcttgagttcgaatctcacttgtagcatccaagttatattgcgtgaaaaattgtgaatttgtaggtagtgatgtgtaaccatgtataggatggctagtaaaattcaaaatatttttttgaggttttttgttgcgtttaaaattcaaaaattgtatttcttgctttgtcatcagtgacgggtcgtaagttacaacccgtcagagatgagttatataccactcacagatgggttctatgcgacggttgttacatccgtcacaggtgattttgtcatcagtgaccactaatcactgaccaagaccaaacccatcaaaagtgagggttcgggcccgtcagagatgacctggtccggcgtagtgcaggcagtgattctgtactttgtactagaaaactacacgtcaggacatgggagtataggttactcatgcacatatataactacattgcagttaaattgcatgcaacatgtgtgtagcttcatctgtatatataacatatactgagagagtaactgagaactcatcagggaggcagtggttcacttcattaggtggtttcaaagttcattgccgttggtatgctagattgttgctggtagcgcagtagcatagggatgggatgcatagggaaatcagtcgaaacagtagggtcaaactgtcttgatgaagcactgtttgtatacatatattggctgtatggaggaacatatattaccctttttgcaaaccccggcccaaaatatataaaagaaactacacatcggtcatgaggtccaaggagtaagtctatatggcataagcttgagaggcatcaggaacatagaagccaccgtcgtgtcctggtcagattgtggaggacctgtgattgtttgcccatggctgagagccggagcagcggcagacagaacgctcattcagtttagtctggtgtaagccgttagtttcctgtgatcacgaggttgagctccaaccccaagtctggtttgatttcgtgctgtactaccaaatttggtacgactgagttgcttcgagagatatgcttaattaaaataattgcttcgcgggcacaatttgacactaaacctcatggcaggaggcaccgagaagtattttgtctcaaaaatactacatacaaattacgagcaagcgcattctgcgtactaagagtcatagctagaaactgaagacctcggtgcaaaataaataacaggataataatatttttaaatacactatagaacatgtactagaaaagataacagtagcccgtaacttggagtttgctcgtgccccagcgacgtccgacatcataaataaaagaaaaagcaaaaaagacaacaaccaatacaaacaaagcaaagtgttttttttttcttccctgtgtagtagtttctttttccttgttaatttgcttacttaattgttagtactaacatatctgctagagtttagtctgcaacagactgcaagcccatgtgtggttcagtgacagctagttgcattattgcacagaacaaaagaacatatccacacctggattggaatcacctgcagtagctatatctaattcaacttaagcagtcctacagctaccattggatcagaaattaacatcttagatatttcctaaatactgttcacaggagaccgtacaaagttgtattgtaacagttactgtttaaatcactgtagcatatgtttggaccgttgactgcctttatccaatgatggaaagcgatcccaactgccaaacttgcaatccctagtatgacagcaccggatccttatccatccacaactatatatgacatcgaaaaggggttgagagggtgaagttcatgtcgtcataatttagcctgacaaaaaattaccaaatgtactaattaataggcgtataggagaatgctatgtataactgcagttatattatccattaataactcttaagaaaaaatattatgaaaatctagatggtgctgcgcagttgaggcctaagttagcacactccattctcaagaactacggcattaatagtgactttatattcatctgcaatttcgaacacatacttcaaagaagagtgcaaacttatgagttgaagctaagcacctatcatctacttcagtatagctctgccagttagaacttactcccttcgtccaaaaaaaaaggttttttttggacggagggagtagaaattaaacaccatatgaacaagtagccagtacagaaaaggcagagatcggtaacaagaaatcactcgtagatacaatacaacatgtactatgtaatatcataaagggtctttcccaccccaaaaactaaccaatgggatgaagggctcctccacttatacataacctctcttgtgccctcccgcaatcaatgtgagactattcaatactctccccccttcacaagttggtgtccctcagccgttcaccgttccttcaccgcccacggtcactcaggtatataggccccgcatgcacgcacagtccatcaagcattcacacattttgtctctcgggttagagttgttcaactagttagcctctgataccaattgtataatcgtaaagggtctttcccactctaaaaacgagccaatgaggtaaggggttctcccacttatatattaggtttattgtccttccacaactaatatggtattattcaacatactagacctccatttcgcatgatctatcgccgctttatcttctctgagaagataaaatgtgtacactcctttctcaacgagacgccaactaaccctacataccacacatcacatgtttgcattcgaattgcgtgcgttattacagcatgtaaggtttggttgtctgtgttgatcacaaaaggggagagggaacagcatgcattgtatgctcatgcatgctaggttgctaggtagacctaggggtgtaagtggctaacccgcgaaacccacttataggctaaaataagccgcgagcccgcttattttaacctataagtgggttcgcagctgacccacttacacccctaggtagaccgctagagcttggtagtcatggtttggtctcaagttgtctacgtgattgtcagttgatctgtggacttgggaggcataggaaatttgtcagcaccaggattagtctcctcatcatgaataagagagcagcggtggatccagcgtagaaaagtgggaggggttgaactgaacaccaacgttaactcaattatctcgcatacaagacaaacgtggctgtaatttgaagtggtttcatatgaaaacattgagagagaaaaaaaggcaaaatacatcacacgacaattcaatattcacttgatctctaatctcaaatggatactaacaattggttcagcattcctagatcaataataatatccgagcaataaacttcactcttgccatttcaggttgtctagcttgtattcttattgttatctacagtaggagtactactgctgcagcttgaataataattcaaaaatatccttttcgaccttttgcaaacttgcaattctaggagcagccgagcagagatgatagattgctagctgagaaacaaaatttaactatgctaaatttccaatgctgagttgggctgatggcttgggagattttggatttctgctagttgggttaatggctgagtcgaaagcctaattagtgatcaactgcacgtgcacctagccacctggcctaatatattgacgttgtgttgatacatacttttctttaatttgtaaagaaaaaaaaaagcaagcgatgttttcagcatacactggtatggatgatcgtcagagtacgtttagagtccacatggccataggtcatggctgtgaattatcaggcttcagtaaagtccatgcgattgctttcacctagatattacacaatatatatatagtactatatggcctttaaaagaggttgctaaggaggtcaagtgtgtgcaatggaagacaatgtctaacgttactgcaagctgaagtagccaggtagggaatagcaaaacaattggtagatatgccaggcatgggttgcttttggcttggaaggtatcaggtgttagtaatcttggttacttagatccatggctcgatagaaatcagataaatttacaattccaccattctttcttactaaggagaaggaacaaatttgattggactttgcactttggcagtatgtgaccaggcgccccagcggtacaccaacagcgcgcgcaatgaggtgtggatatgcaaggttttcaatttcgatttcttccaaaattttggccattttggttctactgtaattcctaaaaattcaggattttttggcattttttgaccggttttttttttaaaatcttaacatattttaactgaatttgactatattttgatcaaatccgtaaaaaaatgagaaaaaccaaaaaaaattggccgagataatctcttgccgtggggggagaggggtgccgaaatttcgggattaggaggtatcggaaattcagcggtctccacggaccacggtcaagtatccatgtcttgaaatctaaggaacaaatgacttgccatcggagtccatctcattggtaatggagtaagatggcccagttcgtgatgtcgtctctacccagcatgccataaagctaatagttgttgaacaagctagaatgtgatggcacgttaaaaaacttcagttgattatatataagcccgcatgtgtttatatttcgtgtcaacaataatgatggttttgtttgcgcaggtttatttatcaaattagataatatatgaaaataaatactatcgcatccgttacaactacaattgttatccattacgctaagagcaatcttatgaaaatctagatgatgtacaggcacgattgggagctgagctagcaacgtaagaccacagcccacaagtacaatttatgatcaagaacttaatggcattattatggcttgaaattaagcacttattaagcaggagaaacaattaccaactcatatacttcaacgctaactcatactacttcaaagaagagtatatgaacttatggtttcatgaaattaagcacttaccatttgcttcagtataactccgccagttagaacgtataatagtgcttacttcgtcggcgccgttgtgtggctacatatatagccagtaaaacatcgtctctgcatcttctctgagaagataaatataggcacccaattttcaccgagacaccaatcatccattaaaccatccgcattagattaattaattgatgcccatatatatcttgcctccagagctgagaccaggaaggatatggtgtgtgagtgacaacgttcctggtgatcacaaaacaggagcagctgcagcctgcagcctgtatctgtgtatcgctagctagattagtactgctcgaactgtggacatgatcgtcactgatctttgtggacttgggaggcataggaaattcaggactaacatgtttagtctcttcagcatgaacaagaggatgaaacgctgcatcttcgacgagcttcgtgtgaaaaacagagcgaactaggagacactggacacttcacagcactgatatccctgttcctttctaagctaaaaactagctatttttgcatacatatgtcacattatgcatccaagaaaatcattgtaagctttctttctggaattgggcatttggtatgacatgcattgtttaattctgcctatattatccattaacgaaacggctaaccttctttcgacagaaattccatccccaaatcttgcaaatttcgggactccggatgagcttcgagattcgtgctccaggttctcttccaactccgatgacctcctcttctttttcggcgccggcgacaccctagactttggcgaaggatcctacgagttagggtcccggggtagagtggggtggggtgggggtgggaggggg

SEQ ID NO: 59474 - DNA, 13144 bp, Oryza sativa
cgccaccgcccgacggctgccccgggcgtctcgccggcgccgttgacaccctccggccagccggcgaggcgggcggcgacacagtagggcggtggcggcgggggatcaggcggagcgaacaaaagcacgatgggcgcggcggaacgagcgatgcgaggggaacggaaggaaaagagctagggttaatgtttctgcacgaatcttaaagcatatccgatagtctaaaatttgaaagatggaaggtgagattttctatcaagagatatacagacagtccctattaacaaaaaaaaagatacctgaacgttgtgttgtgctttactgtcacattatattggctacttttttcacacatccatttgtccaactctttcccagctgcattcaaataaatgattcttgatacaaaagcccacagcaacgagttcagaagacagtgcaccgcgcattagttgtgatattatatatttataatataggcatatatagttgtgctattctgattaagagaagacattagttaacagtgacttttttttttgtccaatagaaacaatttcatactcacacttcaacgcgcatgtttttgtcctaagggaatatcccccattttttaacatgtcattcaaatggttttttacatgtcattcaaatagttataatatcttttgaaaaaacaaactgagaacatcgatggcattagaaggcaaagatgggattaatcgattaaaagtgtgatgagaaggaaagttttctaatatatctactttataaaggagaggttctcttataatatgagatgagaaaattcagctagaatgataaaggtgcattagtgcatccccggagtgtttacaaagtaaatttcatctactcctgacataaaaatagcagctcaaccagtagtccatctctatcagtatgaaacaatttggcacactttaccacattcggacctcggattatataacagctaaaaattaatgccagttgtactggatctatcagtttgatctctttgcaattatgaagcatcacatatcataagaattgatctacaagaacacaaatatagacagaaaaatgccccatagtcaggtcttaatattgccacagcctcattggagcccaggatatggcattcaacctcatgtacatgtagccgagctgtagccattgctcctccaaacacaaccattgcagctccacgtatatatcgtcgatgagcatcataggcatgaaatgggattatgggatagtgatatattaattggggactaggatgcatcggaaattcgatagtgtctagaggtaatgctaccgccatgaaacacgggggccaaatgtcgtctggttgccgtcatgcatatggctaatgcagcgaaagatggcatagcttccaacctcgtgaaattaggaagaattgggaaaccatcagcagaagatcatggacgatctcggctatagtttctttgttagcctagcggctgccagtcacacttagcagtaaccggtacagtgctggccttctcttggactatgtggtggtgattatttttttttctttcctagctattgcctcctaggactctagtcttgtaagttttctcctgctctattcaatgaatttttgcactgtatggtcaggtgggggtggctaatacgaaagcacgtgcttggggtctaattcacactcgacataacacagttagagtcagtttccgaaactttccgaatattattacttgtactaccaataaaccctccatacaaattgtcttagaaatagaccatcgtatgcttacatcatcatttatgtgctcttctccagcaataatttattgtcattagtaatatgtttctgccagagttatatggttcggaaaagtccatgtacgattcagtgataaatagctgccacaggcccatagttgcatcacaacacggaacagaagacatgcatgcaactatgtatgataatatgaccccgaaagaggatcgatgagagttcaaggtcaaacgcagtcgtagatgactcaatgttgctatttactgatatactttctccgtcaaaaaaaacgaatgagacggagaaagtatgcttcggagttgggagtgggactaggagacaccggaaattcagtctgtttaggaacagtctcctggccacggaccagagtggcaagtgcagccaattatgtggttgctgctcgtgaatcaggattaacagcagaaaatgatgttcttccatgcaagatgcaaaagaactgtacacttgggagtccatacaaattctcctttcgtgcatttcacaaagcactaaggaattcacaacattcgtgaaaaaaaaaagatccatgttatctctctctaattctagaatttgacattatatgacgtactaactgagaattactctaaaaacaaatcactctgtaactgtaagacctttttcttcctccctctataagataggtgaacagccttccaaacagtgtacccaaaaacagaccgtcatatacataaatgatattttcccttatatatggatgtgtttagatccaaagtttggatccaaacttcagtccttttccatcacatcaacctgtcatacacacccaacttttcagtcacatcatctccaatttcaaccaaaattcaaactttggatccaactaaacacaacctatatctttttgtccaccagagtttggtctgcaagtcctgtctatgattctgctgcagttgtatcataaattattatgtattctagttaatgcagacgccggggaccagggagttatactttcattatatatctatctatatatatagatgaacatacaatgggatcatgatggtaaggtcatatcaacaattgttgatgttgtctctgcctagggaatggcataccaatacaatggaatactctacatcatattggtaatcttggaactagagacatcggaaattttcagcggtgtggactactctctccaagccagaaaaaaaagaagatcgaggcaaatgtcaccaccgtgcagaatcatactggactcctctggcttaaactagaacagatccaacttgttagacttttgcatgtatttggggtgtaggaaatagttaaaggaaaggtccagattcccccccccccaaaaaaaaaaaactttaaattaaagtttatctagcaccctaaactttgaaaccgaatattcaatcccctcaatttgacaataccatttatagaaccacctaaggtggttttgcatagttatttttatctaattgttatataagttggatgagtctgaccacttgacatagacattagacatatatattaaatcactacttaaattgttattttttacctattattaactttcacttactaatagcgcggtacaaacataataatagtatggtatcgatgtataaggataaattgatgacttacaactgatgatatacatgcgagatacggcatttaatcggttgtagctgtaagatcaacgtgtgttttgattctaattctgtgatgaacaattggtacctgtgattatcggttttgatatttggagattatcgtcgaagtggttttggagataatcaatttccaggagatgaacagggttactggtttgtcgggaccggtcagatcgggcggtggttgccggtcagaccggcgctatgtgagcggtcagaccggcttgcccgcggtctgactggccgacgctgtgtcggtttcggtttcgtgttgtttatttggatatccatgattgtttcatggttatggcttctagatggatactatacgtatgtaatactgttctttgctaacaatgagtcgagttggagatagcttggtctcgaaatatggtttctttgtttgtttcatgtgtaggtgactcgatgcctcgggagagtatttgcggtgatggaccgggagtcggcttggtggtaagacgatgtccgtggtggtcagatatcatgcgggatactaaggctagagttgatgtacgtggttgatggagattctatatggcatacgatggaggtattgtgtgcgtatgggatgcggagtcgaatttggaaggagtccaaatttggtacgattggttatgtggagtttatttcttgtactagagggtttcctaaggtgtttaggactcttagtatgagtttggttcgtggctttaggctgcctacctcatgtataaatagagagagagcgtgaggcttcccggtatcgcttttgagagcaattgagttgctagtttagttagggtttcgagtttagtcgagatttttgtaaggagtgctgttggtgcactttgtaaacacagagagaagcaataaagttttcatctactttgagagttcttcgatttatgtttcaccgggtttcggcggtctaaccggcatctcaccagcggtcagaccggcggcatcgcggcggtccgactggcggtactagggcggtcagaccggcggcggcgacaggagctggcgattgatctcggcggttcgactggtgttacaaccttggtcagaccgacgatattcaggcagtcagaccggcgctactacttcggtcagaccgcgatccattgatttcgagggtaacttttatttccactaaaagtttttggtttttggatataccaactattcacccccctctggttggactagttcttgtgattcgatcctacaagtggtatcagagccacatttgctctttttgatctttaccgatcttgagttttttccatggctacttctaataagtttacaactaagcctcatattttcgatggaacagatttttctcattggtgtagtaggatgcaatcttacattatggctgagaattataatatttggagaaaagtttctctttcttatgtgattcttgaaactattaatattgctgctgaaaaaactacttttgaactaaattgcaaagctcgcaatattcttttgagtgggatttctcgttcggattatgatcgtattgctcatcttcaaactgctcatgagatttgggttgctttgaataatttttatgaaggtactaataacattaaagaacttcgtcgtgatttttttaaaaagaagtacattaaatttgagatgaaatctggagaagctttgaataactgtcttctcccatggagagacgtgtaggttcgtttactatattgtcccgaggcgtccagacctagaaagaaatccatccccatcgccttctctcgcccttccgccgccatcttgctcgccttcgtcctccggccggccactggggagctacgcctacgccctgccccttccaaccgagtgccccaggtccgctgcttctacttctacatctgttttatctttatcctctcggttggaaagccaattttttttcattttctcgttgttttatctttgatatttgcagaacttgtgataccatcttatcctgcagcagagcaggccggacgctccctggattgactgcaaagcagatcgaatcggtttgttgctccgtgcttctactctttcttccccgcaatctaatcttgctagctagtaccgtacccaaatcacggagattgtctgttctttctttttttttttccctctcgttcttactgaatcttcactatattttctgatgatttttttttcctttgaagtttgtggatcgacgatgagcctctcgcgacgctttctgaatgtgattatggacagccgcatccttgggttgaggtcgctgcgccgcatcgacctagcgcgccagaaattctttaacccaggaccaccactaaacggaaaaggatcggtggccaatgccgactgtgaggcgtcaaagatgccgaggattcatcttcccgacccgatcatcacgttccgagcttcacccaaggacgacgaccagaggaggagcatccaatacctcccactcacggagagcaagatgctctgcgcggaccagtctgggcgcaccttcctcttcgacgccgagacgcaccacgtggtgaccatgcccagcctccacaaacccaaggaaaaacccctctccctcttcatcccgagcgcagtcagtcaaaacatggacgaggaggagtatgatgaagactatgttggcaccctctttgtcatggagagcagtcccaatatggagctgcgctacaaagaccagacgagtgaccagtttgaggcgtacacctatggccagcagcacaagaagacatccttcaagtactggaagtgccaactgctgccgccgccgccttacctacgtgaccccatgcagatgaaggtccgctccgagatcatgtcctacgcagtggtcggtggtggcacctaaatcttgatatcaatggaggacgttggcacctactgcatggacattgcgacccacacttggagcccggttggcaagtggatgctacccttgtatggcaagattgagtatgtgccggaactcaatctctggtttggattctctgacaagaaccacctatctgctgctgatctctccaacctggactccaaaccacagctagttggcacttggaaggagtttgacccgctggaggactgggatctactgcaggggcctcagcttgtcaacataggctcgggcaagttctgcattgcaaggttcttcaatactacgagaattagctactacggcgatgatttcattgaccagacatttgctatcataaccggtgtggaggtggtgccacgtacctaccagggcaatgggaatggcagtgccaacggtggcaaagacaacagaattgcaagcagcaattgcaatggcagtgcaagcaacagttgcaatggccatggtaatggcaatggcaacggcaatggtggcaaaaagaaactccgaatgatcaagcacaagtcgaaatgtcacaccactactgacggcactttcattgagtcagtgttctaatatattttgagacttgctttgcttccaagaagattcccttagtccacttttcattagtatcttaatagactataagaggtatgcttgtattattaatgtcacaagtttggacttttgttttatccattgtgcatcctactatctattagtaaccctacaatctctggatgaagtctagtagtgtcacaccccaatctgataccgccgtacaacggcacctgacaggagcgtgtcgtagggaaaacggcgcgaaccgcttcctacgaaaccgcgatctcggtaccagtcccaggacatagtgctggtacccacggtgacaaatatgaatcatagcaatccttaaataaatagaggacttatttaccttaacttaggttgcagctcagacagcccgagaatacaaccgacaacacggacgaggcgaacaccaacaacaacagcggcagcggaaccaacggtctaacacccaacaccacaggcgacggctgggaaccaggacgaaaccctaatcttcacttcactttgtcttctcttcagggcggaggaactatatatatttatatggagcaagggtgagtactttcgtactcagcaagtcacgggaacttaggtgtttaatgcaagcttggaagagaggcaaggttgttttgcaaatcttttatttgaagatattttgaaatcactaagtgaattatttctttctaagtttgggtcgaaaagagacttacgtctcaaatcgacttaagagatgcttttcaacagctcaaatggaaatgtaccgacctcccgggtcagatcattacttctcggctcccagagccattccacttgaataatcggctcccagagcctttttcattttctcggactcccagagtccagctgcccagcagcacaacaatccgcttccactcgggaagcctagtctatgatgcccgcagacatcccgaatcacacagattcgtttctgaccactcaggtcgtccatctgccacataggctgattctggttacgattcccacaccacaacaacttttcacaaagcacaggcaaacaaatctacgcaacgggaaccacctcacatctgcccatgaccgtgggcacggctgttcgaacagttggttaacctctgcaaaggggtacactttacccacaagacacgaacttactccagacactggccggtgtcagaggttcgcgacaaagcctttcccaagccgacccagggatacctcatgccacatagaaggatcaaatcctcacataaacataggccattttaggcgttcacaaatcaaactccaaccacctcgatcggtaattcagcaagcttctcgttcttgcattaccaggaacccggtttggctccaaccgaccccgccccaacgttcccaactattggcatgcgaggtttccctgaaccgactagttacttagccagggtgtcccattccaccttgtggttgcactttgattatgttcgatgagtttcccataggaatcggtccttatatgcgaatacgggacagtgccacataggcacaacccccgcatcgcaagttttcacaattcattttattttcaaacacaccgacaccacatgtcgggttttgaaggcttcacaaacccatttcccaagttttcgacaaacaacggtgtatgtgggatatttggtatacgcgctcagagagcacgaataccgaggtaccacaagggtggagcgacaaggaatcagggtagtacgacctacggaaattagtgcgactactaggtaggtccgtcgatttggcacgcaaaccgaggccaagcaagttaagtgtgtgattataataatgcaagttgcaaacaaaataataatgacttttcaattataggggcaattgatcaaagggtgacttgccttgctcaaggtcttcacgaagcttcacgaatcttcgagaaaacccgcgatcgacgaaaatccgataactgcaactatacgcaaacaatcgaaaacctaaacaaaagacaaaaagaaagatcctatttagactaattagtagtgccattaaatagatctcaatttacggaattattggaagttgaacggagtcaatcggaagagcggttgggaagatatgaattttggaagtttaattggaatttctggaagacgagaaatggtttatggaatttatagaaataatattctcaagaatattattgacagtcactgacgtgcgggaccaaaggaaaatgattcatggaattttggaataaagaattttatttatgaaacaaaggaaaaggatttattaaatcccttggaaaattaaagggatgagggatgtgatttggacttgtctcgggtggcattggtgcggcccaaagggttgaaggaggctcggccgagccattgggccgggcgcggccacggggaggcggcccaacagagggggcgcgggggtgagagagacggcccggtggaccgattccaccgcgcggggtcccgggtggggcccgcttgtcggtgatacggcccacggtgggatgggcgcacgcgagggcggcgctagggttcggggggggaagcggtccacgcgcggcgcgcgggtggacgcggtgtgcggcgggcccacgcgcagcatgtcggctctccgtggaccgcgcgcgagggtgggggacggagggaggcggctgaccgaggtcagctttgacccggtcgcgtcgaggtggcgccgacgtggcagccacgcgggccgggcgagaggaggaagaagaacaggagctccaaccaacggtggccgacggcggggtttcaccggagcacgacgcagcgattcgatcgagagggagttcaccggtacaaaggggagcacgagaggggttgagccaacggctcggatccttcgaggaggggccgacgacgacgaatcgcggcggcgcacgccggtggcgggaaaagggggaaacggcggaggggtgacggggattcaattcaaggcggtgggggcatgtccggggttcaagaaatccgtttccggcatcggatggggcggaggagcaccgaggagggctagcgacggcggcggcctccggaagcgggcggcaatggcggcgaggccatgccgagcggcggcggagctcggggcggtgtctacgcgctttcgaggggctagtagagctaccacgcaagctagagagggcgagggagaacgaggaaggagaatggagggagtcactaccgagtcgggacggcaccgtgacgagtggccgacggtgcgggagtgagttctccgttctcaggccggggaaggggaagaagggggggtgctcggagtcccgcgtcacgcgtcctcgcacgcaccggcctccccagtgcttggcgacgaacggcgacggcgagagtggagtgagcaacaacaatagcgcggcagtgatggaagtgaaacgagaggaggattcgatgggaagggctcgggttttataggcgcggggtgaggcgatgtcggtttgggaggggagaaccgaccttggcggtcaagcgctcggctggcggcagcggcggtttcgtgggcgatgcaaaagcggcgacggcgtggatgctttgggcggcgaaggcggtggatcggacggccgaatttcgggtcgtgagcgcgggctggcggtcgcgcccgtggtccaggcggtggcaggcggtgacgccgatggtggtcgggaaagggaaaaagaaggggaaaaagagaggctcgctccaagccgattcgggaagggagtaggagggagagggagagctcggcctccgggttttggcaggacgcgcgtggagcggctcgagcacgcgcgcggggccgtgcggctgcgtggtgcagcgcggcagggcagcggggctggtgcggcggcgacccacgcgcgagcgcgtgcacgcggacgcgagggcgcggcagggctgacggcggcaacgaccggccggtcggccacgcacgagcgcgggaaagagcgaaggcggtggcgggttttgggcggcgacggcgggaagcggcgatggcggcagcgctggcgtgggagagagagaaaggaagcagagagagagagcgaggaaagagagaggaagaagagaggcgatgcctctctctctctcggcgcgtgcagcgcacgtggaggtggagggagctgaggagaaatgggccgagcaagggagaaacggcccatagccaagaaggacgcaatttagacttttttcgagagaactgatttggtgggggggtttcaattggagagaatttgagaaggatttttggaatttaaccttgatactttgactttaggaacataaggtgaagtcaagggaaggattcgaggcgagatttgaataattctagattcgtagaagtatttggcgaggattcaaaggaaggatttgaatttcagaatttgatttcagagacttgaatcggaaaaggaatttttcgaggtggaggatttcgatttcgatgagagggaacaacgggattaaattgagatccttggcacaacttagactctcacacaaagaacgaaaattttcgcaattaggattttgccgagttagtttttaacgactcacgaaaagcggagcgttacaagtagtaagagactagatggcgtgctttactgatgtgtgtctccgtgtgttgtctattgatgtgtgatatcatctcctgcaatgatatagcttgtaagataccttaattttgcccttctataatcgggatggtattatttctttatgaattgcctcccaactgcgatggtttttttatatgctctgtgattggttacatacttaaccaaaaagcatttcaattttcctcattttttgggtgaggtttcctattagtctggagtcggcacaagtaccacgttctgttaccatttatatggtaatgttagatatttgtatgacctgctcattgacctgtctacagtgaacaattgtttgttacgatgggtattggacacagaagcacaaaagtagtgctaaactattgcatcgtactcaaagcttacgtgagaggtttgcagttatacgagagtgcgagatccttgaaagaagagcatgagcttgagttgaaattaagcacttattattgtcttttgctcaaatataataacactgccatttagaacttggaaaaccaccatatcaacaagcaaccagccggtacagaaaagtcagagattgctaaccggaaatcgtgcaatttcaacactggatcaagcaaattcaaccgagaagataaatgtatccacccaattctcaccaccaatcaatgtacacacgacgtattttagatttgaaggttggctggtgcctggtggagcagctgaccttgtgaaagttggttgctttgctccgctagagcatgcatggtaagttatggttttgtctcgagttatcgacaattcgtcactggtttgtgtgcacttggaggcgtatgaaattcagcagctccattcacatgactcaaaagtaatgatgttcttcgttagttccctttagaaatgttcatttgttattctcaactaaatctttattttatctttatctttatttttgtcttggcttacttaaaaaaaattatagtggttttgtcgtcccacctaacatatctaccctgaaataggaataggaaatcaaaatataaggaaaaactacaaattctccccttgaactatcgcggtcgaccgaattacctctctaaacctgaaaaacagacattgttcgctctgaattttcaatactggacgaattacccccctcgatctaatccagagtagtatagttctacatggcgtacacatggcaatctagtcagtattttcttttttaaaaagttatgggacccaccgtcgtatctccccttcccctcttcccctggaagaaaattatgtaccctcatccgaaagacttaattcctctgtacgacacctgtccccgcacgaatcacaagacaggcttactcccctcatccttctgcctccggttcctcattctctttgctctcctcggcgaggcgtcgagctcgcggctgtcgctgtcgcgggcatcgagcgggattcgtgatgtggcagagaaactcagcagcatccatgctcgcatgagtcgctgctcgggaagaatcgtcaagccatcaacatattataatcctgaaaggctc

SEQ ID NO: 59475 - DNA, 3081 bp, Oryza sativa
acaaagaaatgtttgaaggctcaatgataatcagtgcaatgcaccatacagactaaactcaacggcaagcaaaatctaatcgttgaataatttcatcgtgaggcaactctttgcagttcaaggagcagattcgaatcgatgacacaccttcttccaaatcttgagatatcttgtacaagcaggccggaagcacgagcttgatgccttgattctaattcctggctgccctcatgagctcgatgctgcggggcgccgccgcgtgggctgtcggacgggcccgagctcgactcctcaccagtcaccaggagcgaaagaatgaggaaccgaagcgagacgagggggattgagggagtaagcatgcgctgtgattcgtgcggaacaggtgtcgtgcagagcaacaaagtccttcggatgagggtaagacttcggtcttacataattttcttcccttcctctctctctctctctccacacactctctctcacagggcggcgcggaagaaccaagccctgggcgggcacccaagcgccgtgaagaagtgctggagcacagtcagcggcggcggcgcaacaccggtgcgacggcatagcacggtgaagctggcgaggaggcgccacgcgctcggcgtgagctagctcggtgcgagcccgaagtaggcgagcacccggagacgggggcgcgcacgccgggaggtcgacggcgtggagcgcggtgaagccgcgcgggaggcaagccgtgatggagaggcaggcggcgactggaggcagaggcacctcgtcttccccgcgccaccgcacaccacccgtccacgccaatcgtccgcccgcccatcgcctgtccccgcaccgccgcccaccgcctgtccccgcgccgctgcccaccgctcgcctcgcgccgtcgccatcgctcgtccccgtgccgccgcccaccacctgtccccgcgctcccgcacaccgcctgtccgtgctgaccatccgcctgtccccgcgccccctcaccaccgccgcccaccgcctgttcccgcgccgcccgtcagcgccgaccatccgccgcctcgacacgcctccccgagcgagctccggctgcctcctgctctgggagatgagggtggcggcggcggccggatttggggaaccggctcaccttcgcctccggccccagccacgcgagctcgctccgcccacgtccgccattggccgccagagtgcgctggggggggccctcaaattcgcgtgattcaacttttttaacacccaattcacatgccctctataatatgtcattagccggggaccctcaaattcgcgtgcttcaacttttttaacacccaattcacatgcctctatgatatatcattaggactgctaattagtctatttggtaccaatttttctatgttttctgtatttctcttttcttagttctatttgtatatttttcaaagtttgtggacgtttttgcccatgggcccacctgtcagatcaaagagagaaatatatgtctggttctggatcgattgatccctccaagcgtagcgccaccgccgccccacacgcgctacttcggcgtcgccccgccgccaggtgccactaccgaccgtccgacccaccgccctagcgccagcaccgacccgcagccccaccatccccgccgcccaagtgccaccactcagccgccgccgagcgccaccaccgacgcccccgccggcacagttcaccaccacccggccggcactgtgcggcaccacctccagccgccccagccatcagcgccattagaggtttgcaatattgcaatatacctgaaacttttggctacaatatgcatgtctgttacagactcaatgtcctcaagcacccaggaaatatgtaaatgagaactaattaagatcctacaacattcagtaagcagtcatccagttgccatcatgctcggcactataagcgatcatctgtaaataagagctaggtgccgatggagctcatccagttgccaccatactcggcgtcggaggcggtggaggcagaacgggggcgtcgacctggggtggcggcgcacagtgctagcggcgctgctcgacggcggggtggtggggcgacgcacccgggcggcggccgctcgtcggcgcggtggtggggcggagccgctcggcggcgcagtggtagttgctagtgtctggtggcgctcggcgtcgctggtgtctggtatcgatccagaaccagagagatatttctctttttatctgacaggtgggtccatgggcaaaaacgtccacaaaccttgaaaaagtatacaaatgaaattaagaaaagagaaatacaataaaaatagatgaaattaagaaaatagaaatacaataaaaatagagaaagtggtaccaaatagactaattagcaatcctaatgacatattatagaaggcacgtgaattgggtggtaaaaaaattgagacaagcgaatttgatggtaaatagtctaaattctcggggggggggggggggggagataggtgggcccaagggttttttacccttttttctgctgactggtctgccatgtgtgctaaatcaagtcaaaaccgctcagaacagtgtcaggggttcttagtccggtataaatagtttaaggtgtaaaatgtctggtatttaagcttaggggagcaattcgtttaaccgtgatagttcgcgcgggggagggggtaattcgtactttttctaaaatataatgtagagtaaaatacaccatcggtccttaaacttgtcaggaggtttcacttaggtccacgaacttgtaaagtgcacatcgaggtccctaaacctggtttattgtattatcccagtccaaagccgcgtttgactgtgatcttgcctacgtggcacgccacgtggacaataacatggatttttttttattttttttctcccttcttccttcttttttctcttccttccttcttttttctcggtggtgagaggcggcacgaggggaagggttgtcgcagtggtgaaagaagaaggaagaaaggataaaaaaattccatgtcagccttcacgtggcgtgccacgtaggcaggaccacggt

SEQ ID NO: 59476 - DNA, 4224 bp, Oryza sativa
ttgcaagttcgtggacctaagtgaaacctactgacaagtttaaggaccgttgatgcattttaatctactagtaatagtgcacgtgcaaggcacgttccagcactatatatcatggtaaacatataaacacaatcaaacggcggtgaccggcgacgacgggaggcggagaccggagaggtagggcgtggcgcaccatcaggagcgattttttctagatttgggtggcggaaggcatgggaggaggcggggcggcggaaggcggggatgaggcggggcagtggaaggcggaggaggaggaggcgcggcggcggaatgcgggggaggacgcgcggcggcagaaggtggggaaggaggaggcgcaggtggtctggcgacgttttttctttcgatttgtcgaaggaagggaccgagaagcgctaatcgcatgttaatccgacgctaattgcaatcgtgatgttaattgcactatacaactcgtgctttttatattagtagataatgtaacttgtaacttttcgctctcttgccagatcggtccctccccatatggcttctgaatccttctccctccctataaccgaccgggaaaataagaaataggaaatagaaatcagaaacagatcgcttgacagaacctgaaagatagaaatgaaaagactgaaagcatttctgaacattctgaagactgaagagaagggagtaatgaatggctgagatcgatggataacggttcgctctttacatccaacggagctgcggatgaaggaccactgcagacttcaagtttttgtcattatcgttgctttactctctttacagctgtaagatgattcctgatgtaagagactatttaagttggcatttggccagatgaagaagataagaaagaactaaatttccttattgtctttaggagtaggctaattagaaccctagtttatcctttcggcgaccaaccagatttgttgagcacgtcagagagagagttgattacccatttctgagctcgggtcttgacatcgctccctccccagacctaacaaccttttttccaaaaacttttactttgtagaacctcagactgaaaataggaataggaaataaaaaattataatgtaacttgtaacttgtcgctctctcgccagatcgctccattccaatatcgcttataatccctctccctccccaaactatagatggccatattgcctgcggcccgtggcccagcccaagcacagcatggcctgacaggggtcgtacccgtgctggcctggccctacagccgtgccgtacttgggctgcaccctcggcacgtctggccggcccggctcagcacgatcgaagaaaaatagtatagggatgcaaaatatacttaaataaccatatagggcaaggcccaaaaagaagagatacaaaatagacccatttttccaaccatatgaataggaataagttcactttggatccctctatttgtcgcctagcctgactttcgtccttgatcgcaaaaccgggtatgataagtcccccaacttacaaaaccgttcaagtaaggtccctcggcagtatttgactccagttttagcttaggtggcgcctacatggctaatttgacccggtgatcatctgacatgacattgacgtggcgcttacgtagcaattcgatccgaaaaataataaaacctctataggacccacatgtaagtttcacgcacactataataaaaaaatggtggggcccacgtggaccccacctgtcatcctcactaccaattctctctctactccatcttcctcctctctccagccgaagcggcgggtggagcggtgatggcggcagagcggcggggaggagtgccggcggccggagtggggcggggaaggagcggcggcggcctacgacgacaattgcagcaaggaacgccatgtacaccctaatctgcatcaagaaaaaaaaacgaaaaggagaaaatcggatttgtatcaaagctgagaaatcgaagaaggagaaggagacgtagagctggtcgtggttgtcgcgcgagaaggagacctcgcaaaactgacgtatcttgcatcagagattcctctatacggagtcatcatgctatcgcgctccccgacttggatcgagcacgctgcagacaccttgtctcgattctcgtcatctgctaatctgctctagtaaggcctcctttaatggtgcactagctcatgcttcatgcttgtccatctcatataagagatagcaaaaagtctacctctctccaatagattgtctcatagcacattgtttaaaatgctttgggtttcacaattcctctcacattttctttaggaacttagctcttgaagaagagatagtgcattctctctccttatcttctctctcttccacatcatacaaaaactgatatggagatttatgagctagctgactcatccttgttggaggaggcctaaagggaaaaggaagggagtcgtacgaatcgagaactaggatgaataccgactatggcatgacatgcacacatcaatcggtgaagacggaaaaaaaacaaaaaatgccatcgatttagagaagcatctgcagaaaccagatctgggaatgagaatcaaagaagggttacttagatatatgccattaaaaatttgccggttttaaaatatgccatcagtattcacgtatttgaaacaatgctattacaattttacacagattcaagatatgtcactacctaccatttacaaaaaaaaaatttagatcaaattacccttctttccttctttttctcccctctccttccttccacagctcagagaacagggggcggcggtagcagcgagcggcagcgtcggagcactcgtctacccggagtgccggcgtctccttgactttctggcgttgcggctctggccgttttatcctggaacgctcgtcttccttggcgccggcgagccattctacctgttgtctgacccgttccgacttcctctgcgttccctctccgccatcttctcccccgtcggaacactcgctgacaagctcctcgtcggcctcgcccggctccgggcagcgtccacccccggacgaggtcatcatcttgtcgctggagacgaccacggcgatgcacctggagaagcttgggttctcgccatccatcgtggagcaattcctgcggccgttcctggccgggatactctttgacccggcgctcgacacgtcgtcccgtctcttcaagctcgtgttcaagcgcctctcccacggcggcggcagcgagcggagcgagcggtagcagcggcagcgtcggagtgagcggcggcggcggagcggcaacagcagtgagcggcgagcggtagtgtgcggagcggcggcaagcagcaacggcagcagcagcgtgagcggcagcggcgttgagcagcaatggcgcggcagcggcagcagcagcggtggtgacggcgccggagcagaagcagcggggagagagagctagaagataagagaagagggagagaggtagaagatgagggcattttcgtcatacatgcaaaatacatatcttagtggcactactgagattacaaactaatagcaatggcatcgttccaaatatgcaaatagtaatggcatatttcaaaaccggcaaatttttaatgccatgtatctaattaaccctttctattttctacttcctccgtttcataatgcaagtcattttagcattgcctatatttatatggatgttaatgaatctagatatatatatgtatagatacattaacatccatatgaatatggacaaatgctagaatgacttacattataaaacggagggagtatttcttattttgttggttccggtttcctatttctttttttccgggtcggttctaagtatagttgccaaatggaccgcctaggcaaggttagtcggggttagtcggggcgtgatgcctgggccaaggttagtcggcccggcacgccccgaccgacacgctgggccatgccgtaccagcctacgggctgcatacacggcctaatatgactcgggccatgccgggccagcttgaaggcacgacaacctatcgtgcttctttatagaataagtctatttttcgtccctcaactatgtgggctatattcatatcgaataagttcacattgggtccttctatttgtcacccagttcgattttcgtcccttcaccgtaaaaggggtgcagg

SEQ ID NO: 59477 - DNA, 23024 bp, Oryza sativa
  unsure (1)..(23024): unsure at all n locations
ttcctgcagcccattgacgtggcacctacatggcaactatatctcggaaaaataaaaaaaaaatatggccccacatgtcagctgcacacaaaaataattttaaaatggtggggcccacgtggaccccacatgttacctcactcctctcttcttccctctcccttctctctcttcttccctttcctctctctctctgtctctccttcccgggcagcgacggcgcgggtgggcggcggagcaagcgagctccggcggtggcagcggcgacgggcgtggtcgagcgccgccacgtggctgcctcctccccttggaagccaatcgtcggaccgcatctcctccttccggcgcctcctcactccgactcctccgcgccgccgcctccaaagccagcggtgttcccataccctaggtctaacgccatttccatactcccgacctcccgcgcgctgctccttccctcctagcggccaccggcgccgctgcaacttgcaagcctcacatatcacagtcgctgccgattcgccgccgtcagctaagctccccaccccccactatgcccgcacccgattgtcagatctgtgatttctatgttcggtttctctgctatgtttcccccggttgatggattctgtgatttaaatttgtgtggcatggttcaaattatccctattagaatatgatataggcatatatagttgtgttattctgattaagaaatgacattaacagtgactttttttccaataaaaacaatttcatactcacacttcaacgcacatgtttttgtcctaagggaatatcccccaattttttacatgtcattcaaatggttttttacatatcatccaaatagttataatatcttttgaaaaaacaaactgagaacatcgatggcattagaaggcaaagatgggattaatcgattaaaagtgtgatgagaaggaaagttttctaatatatctactttataaggagaggttctcttataatatgagatgagaaaatccagctagaatgataaaggtgcattagtgcatccccggagtgtttacaaagtaaatttcatctactcctgacataaaaatagcagctcaaccagtagtccatctctatcagtatgaaacaatttggcacactttaccacgttcggacctcggattatataacagctaaaaattaatgccagttgtactggatctatcagttttatctctttgcaattacgaagcatcacatatcataagaattgatctacaaggaacacaaatacagacagaaaaatgccccatagtcaggtcttaatattgccacagcctcattggagcccaggatatggcattcaacctcatgtacatgtagccgagctgtgtagccattgctcctccaaacacaaccattgcagctccatgtatatatcgtcgatgagcatgataggtatgaaatgggattatgggatagtgatatattaattggggactaggatgcatcgaaaattcgatagtgtgtagaggtaatgctaccgccatgaaacacgggggccaaatgtcgtctggttgccgtcatgcatatggctaatgcagcaaaagatggcatagcttccaacctcctgaaattaggaagaattgggaaaccatcagcagaagatcatggacgatctcggttgtagtttctttgttggcctagcggctgccagtcacacttagcagtaaccggtacagtgctggtcttctcttggactgtgtggtggtgattattttttttctctttcttggctattgcctcctaggactctagttctgtaagttttctcatgctctattcaatgaattttcgcactgtatggtcaggtgggggtggctaatacgaaagcacgtgcttggggtctaattcgcactcgacataacacagttagagtcagtttccgaaactttccgaatattattacttgtactaccaataaactctccataaaaattgtcttagaaatagaccattgtatgcttacatcaccatttatgtgctcttctccagctataaattattgtcattagtaatatgtatctgccaaagttatatggtttggaaaagtccatgtacgattcagtgataaatagctgccacaggcccacagttgcatcacaacacggaacagaagacatgcatgcaactatgtatgataatatgaccccgaaagaagatcaatgagagttcaaggtcaaacattcgtagatgactcaatgttgctatttactaggcaatggggatttgtgatatacagtatactgatatactccatccatccaaaaaaacgaatgagacggagaaagtatgcttcggagttgggagtgggactaggagacaccggaaattcagtctgtttaggaacagtctcctggccacggaccagagtggcaagtgcagccaattatgtgattgctgctcgtgaatcaggattaacagcagaaaatgatgttcttccatgcaagatgcaaaagaactacacacttgggagtccatacaaattctcctttcgtgcatttcacaaagcactaaggtattcacatcattcatgaaaaaaaaaggattcatgttatctctttctctaattctagaatttgacattatatgacgtactaactgagaattactctaaaaacaaatcactctgtaactgtaagacctttttcttcctccctctataagataggtgaacagccttccaaacagtgtacccaaaaacataaatgatatctccccttatatatatctttttgtccaccagagtttggtctgcaagtcctgtctatgattctgctgtagttgtatcacaaattattatgtattctagttaatgcagacgccggggaccaggagttatactttcattatatatctatctatatatatagatgaacatacaatgggatcaggatggtaaggtcatattgttgatgttgtctctgcctagggaatggcataccaatacaatggaatactctacatcatattggtaaccttggaactaggagacatcggaaatttttagcggtgtggactactctctccaagccacgaaaaagaagatcgaggcgaatgtcaccaccgtgcagaatcatactggactcctctggcttaaactagaacagatccaacttgttagacttttgcatgtatttggggtgtaggaaatagttaaaggaaaaggtccagatccccccccccaaaaaaaaactttaaattaaagtttatctagcaccctaaactttgaaaccggatattcaatcccctcaattttacaataccatttatataaccacctaaggtggttttgcatagttatttttatctaattgttatataagttggatgagtttgatcacttgacatagacattagacatatattgaaatcaccacttaagttgttcttttttacttattattagctctcacttacaaataggtacaaacataataatagtatggtatagatgtataaggataaattgatgacttacaactgatgatatgcaaccgagatgcggcatttaatcggttgtagccaccttttttccagcacaaccatcacaattcgcaaccccacatatcattgatgtccatgataagcgtcaaatgggactatatataagtgttatgctaggactaggaagcatccgaaattcagcaatctcctattcatcgaacagcggggaaaattcgtcaaatgggactataggagtgttatgctaggactaggaagcatccaaaattcagctatctcctcgcatatcattgatgtccatgataagcgtcaaatgggactataggagtgttatgctaggactaggaagcatccgaaattcagcaatctcctcttcattcaacagcgggaaaaattgtcgtgccatcgatatccatcgtatggcaaatgcagctgaagatggcatcttccccacgaccccgaactggaaggcatttgagaacaatttcctactactttgcttgaagaagagattatgatcgaattggtgaggaagtgcaaacagcaatgacatctctcctcaaaagcatctgtaggttctagattaaactatgttttgtttcattcgttgctgtatttatatgccctcgtttacttccaatgtgagagaatttgagtaaactaaaatgcatgcgagaaaaggaacttttccgttcattgaagcgtaatgtctagtttacttaaaaaaatacaaactattctgacttctttttcttcattccaagatgttagaacatggtgaaagatctagattacatcattcctaccaccagaagaccgcactaaaaattgtcaaagaaatagaccatcgtacacatacttcaccatatgtgctcttattgcaataaatcattggccaagattttatatgattcagcatgtccatgtgcgattcatgacgttcgaatccattggaaagagtggattaaattttggattaaagtggcacgttttttaaactgctaaacggtacgtttcgtatgaaaactttctatatgaaagttgttctaaagtatcatattaatccatttttcaagtttataataattaaaactcaactaatcacacattactaccacctcattttgcgtgaaacacttaatcttcatcttcatcttcacgagattcaaacaccaccacgacagcgacaaatagctgccacagttgcatcactgcacggtacaggccggagaacaaatccacaactatctatatatatgtgataatatatgacctgaaagaggattgagagttcagggtcatatcgtagatgaatcggtgttgtttgctaggcaacggggttgtggtgtgtatgcttgggaatgggactaggaggcaccaggaagtcagccgtgtccaggaaaaatcttctggccacgaagcaatttgaccaatgcatggaggccccggatttcagctcaccatggaagggcggtagtacaatttggagatagaaaacataatggtttaatttaatttctttgttcttctgttctaagttcgcacgagaagcgaagaacttcgagttctctcctaagtttgtacactcctgagttcgcacaagaagcggagaacgtcgagttctctctnactacaacgatttcaattatcagtaaatttagagagaacaataataactaatatatgccataagaacgtttccgtgctttgcagattacaaagttagaaaaagctaaagccgtagaagagctccctcagcgtaatatagcaggataatactaatcaaagaaaatccattatcaaaaatatactaacaagcatacggcgtacagtaatgtacgcattacaactacaggttttgtctaggataacaatctcattaaaatccagacaatagatgcccaattggcagctatgcagctaatgaagcacaagcataaaggccacaactaatcaagaacaacactaacagtgactttctgtaaaacgggaaacaattttcaactcatacttcaaaaaacaacgttaacttacgagttgacactaagcagtgtcatttacttcagtgtaagtctggcaagaaccaccaccaaccatatcaacaagcaaccattacagagaaaggctaaggtcgctaaccagaaatcaattgcagatggaaattcaacactgaactaactctgatttccggagaaaaggcaatctcggcttggcatcatatgataaataggtttcttaagagtcatgcgggatgcccgtaatgctggactttagtgctccaggtggaagacgcattcagttaatcgctgaagtttgcttgcatcgagcttctggttagtcttaacctttggttttacgacagtaagcatcctggctgccgcatccaagctccaaccgttttgcatggcatctgtaatgattattaagacaactattgtcatcagcttctgaagcaggcaaatatcatgcagaaagtcaaacacaatagcataataaaatttgcagaactaaaaatgcttcaaatacagagggatgcttattccaaaaatattcaatatgtttttcaatatgtttcaaatatagcaagttttagttatagccatagaaagagggatacacgagccttgatgcattgaccacaaaaaaaaaataattttcaatatgttacatgaatgacctacgaaaaattttggtaattagaaggaagaagaatgcattcactatattgaaatggtaaaatgaagacaactctttttgagtgggttgtgccaaaatttctactaattttatactccacaacagtactcaagccaacagagatagccaattagatgtgaaattgtggatatacctcattgtgaacatcaaaatcaatgggccagcattatcacaatgatcaaaacaaactaaaattcatgcacacaaaagtatgtttaattttgacacaaccgagtctcaaagacaacaaaatatctgacactttattcaaacctagaatgtacaatgctcaatccaggagaaatgtggacaacactgatggcacaaaatggaattcaagtattgtatgaaggagaggtttctattttctattgtgaaaggaaagtaatgtaatatgcagtgttataatccagtcagtacaatagaagtgctacccaaaagaagtccataggggcaccatcattgttttagagttttagagttggacacggttattaagaaagtagatagaagtgaatggtggagggttgtaattggatgagtagtggaggtaggtgggaaaagtgaatggtggagggttgtgattggttggaaagagaatgttggtggagaagttgtatattttgggacaaatcctgagggttaaaagttgttatattttgagacatagggagaaacatttaccttccaaaattcaaggaacttgcaaaaacacatattggacgaaagattataatctatgaagaaatgctatggaagttgaaaaggatgcagtgtatcctaaaattgggactttggatgatttctacagataaagatgactaaaaacaccatattaaccatgtcagaacttctatgatctatactgttgattaacatgaagatagtcagaacattgtacttaacattaaaaaacatagtacagcaacaagatagtttcagaaaatgtacagttagtagcatcctcctcattcatccccatgaagtgagccacatcagcaacgctgattgtggaatatgcagaagtcaacaactggaaaatcctctttctgtagctttctgtgtaatcagaaaacaatattggatattcaagttaaccaattataaatactaaaaaaaatataaaacagcaggctttatacttatttcctaatataaaaataatactagaagattagttggttaaacaagcaaaagggaaacaatcatgatgttattaacttattatcctgattgacgtattattatggtatatgtcatagtaagcacttcatggaaagaacttaacttctctagttccactactgtgtcacaatgactgctggtaaaatgttaacaatcaccttataaaaaagtgcaaatgtttaattataatgctattacattaatacattcaacagtttcactcataaatgataactacaaagtgtttattttgattgaagcatgagttaatgaacatcctctgtgcatctagaattgttgcatcatgttgtcaattagaagtaaaaataggaacaaaactgaacttcttgggaaccaaactcttatgagcagcctgaaaataatcaaatcactagtccttattaaggagatagtataaacccactgaacaaggctatcttaggaagcaagtatttccaagataaacactttaaccattacactacgcagcacaaaactctactaacgggcactctactaatagtaactttgcgtattcattaaggaagctgattcagcctgattgtgcagataaatcgtttccacaattactccatgaagtatatgtatgcacatctgaatctcccgacttcccaacccacaccacaaagtggtgacctccaacacaatactaccacagtatgcaattcattctagtaagcaatacaactttgcacaaagacacagaataattcaactgttgcacgtttccatcatgaacagtaaagcaacaaccagtacctaggaaggcggccacgaagtcggcgatttcagggctccactcgaacccctgcgcggccgcgtagacgcccgcgtaatcgcggttccagaggcactgcccgatcctccagacggcggcgagctccggccgcgcgtccttcgcctcctgcggcgtcgacttccacagaaacctcgcgctgttcctgctcacacacgcacccacccagaaacacaaaaacaacattaatcccggaagccctagcccagaaaaattccatgggagagaggtgggggagcagatcgcggggcgttacaggtcgttgaggtagaggtgggcgaggaggtgcacggcgtagggccagccgtcggtggcggcgccccgggacgcggcctgcgcgaggaacaccgagtcaggagcgctacgctaaccctcctcgcgtcgcgggaggcgggagaggggtggggaggggagggattggtacctggaggaagaggtcgtcgcagagcggggcgacggaggagtaggacttgccggcgagggcggcgtggacggcggcgagatccatcggaggaggaggtggcggtggtggccggccgccggcgggccgaggcgaggggagaagaggggaagggtttttggagttcgagtaaaattcggaatttggggcagatttggagaaatttcaggaaaggaaataaacggggggaagaaaaaacccacgtgtaatcgtgtatctctctggcccatctgacatgtccggcccaggctggcccgcgagggatagggttgtttctttctccaacatatactgcagtttttttttctttttgagattacatggcagactctaagagacggaaatcagccaaacatcttttatgttactaaaaccctgctaaaagttcacctagatttgatttctttatgagataacatggcagactctaagagatggagatcggtgaaacatctattatcttattaggatttaaaccctagtggatggagccatgcacccacgactccatcaccacccactagtgcttccccaacatgctgcaaatttgactactatttgattcaaatttggaagtagattgaatactactactggttggttttgtctatttagagagagcggtgttttattggttatggtaaatcattactacaaagtatctcccgaatacactccaaggttacgttacggtgcataacatcactagaatgttcacagaaacgagctaataaatgagtcgcggcattcaacatagataaacatgattaaaactaatagaggagaaacccactgctatgaccttgatgtctgcaatcactatgccatttgaagattggtccatggataatgagttaactctccgtatgactgcattcagaattactagcgttttgaaaaccttcttcgcaagtgagagcaacaacgcggcgtagagccaatgcttcagcaagctatactatggtaacctcttttgtgcgctcattgcaagccaataaatcacaggtgtagttttttattaccatgcccactcccattcgacgtgtttactgaaaagttgcagcatcaacattgatagcaacaacatcacggttttatttgaatgagttgattcgaaacaaattaaatactatttgatggtagtttgaatgagttgaataaaaactgttacgaaatgagtaaattgcacagaactattcgtaactacaaatttatgtatatcacaaaattacaattttaacatcaatattattataaaactactagtttcaagagtttatatttgggttgagctacatgctatgattgtgtgataaaattagtgttcaaatttgtagatctacaatattatgcattagacctgtagtattgtggtaaatttgatgctattgtgatacaccctcttaagtctgtagtttaatgtaagtttgggtaaaattgtaatactgtcataaatttagatcaaaatttgtgcttttctcatacaccctataaaaattataattattgttttgcgatagtatggtaaggtggttcttggtacaaagggccttaggaagtatccacttgatgaactacattcatataggcttaatctcctcctgactaaaggcctatttgtaatggataaattttggaagctgtttatgagaaattaaattaaattgtttgaaaatcctgtaaattacagacattctgggacttttgcagttggaggattggagtgcctccatgccagatggacagatatttatatataaatcaatcatcgtaacattaaactgcaggaacagaagcatgttgtttcacaatcactaacaattagtggaatcaggcaatcagctaatccgaatgtcaaacagctgcccagttagaattacgcgaaacatgcacaggaaagtcgagcaaaaacatatgcaacgtcaccatatccaattcaaaagcgagttcgatacgatttgcacattcatagaaaatgctgtgcgatcttccaacaccataacaaatggatcttctgagctagatttgaggacaacacactaaaaagatgctacaatgcacagttggaatggtaatagaactgaggaaaaagcaaatggaagaataacctagctacaaaatcataactagccgcatcccccacactgaagtcactatgtcaaacttttgaacataaaaacctaaacagattaagttacagcagaagataacactaatctaatgaagacgagtcactgcattggatagttgacgagccagccaatctctactcttgaggaggaggaggaggtccacggccacggcctccaccacgaccacgtccacagcctcggcctcgaccacggccccttcctctgccaccttctgtagttcacaaaagatgcaaggcaaagtaaggaacaaatgcaaagttacgtatgcaaatttgtaacacttcaaaaaaaaatccaaggcaaaacagtcatagtagttgtaaatttaaggttaaatattacttttgtaacttattttacacatctgacaaaataatcttaaatttatatcaacataaaccataaaaaatcaagtggctctcggacaacgttcagccaacatccattaaatgtgtgataaatgatagcagatagtatatttcagtacaaaccaataggtaagaaaaatacaatcgaactgaaggaactataatttataatgctatttctaggtaataaagtttaagcataactaaccatgcccttgcataggaggtgcattaggctccccatcatcatatccaccagcttcttccattgcaaaaccatctccaccataacccctgccaggtccaaaggatccacgcctgccccttcctcttcccctgccacgatatccctgaggctgtgggacctctgcatctccatgctcatcatcataatcttcattgttgaaccctgaattgcattcatagaggcatcagatcaacaccaagaccaatcataatttgcagggatataaactttacaatcatcagtaggcagatatttacctcttcccctgccccttccacggcgaccacgtcctcttccacgaccactgggcacggcctctgcctcctgatcaaagtcagttggcggcctgacctgatcagccggtatcggtggttggtaactacacaaagcaaagtcacatcacatatgttttgaagagataaatattgcatgagtatgttgaaaagaaatagaccgccagataatagggatatatttggagcaaatattgcctacaataactctatggtttgaatnttctagcaaatataataagtagcagcagtagtatactgagacagtctagcaaaaagttaagatatgcgacacgatgaattttaaatgagccattcctgcaaagaattctatcttatcttgaactactgacaataatcatatccaactagagctctcttagattttttttacaaaaaatcgaaaggggaggaagaaagtgcagaattctacttacccaggagatgacgtatccagctccttctttgacaatgtaatggtaatcaaggaaacatggcgggtagtctcaaggctatcataaagacaaacaatcatatcaaacacataagccctttccaaaatagatacaggtacatggaaaaaagattgtgtgatcctcacgtgttaagcccttcttccaatggttcccaagtgtcagttatgtcgattgattcaatagaggtattctgatggagaccaacaatccttctctgctcagggagggcgtagatcagcacatggcatatcgtaacagtgagggatatccaatattatctgattacattatggaattgcaaatttaccttgagaagctccacaattgcgacggtcttgttgatcgcccttcccatagctttgataacgatttcatctgtcgcgttgtcctgctatgaggaacgagaaagcaaaagcaattattagtgactaattagaaaacatggatattcccccaaaatagcagtcccaaacataaagagatggacagatttaacaaagccactacagtcagattccctcatgattactgtgccataccagacagtggacaaatcaaatctccacacatatagaaaacaattactaataattagtatcattcacaacacaataccacctttaccctactaaatctatttcctattttattttaaggatagtacagggtgaaagtactatcctaagacacacagtgaacaagccccacctatcaatcatcaacagcaacgataaaccgcctgctacaccagaccagaaaagagttcacttcctaaaacaatttgtatattctatgggatataatactagtagcaattagcaaaaataaaacgtaaccaaccaacacctagagcagcagcagcagcatctaccaacgcaatagtagagccctaggtcaccagaaaatcggccggaaacatcgagacgcgccccagattcgcttccgccaacggcggcgagattactgaacccgcactaaaccctagctctccccacccaaaaaaaaaacaaaaaacaaaacaaatcgaaggcggaggaggaggaaggcggacctggagcagggcgagggcgtaggtgatgtagttgcgggtgcggccctgcgcggtgatgcggatctcgttggcgccgatggccgcctcctcccgcggcttctccaccctctggtaccgatccatcgcctcgaatcctcctcctccgctccgcctcgcctcgaaccgaatcgaaaaatccgcctctcgcagctgctgcttccgccgctagatttctcctctcctcttcgtcgtcgcctcgagaggagtagtagtttttggctttgctcgacgccgcgagggggagggaaggatataggtggggggaagccggaggtggatagggttcggagcgagcccgacagggacccggtttgggagcccgggcccggcacgtcgtacggtcggtcggaccgtctctcgggttgggttgggtggggtgcgttggttggtcgtgtctgtccgcgtcggggttggggtatctggtccggtccggtccgcgtcgatcgagttggggaaaattgaaaaaaaaaaaggggataaatcggacgcgcatgtcgaggcgggcgggcacgggttggatctggactgtcggtttccgatcgggcggtcgtcgcgtcgatggggggctggtctgtggtgaggtcaacgcctttgccatgtccagattcagatttcccttcagattttgaatgggactttgataaatatacaatattacatgcaactacaatataaaatttgtgtagacaaatacgttagcaaaattgttttgaatagtactgaactacccggagttcagattagataattagattactgtttcggatacaattagacgggaggggtaatattgtctcgtgtcatgtccgtactccgtagactgtatagctgctaagattacagttcgaattcggaagaataccaaaccgttaataataggagtacttatactaaccgaaagtatagtacgagctcgagtccagtacgaccgcgtggtttcttaattcttacatttatcatcctatataatcttgttatattatactgattaaagcctaaaacagctacagtaacgaccccccacccccagtttgtttcaaaaaccaaagctagcctcccaattaaggtaaaagattgcaccaaaactcctgatctatttacgcatacaatacaagactgagggagaaacgaatcaaacgataggaacagattgatggctgtaaaactccggtccctaccactgatgcacatcggtgatatcggattttcatcctcgagtgaatgttttctcgttgcttgcatatcatcaccaaaatagttataaaaaattttaaaaagttttgataatatagattaatataaaatatatcattttacaaacatgcaagactaaattcgacttctataagttacaacaaagaaacaaactaaactgtgaaaatagttatcatacattcgttgttatttttctacaacttttaaaagttaaattttaacttgcatattatggagtgatatatttgatattaatctttattttaaatttattttaaattttctgtaactatttagataggatgtacataacgagagatgagtacactttcccatgcatttttgaaagcgaattcaagcagaacctgcagaaaatcctgatctcgctcgaaatcagtactcctactggctactgctggagtagtaccatgcgtggttcctccacagctttgattagcgatgacaaggaaccgcacaaagcgtactcctatattactcctgtcctaactatggtgcccaaagatggcagcagcgttgatgacaacattaacacgggaggatgaaacaacaaccggtggtatccctgcaatatttactgaccaatgttgcaagttgcaactcgacgcttttgctttgacaccagctggttaattgtcgacgacaattaggccaaatcaagagacacatttattcacaggcaaagttggatccccaattggtttgctagtgccgcgacgaaggaactgggctaggaaggccctgcccatgcacacagcccacaggggcctgcgagcctgcgactgcgagataagagagtgcacaggtcgatgcatcctggttacttggtgagtttagtcccataccggggaatcaagcaggtgcgcagccccctcaaatggtggccttggcggctgctgggcgtgccaaaatggaggcacacgaggagcccgtggatccccgtgacctagtggcggcacagtgtgcacggtatgtgcacgtagcgatccccaaacttgatgttgcaaaaaacttcctccacaagaggatccgccactagccaggcgcatgacacatgcgcttagcaaactttttttatttcttcttctctttacttattaaataaatgaaattgatacatttttgtttcttcctctttacttattagatgatgaaaataatacatttttgtttcttctttacattgtataaatgaagatgactctgcattgtataaatgaagatgactcatgtacatttttgtttcttcctctttacttattagatgatgaaaatgatgcatttttgtttcttctttacattgtataaatgaagataactctgcattgtataaatgaatatgactcatgtgtcaccttgtgattgagtcgtaggttttcataaccgattctgctaaatctttgtcgacagatttttcgttgcaaatcactcttttttcaacccttaaatttatggtgagattcgtgctaacaacatccaaaaaactaaggcagcttaccacttaccatgtgcagcgcttggccatttgagtatggaggagaatttggttgtatatataaaacaatatttacatcataatataaaattacagtcctatataactaaattatatatgtaaattcagttgatatgacatgtaagtgcactataattttgataaaaataatgtgtaagtaaatatgcatttgttattttcttttgtagttcgttagatataaatctaaaggtagaaaaaatctaggtgattttttttttgaaaaaatggatattcagttccactgtaacaccttgaaaatcatatcggatccatgccatgttactaggatctatgccactgtaacaccttgaaaatctaatccatgccatgttgtaggtctgatacacgttttgaatcgtattttcccatataccaaaataggcatgcctcctgttgcccaagcattgtctatttgtctactacaatttaatgctccacgttatatgatctcctatgatgctacaatttaatgcttcgtgtcagatcagatatcctatgacttatgcattgtctatttgtctactactccctccgtccctccgtcccataatataagagattttgacattttgcttgcactatttaaccactcgtcttattaaaaaaatttatgcaaatataaaaaataaaaagttgtgcttaaagtactttaaataataaagtaagtaaaaaaataataattccaaattttttttgaataagacgaatgatcaaacaatgtaagtaaaatattaaaaatccttatattaagggacggagggagtataatttaattaatgctttgcgtcagatcaaatccacaacattttgaatcaaaatcactcgggcaaaagaatggtgatggaggagttggcgtagaggagttgccgaccacgagcaccagctaaacctagaacccaccagtggccgccctacatctgcttgcgtcacgctgagccactactaaacccgctatctctgagtctcgtcaccatcgccagatatgcttaaccactggatctacaaggtcctcaacgaacggagtgaagaaagagagggtgggattatgagatatgctccgcacagtcctgaccttgccaccattgccgcttgctccaccgtcgacacggtcagcgccacccccggctgcttgtttcgctgtcgacgccatgtcgcgaaccgatggcacttgctctgttgtcccctgctcgctcagttggttggaggaatgtagggtagagacgattgggggcagaggaacccacggtgtctgacacaggagggagaggcattttgatccatataaaattataaatagccaagaaaaagagagttgaaatgtatgtacacatgatatagatcagattttaaaagtattctagtagcatgattcctaatacatcaattgcagtgaaattttaaaaccataaaaattataatggtatagatccaattaaaacccaatggttactagagtttagtaaagggttttttttttacatgcagtgatgtacgccatgcctgcacacgctctgctttggcacaaattaggcccaccaatatcatcagctcgtcaacgacaattagatccattatacaggcaagttgaatcccaattggtttggtgggccgctagtggcccacacgctccagcagagtgcccacagcccacagggcctttggctctgcacacgtcgatgcactctctggtttagtcccataccacggagcaaagggggtgtgctgcccctcaaataccgtccgcgtggcatctgggcgtgcaaaagaggaagcacacgctgagggtgacgaagcgtgctagtggcggcgtaatttgtgggcgatatgcctacatagtaatccctaaaaccaaactttgagtgtttgtaaccaaattcccgccactagctcccaagcacattacatatgtgcttctaggcaatttttttggaaaataaatatattgctactatatttagactaatctgatggacatataatctttttttcgcaaacgggaaaaagctatgcatgtcagtatgttagaagaagaattatgttttttcttaaaggcgcaaaatctttgcacatcgctatattagaagaagaatgtttaaatacaacttttggcacaaatatgaaaaagctttgacctttgcatgtcactatgttagaagaagaatgatgtttttttttcgcaaaggcacaaaagcttcgcacgtcgctatattagaaaaaaaaatgtttacatatatgttgtaatgatcatggaggggttatgagggggagaatccaaactaaaagtgggctaactaaaccggaatatgctccaaataaaaggtgcagggggtggtgttggctatagaaaaacagccaagtgccaaaaatatctcaaagagaaaaaggttctaccttcagctagagccgcccctcttgcatgctcgtgtccaccaccgtatctacctgggaaacatcaccagtgaagacgcaagaattttgttctagccaaagctaccaggtaagcaggaggacggaagaattgaaggtgcttgtgcattcagccatatgactcctcccaccaaagatggaggttagactaccgattgggagagaggcttgataggcctacctcgatgagcagcttgtgccacacctgtctagcaacagcacattccattagaatgtggtttgatgtcttcggctcctgcgtgtagaaggggcacatgacatggttgtccatccccactgaaacattaggtccgccatctagcatcaacgttggatgttagccaaagaaatagcttgtacttggacgtgccagcgccgtgccacaaaagatccacaaatgggaaggagtgatgcgtagtgacaaaggcattgtaagtcgagcgccagtctaactctagatgaaccagtctatgataaagtgatgaatcgtaatgtatcgaattttatcctagactatcaagaccgttaggccgcctatgaaaacctttgcgtacaggtggtccttttccctgcttggaaaaatatttttgaccgcttgcaaaaactttttttattagtgtgtaaaatggtcctaacaaaaaaaatgtataaacgacgagttgttgacgagaatcatgattaggcttgtacgtggtgcacccgctgttccatgagagatatatatgttcagctggttctaaacacaaggaaagtgcacattgtttttagtaccacatcggagagcctatagtgttttaaatattactttgatttaaaatggttttgtttgtcttaatttattaattagactatatttttatgtgattatgatataaatatggtatttattgtgttttgttggtattataaaataaacatcttcgcaccattttatttttaatcctgcgtctgcctctgctcccagccgttaccaccatcaaaaagaggagaccagaggcggcggcgccgagcgatacgactcctgagccccacgatgacggcgacgtccgaatgctccagggagcccaagaagcggggttctaatttctagatgttagaaatatggtcataaatcggcatattttaatccaaaatattaagacaataatcatggcataaacagtgtagggtgatctagtgacaacatgtaacataaccagtaacatactaaaggcatcgtgcgcattatgaatatcaggaacaagaacatagtagtaacgcagtagcatgctagaggcatcatgaatatcaggaacaggaacatagcagtaaagcgctaacaacgggaacaagaacaggagaaggatataccccgagaatggccctccgctggattgtgaggcagaattgcctccgttggtgttgttgttcgcggcaccggctccagctcctggcgcaccacctccagctccagctcctggtggcgcaccacctccgccatctcctccagcagcagcagcggcgccggcatggtgggcgaggacgagcagtcgtgcgggaagcactccccaaaaacctgatcacccgcctacccggtgcagatctcaggcgaaggtgtggttccggaggccctgctccttccgatctctcgtgtgcgcaagcgatcagaagcgaggaggcgagagcagcacaggcccggaggaggaggaactaacacccgggaaagaagcaggcggatcgttctgatcggactcgcggcctccttatctatcaggagagaggcagtcgtgggaacgtgggatcgtggacgcgccgttgcggaggcagtcgtgggaacgtgggatcgtggacgcaaaagagtagtgacgtgacgcacgcacacccaccacgcccatgccctcggcctcggcctcggcctcggcccggcccggcgcgcgcgcgcgtgtggctttccgacccccacctcaaccagtcaacaaggagcctccaataactccctatttaggttgagatattcctcgcttaaatcctgaggtgatattattatccttaacacttattatgggcctttgagatttaataggataaattgggcctagcccaattattctaacaatccccaccaaatttcaaggctcataagaaatgttctcaaggttgtgcctgtttgatataccagggttttggtggagactgttaagttgaacttccacctaggaaatgagctacatcagaccacaactgaacaatggactatgccttcaattgtcagttttgtgtgatcaggtttcactcagacccttgactggtactaggctgccgttcccatcccctctgtttggagcatataagtcaaactccaggcctttcatgagtatctagagatcgcccaaacctcatagactgtgactagcagtcgaactcatataggtgtgttccttttgagatgttctgcaggtcaacatctctgcttggaaaagccactcggatcacattaaggcatgagccatcctaccatgcaggaaagaagagaagtacatcatgaaaatgagccctttacaagggtctcttctctcagtcacacaatagtttgtttcgccatccaaattcacgggatctccgatcacaatggacaggtttccactattgtgcaaccttaggtgggtatcaagcccattttccttgatgcactgtctatcacattacgtggtagccccttggtaaactgatctgccagatttctagccgtttggacatagtccaatgctatcactccggagtttttctgctttctgacagatttcagtcttctcttgatatgcctagatgacttcgtgttgtcctttgaactgttcactttaataatcactgtttgattatcacagttcattaggatagctgacactggcttttcaaccaccggcaaatccatcaggagttcacgaagccactcggcctcaactgtcgcagtatctagtgctgtaagttctgcttccattgttgacctcgttaagatggtctgcttgcaagacttccaggaaacagcgccacctccaagtgtgaacacatatccacttgtggcttttatctcatcagcatcagatatccagtttgagtcactatacccttctagtacttttggatacccggtatagtgaattccatagctcatagtgccctttagatagcgcattactctttccagagcctgccaatgatcatctcccggatttgagacaaaccggctcagcttgcttacagcaaatgagatatgtcaggcctcgttgcactagccaagtacatcaatgaaccaatgatttgagagtatcacagttgatcccttgctattcttcggtttttccttaatagcacgctgggatcataaggaataggagctagcttgcagtcactatatccaaagcgactcaacaccttgtccacatagtgggattgcacaagtgcaatcccaccctcatctcctctttgtagtttgatgttaagaataacatcagcctctcccaaatccttcatttcaaaactcttggacagatagtccttgacctcctcaatcacattgaggctggtcccaaagatcaatatgtcatcgacatataagcacaagatcactccttctcccccatcatagcgatagtacacacatttgtcagcttcgttcacaacgaagcctgcagatgtaagcgtggtgtcaaacttctcatgccattgcttaggtgcttgcttgaggccatacaaggatttcaacagtttacacaccattcccttctgatcttctagtacatacccgtctggttgatccatatagatctcctcctctagctctccgtttaggaaagttgtcttaacgtccatctgatggacgagaagaccatgagaggctaccagagcaagtagtactcgaatcgtggtcaagcgagcaactggtgagtatgtgtcaaaaaagtcattgccttccttttgggtataacccttggccacaagccttgccttgtacttttcaattataccatcaggcctaagctttttcttgaaaactcatttgcatcctacgggcttgcacccatatggacgctcaacgacttcccaagtaccattagacataatcgagtccatctcactgcgtactgcttccttccagtagtcagcgtcaggagatgaatatgcctcttctatggttcttggggtgtcatccacgaggtatacaatgtagtcatctccaaaggattttgtaaccctttgtctcttactcttgcgagtatctacaatgttgtcctcctcaggattttcctcaggcgtttgatcattgtgttctatcggtgcaaagtgctcatggggcatgacagtttcttgactagaagtgctaggtgtatgtttcatgggaaattcattctcaaagaatgtagcatctctggactcaaaaattgtaccaacatgcatgtcgggtactccagagtttactattaagaatctataacccacactgtgaatagcataacaaaggaacacacaatcaacaatattt

SEQ ID NO: 59478 - DNA, 4005 bp, Oryza sativa
agggaggcgtcctctcatgaataattccaaactcttcgcaaaaggatgcaaactcattggaaaaatactccccacctctatcagacctcaaccgtttgattttcctttcaagttggttttctacctcagctttatagattttaaagtaatgcaatgcttcatcctttgttttcaatagatacacacaacaaaatctagtgcaatcatctatcagtgtcatgaaatatttctttccccctttagtcaacacgccgttcatttcgcacaaatcggaatgaacaagttctagaggtgccaaattcctcgcctcagatgccttgtgaggcttgcgaggttatttcgattgaacgcaagtatggcacttggaacctttgaccaaagtgaattttggaattaaactcatgttagctaagcgcgtcatacaaccgaaattcacatgacagagtcgcgaatgccacacattagactcatcattctcgctaatatggttcacaacattatgattattacacatgtcattcaaagaaaagcggaacaaacctccgttgtcataacattttccaacaaaagtcccatatttagatacgacacatttattgcactcaaacacaagtctaaaaccttctctacacaatagagagccgctaactagattcttctttattgaagagacatgctgcacgttcttcagctgcatggtctttcccgaagtaaacttcagatcaaccgtaccaacaccatgaacagccgcaagcgacccgtttcccatcaacaaggaggaacctcttccgacctgataagaagaaaatagagaaatgtcagcatatacatgaatattagcaccagtatccacccaccaatcaggtgagtgaaaaacagagagaactgtaggtaatattttaccgtaccccgatgttcctccgccctcgctaatgaccatgttcgcagacttcctgtctttgcgctcaggacagtccttagcccaatgcccagacttgccacacacaaagcagtctccctttgcctttctcttgcctttcttcttaaagttggttgcagccttggatttgacatcaggcttgactttcttgttgttgtgggatacatgagggttcttcttctgtaccatattggcactagaacctccctcaacctttttgccccggacgtcctttgccctcgccttctcctcaacacccaaagaaccaatgaaatcagaaacactgaactcttgtctcttgtgctttagagaagtggcgaagtccgaccaagaaggtggcaatttggcaataatgccacccaccacaaacttgtccggcaactcgcagttgttgttctcaagttccttagccagcatctgaatctcatgagcttctactacagaacggtcatcgaccatcttatagtcatagaactgctccatgacatacagcgcactgccagcgtcagaaactccgaacttggcctcaagtgcatcccacatgtccttcccagaaggcatgtgcatgtacacgtccactatgttgtcagcgagtacactgatcaatgctccacggaacagacaatccgaagcctcgaacttagcctcttcctcaggagaaagaggtggttcacttcgtttgccccgtgaaacatagaagcattgcatcgctgtcaaccacaatagtgcacgtgctttccatctcttatagttagaaccatcaaaagcatgtggtttcaatgtagcagcaaagccaactaccgaaaatgacctatcaggtttttggatagttgaaaatatggtcataaatcggcatattttaatccaaaatgttaagacaataatcatggcataaacagtgtagggtgatctaatgacaacatgtaacataaccagtagcatactaaaggcagtagcatactaaaggcatcatgcgcattatgaatatcaggaacaagaacatagcagtaacgcagtagcatgctagaggcatcatgaatatcaggaacaggaatatagcagtaaagcgctaacaacgggaacaggaacaggagaaggatataccttgagaatggccctccgctggattgtgaggcagaattgcctccgttggtgttgttgttcgcggcaccggctctagctcctggcgcaccacctccagctccagctccagctcctggtggcgcaccacctccgccatctcctccagcagcagtagcggcaccggctccaggcgcagacatggtgggcgaggacgagcagtcgtgcgggaagcactctccaaaaacctgatcacccgcctacccggtgcagatctcaggcgaaggtgtggttgggaggaggaactaacacccgggaaagaagcaagcggatcagaacgcgagagcagcataggcccggaggaggaggaatctgatcggactcgcggcctccttatctatcaggagagaggcagttacccggtgcagatctcaggcgaaggtgtggttggaaggaggaactaacacccgggaaagaagcaagtggatcagaacgcgagagcagcacaggcccggaggaggaggaatctgatcggtctcgcggcctccttatctagcggcctcctaggaacgtgggatcgtggacgcgccgttgcggaggaggaatctgatcggacttgcggcctccttatctagcggcctcctgggaacgtgggatcgtggacgcgccattgcagaggcagtcgtgggaacgtgggatcgtggacgcaaaagaatagcgacgtgacgcacgcccgtcacgccctcgcccgacccggcgcgcgcgcgtggctttccgacccccacctcaaccagtcaactgggagcctccaataactccctatttaggttaagatatttcttgcttaaatcctgaggtggtattattatccttaacacttattatgggtctgagatttaataggataaattaagtctagcccaattattctaacactagacacagaggtgcacgttgtttactttagcgccgtcaattttttttagtcccacaccggagatcgaaaggatttcacctcttcttacatatctatcctgctacgctgttgacgtgctcgatcgaaggcacacctcgcacacacggacgtgtatgctgatggtagtgtgcgtatgtcacacgtaagcatatcaaacaaaacccatggattatgaaggccgacttgtggacattgctgtgttgcttgtcctcggctcttcgctcaacaattgagcaaaaaacagcgcatgacacatacgctagcaattttttttatttttgctctgccccccattcgggggctccttgtatcgcaaatcactacaaccaaaattgctttgagtttacatcatgtatctatctacataaataatcgcttgccttactttaaatgagtttttggaacatacaatgatttttcgggaaacaatctaacaaagttattctgctactactgctaattactactactccactactactacactacggagtaccataaaagaataggctaattctcgaatatactatgagtacctaaaaaaatagcctaattctcagtaccatgataaaagaatatgctaattctcgaatcctttgcttttcttcttcaaatatcgctaatcccgattcccgaggcgtctagaaaccgttgtatgcactgtcaccgcgttgctcccagccgttaccgccatgaaacagaggacgaacaggggcgccgccaccgccaccgccaccgccaccgccggctccgcccgagcccgagcccgacggcgacggcgacgtgccaatgctccacgagtgcaagaagcggccgttcccgccgccgccgaagaacccgtccgggacggtggagctcgtcggccgctccggcgcccccgccaggatcctggagtagtcgaggcagtccgcgacgtcgcccggctgcgactccagcagcgcggcgggcgccgacgacgccgccgccgcggggccgcggcgtccgtggcgcgtcgctcgtcggccgcggc

SEQ ID NO: 59479 - DNA, 7793 bp, Oryza sativa
  unsure (1)..(7793): unsure at all n locations
gcgggccgccgccgccgtacgcgacgacgtgcgtgagcgccgacacgatcgcctccgtctccgccgcgaggtccggctccgacaacgccatcgccgacgcagtagctacgctcgtttgacctcatgcaagaacaccccccaaatttatatgctcctcttcctcaaccactcgagcttaaagaaagccaagaaactccaaacaccggacacttccccatccatcgccatgatcaaaacaaacaaatcgaaaacacggtttgcggaagccaacttggattaagcaacatcgaaattagcaaaaacaaatggtttgattagagcgaatgaggacgaagcgaaaccgaattaggagaagatcagtggatcataagaagacagtccctcgatccttggccacgaaggattggatgatccgtggtggctctgcgctgactctaaacgtttgcttcgactcttggtccactgctgcaagaaacccaggagccaaagctaaaaaagacaaaaacaaaagcaaattttgtccgtgtgtgtttatggcgattcttggattgttctcatctctgaatcaagtaggagacaaaaagagatatagattttgtgatggctgcagtttgaccatctagaaaggaagtcagagtggaggagacgaaggcaaagcaagtcgatcgagcagggaaattgggaacggtggaaaatggtcataaggtgattgatggatgataataacattattattacattacatgtaaaataacactaaataaacggggtcattccgccacgtggcgattagtatttttcccgtacctcagtacctgtgattatttgatgagcacgtgacgtgtcgaggcacgatttgccggtctttagttttttttcttgagattttttttttttggagaactggtctttggtgttcgcttccgttttcgctttggtcgtgcaggcgtgtgcaggcgccgtgtacggtgacgcggaacacgcgacgggatgcagtggcccataccgtgggtcttgagcttagctgaaaacctctgctgcatggccaagatttgttttataagaaaagacaaagttttccaagttgatgcatgtaaaatcgacgctatttctttttcatttttggagaaagagaaaatgtagtacgctgtttttctagaagaaagatgatttttttttaatgatgtttcctttaggagatcattagttggtcagaatcttacatatttgtatgaattgtgtgcttctattgtacatattcaattgaatcaatcctctgatagctttagatggaattatcatcagaatggaatattttctgttaggtcgatgtatctagctttaattaataatggttatagtgaaagaaacaagattatttgaaagcttaagatgccacttaagattaagatttttatgtggtacttgcttaaaggggttgtgctaaccaaggataacttggcaagacgaaattggaatgacagtttaaaatgttgttttttatgaaaaatgagactattcaacatctttttatagagtgtcattatgcaaaatttgtttggagagcagtacagttctctcttggtttataccttcctactaccatatctaatatgtttgatggttggcttttgagggtagataagaagaagagtaaactcatacttgtaggagcttctgccatatgttgggctctgtggttgactaggaatgatatggtttttgacaaatcactatctatctcatatatacaggtaattttcagggcaacatatttgctccgattttgggcacagctgcaaatgtgtgaagatgatcgagagcttatgaaggttgcatgtcgtaagcttgagacaacggtcatgcaactccttgcaaactatagatggagattcataaatagacttgaataaatgtgctctccttatcttagtttgatattttattttgttgggtatgtttaattcatttgaactacactcagtgtttgggtgttacttttgtaataattggctatagctctgatgatcaaaggccgggatgttttattctattattttttaaaaaaagctttgcacgttattatagtagaagaaaaatgtttgaatacaactttaacgttagaacaatcatggcgggttatgatggggagaatagggtccgaatttagctgaaaaaaaacctaagtgctaaaaagatctcctagagaagaaggttccgcctctatctagatcatgttcaccactgtgccgatctggcaaaaaaacactatcagaggcacgagaatttcgtttccaaccaaagctagctgctttgtaacccggaaacgaaagagtcgaagcccttcctgaggttgcctagcgaaaacacactccattgggaactcccttccggcgagtcccagcccacacggagcttgtccaggcccatcagctcgttgtcttggaagcccaatcaagcaaaacctatcagtacttccggcccggctcaacacggccgtatgtctgtatctatcagaatttttttcatttttcatttttttaaaatatttacagaaataatctatcgtcagaaaaatttacaaaaatagacactgccgccctagtggaaggtggcaagctgacgtgacagacggcggctcaacggcgccgtgtgcgcattttgcgctttggtccttaccgcccttatttgcccagctggaaagaaggcagagatgaaaaaaaaccggccaaatgcttctttccacctttgttgataatggcccttctcgggctggctttttcatggaggcccattgccgccctggcaatgggtggcaagggtgttaatacaaaaagttcaacttttccaatcggccgtcaccgcccgtcgagccgttgtctgccacgtcagcttgccgccctgcactagggcagcaggatctatttttataaatttttccgacgatagattatttctgtaaatatttttaaaaaatttaaaaaaagaaaataattcgtatctatcagccacaattatgctaccgcacgttggatttttctcgtcttccacctgcctcggcatgctaaatcgcagcgctatccacgtccaactaggggtgagcattcagtaataccgaaaattcgatctcggttttcaatctgttttatgttcggtcatttaaagcgcaagaccgttcggacttgaaaaatattaaagatagaactatttggtctcggtcttggttagaccgaaatttcagaaatattcagaagaatcgcacaaatccacaataaatttcaaataaaaaaacatacacatgaagaaaattcataaaaatcccagatcggctttcttcattatcatatactcatcccagatcggcttcggcacctctcgtcgctggcggggtagaggaggcaccatcagatgtgcccccggggtggagccacggaggatcgcggcttgggcttggcagttgggggtttgaggcctccgggctccggcagcatgggtgtcgactgaaggtggcgcaacaagagtaggtcgtcgtggtgtgacttgtgagaaggaggagacgctgggacggtgcagaggcgccgacgacaaaacacgacgtcgatgtgcgagagaaaaagaaaggagcgctcaggtgaaaaagaaaagaaataagcgctctctcctagttgggtgggagagcgtggcggctgctagctgggtggatgaggagaaggcaatagagagggagctagggttttactagtgttgagcttgctttcttgggctgatatgggctttcaatgaaattcggttaactaagggtgatgaccgaattgatcgaaaaaaattcggtcatctagtaaataagaccgaatttttcagtcttggttattttggttcggtctttttctgcccacccctacgtccacagctagcgtcgctgatggtaaaaggaagagaaaatccaaccattgacatacacataaatctaagaaataccatcgataaatatgagttttataaaataccatcgtacaagtgattttgtcctagaaatatcattgtcgttattcttccgtctacccaacgccaacggggagatgctaacggaattataacaacattagcatttatgggacaaagttgcttgtacaatagtaattcatgaaactcgtatttgtctatggcattttttttggaaccagacacttatcaatggtacttcttaaattttcttaaaaaaattgtaaaatcaacgagttgttgactttgttggacaattcctataccagtttagctgccatttgttcggcagatgtggctgtttggttggttgtgtaaaactgcctaagctagccagacatttgtggctaagttgctaaagttgtggccaagaaaaatgaagccacatcttagcctccttgccacacattattgtgtctattaaatgtagggtcaagttaaaggaaagtttggcataactaacttatgattagaaccaaacactacactaacttgatcaaacctacttgccatacttatggtaaattaaccaaattttggctagcaaccaaacaacctctactagtcatacgttgtgtgacgaaggagatgggctgagattatgacggaactggtacgttcaccgaaagcgtacgtgaatacagtacgtgcgctcgtctttccacgaggaatttattccgctccgcgggtttctaaacacaaaggtgcttaggtggtgcacgttgtttagtaccacaccggagagctaacaacgtttagtcctcctcatatggcaggcgacagccgaaccaagcgtgctgacgggcacaccccgagtccggtggctgcacgtgctgagtgcacggctcgcaatattcacattggtcaaaggaaataatcattgtcaccgcccaagggcaaaagacgcatgacacatacgcctagcatatgtcctcctttttttttttgtttacgcgaccattttttttaatgaatcaattttatatttctgaactctgaatcacccggtcaatttttcaccttccttaaaccggcgtaaatcaagtcagtcgactatttggatggcgttttcatcctacgtgatgctcatgggatccacatgtcatatgtcctcctttttttttgtttacgcgaccattttttttaatgaatcaattttatatttctgaactctgaatcacccggtcaatttttcaccttccttaaaccagcgtaaatcaagtcagtcgactgtttggatggcgttttcatcctatgtgatgctcatgggatccacatgtcagtgagagaaaataagacaaaacggcctcacatggcagtcattcctttctcccctttaccatcgctctctaccctctctctttgttctcgccaagccagtgccaaatggcgtcactccgcggtaggagctccaacacatgcttatttttttcggtgtggttaacatttttttaattagtctagtttacatatctccaatcttgctcccttaaaccggcgtaaatcgagtccttcgctgtttgaatggcggtttcgtcctacgtgatgctcatgggacccacatatcagtgagaaaaaaataaacagtagccttacaagttagtcattccttttctcccctttaccctctctctctatctctctttgttctcagccggagccagacgacgtcactcaatggtaggagcgccaacaccagccagtccgtgagttctgcacgaagtatgtgatggcgccggtgaggttgcagtcgttgaggctaaggctctaaagctattgcatggcggtggtgtcggcgggaaggtcgatgttgttgatgcggctggtgtggtcgcatgagatgtgcggacaggcggcgtagggctcggcgatgttgaggtcccactctaaggcgagggcattgccattggtcagcgagcggcgcaagtcctagagcatggataggctacatgggttgatggtggtgtcggtgacgatgggtgggtgaaggaggaagagtgtcgcgggggcgctgacaagaaggagggtggccatctaggggaggtgctggtcagggaggtggagacattggagatgggagagagagagccaggtctatctatgttaggcaaaaacaaacacggtgctgtcgatgggagcacgcttgggcaacgctccccagagccctcctgcgatagattgtgccnnnnnnnnnnnnnnnnnnnnnnnnnnnnnnacgcaagcaccattcattgccgcgatcaccggcgttctgcatcgctcgatggccgtgactgatgccaacatctccaggatggcacggtggagcacctcggttgtgggcagggggtcgtcatcggcgctgcccgacagggagaggaccaggtggggttcctgcaagagctgaggtcaatgccgacaacggagagcatgacggtgcgcacagtgcggaggaagttgaggagcgccatggcatgggggatctctgagaaggcttctgggctgaggtcattgagctggacggggtggttgaggtaggtctcacaggccgccacggacgggttgggccgcgacactgcgagcatcttgaaccctcgtcagagctccatctcgggcgtggcgcggtcgccaatgaaaatagaggagagagaagagaagaggtaggggaatagaggagtcatgacacgtgggccttacatgctgactcggcaaatcaatcgtggtcatcatgccacgtcaacaaaccaacctccaaaccaccgaaagagtcgattggcaccttttttttttaagatgggggagacattatacccagttttacggttgagggaggcaacttaatcacgagcaagagatgagggaccaaaaatagacttattccattatccttttgccatggaaaaagtacaccgaaggtccctcaacttgtcatggatgttacaaaatcgtccttcaactacaaaaccagatataacgtattccccaacttacaaaacagtgcaaactaggtccctcggtgattttgactccgattttatcttatgtggcagctgactcagcgtgagacccacgtgggccccatccgtcagcctcttcttccctcctctccctccacctctcttcctctcttctcttttctccaatctccgggcggcgcgcgggggagcaactgcacgtgacgtgcggcggccggcgggcgcaggcggcgtggggaggaaccgcgcgcgggcggcggagcggcgcgcaggcgggcacaggcggcgggcgaccttcggtgtactttttcgtttaatccatccatcctgcaaggcaaccgccgacaaggttgccctggagcccatcatctccagtagtacgccgatgagcaatcgatctgatgatccccatttgctttggatcctcagcagctggtggttcctgctacagttctgcttgcttgttgttaagatcgagctcacatgctcgcactgtttggtttggtgattgccactgatttgaactggtacaaagttaatggttgacttaactccaggcgggcgaaggcggcgtggggaggagccgcgcgcgtgcggcgggcgatggagcggcgcgcgggcggacgtgggcggcgggcggcagccaacgggggagcagcggggcgcggccggcgtcgggtgcagccgcaacgtctccttcgccacggcctgcaggtcaccgaccaccgcgtcgagctccgcctgtcgtccccgccgcgaagatgtcctggtacacgagatcgccggtgagtccgccgtctcggcgaccacgctccgcatctcctccatgtcgttgtc

SEQ ID NO: 59480 - DNA, 3016 bp, Oryza sativa
tgcgcccgccggccgccgcccgtcacgtgcagctgctcccccgcgcgccgcccggaaattggagaaaagaggagagaggaagagaggtggagagaggaaggaagaagaggctgacgcgtgggggcccacgtgggtcccacgctgagtcagctgccacataggataaaaccgagtcaaaaccgcctagaaccgccgagagatctaatttgcactggttttgtaagtttggagatgcgtcatccggttttacagttgaaggacgattttgtaattcgatgacaagttgagggacctttggtatactttttccttttgccatttatagatgagattatttgctccgtttgcaaaacggaagaggcaatccagccaggttgcttccggcccggcccaacacgacggcggcacgaggacccggtgatctctccctcccatcctggccgtccacgtgtgcagcccgctacgcttccaagcgctagcgccgccgatccgacccagccgaatccgtctttcctctcctcctcctcctcctcctccgaccaccggccagccggcgaagtcctccgccgcggagctcacctcctccggcgccggcgacgcccccctcggtagccccggggaggacgcctttcctccggcgaccacttccccagtcgccgcctccgccgctcctcgaaccactcacgcgccgcgcgggctcctgtcccaggctatcagccgcgatttccctacccctctcgccggatacctcgccgccgtccaagagctagcgtctctgatggtaacttctctgtgagctcgctcgctcgctcgtagagattcctgattctgtatgattgagctccccgggctgttcggttttgcaggaggaagagcgcatggagccgccgccgccgccgccgtacatccacatcgagaccaacgatttcttgcacaggaggtgagtgagtttcacggcgatgtgggacaacggctgcgtcctgtgcttttggatgtaatgcgaatctttatactttggtgcgcgatgctaggcacaagaggcagaaagaggaggacatagctgtgtgtgagtgccagtataatctgctggatccggacagcgcgtgcggggatcggtgcttgaacgtcttgactagcacggagtgtacgcctggatactgcctctgcggtgtatactgcaagaaccaggttggtgtttctcttgttcaagtagtagcgcaaccgttccaaatcttgattgaatgaatatccatacatttgttcttacatgattactttagttcactcgagcctagttactaggcaggaggggaaaaaaatggtgtaacacggttattttgctttcttgtcttcttgattgaatataatccagtttattatagatgtacagcaattttcaatatagtcgtgctggctcttagctgtaaggattttttttcaagtgagattgaatataatctggtttcttatacatgatgtaccattatttctaatatatagttttactaattttctatagataccgaacactatcattttcaatatatagttttaccaatttgctagggaggccgaatgtcatctggagtgctttacagtttcactggtagttatgtttgtattttaatcaatttctctgttggcagcgatttcaaaaaagccaatatgctgcgacaaggctggtaaaaactgaagggcgtggatggggccttttggctgatgagaatattatggtgactgaatttaccttgattttatggtctgctaatgttgttaaatatattcaagtgagtatgctttagtgagtcattgttttcttaatggtttttaggctggacaatttgttatggaatattgtggagaagtaatatcatggaaggaagccaagaggagatctcaagcatatgaaaaccagggtctgttgattttatcttccctcaatgttagcatggtggtacattttggctagggatggcaaccgggccatccccggcggggtgtggtcccccgtccccgtccccgtccccgtgcagttagaaatcacccgcccccgtccccggtgtcggggctgtatttctcccgtccccaagcctcgccgggtgcacggggcacccacggggtcgcacacccgataaactcgtgggcataaatcaacaagaaggttctctagtaggaaggtagaagtagaacagatcggcaaaaatagcacgaggacatacatctatcattttctcagattatgaacatgaccatggtgccagacttgcatgattctgttgccaagaatcagctccaacttccatcaaaatgagaaaaataaacagcgacaaacaggacagagcagaaaataacaagcaaagtatataccggcattcggatgcagcaagtgcccgtcctcttgctttcccgcatgagcaagcgacttggaggcagaacaacagctcgcgcggcatggtcaccttatgcggcggcggggtgctatatcgctgctgtggcctggaggaggtgcgatggctggcgcccttgccgacctcgactggcggctgctgatggatctgagaaggggacaagggaggactggtctagtgtagggtttcttttgctttatataccagcacctctaaattgggcactaagtgggcttttaacttttatggactgtacatatgcctacactactcgagtcacccacggggattcggggccgggtgcctatggaacatccccgtccccgcatcacccaacggtgacagtttctagccgataacagccccatgggtgatgaatttagcctgtttacataccctaatagagtttttacctatcgggtatcggggttcgggtccccattgccatccctaattttggctagctataacatttgttttttgtgccctgttaggtttaacggatgcctatattatctatctgaatgctgatgagtctatcgacgcaacaaagaaggggagcctggcaagattcatcaaccattcgtggtatgtcttgtagcaaatat

SEQ ID NO: 59481 - DNA, 703 bp, Oryza sativa
ccaacggcaatgaactttgaaaccacctaatgaagtgaaccactgcctccctgatgagttctcagttactctctcagtatatgttatatatacagatgaagctacacacatgttgcatgcaatttaactgcaatgtagttatatatgtgcatgagtaacctatactcccatgtcctgacgtgtagttttctagtacaaagtacagaatcactgcctgcactacgccggaccaggtcatctctgacgggcccaaaccctcacttttgatgggtttggtcttggtcagtgattagtggtcactgatgacaaaatcacctgtgacggatgaaacacccgtcacagataacccatctctgaccggtatataactcatctctgacgggttaaaacttgtcacccgtcacagatgagtcatcagtgacgtggcgtaactacctgaccgtcactgatgactcatctctgacgggttgtaacttacgacccgtcactgatgacaaagcaagaaatacaatttttgaattttaaacgccacaaaaaacctcaaaaaaatatttgaattttactagccatactatacatggttacacatcactacctacaaattcacaatttttcacgcaatataacttggatgctacaagtgagatacgaactccagacctcaacctccatatagagatcccttaccaactcacctactcaa

SEQ ID NO: 59482 - DNA, 18352 bp, Oryza sativa
  unsure (1)..(18352): unsure at all n locations
attcctgcagcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacgtggaggagagagataacaaaaaaatcaagaatgctggctctcatgcaaaagctagcttaacataaactcctaagtaaatacattaaatgtataggtgagagatagagagatgaggagaaaattatagccaaccttatagctaatccactatatatgttggctttaaaataggctaatattaggaagtgagctctactattgtcctggctctaacaaacagccgcagccacaatggttggtgtttttggggcacagaaatcatgggcatgagtgacttaatttcctagattgatgggcatggtaaacgtcgggaattcagttgcctccgatgggattctatgcagctttggcattgccctgcctggagcacggtgcatccacagatacggtgtagcgtgtgcgttgtccactacttccttgttggtgccacacggcatacctgctctggtacaacacgcagagcactgcttgctgcgtgctgacggttcgtctagttcttccacgtcgtcgattctggatgagtacgtacgggtctctcaagagatgctggatggtctggccatgcgttgggacaattggactgatctgatcgatggttgttctatctttggttgtatcctgactgtattgttgcaatgtttctctgttaaggcttacacacaatggagtaaaaaaaaagcgagaaactaaaaggagaaaaacaaataaaacgaattaagggaaattaatttgagcgacaacttttacgatgatctggtagctaaatgacccttttctcaagtacaattttattttaagaattttaccatacctgagaaggtaccaccaggtactaggaggtaaaaactccatctgtccgtccattcacaaagggtatgatcggaatagcttgtgataatcatctagtcctacacctggcatcgtctcttctacatcttcttctccttccacatcttgtagtcccaaacaattccgtcccactctatagctccgcgacacactgttgagacctgaagcacaccgccaatggttatagaggaggctacaatccaggatccagttttggggcctcatcaggatgggaatagtgggagggcaggcgacgctcgtgaggtgagttcatgtgccaccgacacctctgagggggtggtttgctggtgaagaggagaggcagcaaacatggacagacggagctcgccaatgattcagctagtggaatggaaaaggatgaacaaaagaaagagcaagtaaaaaatggaaagaagggctcgcctgaattcgggaaggagaatggtggattccttccattgtgatgatgaggattgggcatttttgctgtttgagcaccatgtcctgtactcctgtacgtcttcaatggtgatagactatctaacagttcggatcaagctaataaccagaaaaacatattcctggtcattaatccaatgttatctcaactagaattttcaaatactcggctctatcattgtggatcaacttctttaggtacatgaaagcactaaatttccagacaatatagctcatgcacctctggttcgcatggttcttggtgccaccaagactaggagttgaccccaagcagagagggcactgaattcgcagttgctgctggcctcggcttcataactgatggatgctgggtggcgtccccctcctctttattgcacaaccaggacagctgacatggcaacgcatgactttggaggtgtccagagcataaaagggggtggtaggtcccagctcggtctgaaccgcggctgcagcggtgtattatcgatgaggggagaagtgctaaagcagaggttgccgttttgcgagagtgtcagtgacagcggaaggagagacagcctgagaggacgagagagagctagcggagaggaggtagtgttggtgggaggataagaaaacaaactagagcagcgtgggggtgggggtggggattggcgacgggagcggactggggaggaggaacaacgccatgggaggaacgacaccggcgtccaccatcaaatcacctccctcaagctcgaggtaaacgttgtatcggccaagtcaagcttgttgttgtgtgcccgtgttaattacctctacggttctcgctcgatttgaggatagatggcgctccactcccacctgcatgcgaaagtacaaatttgctctcctaccatcaacaacatttggtacctgctagatgccatagcgccaggtaccgagcctttccaagccgttacatagaatggaatggacgaccaagatttggtacctcctcccctcaaggactgtaaaaggcctcttattattattttgatggttccaataattgcagatatcctcactcgtacgaaaaaagggtccaatttaaagagtgtagttttggctgatatttcataccacgtaggagtatatgtaaatggtacccaaatttaaatggaggtgcagtggtaaagaacagcattagaaacaaaagctttgcaatgatcaagacgtgtccagagctctagcttaggcaaacaggcatgggaggcactgaggacacgattgcgtccacgctggccttccttgcaaacgcaaagtcatccagaagcagcgcaagatatctctatggacaaacctgcagtgttctgcttgccgccctctgcatccgggagcagcagcagcttcatgttccccggtggattcaccctcgcccctgattattgattgatccgcgtagaggtcaatcggcatgcagggccgagccaagtacgtatatacgtagtgagtttaacactaggatagctaattcgtccccaaccagccgtgaaggaagcctgccaggaattcatgagatggatattatcgatagaactaagtattgtttggttttgtttgtattttccaaaaaggtgaaagcaggtattatcagaactataaaagcccatgaagctcctcgtttcttgtattgtcacgttgagccgggggggaatttattttaatattttaatatttaatttgtaacatcgtttattttcatgctcatttggtcttctctttcccttttaacgaaagtttggtgtttcttcttgcaacatagccaagcattgagttatatggtctgtgaaccgcgacataatttttaatttcaccatttaattttatatttaatttagggacctttttgtttttcttctatttcttagacttggcttttggaccgctataagtaaaagcatatgttttatgtttaaattatatgttgttgctcttttttttaataatgtaagttattctagccttcgcaatgttttgttgcttacttcattcatgttttccttcaagttagccgtaaccattaataaatagttgttgttgtattatggcacacaagacaccatacattatgtagcgctctagcttgtcataaaaggtagtagaaaaagataggctagcaaaatatatatagaagggctgaattatgtagctatgttactatgtaatgaattgcaacaggtaactacgtataactagtaacagtaacaaagggtaatacaaagctatctgcttgttgctcaaataattagacaaagcagaagcattgttctctaatcatatctccccaaactcacccgtggatgtaacacatctaggaactggaagcatcggggagggcgatcgatcacttcttcatggatagggcgaggtcattggctgagagggaggcctcgacgaacttgccgatggtgaacttgtcggccgctgcagagcgcactgtagcgcgccgtcctgaccaaaggcctctgcatccacaagctgaggatgaaggtgatttgggatggcaccgagaggtgcgagatgaagatggtaattaccagaggatgacgtgtgggaccaaggatattttataaataattgttttcttcatttgtagatcggactgatctggtgaaatagctgccgcacatattttgtaaataccggttactttacacctgaacttcttccacggtatggaaaactcctggtgtaaaaagtttagggtgtaaagtaaccgatattagagtttagtggtgaaaatcgaattaccgacatcaaacgtggtctttgaaagttgaaatgtggttactaaaagtcattagcactactttctaagaggactcgcgcgctaatttaaatggtagccaaatttaaagaggtggagcgcaccaattttaattgtctagattattcagaattttgggatagaagaagacatgcaaggagtagtaaattagctgaaaagaacttaatcccactattaccacactcacatgtacacacggctacttatatggaccggtgtgcacggctcacgtttttgacccaagaaatcgacgtgacaacgatcgagctctccgatccgatcccctctagctaggattgtaggcatggaggcattggaaattactcggtggcctctgatccttccctcgcagcttggcgatctcctcctcgaccaaacccggcgcttgcgtctaacgcggcatgtgcgagttgccacaaccacaccattgcgtgcgtgcggcttcttccctgcacgccacgcgcgatcgacgacgtacgtgttgcagcactttgttctggccctggtggcggtaccggtgatcttggtgtttgctgagcccagttctgatggtggatgagtaggtcagtccctctgttgcatctattccttgcaacagagtgcagctgctgtgaatattttttttttcttgaccatacggatgagctagctcatgcttagccttacgcttgaataaactggaacgtaataaatagaactcggctcattaccatcaagagaccttttgcaactaaggatacatattttcagcttttttttaaaaaaaatgattaaaagcctgacctctacatccaacttggatgtacccaacacatacagtgatgtcattgataaataaaataaattttgacaagttggaaaactcatatattagtaactttcactacttgactaaatttggtgctactcccccgtcccatgatataaaggattttaggcggatgtgacatatcctattacaacgaatctggacaggtctgttggagccttaagtttttgttggagcctaagcaagatgggttgagttgtgatccaaattcatttacatatgtataaaggtcaacttcggacggagcgaagtggaggcccgtcgccggtggcttgggccgtcacatagctgaagaggtctgaatatgatagctgtgtgtatattaaatttgttaatggatcacgcatatatatacttactgttatatattgatgatatgttgattgctgccaagagcaaagaagaaatcactacattgaagaaactgttgagtagtgagtttgatatgaaggatcttggtgctactaagaaaattttaggtatggaaattactagagaccgaaattctggtttgttatttcttagccggcaaagttacattaagaaggttcttcaacgtttcaacatgcatgatgcaaacactgtttgtactcctattgcaccttattttaaattatcagctttacaatgtgctagtattgataaggaggtagaatacatgtcaaggattccatattctagtgctgttgatttttttatgtatgccatggtttgctcttgtccggatttatcttatgctatgagtttggttggtagatacatgactaatcctggtaaaaaacaatggaaggctatttagtggagtttcaggtatcttcgagacacagcaaatgcttgcttgaagtttggcaggactgataagggacttattggctatatggattcagattttgctgctgatttggacaagcgaagatcacttataggttatgcgtttactattggtagttgagccatgagttggaaggcaacattgaagcctgttgttgcccagtctaccactgaaatagaatacaaggctattactgaagcatgtaaggaatcagtttggctgaacggattgtttcctgagcttcatggagttgattcttgcattaacctgttttgtgacggtcaaagtgccatatacctcactaaagatcagatgttccatgagaggataagcacattgatatcaagtaccattatgttcgcgatgtagtcgcacaaggtaagataaatgtctgcaagataagtattcatgataatcttgctgatatgatgacaaagtcagttcatattgctaagtttgagcttttctcaagcttagttggtataatggtttaacccaatagattatttggcgtcgaaagtgtttttctttgttgtgttgagggtgaaggtttgatttatgctacaagaaggaatttgtctcaaggtggagtttgttgagttttaatccaaattcatttgcacacgtataaaggctaacttcggacggagcgaagcggaggcccgtcgccggagacttgggctggagcaaagcggccgttttagggtttcacctttatatatacttctggaatgtaagctgccgttcggcgttctaacctcatccgatatatagtgaagatatttgctagctggcgcctatggtttttctctcctaatttaagaggggttttcacgttaaatcttgtgtcttctgtgattggtgtatcattttttatcgtttatttgccgatcgttttctaaatatatttgttggcatgcagcaagtaatcaaagacagtagttgtagtacgtacatattctctctgtacttgtgctgttaagtcgccgtagtaccttgattgtttatttagccttatacagacttgacgtctcatgcatgtctcatgacagagggagtataaatgatggcctttccgattgtattttcatcccatagttcatctatttataaaagacaatgctccacttctaaagctgcgtgacacacatcgagagctggagcgaactaaagagctggccgggtcagtgtggatgttagcatgtatacacgtacacgcatccgtagcgactctattgatttgttgaaactaattaagatcctagcttagatatgggaggcatggggaattatttagccgccatggaactaaagcttcgccctcgcttgtttctgcgcttcttgtgcaaccgcccatgaacatacgagcaatattttcgctatgaagagcacggggaggatgctggctgcgaggcccgttctggcctggccttctctttgtccagccatgtcgggatggtcgtacgatttcatatgtcctaatgtattgctcgaagttcagtttgtactattggagaagtgattatcccatttagtaccggttataacaaccgcgactaaactttcatctgtcctaatggtattcgaagtgcagctagcggccggacgagacgagttcgatctcgatctctcgctagtagtcttctaggcatgggatgggaggagtcggaaattacttggctgcgtcggatccaacacttggcagctcggcatcgctctgcttactaaccgggcgcctgcgcgtgtgacgccgaatgcgcggttgccacggctactccattccagaattaaattttaaaatatacagtattttcctagaatttgcacatatatacatgcttttgaaaattttacaaaaatatatgtttccgcggattgggaatgcggtatcgggcagtggcgcgacgccaagacgcgcgaccgcatccgtcggtcccgtaaattggttgtgcggcaccggtgctgacataatatagtcgtttcactgcctttgttcaattcgagctgctagtgccaagaagtcatgcaagcatgtcagaatagtgaatgctaaagctagctacctgttaatacaatcaaagttttatgagtatatcctttgtttgttgcgggatttggcggtggtggcgcggctccgcgcgaccattccgcgggagcgagtcggtctattcttctgcgcaactgctcctggtgctgggaatggacgccgtcgcgcgctattgtcacgcgggatcgacgcgatcgcgcgttttggggtcgcggcaccgcccctcccatcggtcaactgtacggtgccgtatttccaatctgcgggaaaggtatatttttaaaaaaattacaaaagcaggtatatatgtgcaaaatcgaagaaaataatgtatattttaaaatttaattgatccatgcctgcagcatccctcggcaccgcgacgacgcgctccggctaatcgttctgccccagtatggtgttatgctaagcccagctctcattctcacgatgatgatgagccgtcggtcagtcctgtcctatctacctagctattccttgcaaattggagtagtacccacctgctgtaaatttttcttgaccatatatatgttgttttatggtcgagggttaatacatttcaatgtaataaatggaactcctcttgttagcataatgagttcgtttttttttgttgtttccaggagactgtttaaaaacataggtgtgcctggttacatgacaaaatgtgtccatcactaaattattgaagcatccatgactttggctataattaaatagagagttagacgaaagttttgtacatgcaattgatgaatgagaaagcataccacaagcttatatctttatgtctcttacattcctagaaattatgcaacttgttttgactaggcatataatacagggtcacacgatgttctaccgaatatcgacgaagaaaactagtaaaaattcatagattccttttgcatcttgctgatctaatcacgaaaacgaacttctcccctattccccgttccgttttcgctattcccaaagaaatccactaccgtctgacttggagtcgtcggtgaaagctgattgggaattcgtgaaacagcttgcgggctgtgcatgtcacaacgcccacggacaccatattgcgccgggaccgcacgacagtgaggtcacaccgtgccacaacccaggcgtcgatgtgcaagcctcagcgtccatgcccactgaagccacgccgccacaccaagacacatgtaatgtactgtcgtgaaggtgctggccggacatgaagagggaaacagaaatatagacgaagaagaatgaagaagaaaagggaaaaagtggcgaacaacaccagctagcggagccacttatgccgaccattcatggcgctgccatacccacagcgcatgccgaccacttgatgtgtggctgcaggaccgtcttgtaatgactgaacgagtaccaaaggcgttggccgcgcctccacgccgtgtcgagactgttgcttgcccgtgcctagcaccgctgaccggccgagctactccgccggttggccgcgccccgccacacgggcgcgcaaccaccgctcgcggtaccccgccgaccgaccaccgccacacatggcaagggcggtggttgtgtggaggtggggtgggggaaggaaaaaaacgaaaggaaaaagtagaaagagttggtgattttgcaaaaatgcgtccgtattttctcgaaagtaagcacatgttcttctgcattggaaaattggactttaaatcctgaagtttttagagaatacagatataatcctctgcattggaatatttgttggactaaaaaaaagatgtgaaacacacatgattttcctttgcgtccagtatatatagtgctatgattataaaagaaatacaagaccgaggtgatagtgagaccagacaacaaactatatatatcctagtgagttgggaactaaattttccaacgaccgtcgagacgatgatgcatcgatcgctctagtttaggcatataggcatggaaggcatctgggacaaagctgcatcaactctagtactccctagaaacgcggaagcgttttagcctcgcttcgcgtatccggccagtggtgttgacagcaagtgcgccgtgcatcctagccttcctagcgctgcgcacacccccggccccatttcagctgcattttctcatggttggtttttagcgagcaatgtgagcgtaatcggtcctgcgaccgtgcgtcgtattctctagccgccctaccacaaacagagacctcaatcggtcgcattttggtggaaccccaaccataaataaatctagttttcttagtgtgagttgcagcatttgaatgtgcaatgttctggttactgcaattcaattgagaggatgcatggagatctttttctggtcgttctaatgcatgtcatgctcttttattttttttgtttctacgaaaaatattagacctttccacaatcctctattttaacatggtttaatctattcatgataatgtggtagcccctccgacgacaaatattaattgacctttggttctttttacggtatttgaggttctaccttagactacaattttagtttataaatctagtcagagatatagtgagactatcaatgtgcattccatgaaaaatctactcacactatttttacgttttgaactaaatatttttaaaatatatttttttgagaaaattgtagtatttgaaggttaaagtttaacctgattttatccaaaaagcaatgttctaataaatctccagctatagcggcaagctatagatagcggatagggaggggaacaactaggatacttcaattttgacgctaagatttgtcggcagctaatagctacacttagttagagatagcatcaccaaaatagccaaagatagctgcacttagctgctaaaagtatgaattagaaactatgaattccatatatgaagtatgaactacgaattggtgatgaactctatctgtcaatttttagctcaaattctatcattttttttaattttttttcttatattttcaaaaaccgctaaatttcttagctatagctatagctggtcttagtttttggagagctcaaccactaagaggcttagctgaagatttagaacattgccaaaaagtcaagtactcgtgaccagggaatataccctcatagcttgttggttggactgaatattttctttggctacatgaagatagttgttgagttattatagttgtcgaaagatggcaccccagacaccaataatgcacattaatatgtagtgataggctatagaagacaaccaaagtaacataatagtaggaggtagagaaacaaggtgcatagctcaatatgtgaaaaaagaatttgagaagtacatggccgtcgaatgattgtgtgtgtgcaccattgtgtgccaactggaagattccatcttcttaacatgttggacaattcatcctatgcttctaggcatgggatgcatcaggaattattcaacagccttagattggacccttcgctacagcttggcgttgctctgcttgactaagagcaacttcaacccgagcctcatccctagatccccatcatccgttgcaggacgcagctccagtagatggatgtggcttggaagctccctccctctctccatgactaggaccttccgtggcgtcgtgcatagaggtttgtgaggtggcggatccgaagtctgtggcggggccgacggatggagacgtgcaggccagcggtggcgtagaggcatgcagtatcgtcgttggagccttggaggcttgcaaggcggcgactcatatgcaaatgacgatggagggatttttacatttccttgtttttcctagataagtgctaatgactaacaagaagttgtacttgaagaagggcatttaggtcatttcatgttagtactaaacttgcattgggaatttagggatgggtttttttgtgagacagagggggtagatctcatgtaatcaagtagggagataagggaactgtttccgtggtcatctctcttcatgtgagtgctattcatcccatagactaagacagttagacgcagtcatcattttatagaaggatagtactccacttcaaagatgcgtgacacacatcgagagctggagttaaataaacaaggtcaatgtacatgtacacttgtgtacagaacgcatcgatagcttatctctctcaatttgttgaggcaaattagttaaatttgacgtgaggatcgactctccaagcgaagctctcagcttagctagatatgggaggcatcgggaattattcagtggccatggaactaaacatcccccctcactcgtttctgcactgcttgactaacggggcgactggaggaagctcagcgtctacaattgccgcttatcccagcttgatagctttgatagattgtggcttcgcagctcgcgcactgcacgcgcgtcgcacgctgccggagccgacctgatattttcttgcaacattttcgctatatgaagagcacgcgagcctcgaggttgtcaaaaaaaaaaaagctcgaggctcacgagctgctcaagctcgacttgtcttaggctcgattcgagcttggctcgagctccagacgagtcgagcaagagcctctcccaaagttcatgagcattgtcgaggagcttgagcttccaatgagtctaatataagaattttgttgttatttaataaacttggagatcaaatattttatttgtatatcttgtattgtcatcatatatttattttattattttttctcttttattaatatgatgaactagaaattaattatttttaaaagattattcttgaaatatacattgttttacataaatattaagttcaatagtcgagcttgatcttgatcgagctcgacatagcctgtataaaagctcggacgttttataggcttgaactcgagcttgtatgagctcgatcctatgcaagcgagctagctcgggctcggctcattgacagccctaccgcgatcgatgccgacgagaggcccgttctgtccttgcccttcttccctttgttgtgtccagttgggatggacatacgatttgatctgtcctaattaataaatgtttttttaggaacatcactgttgagaagtcttagagttggacacatttaataaaaaatatatagaattaaatagggagaggttgtgattggttgggaagtggagataggtgggaaaagtaaatggtgaagggttgtaattggttgggaagagaatattggtgaagaagttattatattttgggataaattctaagtgctaaaagttattattttttgggacggagggagtagttgttttcccatggtgttgtgccaaggccgagattaatcacttacactgctaagctagtttaagcttcaacgaaatttggataagacgcaaaaaaaaaaatcagctcgttacgtcgtagactattgcaatatactccatccttccctaaatatttgacaccgttgacttttttaaatatgtttgaccgttccttttattcaaaaacttttgtgatatgtgtaaaactatatgtatatataaaagtatatttaacaataaatcaaataatagaaaaaaaattaataattacttaaattttttgaataagacgaacggtcaaacatttttaaaaaagtcaacggcgtcaaacattttaggatggaggtagtagtacatataggtagtcgtgaaaatttggtctttgatagttcccggtgataatgcacgcaaataaaatggagaaggaaaacaaagaaacaatataacaaataaatttgacaaaccattaattccaccacaaaaggctcaattaatttagtctaacccgaagtacgctcccaatatttgtgctctctatttataaagagcaagccgaactgagtcatgacaaaaggacaacgggagtagcttaaagttaacagcttaaaatagatcgcataagcatgtagaatggaattgcttgcggagcagatataaggtctaagaggcatcggaaactctgttgtgccatggttgttttggttactgcttaatgcttatgtttatcataagagccccactacggtgttctctattgatagtagagaataatgtgagccattattcttatttaatcgaatagttcagatctatttatattatcgtctagtttaaggtaatagaaatatggagatgtattattgtaaataaaaaagatgaggaggggtacaatcattatttatctgcgactaaacttttttccttcttatttgttttttcgatggaatatgagtaatgccattgcaatggatgacctacatgacgatctagctgggaaaaaacataaatgataaagttacctctgatcactgtattatgaattactgtcttatccttaacaataaacgggatagtgtcttatccttaacaatgaacgggatagtataatactatcgtagagagcaccataacattgcttttttttaataaatggaagcttatgtttggtaatacgggacggaaggagtacatggccagactacttatagataactccagctgcctccaaccctcctatgctgtccacgtgaggcttaaccggattttggaaagggtttttggacacgaataaaaaaactaatttcataactcgcctggaaaccgcgagacgaatcttttgagcattattaatccgtcattagcacttatggctaatcatagactagtcaggcacaaaagagtcgtctcacgatttcctccctaactgtgcaattaatttttcttttaatctatatttaatgctacatacatatcttggaagattcgatgtgatgtttttagaaaaaacttttggagaactaaacggggcattatataggacatccaattcgctggacagtgtcactatcagagatcaattcagccgcgtcggatccatggaacgggcatcgatcgatcgatcgagggataggccacaagctaggcaacttgtgcattcgctgctgctggctctaaaacaactctagctgctctactattgcagagttgcgccccttaggcatgagaggtgtttgggacataccagagaccagctgtggaagcactttgatgcatcctcgcttcgcgcattaaaatgtggcacgggccacttcatgggctctgcttgttttagcaactggagtagtagtagtattactctgttgtccaaacatattaaaccaatatactcgagagtgctattttgatgtgctttagtgcggctagtagtagtattcagtagatccttctaaccaaatgttactatctgggtggccggtgcaattgtccggtatgattttacttgaaaatttattaaatagctatcttgtttttttaagactttgaaagaccaaaccttatcatccctgtgtttctaattttatagttttataaaaatcacaccagttgctaccacttacttttgtcatctctttttttatttgtttgcttgatctaccattgattttattaattctccttggaatctttataaattggatagtatagtttttagagtttattgtctcattcggttttgtttttataatttctagaagtcccattaagcgctgccattatactcctccatggtccgtccactgtcttttctctttttgtcattgcgattttaaaagtcgaatataattattgtttgggttcattttttactttttataagtccccccaaactgtcagtggctttgccactgtactcctctacggttcacccgctgccttccttcttattgtcattaagattttgaaatcgaatattattatcattgtggtttattttttttacttttagaagttctgaacctttaaaaattggaccttatagtttttagaggttattgtcttgttgggtttcagtttttataattttagaagtctcgtcaaacgatgccactatactcctctacgcagtgtccgccgccaactttttattttcattgggattccaaaaatcaaacataactatagttggaatttattttttactttctagaagtcccgccaactgtcgacggctgtgtcactgtactcctgtatgacccacccgctgtctcttctttttagtcattgggattttaaaaattgaatatgattatcattggggttttttattactttctagaagttccgccgacagcgttgactggttacttgacggcctgcctgtcgtccctctttttaatcgtcattaggattctatttggtgttttattaatattttttagatgtcccaccaacctccaacactttaattctttataagtatgttacttaattactctcgtcatgaattttagatggtcttttctttcaatagtctttatgttttatcaccaattttagttatttataaattatattcctagttgaatatttttttaattttagaatttattttatttttattttgaattttaattaatactgtattatgtttttttagtatttttatattttattttcaatttcagctgtttcgaaatggtattcctacttgaactatctttttaattttttctaatttcatattttattttatttttttattccgaatattaattaatgtcatattggtctcgtacatggaatcttctttcaatagtgcatatttttaattctgaatttcaattatttttaaattgtatttctacttgactcttctttccttttgctccaattaatgtgggaatttctagctcccacagtgaatgtggttcctccttttaaagctgttttaataatatattaatagatagatttctttgatggttctatctgcataaacattgcagttaagttattttatatctgttttgtgtaattgcacataaacatatactccgtacatagtgctaggccatataggctatagccatgtaacggtaactagagagacagaagggatagcacgaggtagagaactaagttgtgtggctgtacatgtaaactgtagagagcaagcaaagaacaaagtttgtccctcttcaatgtatcaacgaactcatccatatatcccatatatccatgtaaacatataggaacagaggaggtatcggaaatctgggtttagcagtgatgtagaaacgatcgtacaacggaaaactggtaataacttgagaaagccattcagccctcgctcatccttgtataacttattcgcgttgtaaaataaacttcttctcatatccctagaatattcgttctagctaagagcttatcgtctccccagacagtttcacccgaagagaacacttctctacggctacacgttctcctaatgcctaagcaagatgaaggctaacgatgagaagtaccgaagagctatctcctacagggtcccttgcataaactctcagccagacaaataaactgggatgcacaaaagaaattacttcatataacacgagcaaatttacatacggttttccctttcgggaacccccgagcttacagacttgctccatgcagtcttgcgtgtttatgagggggatgaattctaatctctcgggtggacgtccacccgtttcttgtatgccacctaaatgattatgaaaaagttacaaaaaaatttataagataggttaatatgtaatatatcatctcacaaacatgcaagttcaaattcgacttctacaagttgtaacaaaaataacaaatttgactgtgaatatgtgtgtagtagttagagtttaattaacaaataaatttgcgtgtactaatttgacttttatatttgtgcaaaagattttacatcccgaatatttcttaaaaaaattgaatgaacaatatattttcaaatttaattcttgttgcaatatagttcacataggaactcgtgaaaacttggttttagatagtttccggtggcgatgcacgtgactaaaaggaagaagaaaaactgagaggcaatataccaaataaatttgacaaaccattccacctcaaaaggctccatttattctaaccagatggacacttccaatatttgtgctctctatttataaagagcaagacgaactgagtcacgaacaaattaaaggacaatgggagtagctcaagggtaacagcttaaaatagatcatcaaagcatgtttaatggaat

SEQ ID NO: 59483 - DNA, 12121 bp, Oryza sativa
tcgttggtgtcataacgtgtctgttggtgtcatagtatgctaattatacttagatcgtgatggtataatatatggataaacagtttcgctatagattttgacaaaagtcgttggtgtcgaaagcatgcattacactgtagatccacccctgaccatgcagcatgtatgttaggtctaagaggcatcgaaagctcagttatgccatggttgttctggttactgtaatataacaagcaatttagtactgtgcagcaccaagagatagaagtacaagtccattagtcttctaaaagatgggccatatattatgaacgcattcaatgtgaccaagaggtgctattttttaataacataccggtacctatgatgggaggagagccattgtggtcagaatcgtaggtgttggttctatatgcgaaccagtaactgtgtgatttttatttagcaccaacacctataaggtgttttgtaattgtggtactaatattgtcctgcagggtggggcaaaggtatggagatgctgagaataaccatccgtttataaatgatgtactttcaagctgaggtacttataaatcattcgcctaagagacataagtacatgtctttaggtttccagaagacaagccatatattaagagcgcattcaatgtgaccaaaaggtgctaatttttaataatatactagtacctatggtgggcggagagccattgtggtgaggatcatggtgttgattctatatgcgaaccagcaccaatgtgcttttcatctagaaccagcacctataaggtgttttgtaattgtgataatgaccattgtcctgcaggttggggtgaaggatatatatggagatggtgtgaaaaaccatccatccataaatttcaagctgagctacttaaaaagactctgagaggatgtgccatctatatacatagcactcgactgccgcgggccacttagatagctgagttaacttaaaagggccagcagatgtgcacgtatatgtagctcagttttggaggcaaattaaaattgacggtccgacgactctcatcagatcgagtctctgtcgctcctagctaggatcctatatatgcatggaaggcattgggaattattcaacatcccttcatcggacccttcgctgctgggcgttgcatttctggactaatgtggtggccgaaggcagcgcaacgtgtgcgaccccctcttcctgccaaatagcttgtggcttccccactcacgtactgcacgcccaccgcgcccttccaacattgtggcgtggtgttcgtgcagacattagacctttaggcagagcaagtggcaagggaagttctcacgcctgctctgcccggttatctctttgatcaccatcacagaaggctcatccatagctggttccactgctctaatcggtgctagatttgttgcatcactactcttctgggagactcatctgtgtcaactctcaaaccggcattgatgggagagcacgagtgaaaagaaaaaaaagaataataagaagagttcgacagccccattgtttggttgtttggtggaataggtcaaacggcatatttgcaaataaaaaataatttgtgaataaaacttttatgtatgtgttctaaacgatctaaaaacaaagactgaaaaataaactacgatgacaaaactctaaaatcaactttaaatttaaagttgaaaatttaaattttgactgataagcgtaagcataagaaaaagacgaggacgctgagcatgtctcgatgaacggagctgacgcttcgagccaaataatcagaatcgttaccgagacaccgtagaataatcacatttggatgcaatttttggctccaattaaaaaaagcacgaatgttgaaataaaaaccacaggaatgagtacacactgggacatactcccaatcatatttaggcttcatcctcgtattggagtatgggaagcatctaaaattaggaaataaccaacagacgaagagaatgaatactaatataatgatcaactatgaacagggggagtatttgtttttatgttttcacaactgacccaatggttatacaacttccaatcttttaggtttgatcgatgatccggttcggttttttcgactatggataggacacaccctgacagggatgccgagaggcccattctggctcggcaactcttcattataatggacgaattgttctgccctattgtattccccagagtgcagctatactatgtgaaaataaattctcatcatgttgtttcttggctgaggtcaactacactgctattttttcaataaaatatgtataccacatcgtttcaagataatatatatatatagatatatacaccctcgtgaaatatgtttaagatagttcccggtgataatgcacacaagcaaatggggaaaaaaaatcagagctgcaaatgaaccaaatgaataatgaatttgacgaactgttacaccatataacggcccattttcttttttttagagcatctccagcagggacttcaaatccagcccctattcaatttttgagagttaagataaaaaaactagatccagcaggggccctactacagcccccaaagtgaggaggccctcaaatcctcccccaaggccccagtcctggggactccggagcacgcccccatcgtcatttttttttggcgcggatataattttgcttcgtgcattttcttgttattcccgcacggctgcgacgacggatcttctccggcgagcaccgacgaattcccagcacctccatcaagactgccctagaaaggtaagacttttccatacctttcttgcccgccgttctcgaggccttcggcggcagtccatgcacatgcccggccgccgatctcccgccatctgcctggccacacgccggccgtcgcgtgccctccgaggctgcccgcacacacgtcgcccacctgcacgccgcctgcccccacgctggcctcctgcccccattgatttttctggagaaactctaagtaggtcatgtggtgcgggggttcagtggtagagtactaatcaattttctgaataactctgttcttgacacctgtggacatgtggtggtagatggttctggtggagactgacttgtttttaatatttttttggagaattgtagtggactttgtcggcaagaaaaatctaaattctcagctagtaatggttgtgtttagttcacactaaaattagaagtttagttgaaattgaaacgatgtgatgaaaaaattagaagtttatatgtgtaagaaagttttgatgtgatagaaaagttggaagtttgaagaaaaactggatctaaacacggtgaatatatcactgtatttatacttagtagcactgtacaattgttgcaatggatcgattagaaccatatatatatatacaggagtaagtggtactgtactagtacgattccactgcttttcatagattgaatgttgcatactgtatatggggtatactctgtaccgtgtatgtgtagttggatgtgtgcatatgctctaaattttcttattaattttatgattttgtgatggcagtgttttttatatggacttctacgacgacgatgacgacgacgatgatctcattaccgattggtgggatcaggaggagttgtctgacgatgatgactactacattgcagctgctcttcttacagacatagagcataagaggaccaaaagaaagcatcatggttcagtcccaggtcgtgagataattcatagggacaggtttgctggcaatttacgcatagtggctgattattttgcagatcctcctatatatagtgcaaaattatttaggaggaggttcagaatgtcaagggagctcttcttgcgcatcgtggctagtgtggaggctcatgatgactacttcaggcagagaccaaatgcagtgggtcttctcggtgccactgcattgcagaaggtgtatggtgcaattcgcatgcttgcatatgatattccagccgatagtcttgatgaagtcgtgaggatttcagagagcaccatgatagaagctttcaagcactttgtcaaggctgtggtggatgtgtttgctgatcaatacttgagggcaccaactgctgaggacactgcaaggttgatggctataaacactccaagggggttcccagggatgctaggttgtattgactgtatgcattggaggtggaagaattgcccaacaggctggaaaggacaatattcagggcatgtggatgggccaaccatgattcttgaagctgttgcatctaaagatttgtggatttggcattccttctttggactaccaggttctcttaatgatatcaatgtactacagagatcgccactctttcaaaggcttacatcagggacagctccagagttggagtttatggtgaatggaaataaatacaccatgggttactatcttgctgatggcatatacctttcttgggccacttttgtgaagaccatttctaattcacaaggtaacaagagaatacattatgcaaaagttcaagaaggagtgagaaaggatgttgaaagagcatttggtgttctacaagcccgctttgcaatggtgaggggtcctgctagattttgggatacagagaccctatggtacataatgacagcttgtgtaatcatgcacaacatgatcattgacaatgagcgagatgaaaatgtagattttgactatgatcaggaggacagtgaggtgttgaggaaggaggaataccaacgacgtaataaacctgtgttagagaaatttctaaagatacataaagaaattgaagaccgacgggtacatgagcaacttcgagatgatcttatggaacatttgtgggcgcttcatggtgctcggtagtttgtttcattgcattttctatcatgtgtgggttatgttcaatatttgcttctaggatatatcattttcatgtttgaaaattttgaattcaattttgaatcgtggtgtttgaaattgcaaatttgaatatggttgaattccatgcgctagaattatttatgtttaaattactatgtgttaaactagatataaatataaattctatactaaaataaaagagaaaaaaaataggggctaagatatggaggctactgctagacataaagacatatttagggtcctagaacattgagggcagcccctatttaacttttagggactcgaaagtaggggctactgctagagatgctctttagggaaaagacatgagctctaccattcatttatagaggaaagcaagtaaaacaaacggaaaatccttttacaaacagaggaaccaaggttttcccccacaatacaggaaccgatttttaggtagccagcggccacaagcagcaacaaacgactaagggccatctaatttaggggactagctgagctgccgccatttgtttacacatttccaagatcgaattcacaacatgttccaccgtgctgtaggttcagttgaaaattctgtcatttcattgcagccaaatgacccaagccgtgcaaatgattattccatcgaaaatattcctttgatccttcaccatatcttccttcagcaagtgtcccaccagctcatgaagttaccatcaaagcaggaggaggtcggaatgtgtggaacttgatttggaacggctgcattttcttctcgatcagccgctatactgtcccgttgttcgtgttctgtagtttatatacacaaatagtataacatgaaccaacgtagaagagagtcaacaacataaggacgacgaggctcagagctagcagctgataaaatggatcagaaaggcatggaattgaatatagcctgctaagcttaaaacgatggcaaattttgctcctcaagtgctatgattaccgttcttctcagaaccagggctgggaagcaacgatacaacgagggctgctttcccagtctgggcaaatagcaattagataaattcaggctttagatcagagcacacatatgaccggccatatgccaggtttcaacttttgtaattgccagttatatatagcgtgcaggcgagatgacacctctggcaaaataacaagacgtctatatatgacatgtttttgataatgcagtttctttacaaatttactttgaacactcaactttcttcaatttccctttgtgatcttttttttttgcgggggccctttgtgatctaatataatggtagagcattgtaaaagaaagcacccttcaatcaagcaccatccgtcttaaataccatagccacattttttattttgtgactaagacatcatgcacgcatccctgaaaaaaaaaagaaagacatcatgcacgcagcggtatatctatgatttttatataggtggtccaacttatatatatttttttaaaaagaccctaattataacaaagctaaaagccttttaaaggaaaaagtacgagttaccctgaatcatcgtggtcgactaaataacccccctaacccaaaaaccatattagaaacatattagaaacgagtttttgctttgttcaaaagtttttttcatagatgtataaatatgcattaattgggctaagattttttttggtggcaccgggatcataaggaccaccctgtagacccgcctatacatgcacgttatgtagtgatgggccataaaaggctgccaaaaagagggtagaagaggcagaaaaacaaggtggctagctatgtgaaacaaagagcaggggatagtattcaggcagtcgatcaagcatttgcactatctgcgcaagtcaggcgattgcaacagccatatatataacatgtaggaattggaggtaccagaaacctagctcttgcttcgaagaacagattgacaagtttgactacccaaaaaactgtagaaattaagcctcgcggccctttttcagttcatcttcctgtcatatcctatgctatatgcatatcagacagaagcgtgagcctctagctagtacaagcatcaacaaagtggagaagctgcgaatggtttgtacgctagcttcttccatggaagattcacccgccatgatatatggaacttcaatgtggtgatcgcttgcgcttttttctgaagactgaattctactacgatgctacctgaaaaaaattagccccaaaaagattctttgctgctttgatttactatactagctagtatgtgggcatagcacatgtttttgtgatttatatttgatcgaaaatcgctggttataggtgaaataattgtccaacgccacatatatatatataacaaaggctgcatcgtggattgtttccatttctcattaaaatgattgtgaacaaaatagcatgcattgtcgctattttatttcaacataaatataataactgctactctaattaatatccacttcaataaaaaaagcgcaaagcctcgatcttcaatctccattcaaaaataaacattgaatagacaaacaccacaaaagtacaattattagataaaaagagtggagactaaaaggatgattaaatgcataacttgttggacatatatatccttgtggaaaaaatctagtatgttgtattctgatatattatatcactacaagagaagtgctcatctctcccggttcgcaaccctctttactcccgggtagcgaaccgggagggagaatccgggactaaagatggcggtctttagtaccggttcaaatacgatgtagtaaagctccggctcatccccgtggctggcttagccatcctttagtcccggttggactaaagatttttttatttttttaatttagttgtgatgtgtgctgcctatacatatatatgcatatatattatggatatatatgtttaaatacatatatatatatatatatgcataatctagaaatgtatatattacaaatatacatatatgtgtacactatatgtatctatacatatatatgcaagtgtgcacatatatgtatatgcacttaagtaaatatggcctatatatatttacttaagtacacatatgtgtactatatgtttttacacatatatatgcaatgtgcatacatatgtagaaatacatataatatacatatatatgcccttaagtagttataggccacatgcatacattaacaaaatatgagtttgcacctaagtaaatatacacatatattaccaaaataaatacacaaaagtaaatgcatgtgtacacaaaagtaaattagtgtgttcactttgcggggaaacaaaattgagctataaacaatacttacaaagtccgcgcactgagaatagagacgtcgagggcgtcccggtgctataagtcgaagacttctttggggcggatccaaagaacatcttctccttgataataatctgagtttcgcaccatcgctcggaacatctctctacccatccctgatttatccatgtaccattgatggaaccggtcatctatgatcttattaggcgtgactagcggttcaccgagtttaaacttgtacttgaccgaagcagtttcaataggtgcgtcctctagcaactgctccatcttcagactcgtttctttcaagaactttcgtatctctatttctcccggttctatgaatggctaaacatcttgttgtggatgctgcctcagctgagggacttcctttccgcactttattgctgcagactttgctataagagccttcttcaatgttcaatcatagtcagaaactacgattggtttgcccggttccatcattttaataaagtgctcctgagcctccgggtctataggaatcttcttttccggactacgtggattcaattgtgccctaacttccactctaacggcttcatcgagctcctccggagtcttgtcgtacgaccttttcttgagagctgggagccttggctcgtcagatttggccttcttcataggccttgacggcgcaggttcatattggcgggaccttgacttggcagccggtgcaggctgaggagtcggtgcagacttggcagctggtgcaggctgaggagtcgtttgccatggaccagacggtgcagacttggcagcaggtgcaggcggaggaggtggtggaggcggaggagccggtgcaggcgaaggagccagaggagccgatgcaggcaaaggagccggaggagatggaggaggcggaggagacggcgcttgcggcggggatggaggtgtggacaccccatcttgcccgggaaacatgatgtacctcttcagccagagtaaaatggcatgggctgtgtctccaagtctcgtctccccgtctcctccggggatgtccagctcgagatcctcgtaggttcgttccaccagctctatctcgaccctcgcgtatccaggtggaatgggcttgcaatggtatgtacccaaagggtccgtggatattgatcgggagaggcatcgaatttgcaatagcctgcaaagaagacgacggcaattttctcctcgagctaacataggcaccaaatcaccaatgcagcatgcttgttaggtttgaggggcatagctagggtgatcgatacaaccgtggctgctttccgttttgtattcctacgtactatcacagcattgagagctatgcagctaagcttcacattaggccaaggaaacgagacaatgatcttcatttcttcaccttgaccagcaatatatatagtttaaatccatgcttccagatcagagagagaaagagagagaaatccaactgtcaatcgtcaccaacgttttgttttggtgccaaatcatagtaaaaagaacaaagccggtcagtgaactgctagagcccctactcaccgggtcagtggtccgaccaccggtttgtctggtccgacagataaaccggtagagttatttactatatgcatattttcctaagacaaggtcagttagctagcggtatggttgcgggtttacggcgctctgctaagagcattacaaacagttcccttattctattctctatctttaaatttaggaaattttgagcaaaaatcgtattcaacagattccctaacctatctcctaataatccaggttcccaaattcggatatctcgttacccactttcagggagcgattttttcttcccaatcacggtcttcactctcttgcacacgcacgatgaaaaaggttcccgcgctccttttctcgcctccctcaccccgcagcgaacgttactcttcctcgcaggcatcggcggcagcgaagcagcaaccatgcaaccccttccttgcaagcatcgtcgtcggatttccaggtggcaatgcagcggccgtccctttcctctcagtcgcaggggtaagttgaaatgggagtgtcaattgcaagaaagttactatgttcccttctgaaaattgtggatcgcacacagggatccatgataatcgcaatgtgtatatgcatgggagaggatagtgtagtacaaaatatcggtgaaacaaaaattatttttgacttggtgttaataatcattttgtgagactagagcacgctagctaagccaatgcaaggcactttaggtattttattggatactttcttgggtttttaggtgcaacacagaatcaattgatgcaccctacttggatcattagcacatttgtagtgtcacgccccgaactagccccgaacggaactaacctgtgacgctccaaattaacctgttaatcgataccagtcccaggaaacagtgctggtatcacaggaagacagaatatcacagcaacagtggtctctttattacagagtaggagtacagtcatgttgggctgcggacagatcccgagctcacaactgcattacaaaagggaaagcggaagccaagacttggaccaatcatcacaggcgcgacttgggaactaggccgaaaccctaaaacttatcgtaactgacttgctcctggaagaactcctcgtcagcgggatccacattatcttcttcagcaactggggggggttatttatacagagcaagggtgagtacaggagtactcagcaagccatgggaatttaagtgtttaatgcaggcttcaaggaaaggttgttgtttttgcaattgattttatttaaactcatttttgaaacaactaagtgagtgcttcttaaacgatacggatgagacagtgcgtcacgcccggtcggagtatgtgcaatgtatcagtctttgaattgattcaaggttggcacccggccaacaactttcaaacggccacccgggcctggctgatcccatcagccgccgattttccaaacatcgaacccattccacagcagcaatttcacaaagcagtagtcaaacaaaactacgctaggaatcacctcacatccgcccatgaccatgggcacggctgttcaaacagtttaataacctctacagagggggtacactttacacacacaacgttactagccttggtcacctcgcccgtgtggatcagacatgtctggtgacttggggctttcacgacaaggcatttcgaaagccgacacaggttcaccatatgccaacgagaggggtcccagaccgacatcaggttaggtcccagaccatactgtgccaggaagcccgggggttctccccgacaccaccccgttgaatccacatgtctcttggcatcatcgttcccccgactagctaattactcagccaggtgtgtcccattccacccatgtggtcgcacttgccttatgttcggatgaaattccaaggaaacggtccttaagtgcaagaacgggaaaatgtactcccagtacgtctcccggtctgcgattttagaaattcattttagttcgcaagcaccgacccaggtgtcgggttttccaagtcttttgtaaaacctaagttttacccatcgttggatattttaaattttgagggggggttccgatgcgcgtacccaaaggcccgtgcatcgaagcacaacagttgacaaaggaggtttaagtgttcaataattcaaggagggtaattgcagcaattaggattgggggccggcaagatatctcgcaagccgcggccgaattacttgtgtaaatcctattcatgcaatatttgcggaaaaaaatacttag

SEQ ID NO: 59484 - DNA, 864 bp, Oryza sativa
cagtgggaggaggggctctgcctccatcccttgaagcttgcgcggaggtggcggggctgggtcgtgacgacggcgatgacggcgggggcggtgtggagcggagcggcgacacgggcggcaggcgcggcaggcgctaacggcggcggcgaccaggcggtcggccaccacggcgcgcgcgcgtgggaagcaacggtgcgtggcgatttgagcggtggtgacgggaagcggcaacgagagcggagagggagggcgctcggctcggcgcggctcacgcgcacgcgcgcgcggcgcacgggcagagcgagggagagagagagagaaagagaaagatgggccgagagggaatcggcccatcgaacccgggggaggcaaattagacttttgcggaggaattgatttgggaaggatttggattcgggattgaactcggcgatagatcggggatttgagatctgagatggcacggacactagagaacaagcaaagaaacaaatttcgcaattagggtttttaagagataaatttcccgctaggcgccacgacggaacgggcgctacactaggccattgaatgaagagtaccctgagctaaatcttagcaagagggaaatatattaggtacgaataaaggttttatcctaatgaaattatgttgctaggctatcgagaaaaataaattgtatttaactatttaccattagcttccaggtgttgataatccatcaatatatgcatatttccatccaaatagttccttttttaatatcttctgttgtttattgatatcttccactaaattgatgcaagaggaaatactaatagtgattctcataggtaaattaaaaacatcttattacaggggtgc

SEQ ID NO: 59485 - DNA, 753 bp, Oryza sativa
  unsure (1)..(753): unsure at all n locations
tcaacctgtcatttcaaacaaagcctgaatttcttgaaatgccgaaatatcgacggatacaacaaatctgagcaccggttaacatatgctttccatcttaaattgcaggttttctgttgagaatgttcccctttatgattctgctgatgatgaacctaccagcattccaaaggacatcttaataaaagatgagccaaatacacaggatggcaacaacaacacaatccaaaatactgggattcctattattgcaagttcaagtgaattcacaccgatgaatgttgaaccatcgattgcgagttcaaatgagttcacaccgatgaatgttgaaccattgaatgtgagctcaaatgaattgacaccaatgactattgaaccattgaatgctattccaatgggagttgattttactcagaatggatcaattgaatatggtgcgcaatgtgctgaagatgctctgcaaaactcaacgcgtggagttgcaaacctccagaatcaaagtgcgccccgggacaacaaccatacagagttggttgcggtgaaacgtagacccacacttcgtggtggaaaagctaaacgtggtatgcgcaagcaactgaatgttgtgggtatctgtgatcggttagcatcagaggtggcacgtgaagaaatattgtattgcgaggtaaagaactactgtaactccctttttattgaacattgctctaggannnnnnnnnnnnnnnnnnnnnnnnnnnnnnnnnnnnnnnnnnn

SEQ ID NO: 59486 - DNA, 1167 bp, Oryza sativa
tgtaatgcaatactgcagtcaactatagcaaatcttgtgcagagtgtctgctttgccttatgcacaatagggtgactgaatttctaatagtacacaactcagaatatcttgattcgctaactgttaaaactgctctggttcaagtagttgttctcttgtagtcattctttgaattatgggagctctctgttcatgcaatgccattacattgtacaaaaggatgtaatgtcattttttttcatctatccaaatgtacagggcacagagacagaatcaaatgaagactatgggatgttattcaggttatcacaggagggaggcatcacctatacaaaattaatccagcaagtctctgtctcacctaatgcaattcttcctggtgctcaggtggcagtgactagaaataaaacacatattaaatgaaaatgtttaaactaaaactttatgtgcacagtcataacccccaatgtatttttttttgcaaaacagggtggtcttcccttgctccaaaacacagagattctaggtggtggaccaattgggatattctaattccaaaatctttgaaatcaagataattaatctaaggaaacaacacaaaagaaaaagaataagtcaatctttagaaatattatgggtttaaaaaatgacttaagtaataaagaagagatgcatacagcaagtaagtgtccgcagccaccaagggtttttgatgtttgttcctttgatttactctccttttggaacttggctatgtatgtcataagccattcataaacaaactttgaccagttccactttgagctggacttgatattaatcagaggttcaaggtattttgggctggggtgagtgtctgagttggggcaaagaaaggttgatagtgcaaccaccatgaaacaacgtaggacatcatcttctgatagtttgttcacacccttgtcgctaagcaaccttgtcattcttgatctctaaacctccatttgggataccaagtatgaagttggtggtgtttgggttgattggtatggatctcccattgacaactatatctgagcagctgacatcagtgtgactagctatccatttgacaaaagatagtggtatagcacacctttgaaagtttagaagagaaccaaaagcagaattctcaataattaacctttg

SEQ ID NO: 59487 - DNA, 1145 bp, Oryza sativa
tgtataggtttcggtttcgggttgtttgtttggatatccatggatgttccgtgtttatggctgtcgccgcctctagcctccaacgccacctccagcctccaccgcgccgccgccgccgcctcgcctccaccgtgccaccgccaccgctccgccctccaacgcgctgccgccaccgcctccgccctccaccgcgccacggccgccgccgctgccaccgcccgcagccgacgcctccgccgtccaccgcgccggcgacgccaccaccctccaccatgccaccgccaccgccttcgccctccaccgcgccgcggccgacgccaccacctccgccctccaccacaccgccgcctactctgtcaacgtttttcattccaaacttacccctgaaaaattttggtcagactgagaccgagaccgaatttgccggtcttgagattttttggatgaaattcggtcctaagttttcaaagaccaaactgaccaaaaaaccgaagaccgagaccgaatttttcggtctgaccgaacgcccacccctactgggttcgtatcccactagcgcacctttttctcacattttactctctccaactgcccccgtacgcacgtgaccaccttgcacaaggcagtccgggcggttcatctccgattttcttggcggttttcctacaaaaccgggtggcccaaccggtttataccaacccaattgcatagacggtcttttaactagaccagaccggcggaggctttggttctggttttttccggtccaactgccggtccggtccggttctaataattatgtatctgcatcttttttttttcccaagctgtgagcatctattaggtgttaattttgccgcccatgattttacatagacttaacgggtcgcttcctcaaaacagattgccatcattagtgaacaagggaagaccatagagtaaaaacttgaaaggtgttcgtgaggtttaaactacgcttgttttgcatatggtataataaattggaatgtttagccattgcattggtagcaaatcctcccttgctgtggcgacaaactttttagatgaatcaaatcatgcaattagtgcccaattgtattagtgtatcacaggaagctgagtttttagacaatcagctcagtcaa

SEQ ID NO: 59488 - DNA, 724 bp, Oryza sativa
ccctggaggagaatttcctaatcagaacccacggattaacgaaggtttatcaacatgggtaaaaaaggataggtccctagaggagaccaacttagttctctggtaagttgtcaccttctaacaattgctgtcgatcttccatgttcatctgattttctagcttaattatggcatatctgaaataaaaacatgtcatatgcaactacaggtacgtttcgggattacccatatccctaggctggaagactggcctgtcatgccagtggaacgcatcagcttcatgctaatggtatcactttggccttcgtttctttctccattgttctttatattacttagatggttttttgctgcgaaaagatagtattcttgtcctaattgcttcagataacattacgactttacaactcatctgaaaatggaagctatatatattggtttggttgtccagcctgatggactcttcaactgctcgcctgccatcgatgtgcctcctgcgcctgatgtttagtcgcagaaggatattcaggctgagctgatttcaaagctgtgatgtgctgcagcttcctactgtggtgtggtgttttagcaagcgaacttgtggtgttacgatttctttgctgtggctctcgtgctgtgcgaatgtataattgctttgctggtatatatagctcaatatttctgctggtcagttataagtttgtaaaaagtatttttggtagac

SEQ ID NO: 59489 - DNA, 1231 bp, Oryza sativa
ccggtactgcgtggcatcgacctcctcagccgtgttgtcgcggctcagcttcaacctttcctccatgggagtgtaggctgggttgcagccggtgagcccgcccaactcgacgatgcgcttggcgtaggcagtctggcgaagggagatgtcagagctgtcctggtgaacctcgatccccaggtagaaagagagaaggcccaaatcgctcatctgaaagtcgccttcatctcctccttgaacgcctccacctcagcctccttggtgccggtgatcaccaagtcgttgacgtagacgcctaccaacagggcattgttgtccttgccccgccggtagacaatagcttcgtgagagctctgctggaaccccagttgcttgagagtggagtccagcttggcgttccaagctcggggcgcctgccgcaagccgtagagggccttgcgcaggcggagaaccttgttctccttgccggggatgacgaatcccggcggctagtggacgtagacctcctccttcaggtctccgttgaggaaggcggtcttgacatccatgtggtgcacacgccatccttcctgggccgccagcgcgaggaggagacgaacagactccattcgcgcaacgggcgcgaaggcgtcgtcaaagtcgactccctcctgctgaacgaagccgcgcgccaccagacgcgccttgcgcttgatcactgccccggcctcatccttcttgagcttgtagacccacttaagggtgatggcgcggtggccggcaggaagatctgcagcacccacgtccggttccgctcgaccgcgttcatctcgtgctgcattgcagtgcgccatgccacatctccattcgcctctgcgaaggagcagggctcgccgtcctcatgcgctaggtgcagctcggcctcgaagtcgcgcgtcaccagtccaaggacaggctgatcactgaagatgctgtccacggtgcggtagcgcagaggctcgtcgtcgtggtacgcatcaacacgatcctcgtcgttggacaacggagtggcgaactccaccggtggtgtgggcgccggtgtaggagagcggggcgtagccggtgatggaggagtcgctggtggtgtaggtggtggaggacgcgccggagctgatggcgagccgggtgccgaggtggatgagctcggtgaagatgagctgctagctcctctggctcccccaaagtggacgtagtcgacgacgaagtctctgag

SEQ ID NO: 59490 - DNA, 733 bp, Oryza sativa
cccatcggaattcatggcctctcgattgactgcacttcatcaaacaaagtcacaaaatggttaaacgaaaacctccaaaaaaatgttaggaatcagcaaggtaaatataacaaacacacaggcactgtggtccagtaacctgggtttaaaagttttaaacagcaaaacggttaaaacaacaacaacaaaaatggtaaatggtaaggaatcagcgaaggtaaacacacacaaacacacggctgatgcgaaacgaacgacgcggcgacggtctgcagtagttcttctgtacatacggatgaaagcaccggagcaagcaaatgctgtaatctccgatcacagattctgctggaggtaggcgtcctcctcctcctccgccgctgccttgtcctggccggcgccgtacctcgtgacgtcggacacccagctgcccagcgacgagacgctgcgcaccagccactccttgggcgtcgacaccctggggctctcggcgacggcgctgccccggcgctcctcctcggcgcgggcgtcgcgccaccgcctggccatgtactccttgacggcgccgacgccgccggccaccacctccttggggggcacggcgagcgggttctggtcgaggcggagccgctcgaggcgctggaggcggccgaagcagtccgggagcgcgtgtatctggttgttgctgaggtcgagctcgcgcaggccgagcaggtccccgaacgacgccgggagg

SEQ ID NO: 59491 - DNA, 725 bp, Oryza sativa
cacaaagaatgtttaatgtaatattaaaataaaaaaaacattagttttttggcaaacagctgtgtgaaattcaaattattattagaagttgatacaagatgacatatgagtacccactgaagaaattgattatgcacaggaatggaccatgcccccaacacccaaggacacacacacaaaaagaagtcctgcaactgtctgacctcatggtgtatatgaactaatgaatagttattattccggattgcagaaatccaccatgtaaatgcccatgaagcaaccaggtttccaaatagcaatcttaccaggtttaagatcacgatgaatgatcgcgtgcgcatgcaaacattccatggctcgagcaatatccaacgcaaatccaacagctacacgaggctccaggctcctaggccgaaggccaaccaagtacttgcgcaaagagccccccactagtagctcagttaccaccaccatgacaggctcaaggcaagccccgataaactgaacaacaagcgagtacattttcaacattcaaaagcatccacaactgccactccaagaaaagaaatgataagagtcaacaaaaagatcaagaccttgacaaggttcttgtgctgcacccttgacagcatagtcacctctctcaagaacctcccctccctcttgaccatctcctcaggggtgtcccccttgtgcacaatcttgatggcaacattttggttctt

SEQ ID NO: 59492 - DNA, 736 bp, Oryza sativa
cctgcacccctgttgttagcagttctcaaattatcccttttcacatatttcaggtgaagtatggtgaaactcttaagaggtgcggtgggtatgtgcaaggaccacaattcagcctgaacttatccgctctccggtccaagattgcatctgcttttaagtttggttcggatgtcgacttcattctgacttacactgatgaggatggggatattgtcatgctggagatgatgatgatctgcatgatgctgctattcatcagaaactgaaccccctcaggattaatgttcagttaaacaacagccacactgcagcacctcaggccaaacagcaggattcagataatatacctctcaggtccaccaccactgaagacccactagctcatattaaatcagttatcgatgaggttttgaagccgatatctatgaagtccatccaggagccagttcctgagacacttgcgaagctgtcccatgaagtacttgaagccgcatcaccacaattagctgagctaataaaaccttttgttaaactggttacaccaagcaacaacaacccatctaatgggcatgctgatggttcctgcagctcctcaactggtttgccccaaacacaggttgatcccaaaactaatgacgagcccaaaatagacacaagtttggggtcgcaacccttggacacgcagaactccaaatcatctggtgctagaggtcttaagactctgtcagttgaggct

SEQ ID NO: 59493 - DNA, 3006 bp, Oryza sativa
agctgaggaagaatttgcaaattaataaaaccgggtggacgaattttccatctccaggggaaatgactatcatctcctaccagataaattcctaattcaccttttggggcttccactcttgcataaagctcttgttttgacaattcaaaattgggtgaaggttttttaccaagaaatcgatattcaaaatcattccattcggaattctttgctttcttaaagcgtcggacttctaaattctcataagggcccccaggaattttttctacagcctgttgaataattttgattgattccctcatttcaccgattcgtactaaatagcgtgctaatgaatccccttctttttgccattggactttccaatcgaattgattgtaagactcgtaaagatcaactttacgaagatcccattgtattccagaagctcgtaacatggggcccgataagccccaatttacagcttcttctccgctaataaaaccaactccctcaactcgttccaaaaaaatgggattctgtgtaataagttgttgatattcaataactcctcgtaaaaaataatcacagaaatctaaacatttatcgatccatccataaggcagatcggcagcaactcctccgatgcgaaagtaattatgcatcattcgcatacctgtagcagcttcaaatagatcatatattaattctctctctctaaaaatataaaaataaggagtctgcgcaccgagatctgccataaaaggtccaagccataacaagtgagaagctatacggctcaattctaacataattaccctaatatagctggctcttggggtatttgaatattctccaagaattctggtgcatttaccgttattgcttctgtaaacatagtagctaaataatcccaacgtgttacataaggtaagtattgtataatagttcggttttccgcgattttttccattcctctgtgtaaatagcctaaagaacgaataaaaccccttgtcgaagccctttatgataagcttccctggatctgggaagtttctctttcacggtattgggatcgtttgatcgatttccttgatcgctacttatgggcgtgcgctcaaaggatacaaacagggattcgcaaagaaaaaggggaattcgtagtcactttttcctgtcgcgtaaaaaaaaggctttacgcgagagcaatagaggttgggatacatctatctcttctgagcaacctcttttggattcttaagaccacccttgcagtaggataccgtctgctttgggttctttattatattatctccttcgagggatttttaggatcgttcaggctatatttagtctattttggcttttactgtctccttttctcagggaagtggttaaggacctcagaagatagaggagagcgccaggcgcagatttccggaatacttctacggggaatgctcattgaatgcgcattctccgtattatgccttgaagaggactcgaacctccacgctctttagcacgagattttgagtctcgcgtgtctaccatttcaccatcaaggcatcttgaaagtgaatcatattccatgaatatgatatctatctaatgtgatatcttgaaagtgaatcgtattccatgaatatgatatctatctaatgtgatatatggaatatatgacaaaggtggagtcttggagtatttcgatcgatcggtcatataggcctgagtcagacatcaaatagcttcgatttgcattatccgtagcacaccttatatgtatcaaaatcaaaaagatgtacaatccaatttctcgattcaatagaagcccaaagaggtgcatatggtacccaaataaggataggatagatatgtcaaaagcaggtctgattacacctattcctaatcctaaatagaatgtaaggacgtggggatttctatgtaaacagagtatcctatttccataggctcgaaagaccccttctcataataagaatgtgcacggtctggtccggtatggaatgaacttataatctgatgatcgagtcgattccatgattataagttcattaccctagcgcccattcccattttgggcggaacagatctactaattcttttattccagttagtaagagggatcttgaactaagaaatagacctagcagctaaaagagggtatcctgagcaattgcaagaatggggttcattgatattcctggtatagtagatgctatcacacatacagtcatactcaattcgatggaattgtttgatcttaaaggggatcttctataatttcgcacataaggggttatttcttggtttcgtccagtcattaataacttgactatttttagataatagtagatagaaagaacgctcgtaaggagtcctattgaaaccaagaaatataggcctgcttgccatccacaccagaatagatagagttttccgaagaaacctgctagtggaggaaggcctcctagggataagagacatagggctaaagagagagccaaaaaaggatctttcgtgtataatcatgcataatctcgaatgttatcagttccggtacgtagaccaaataatacaatgcaagcaaaagttcctagattcatggagatatagaaaagcatataagttatcatgcttgcatatccatcatttgagtctccaacaattattccaataattacatatccgatttgccctatggacgaatatgcaagcatacgtttcatgcttgtttgagtaatagcaaggagattccccaatatcatgctaagaatagctaggatttccagaagaagatgccattcgtttgatgagaaataaaaaggaatatcgagaattcgcgtggctgaagctgaagcagcaactttcgaagtaacagaaagaaaagcagcgactggagtgggggagtcagagtcgaaaagaggattcctcgcttctttctctcatgcaaaaccgtgcatgagactttcatctcgcacggctcctaagtgataaattctcgcgtct

SEQ ID NO: 59494 - DNA, 2982 bp, Oryza sativa
catatcatagaaaaatgaaatcgaaaatattcggagatggcaaatattcggagatgactatgaaaacacctctctggatcctcgaattgaaagagagattgagagggattatcataagagattcccaccatatcaaaagattcgcgttcttgaaaatcggaacttctccaaatccagaagacagatgggattctaggattatccttttgggcaaagacttttatgcatacttcttctgggttatctataccatactgtattctcgtaagatgatacacgctagctaaagatccaccgggtgcaacgtcataaggacattgggaacgtaaataattgtaaccatatacatataaaatgacagcaatggaatcccaatcctctgcttttatttgcaaagtctctattcctcgatgatcgaagcccaaagatctatgaaccacctcatgtttgactagccaattagataaccaaccctgctgcattatcttgatctctcctcctttgtataaatatttcgcagttcgaatgcaagtttgaaatattgccctgctctttctttttcggcacaaagagctcctcctaattcactaatttgtaggaagatactggacttttggatttgaaaaaagtttcagaagatatgtctaaagtagatggtgattgatagagcaattcttgctcataagttccagtattagtactgcgccgaacataaagcttgtggttggtagtaaaacatcgatttttcttttgagatagagttcgatcctcaactatttctcgcgatatcttcttacgaagttttgttagggcatctataacagcctctggtttaggtgggcaacccggcaagtagacgtccacaggaattaacttatcaactccccgaacagtactataggaatccgtactgaacattccaccagtaatagtacaagctcccatagcaaaaaaggagaagtcattccaatcctcaattctcctttcgagattcggcgatagtgaatcaattgaacgcgcttcgaagatttgttctacttttggaagaccttgcgttatgtcactagatctcgctttttcgtatataaacgtaactaacctatcccctttgtaaaggatttctccataatgaccatgaacagttgctcctgtagtggccaaataaggcttagctgctcttataacaaaggaatctatatttacaatgaaaatttgacctgatttttttatgtgcgatttaaatagacatacattttcgcaaataaattgtccaaggtgaatttttgctgatgtctcttcccaagaatcatgagggagaaagtgccaatttaactggaatggatccaacatgatgttactatcgaaatttgaagtcctttgattttcatttattaaagagtgtttaagtccttgaagtactttgaagttttgtttcaaattgtcaaggagcaaatgcttttttaacaggatctgattatacgttagtaaatagtaagatgaagaaaaattcgatatactaggtgcaatagtacctaagagtcccgaaaaatttcgaaagagcccccaaaattttggaataggaattctaggattcgattcttttaccccattgggattttttgaattcttaaaaaaaccaattcgagaacagttggatgccgacaaaaccatcaaagattggtattctttatttcgattcaacaaggtaccaatagcttcttgatgttggctaagtgattgaatcttcgccttggaataaaaggaattggtattggtgcgatctaacctattatggagaatcagtcctgcacttctgctatcatacctttttcgtgtatacgaaatagtggatttgattaacccaattcttaggaaatcgcgaatcagaccatttgctcttatctcaacaagggaagcacgagcctcctctttttcttcttgttcccaattcaatactaagcaagttcgaacgaattgactattcgtatgataaattctttgagttaacttgctattttcatgagaaataaaattgacaagtcgaagttggagattaccctcttcctgcaagagatcctgtgggaaaagtgttgctaaatttctcccttcgttcatttcatacgcgactgcaggtcgaaccaaaacaaaatacttttccttgctcttgagaatttttttccactgaacatagacccaattttcccttttttttgattccttcgaatcttttttttctctttctagtggtatcaaactgccacctaatatcttatccgcctcttcaggaaaatgaatatctccagaaaagatttttagttccgtatggcttttttttctcttcactcgaaccaatccacccagccgacttcttgtattttttgtgagttgtgtatccactccaataatactattgtcaagtacctttagggatgaggatctcggcaagatatgcagttcttggagaatgaaaaaaaactgatctacttctttttggtattttagactaaattcttttgttcctcgatgctcaatcaaaacccccttttttaagacggaatcttcctccgggttcccatattcgtcctctgagtcttcctctgagtcttcctctaaagtcccatgttcgtcctctgagtcttcctctaaagtgccatatttatcctctcggggcctatatttgttctctggactcccatattcgtcctcggattcctcctctcgagtcctatattcgtcctctaggattccatattcatcttctagggtttcatattcgttctctgggatcccatattcatcttctagggtttcatactcctcctctcgagtcctatattcgtcttctagggttttacattcttcctctcgggtcctatattcgttttctgggctcccgtattcgttctctgagtctttctctcgagtcctatattcgtcctctagggtcctatatctaaatttaacaattcctgaacccttttt

SEQ ID NO: 59495 - DNA, 1240 bp, Oryza sativa
tcaatcctcttcttctccttagcattagggaaagacaagaaaatttcagggtaggaaacattatctagatcaacaaattctactccgcatttttggcaaaatctttcgtcttcgttttcaggtccgctcgctcgagaatttccacaagcacaaattctgctttttatgggtccaaagattctttcgcaaaacaatccatctttttctggtttatcggttttataatgaaaagtggagggccttgtgacttcgccaacaacttccccattaggtagtgttttgttagcccaagcctttatttgttgtggggaaacgagtccaatttgaagttgttgatgtttatattgttactacgaaggcgaaggcgatttcagaatcaaaaaaagtaaagtcaaaatcatttagcttattctctcaatttcaatcgaccgctgttagtatatctaatatgaattggcgatcagaacacatatggatagaacttctaaaaggttctcgaaaaagaggtaattttttctgggcctgtattctttttctaggttcactaggattcttagcggttggggcttccagttatcttggtaagaatattatatctgtacttccatctcaacaaattcctttttttccacagggggtcgtgatgtctttctacggaatcgcaggcctattcattagcgcttacttgtggtgcactattttgtggaatgtaggcagtggttatgaccgattcgatagaaaagagggagtagtgtgcatttttcgttggggattccctggaataaaacgtcgcgtcttccttcgattccttatgcgggatatccaatcaattagaattcaggttaaagaaggtctttttcctcgtcgtatcctttatatggaaatctggggccagggggccattcccttgactcgtactgatgagaagttttttactccacgagaaattgaacaaaaagctgccgaattggcttatttcttgcgcataccaatggaagtattttgagtaccaattgaattttttgaaatgaattgaatgaagaagaattggaagaagaaaagttttctcaacacgagggaaaaggtcccttcgaaattgcattattgtaaggggattttgagtatttatctaaaggaaggaacaaatgaggataagagaaaattgcttctaatttgtccaagtgggatatatggcgtaatattcttccattttcatccgaaaggacttttttctatttcg

SEQ ID NO: 59496 - DNA, 1241 bp, Oryza sativa
cttgataaaatgtggaggaaagtaggggaaatggccgatactactggaagaattcctctttggctgataggtactgtaaccggtattgctgtgattggtttaataggtgttttcttttacggttcatattctggattgggttcatctctatagtaattggagggaccaggttgtaaacatgaaaaaataggaacttagcgggtccttaccccttttatctgattagagcggaaaggacccgcggaattcttactcttataacccgacttttttaatctattccgtaacctacaaacgggtttcctattttgatttgtaaaaataacaaagagaaagcctttgctctgatggtcagaatccctctatttattcgttttgtttgttaattttgtttgttaataatgttagtgaagtaatccatcagttgatttataaccccctcgccaatgaaattaattcacttttatgaagcgaggagaaagaaaggatcaatcgaggatccaatattttattccccggaggaagtctcttgtaaatcattgatttaatttagagtaataaactaataaaaccttaattaaaactactctcaactagcctaaaaataaaaaacagccttcaatggaagagtatccttttttttgcaaaatttctgtaagttctaaattgaacttaattgaacaagtcaagcaattctatttggtcacaaaaaatttgtcccccgccatattttctttccctctttttgtccactacatcgcctgaacctaagcaaaagaggttcaagagacagacccaaataaagaagaaatagtaatctttgccgaataggaagaaaaaagattcatatttcgatacaagaagaatcgacacaagaaaatggcaaaaaagcctttttcttgtgcccaatagaggattaagaagaccagcaatccctcctaaaaggatttgttccttttattgttctcgcccttgccttgcattctcctcgttttgcatgagatgatagaaataaggaattgcagacaagacatctcgcaaacaaaaaatagtctaaacaaaaaaaagatttccaaaatggatcatagagaattctagcaatcgccaataaatcgcggctttttaccaacttgatggtaagaaatcccgggacctagaaattcatttcgtacaattgaaccttttcaaactgtttctttttgagaaccaaaaaaacttgtgccaaaataacggatgcgaag

SEQ ID NO: 59497 - DNA, 1530 bp, Oryza sativa
ccccccttttctttacgcagtatttttcttactacaactgttgacgttgcattatagaccgtattgttactcttgctaccatcaggatagatctgtccccttcctcggtttccccccacatatatgggatattttaagaaatgaacgtctttcttcatagcagggtcgggggaaagaatgggaaagacgatttcactatatttcttaccgggaacagggcctatcacaagaatattttttttattgggacgataactctgaaaagagagatttcctatcttttctttcaactcaggagaaatacggtcgggcggcgctaattcgaatccctcgggcaaaataagaacagcacccacattcaaccctccctttttcccattagcaagaacttgtttcagttgcatatcataaggaattcgaagaactgcttcaaatacagtatcgggaagcactgcttggggaacttcaatatccacaggcttattcgctaaatggcaattggcacatacaattcgtccagttgcttctcgtgggttttcataaccttgctgcgcaaaaatgggacatgcatttgaaatagatgtccgagttattacgtatatcatgatcgatacagaaatcgatcgagtcatctgttcctttacccaagaaaaagtatttctattttccatgtccaatcacagatcccggaatttctacaataaattagataggtagctaagctaatctagttccctatacacgaatctgttgtcattctactgcaacagttgtactggaatgatgaataccttgagcaggtagaaatagaaaaaaagaattttgctaaaatggaaaaaggctttctttctaaaggaaaaaggatgctaattttgattaatatcaggagatcaaatgagtttatgcttcactaattgaatgataaatgactacaagcgaaggagataggcggtttaaacaaaaaaagacccaaaatttcaaacatgtatctagaatcacaggaaaacaacaaacaaaaatagtgaaaattagctcgttaggaacccatccaagatcgttatagacccaacgaattagtagttcccaaccgcgggtggagtgaaatccaacaaaaaaatcagtaactaaaagaataaaaaaagcttttactgagtcatttaagttatagaagaattcctgaacccaagaattcaaaataacaagttcctctttacccagaaaaaaagaaccacttagaatagccaaacagattatatttgtcgagaaatgcaaaatgatatggagatgaccctcattatctattttggccaattgtattatttccttgcgtattcctataggggggttttgtacatgtgtattcggtttctcttttatcatttcgtccaagataaaaaggtcttctaattccatgaatctttctagaactcttttctcttgaatagcagttaagagagtttgggattgcctggtattccaccaattcttaatccaaagttccagacatttgttaaaagagaaagagactcc

SEQ ID NO: 59498 - DNA, 6646 bp, Oryza sativa
  unsure (1)..(6646): unsure at all n locations
ctctgaacctacgtgcctatgacttcctttcccaggaaatccgtgcagcggaagatcctgaatttgagactttctacaccaaaaatattcttttaaacgagggtattcgtgcgtggatggcagctcaggatcagcctcatgaaaatcttatattccctgaggaggttctaccacgtggaaacgctctttaatggaacttttgttttagctggtcgtgaccaagaaaccaccggttttgcttggtgggccgggaatgccagacttatcaatttgtcgggtaaactacttggagctcacgtagcccatgcaggattaatcgtattctgggccggagcaatgaacctatttgaagtggcccatttcgtaccagaaaaacccatgtatgaacaagggttgattttacttccgcacttagctactctaggttggggagtagggcccgggggagaagttctagatacttttccgtactttgtatctggagtacttcatctaatttcctccgcagtcttaggcttcggtggcatttatcacgcgcttctgggaccggagactcttgaagaatcttttccattctttggttatgtgtggaaagatagaaataaaatgactacaattttgggtattcacctaattttgttaggtataggtgcttttcttctagtactcaaagctctttattttggcggtatatatgatacctgggctcctgggggaggagatgtaagaaaaattaccaatttgacccttagccccggtgttatatttggttatttactaaaatccccttttgggggagagggttggattgttagtgtggatgatttagaagatataattgggggacatgtatggttgggtttcatttgtgtatttggcggaatttggcatatcttaaccaaacccttcgcatgggctcgccgtgcatttgtatggtctggagaagcttacttgtcttatagtttaggcgctttatctgtctttggttttatcgcttgttgttttgtctggttcaataatacagcttatccgagtgagttttatggacctactgggccagaagcttctcaagctcaagcatttacttttctagttagagatcagcgtcttggagctaatgtgggatctgcccaaggacccacaggtttaggtaaatatctaatgcgttccccaacgggagaggttatttttggaggggaaactatgcatttttgggaccttcgtgctccatggttagaacctctaaggggccccaacggtttggacttgagtaggttgaaaaaagacatacaaccttggcaagaacgacgttcggcagaatatatgacccatgctcctttaggctctttaaattctgtgggtggcgtagctaccgagatcaatgcagttaattatgtttctcctagaagttggttagcgacttcccattttgttctaggattcttcttttttgtgggccatttgtggcatgcaggaagagcccgggctgctgcagcaggatttgaaaagggaatcgatcgtgatttggagcctgttctttacatgacccctcttaactaagattttcttatttatacctgttctactgtttttttctgttctggctcggttattctatctagccgagccattcattcctttctatgaaagaaagataaggggacagaacaaaaaaaaacaaataaagaaacaaacgtattcaatacgcaaaagaaaagagagaggaaagcaaaaggagagagagggattcgaaccctcgatagttcctagaactatannnnnnnnnnnnnnnnnnnnnnnnnnnnnnnnnnnnntctctccacagcctaatccttattttattcctacaaatagaacatagccatacgaaatgactcactaacctctagaaacatctcaaatacaaatcccttttcgatatatttctgtatactgtatccatgtatacaggatccgctatatccgcttgtgaaataaagcataaaaccccctcaaccccatatccaaataaaaaaagtggtgagtaataagttttaaagagaagaatcaatggattcatgattaaacccctcctacttcttgtattttatacaattttgattaagtgagggatcaaatataatatgtagtcaactttatttgatggtaacttggaggattagaaatatgactattgctttccaattagctgtttttgcattaattgtgacttcctcagtcttagtcattagtgtaccccttgtatttgcttctcctgatggttggtcaaacaataaaaacgttgtattttccggtacatcattatggattggactggtctttctggtagctattctaaattctctcatttcttaaatgtgtttagtatttagtagcccgatacaaaataaaaaagggccgtttattcggattgtgagacgcattaaaatgcaatttgtgccccgaattgattgacagacaattaaattaataaaaagaaaactcaaatagaaaatgaaacggtcgacccagacatagacggtcgacccaggcggatataccctataaaatataggacgtagcgagcgtagttcaatggtaaaacatcaccttgccaaggagaagatacgggttcgattcccgccgctcgccagcttaatttagtaaggtactatgataaaaaatttagtctacttttattaaagtaataggtgttagtctagtaccatacccctttactatcttaaccccctttgcaccccactcaaaaaaagagcactacagcggcgggaatcgaactcggcaacagggttccctaaaccggggattcaccgaaacaaacaaccagcaaacagcttttaaagggaagggagatagactgtgcctttctttcatttattttttcttttctgcaaggtagggagggggccttgagagttcctcttgtggtagcaagttacttcgcaacctgctcaatttggccttatagggtcgggaactaatgaataaaaagggttggataccgcccaaccacccagccctctaccatatctagacaaatagaatagtccttttatacagactgctaagtgcggagacgggaatcgaacccgtgacctcaaggttatgagcctcgtgagctaccaaactgctctactccgctctggagcgctggaaaccggtggacgaaaaaggttgaatacaggcctctaccatgtctagacaaatagaatagttattttatacagaatggatcgggtagcgagaatcaaacctccatctttagcacggaacgctaggggttatagtcgacgttggttgattattattaacgtctctaattcaaaaccgaacatgaaattttgatttcattcggctcctttatgggtattctcaccacttaacatctaagtcagcttttttgtctgaatggaaccaaggctctctgctttctagatgatccctaaagagtaggagatagaaatttgcctaaatctatctaatctaattacttcgttccctaatttcatttaagagatcctgaggaaaagaattgggtttccaccgagctgaaacaatatgctgatggctctagtaaaccaaaactaccgttttttagctatttggcttccatttccttttttaacaaaagaagatttagttacgattggaaataaatttttttgtatcttcatccatagatcctttactcatatttaaaaaattggaatccttaatccaatgcaaaattatgcttcgcgactctgtactcataatcgaaatcctatttgttttttggatgcaatttcaattagttttgggtacaaatcgcgaaaatgcatattcttcctcactatgctattgagagaaaaaggagtaaatcctttctaagaactaaagttttcatcggaatataaaaaaccttaaggacgccttaagtatatcatttcaaattcagttattaatagaacgaatcacacttttaccactaaactatacccgctacatgtaaattctgataccaacgctaccctttgtcaagggtagccattcgagaaagatgctaattccctcttagttaatgaaacagagaaggttcctcacagttagcggttggtacttcgatcgcgggcctttcctttactttcttttttgttcagaattgaacaaagaatttggggaagaaaacatcttcccccacttatcatgaaatctgggccatagagaaagagtgagatgtttttttttatttatcatagactttccctatggcttgagagaaacaataaataacttaaagaaaaaggcacataggagccgaaggatttacttgatgtaaagaagattctgaatgtctctgcttagtcgattctctccgtttaactttttcttctcttcttttccactcaattctagtttatagattcttgtttaaaagaatcaaagaagatgaatagaactaagaacacacaaaaaagagcatataggcccgagaccattaccaaaagttcttcccaataatcatattgggtatctgttcccttccttttcctattaggatggggcatgttggattttccatatccagataccatcgaaccttaagggttccagaaccctccttttttgctagttttcggaaacggaaaaccctgaaccaggagcagtataaattctactgcccgccttttacaagaaaattggtgataaaactccactacagtttgttcaaaatgcaccaatcagaatcccttgagaatattcaagtaccctatttctaagatatttctaagagaagaggtacctgctgaaaatcgcttcaacaaatccgcttaagaaaaattgcaaagttttgaactcgaaggtttttccaagggatgcctgttaaaaattgtttcaacctctcaccaaaacagacaagaagtatatcactgaaaattaatacccagccatatgggtatatgaagggcgcgaattcgtttataccccacccaattagaggaaataaaacataaatggagaaagttttcatgataagatcagccaatagaagaaaaaagtccctaatttttcagaccgttctgagcatgtgaaaagtcaatagcctaaagataaaaagccctatactttgtgcaagtgataagagagaatatgaaagattttcctatttttcttgattttcttaagatttttttgaacctgaccatgaatagacttatatatctcgatatatacagatataatgtacattatggagtagacctataatgggaaatgaaagtggctaattttggaattgaataagaagcccttttaactcagtggtagagtaatgccatggtaaggcataagtcatcggttcaaatccgataaagggctttttttacttagtggtagagtaatgccgcggtaagacgtgagtcagtggttcaaatccgatacagtacttttctactaaattcattcactttctttctttttgaaaatttctctttttttattgaatttgataacttagtgcgagatgcatgcatttttagtttaaacactaagcgaagcaggggggtgtaaattccaaaaaagaaattggactctttttcctattagatcaatcaaatcactacccgtactgaactaatatagaatcccttttattaatctattcttattccatatcctttataaacgaatttccctaaaaagtaggggatgatccgtgaattaacctaaccatcaactaaaaaaaatcctacaaaagcataatggaaaagtaggaaggactccttgctttggatctagttatactcttcgagtatattgacaattccaaaaaactgctcatactatcattatagtataatgaggagcggttgtataccgccctatcgtctagtgatgcccctatcgtctagtggttcaggacatctctctttcaaggaggcagcggggattcgacttcccctgggggtagggagtattatgaaaggaggttaatcatagattatcaaaaaccctagaataaattcttcctgggtcgatgcccgagcggttaatggggacggactgtaaattcgttgacaatatgtctacgctagttcaaatccagctcggcccaaaaatctagggcttcgtgaatatgagttaaatccattttttttcttccataaaaaagaatatttgatcatagaaataaaagaaataaaggataaaaagaaaaggggaaatatctttctaatctatatctcttttattcctctcttacaaacaaaagaccttttcttattggttattgaaaggtggattattatctatttttagcgataataaatcgcgacatactagttatgtcattctcactatacccccatacgatacgggggtatgtagtatatgattggtctatttcttagagtaggacaggcgaatattcttattcttatggttccatttaagaataagtatgccatacgccccgcggggattgtagttcaattggtcagagcaccgccctgtcaaggcggaagctgcgggttcgagccccgtcagtcccgaactagggttcaatgaatggagaaattcatctttcctttttccatgaaaaaaggggggcaggaagcaagatcaaatacctatggggtacccttatttcactttttttagttcgcgt

SEQ ID NO: 59499 - DNA, 9134 bp, Oryza sativa
tccatgggattacatcccgagttattgcgaaaaaaaagaggttatggaagtcaatattctcgcatttattgctactgcattgttcattctagttcctactgcctttttacttattatttatgtaaaaacagtcagccaaaatgattaattggaagttcaattaatcattgaagaaatgaaaaagggattaaataaaataaaaatccaagtcttaaatgaaaggatccggttggaatcataaagtgtggtagaaaataggacatatagttttttctaccacactttagagtctttctattatattatcttgaatctacatagaatagaatatcttttttcactgcatccacttaatttcaatcaagtcaaaatgaaaaaatccatggagggagagaaaaataatatgagaatagactatagtaaaagaaaaaaagtaaaaggaaaaaaccagcgaatctttcatgcttaaacatgtcgcgaaatgtttcaaaagtgcataaaatttattttaagaactaagaataagaaaagaatataaaacaaatggaaaatgtgcgatatgttgggaatagctccgcggaagaaaatctaaagttcttatgtatagaacttttttaaccatgggtcgcttctagtagcgattatgaattgctctcaccgctctttctatttctattttctattctttctatttctatttctattctactatatagaaatagaaatagaaagaatagaaagactctttcttacaagagtttcttacaggagtgaaacaaaattaaagaaagagagaaagaataaagttcggcaaaatgattaatgcaaaacggtcaattaaagaaaagagttgatacaacaattcgactactcaatcaattagtagtatccctagagtccactcctcccccatactactagtgaaagagaaaatgtaaagactaccattaaagcagcccaagcgagacttactatatccatgtaaattatgtctcctatttctatgaaggaattattctactattgatgaataatcatagtagaatcaagggtacagagtcaaaaaggggttctgacctaaggctatggatgaatcagttcaaagaatttactcttaacaaattcttagagtatttctggtagaattggggagcattaagtataaatatgatacatagccctttcttattaataaaagaataaggaaacgctatctcatccctattggtatcggtttgggccactactgctaaaacaaaccccagtttgaggaaagaacggtgggttctcaaaatccagtatcgccgagccttgttattctcttgccccaacttatgcggggtgcaaatttgtcgatttggatcagtgctataagcctaagtattttattgatcaggcggcacccagatttgaactggggataaaggatttgcagtcccctgccttaccgcttggccatgccgccaaaaaatacgatctaaaatcgagaaaagagcaagtattcatccacgtttcttactaaaactaactttcttttatcttaaatctaattctacttacttttttccaatctttttcaaaaaatctattcatgctttttttgaatccagtttcgattattctcctcaaaggattctatcttaaaacacacattgctaacactagaaaacttcccttttctttctattgaaatgaaaaaggagaaaagtggatttctagtcacaagctacaaaattaagaacaaattggaaccattaactagaattctctttttattttgaatttcggtattctctcccgcctgccatttaatgtcataataaaagacaatggatttatgcctaatccgtatataggtaaactccaggtccgaacagcattattatctatggatcccccttatgtacatatctctgtggagaatcgttctttaatttttcattgcattaaatatcttgaataaaaaaaagaaaattgactttgctatgtggaggtccagaactagattggcatgtacttaaaaaagtacttactttattttaggattctacaacgaaatcttatatcttatattttatagaaattctactactacgaaacaaaaaagaaccttcaaattcttttttgaaattaaactaagcgtgctattctcaatcgaactaaagtcaaactttctagtgcttataaattattatattttggttttatcccattcatagaaaggagaaaaaatgagaaatctttgccgtccaatctaagaatatcataaactgtaagtggcagaatttttttcgaggttctaggaatgttttatcacttcattttcattccatttggacccctgggaaattcgaactttcgttgaaattgtctctattcatatgtatgaaatacatatatgaaatacgtatgtggagttcccgagaatttcatgtgatttagtaaacagaatatagattccataattgctagatcgatctgtagggattgatgaagagtgagctgataatggaatttttcttcgataaacaggaaacttaagattaagatgctccggaatggaaatgagggaatgtccacaatacccggatttagtcagatccaattcgagggattttgtaggttcattaatcaaggcttggcagaagaacttgagaagtttccaacaattaaagatccagatcacgaaatttcatttcaattatttgcgaaaggatatcaattgctagaaccttcgataaaagaaagggatgctgtgtatgaatcactcacctattcttccgaattatacgtatccgcgcgattaatttttggtttcgatgtgcaaaagcaaaccatttctattggaaacattcctataatgaattccttaggaacctttataataaatggaatataccgaattatgatcaatcaaatattgctaagtcctggtatttactaccgctcggaattagaccataaaggaatttctatctacaccgggactataatatcagattggggaggaagatcggaattagcaattgataaaaaagaaaggatatgggctcgcgtgagtagaaaacaaaagatatctattctagttctatcatcagctatgggttcaaatctaaaagaaattctagataatgtttcctaccctgaaattttcttgtctttccctaatgctaaggagaagaagaggattgagtaaaaagaaaaagctattttggagttttatcaacaatttgtttgtgtaggtggggacctggtattttcggaatccttatgtgaggaattacaaaagaaattttttcaacaaaaatgtgaattaggaaggattggtcgacgaaatatgaatcgaagactgaatcttgatatacctcagaacagcaccttcttgttaccgcgagatgtattggccgctacggatcatttgattggaatgaaatttgaaacgggtatacttgacgatgacgatatgaatcacttgaaaaataaacgtattcgttcggttgtggatctgttacaagatcaattcggactggctcttggtcgtttacaacatgcggttcaaaaaactatccgtagagtattcatacgtcaatcaaaaccgactccacaaactttggtaactccaacttcaacctcgattttattaataactacttacgagaccttctttggtacatatcccttatctcaagtttttgatcaaaccaatccattgacacaaacggttcatgggcgaaaagtgagttgtttgggtcctggaggattgacggggagaactgcaagttttcggagccgagatatccatccgagtcactatgggcgtatttgtccaattgacacgtccgaaggaatcaacgttggacttactggatctttagctatttatgcgagaattgatcattggtggggatccgtagagagtccattttatgaaatatctgagaaagcaaagaaaaaaaaagagagacaggtggtttatttatcaccaaatagagatgagtattatatgatagcagcaggaaattctttgtccttgaaccggggtattcaggaagaacaggttgttccagctagataccgtcaagaattcctgactattgcatgggaacagattcatgttagaagtatttttcctttccaatatttttctattgggggttctctcattccttttattgagcataatgatgcgaatcgagctttaatgagttctaatatgcagcgccaagcagttccgctttctcggtccgagaagtgcattgttggaactggattggaacgccaaacagctctagattcgagggtttctgttatagccgaacgcgagggaaagatcatttctactaatagtcacaagatccttttatcaagtagtgggaagactataagtattcctttagttacccatcggcgctctaacaaaaatacttgtatgcaccaaaaacctcgggttccgcggggtaaatccattaaaaaaggacaaattttagcggagggggctgctacggttggtggggaacttgctttaggaaaaaacgtattagtagcttatatgccatgggaaggttacaattttgaagacgcagtattaattagcgaacgtttggtatatgaggatatttatacttcttttcacatccgaaaatatgaaattcagacggatacaacaagccaaggctccgctgaaaaaatcactaaagaaataccacatctagaagaacatttactccgcaatttggacagaaatggagttgtgaagttggggtcctgggtagaaacaggcgatattttagtaggtaaattaacgcctcagatagcgagcgaatcgtcctatatcgcggaagctggattattacgggccatatttggtcttgaggtatccacttcaaaagaaacttctctcaaactaccgataggtggaagaggacgcgttatcgatgtgaaatggatccagagggatcccctcgacataatggtttgtgtatatattttacaaaaacgcgaaatcaaagttggggataaagtagccggaagacacgggaataaggggatcatttccaaaattttgcctaggcaagatatgccctatttgcaagatggaacgcctgttgatatggttttcaatcccttaggagtaccctcccgaatgaatgtgggacaaatatttgaaagctcgctcggattagcaggggatctgctaaagaaacattatagaatagcaccctttgatgagagatatgagcaagaggcttcaagaaaacttgtgttttcagaattatatgaagccagtaaacaaacaaaaaatccgtgggtatttgaacccgagtacccgggaaaaagcagaatatttgatggaagaacaggagaccccttcgaacagcctgttctaatagggaagtcctatatcttaaaattaattcatcaagttgatgagaaaatccacggacgctctattgggccctattcacttgttacacaacaacccgttagaggaagagccaagcaagggggacaacgaataggagaaatggaagtttgggctttagaaggatttggtgttgctcatattttacaagagatacttacttataaatctgatcatcttatagctcgccaagaaatacttaacgctacgatctggggaaaacgagtacctaatcacaaggatcctccagaatcttttcgagtgcttgttcgagaactacgatctttggctctagaactgaaccatttccttgtatctcagaagaacttccaggttaatagggaagaagtttgatcggaataaatataaattctttttttatttctattttatgattgaccaatataaacatcaacaacttcaaattggactcgtttcccctcaacaaataaaggcttgggctaacaaaacactacctaatggggaagtcgttggcgaagtcacaaggccctccacttttcattataaaaccgataaaccagaaaaagatggattgttttgcgaaagaatctttggacccataaaaagcagaatttgtgcttgtggaaattctcgagcgagcggagctgaaaacgaagacgaaagattttgccaaaaatgcggagtagaatttgttgattctcggatacgaagatatcaaatgggatacatcaaactcgcatgtcccgtgactcatgtgtggtatttaaaaggtcttcctagttatatcacgaatcttttagataaaccccttaagaaattggagggcctagtatatggcgatttctcttttgctaggcccagtgctaaaaaaccaactttcttacgattacgaggtttattcgaggatgaaatttcatcctgtaaccatagcatttccccctttttttctaccccaggctttacaacatttcgaaatcgggaaattgcgacaggagcaggtgctattagagaacaattagcagatttggatttgcgaattattttagagaattcctcggtcgaatggaaggaattagaagacgaggggtatagtggagatgaatgggaagatagaaaaagacgaataagaaaagtttttttgattagacgcatgcaattggcgaaacattttattcaaacaaatgtagaaccagaatggatggttttgtgcttattaccagttcttcctcccgaattaagacccattgtttataggtctggggataaagtagtgacttcggatattaatgaactttataagagagttatccgtcggaacaacaatcttgcctatctattaaaaagaagtgaattagcgccagcagatttagtaatgtgccaggaaaaattggtacaagaagccgtggatacacttcttgatagtgggtcccgcgggcaaccaacgagggatggtcacaataaagtatacaaatcactttcagatgtaattgaaggtaaagaggggaggtttcgcgaaactctgcttgggaaacgggtcgattactcggggcgttctgtcattgttgtgggtccttcactttcattacatcaatgtgggttacctctagagatagcaataaagctttttcagctatttgtaattcgcgatttaatcacgaaacgtgctacttctaatgttaggattgctaaaaggaaaatttgggaaaaggaacccattgtatgggaaatacttcaagaagttatgaggggacatcctgtactgttgaatagagcacctaccctgcatagattaggcatacaggctttccaacccactttagtagaggggcgtactatttgtttacacccattagtgtgtaaaggtttcaatgcagactttgatggggatcaaatggctgttcatctacctttatccttggaagctcaggcggaagctcgtttacttatgttttctcatatgaatctcctatctcccgctattggggatcctatttgcgtaccaacccaagacatgcttatcggactttatgtattaacgattggaaaccgtcgaggtatttgtgcaaatagatataatagttgcggaaactatccaaaccaaaaagtaaattacaataataataatcctaagtatacgaaagataaagaatctcttttttctagttcctatgatgcactgggagcttatagacagaaacaaatctgtttagacagtcccttgtggctccgatggaaactagatcaacgcgtcattgggttaagagaagttccgattgaagttcaatatgaatctttggggacttatcgtgagatttatgcccactatctagtagtgggaaatagaaaaaaggaaatccgttctatatacattcgcaccactcttggtcatatttctttttatagagaaatagaggaagccatacaaggatttagtcaggcctattcatacactatctaaacaaggaagttagattcggggatgcccctttcgaggggcattccgatttcgctagaatcatcatttttgccgcacgaatccagattgagattgaggaaaggaagttaactaagttttcgaatcactgactcaggcccattgtcgaatcctactcagcaattgtcgaattatactcagccgaaaaagggggtacttatttatggcggaacgggccaatctggtctttcagaataaagagatagatggaactgctatgaaacgacttattagcagattaatagatcatttcggaatgggatatacatcccatatactggatcaaataaaaacgctgggcttccatcaagccactactacatcgatttcattaggaatcgaggatcttttaacaataccctctaagggatggttagtccaagatgcggaacaacagagttttcttttggaaaaacactattattatggggctgtacacgcggtagaaaaattacgccaatccgttgaaatctggtatgctacaagtgaatatttgaaacacgaaatgaattcgaattttcggataacagatccttctaatccagtctatctaatgtctttttcaggagctagaggaaatgcatcgcaggtacaccaattagtaggtatgcgaggattaatggcggatcctcaaggacaaatgattgatttacctattcaaagcaatttacgcgagggactttctttgacagaatatataatttcctgctacggagcccgcaaaggggttgtagatactgctgtacgaacggcggatgctggatatcttacacgtagacttgttgaagtagttcaacatattattgtgcgtagaagtgataagtacttgggcatgaatttggaaacctcctatttgccaatagaagtgttggcctacttctacgcccgatatatcgtataaccccttgagtgttttaatggaacacggtataatattcatattgtcccctgataaaaaatgaacttcaaaaaaagaattcttttgattcaaccatctttttctcaactcagcaacgtgaagtattaatcttatatttaggatatcaagaaatcacatcagatgataatatatatcaataccctctaatatatatcaatattccccgtcctttttctatgcaaaacaaaaaagaatagtaagtgattccataaatctacgcagttgcccaagaattaactattcttcttaatcaatgatttcttatatagagagaacggccctcacaaattgcaaat

SEQ ID NO: 59500 - DNA, 706 bp, Oryza sativa
agaaagagccgaaatagcttgaaataaataataattgttccgatggaaccttctacatggtataagcataaccttaatgaattaactaaacttctttttaaattaaaataaaaatagaaaatctaacctcttagcgttctaaggtaaaaaatctagtttaaagtaaaaaatctgctttatgtatccttaaatcatataaatggggtaaatggtgattctgatgtctcatagaaattgtttgttacgtcagaatcagaagaaactaattctgtatggagaaacaaaatatctctcatttccgacgcaaatagttttttttttgaatttcgaaataaaggttcttgtcttgtgggtaacggtgcacaaatttttggaatccggtaccaacaggtataatcccccccagaactacgttttctttcaggcctttcaaccaatcaatacgacctcgtaaggcagcttttgctaaaactcgatcagtttcttgaaaacttgcttcagatatgaaactttgggtattcagggaaacccttgttattcccaataagattgcccgataatagatcgattcatccaaagcccgccctgctcgctctgctcgcaatagtccaattaatccccaggtgaaaaaacattagacattccatcttcggaaacccgcacttttgatgttacttggcgtataataatctctatatgtctatta

SEQ ID NO: 59501 - DNA, 1609 bp, Oryza sativa
ttcagggagagctaatgcttatgcttattgggtattttggtttgacactgcttcacgcccaaaaagaaggcagctacgtctgagctaaacttggatatggaagtcttctttcgtttagggtgaagtaagaccaagctcatgagcttattatcctaggtcggaacaaattagttgatagtgataggatcccctttttgacgtccccatgccccccctgtgtggtgtggcggcatggggatgtcaaaaggaaagggatggagtttttctcgcttttggcgtagcaggcctcccaaagggaggcccgcgcgacgggctattagctcagtggtagagcgcgcccctgataattgcgtcgttgtgcctgggctgtgagggctctcagccaaatggatagttcaatgtgctcatcagcgcctgacccgaagatgtggatcatccaaggcacattagcatggcgtactcctcctgtttgaatcggagtttgaaaccaaacaaacttctcctcaggaggatagatggggcgattcaggtgagatcccatgtagatctaactttctattcactcgtgggatccgggcggtccgggggggggggcactacggctcctctcttctcgagaatccatacatcccttatcagtgtatggagagctatctctcgagcacaggttgaggttcgtcctcaatgggaaaatggagcacctaacaacgcatcttcacagaccaagaactacgagatcaccctttcattctggggtgacggagggatcgtaccattcgagcctttttttcatgtttttcccggcggtctggagaaagcagcaatcaataggacttccctaatcctcccttcctgaaaggaagaacgtgaaattctttttcctttccgcagggaccaggaggttggatctagccataagaggaatgcttggtataaataagccacttcttggtcttcgactccctaagtcactacgagcgccctcgatcagtgcaatgggatgtggctatttatctatctcttgactcgaaatgggagcagagcaggtttgaaaaaggatcttagagtgtctagggttgggccaggagggtctcttaacgccttcctttttctgcccatcggagttatttcccaaggacttgccatggtaagggggagaaggggaagaagcacacttgaagagcgcagtacaacggagagttgtatgctgcgttcgggaaggatgaatcgctcccgaaaaggagtctattgattctctctcaattggttggatcgtagtggcgatgatttacttcacgggcgaggtctctggttcaagtccaggatggcccagctgcgccagggaaaagaatagaagaagcatctgactctttcatgcatactccacttggctcggggggatatagttcagatggtagagttccgctcttgcaattgggtcgttgcgattacgggttggctgtctaattgtctaggcggtaatggtagtatcttgtacctgaaccggtggctcactttttctaagtaatggggaagaggactgaaacatgccactgaaagactctactgagacaaaaagatgggctgtcaaaaaggtagaggaggtagg

SEQ ID NO: 59502 - DNA, 19786 bp, Oryza sativa
ccttccaaggataacttgtatccatgcgctttagattattagcctggagttcgccaccagcagtatagccaaccctaccctatcacgtcaatcccacaagcctcttatccattcccgttcgatcgtggcggggggagtaagtcaaaatagaaaaaactcacattgggtttagggataatcaggctcgaactgatgacttccaccacgtcaaggtgacactctaccgctgagttatatcccttccccgtcccctcgagaaagagaattaacgaatcctaaggcaaaggggcgagaaactcaaggccacccttcctccgggctttctttccacactattatggatagtcaaataatggaaaaaattggattcaattgtcaaccggtcctatcgaaaataggattgactatggattcgagccatagcacatggtttcataaaatctgtacgattttcccgatctaaatcgagcaggtttccatgaagaagatcttgttcagcatgttctattcgatactggtaggagaagaacccgactcggtattcttaaaaaaagaggggaagcagaaccaagtcaagatgatatgggtcgccccttcttcttgcgccaaagatcttaccatttccgaaggaactggggctacatttcttttcaatttccattcaagagtttctatctgtttccacgcccttttttgagacctcgaaacatgaaatggacaaattccttctcttaggaacacatacaagaaaaaggataatggtagccctcccattaactacttcattttcatttatgaatttcatagtaatagaaatccatgtcctaccgagacagaatttcaaacttgctatcctcttgcctaataggcaaagattgacctctgtagaaagactgattcattcggatcgatatgaggacccaactacgttgcattgccagatccatgttccatatttgaagagggttgacctctgtgcttctctcatggtacaatcctcttcctgctgagccccctttctcctcggtccacagagaaaaaatggaggactggtgccgacagttcatcacggaagaaagaactcacagagccgggttcgctaactaatagaatagtactactaactaatactaatatatagaaatagatatctagaaatagaaacaaactaatatatagataatcgaaattgaaaagaactgtcttttctatatactttccccgttctattgctaccgcgggtcttatgcaatcgatcggatcatatagatatcccttcaacacaacataggtcatcgaaaggatctcggacgactcaccaaagcacgaaagccagttagaaaatggattcctatttgaagagtgcctaaccgcatggataagctcacattaacccgtcaattttggatccaattcgggatttttcttgggaagtttcgggaagaaattggaatggaataatatagattcatacagaggaaaaggttctctattgatgcaaacgctgtacctagaggatagggatagaggaagagggaaaaatcgaaatgaaataaataaagaataaagcaaaaaaaaataagtcgaagatagaagagcccagattccaaatgaagaaatggaaactcgaaaaggatccttctgattctcaaagaatgaggggcaaggggattgataccgagaaagatttcttcttattataagacgtgatttgatccgcatatgtttggtaaaagaacaatcttctcctttaatcataaatggaaagtgttcaattagaacatgaaaacgtgactcaattggtcttagttagtcttcgggatggagtggaagaagggcggagactctcgaacgaggaaaaggatcccttcgaaagaattgaacgaggagccgtatgaggtgaaaatctcatgtacggttctgtagagggacaggaagggtgacttatctgtcgacttttccactatcaaccccaaaaaacccaactctgccttacgtaaagttgccagagtacgattaacttctggatttcaaatcactacttatatacctggtattggccataatttacaagaacattctgtagtattagtaagaggaggaagggttaaggatttacccggtgtgagatatcgcattattcgaggagccctagatgctgtcgcagtaaagaatcgtcaacaagggcgttctagtgcgttgtagattcttatccaagacttgtatcatttgatgatgccatgtgaattgctagaaacatgtgaagtgtatggctaacccaataacgaaagtttcgtaaggggactggagcaggctaccatgagacaaaagatcttctttctaaagagattcgattcggaactcttatatgtccaaggtcaatatggaaattctttcaggggttttcccttactttgtccgtgtcaacaaacaattcgaaatacctcgactttttcagaacaggtccgagtcaaatagcaatgattcgaagcacttctttttccattacactatttcggaaacctaaggacttgatggtatggatatggaaaatacaggatttccgatcctagcgggaaaaggagggaaacggatactcaattttaagtgagtaaactgaattccatactcgatctcatagatccctatagaattctgtggaaagccgtattcgatgaaagttgtatgtacggcttggagggagatctttcctatctttcgagatccaccctacaatatggggtcaaaaagccaaaaaaataagtgattcgtttttagcccttataaaaagaaaacggattcttgaacctctttcacgctcatgtcacgtcgaggtactgcagaaaaaagaactgcaaaatctgatccaatttttcgtaatcgattagttaacatggtggttaaccgtattatgaaagacggaaaaaaatcattggcttatcaaattctctatcgagccgtgaaaaagattcaacaaaagacagaaacaaatccactattggttttacgtcaagcaatacgtagagtaactcccaatataggagtaaaaacaagacgtaataaaaaaggatcgacgcggaaagttccgattgaaataggatctaaacaaggaagagcacttgccattcgttggttattagaagcatcccaaaagcgtccgggtcgaaatatggctttcaaattaagttccgaattagtagatgctgccaatgggggtgggggtgccatacgcaaaaaggaagcgactcacagaatggcagaggcaaatagagctcttgcacattttcgttaatccatgaacagaatctaggtatgtagacacatggatccatacatctcgatcggaaaagaatcaatagaaggagaatcggacgatatctttctcgaaacaaacaaaaaggaaaagaaagagaaaacagaaatcatgatcaactaagccctctcgggggcttgcttaagaataagaaagaggaatcttatggaaatagcatggaataaggtttgatcctattcatggggattccgtaaatatcccattccaaaaatcgaaacaatcgggacttttcggagattggatgcagttactaattcatgatctggcatgtacagaatgaaaacttcattctcgattctacgagaatttttatgaaagcgtttcatttgcttctcttccagggaagtttcattttcccagaatgtatcctaatttttggcctaattcttcttctgatgatcgatttaacctctgatcaaaaagatagaccttggttttatttcatctcttcaacaagtttagtaataagcataacggccctattgttccgatggagagaagaacctataattagcttttcgggaaatttccaaacgaacaatttcaacgaaatctttcaatttcttattttattatgttcaactttatgtattcctctatccgtagagtacattgaatgtacagaaatggctataacagagtttctgttattcgtattaacagctactctagggggaatgtttttatgtggtgctaacgatttaataactatctttgtagctccagaatgtttcagtttatgttcctacctattgtctggatataccaagagagatctacggtctaatgaggctactatgaaatatttactcatgggtggggcaagctcttctattctggttcatggtttctcttggctatatggttcatctgggggggagatcgagcttcaagaaattgtgaacggtcttatcaatacacaaatgtataactccccaggaatttcaattgcgcttatatccatcactgtaggacttgggttcaagctttccccagccccttttcatcaatggactcctgacgtctacgaaggagtgtggttcgttcgacaaattcctacctctatatctatctctgaggtgtttgggttttgcaaaactccatagatatgcagaagagaaatgctatccccactccgaccaagacagaacttttaccaaaagtttattgtgatctttttgttcaaataacaattaaggtgaagcagggtcaggaacaacgaatctctttatgataaacagatccattttgcaagctcgttattacgggtagttcctattacgatggatggaagaaagaatggataatccaatagctgcttcagcagccgcaagggctataacaaaaattgcgaaaatgcctccttttaattggcggctatcaaatagatcagaaaatgttacgagatttagattaattgaattcagtataagttcaaggcatattagagctctaaccatgtttcggcttgtgatcaatccatagataccaatcgaaaataaatagacactcaaaaaaagtacatgctcaaacatcattaactaactccttatcaatctcgattcatttcaatatggggacaagaattgaaccgattgaattaattagaatagaacaattacacaacaaaagagaaaagaaggtatttgttggcagtagatgggttttactaaatcaaaattgtggttctttagtgatttattttagatttgaaattcttagaattttgactcattctaagtatttcttattgccgagccatagtaattgcacctattaaagaaactagaagaattatggaaatgagttcaaatggaagataaaaatcggttgctaaatgaatcccaatttgttgaacgttatttatgagaccctgttctactatttggtttgatcttgtagtccaaagaattccataccatgacgtatctgggatagtagtcattagtgaaaaaggaatagttatacaaacgagtgaagtgaacccatctccaatagtccaaaaattcttatctttagaccattctgagccatttacgaacattacggcaaatatgatcaagacatttatagctcccacataaataagaagttgtgccacagctacaaagtaggaattcaataaaatatagaataaggatatacaaacaagaactaatcctagcgaaaaagcagaaaaagttgggttggtaagtaataccacccctagaccccctagtagaagaacaaatcccccaaatagcacaagaatttcatgtattggcccaggtaaatccattatggataagaagaaattaatagtataaattttttcatgaactaactaaaactaaaagattcaaggaagaaaaaagggattaggaaatttttttgtatattgtatataagttctttctatagttagaaatcacatcacgaaaatctactctggtttaaaatcaggaataatttgcaataagcagtaggtattcgtttttctttctagttagtaaagaacttttggattctaacaaaaaaattctagtaatcagtaattgttcttgaattccaagatttttcttcgtctattttactttgagttgaattcctaattgtttgaattgtgtaatctcccattatggagattggtaaccgactcataaaggcaattttatatcatatttgtttggtgtaccccggcttttcctgggacggggattaatacactagcgttcgggaaaaggcaattttctcggtcgcgacaccaacgggccgccatgccaaggaaggtttcgctaagtggttgggccgagccatttagcccaataagggcccatacatgtaaaggacatagtgtgccatcaataatgtccctatcataagggtaaccatataaattcccctgtaaaacctaaaccctaaacgggggaacctataatagggctataaatagccctctagtgtcttgtaatacggggatccaaaacaattttcactaagcaatacaattgtttttcacttccaaccactgttgagagaaccacgcctttcggcgtgacacagttgtctattcgacaacagctggcgctgaccgtggggacctccgagcgaaaccactgatgtcaccgaagaagatcgtcaaggagagagttgtcaagcggatggaagatggaagcgaaggggagatggtagccgaagagggagcagagccttcggcctccgagccttcagcctcgcaagagaacaaaagagaagaagagatactcttcgacattgtcaacatcccctacaactacaacgcaatcttcagcaggggcactttgaccaagttcgaagcagtctctcatcacaactacctcaagctcaagatgcctggcccagccggtgtgatagctgtcaagggttcccagccttcggccgtcacaggacccctttcggcaaggaagtccacaccctagaggtcgaaggacaagaaaaaacaaagccaataccaaagcctgcccccacggcaaggttatccagtggcatatagatgaattcgaccccgccaaagtcatatcgcttggtggagacctgagcgaacaagaggttgtcagcatcctggttgtacttaagaagaacattgatatcttcgcttgggggccagacaatgtagggggtgtttcgccagatcttatcatgcaccatctcacagtcaagcttgaagcaaagccgacgaagcaaaagttgaggaaaatgtcggcagatcgccaagaggcggcgaaagcagaggtgaacaagctgctgaaagctggggtcatacaagagagtgaccacccagagtggttagcaaatccggtactggtgaagaagtcgaacggcaagtggcgaatgtgtgtcgacttcacggacctcaacaagatgtgcccgaaggatgatttcccattgccccggatcgatcagctggtcgattcgaccgccgatgcgaactcatgagcttcttggatgcatactccggatatcaccaaatttacatgaacccggcagacatccccaagacagccttcatcacgcccttcggcaccttctgccatctaagaatgccttttggtctgaggaatgcaggggctacattcgccaggctagtgtacaaagtcttggggtcgcagttggggcgaaatgtcgaagcctatgttgatgtcattgtcatgaaaagcagcaagggcttcgaccacacatcagatttgcaagagacattcaacaacctccgcgcagctggcatgaaactaaatctagagaaatgtgtgttcggtgttcgtgctggtaagttgttgggattccttgtgtccgaacgggggatcgaagcgatccccgagaaaatcgatgccattcagcaaatgaagccaccatcgagcgtacgacaagtacaaaagctcgcggggcgaattgtggcacttagtcgattcctgtcaaaagcggctgaaaggggcttaccttttttcaagacccttcgaggggcaggaaagttctgttggacgcccgagtgccaaatagctttcgatgagcttaagcggtatctccaaagccctccaactctagttagcccagtggcagggaacgaactctggctctatctaccggcttcgcccattgctgtcagcgcagctttggtacaagaaaccgaagcaggccagaagccagtgtactttgtctccgaagctctccaggaggcgaaggttagatacattgaaatggaaaaacttgattattccctcgtgatggcttcaagaaagctcaaacactatttccaagcccacaaaatcgtggtaccttcgcagtatcctttggacgaagtgggccgctaagctgtcacctttcgacctacactttgtcgcccgcaccacgatcaagtcccaagtcctcgctgacttcatgcccgaatggacactcgcgtccgtcccagagcccgaaccggtcaaacaaccatgggtcatgcactccgatggttcgtggtctcacaaggaggcgggcatcactgcaatcctgacttcgcctgggggcattccaattcgttacgcagtaagactagagttcggcacaaccaacaacacaatagaatatgaagcaatgttaatgggcctaaggaaagcgaaagctttggttgttcggcgttcgctagtccggacggactcaaagcttgtcgccagccaagttgacaaatcttttgacgcgaaagaagggatgagaaagtacctggaggccgttcggtctatggacaaaagtttcgccggcataatggtcgaacacttgccccgaggccagaacgagtaagctgacgcgttagcaaaatcagcagaccaaacatcatggtaattgaccaagctttttcgccaggagtccttttcgaagccttgtatacaccaagtgtgccagaagacagcccagacatcatggtaattgaccaagctgaactggcgaagacccagacgactggtgaacgtcttttgtcaagcacctcaaagagggatggctaccggatgaagaagcaacgtcgaggtagctgcagcttagagccgggaagcacaagttaatctctaggcaactgtaccgaaccagaatattgcagcccatgcttcgctgtgtctccttctccgaaggagaagagatggtaaaagaaatacaccaagggatgtgcggagcacaccaagtagcaagaaccgtcacatcagaagtatttcgccaggacatatattggccaaccatactaaaagtatgtgttcaacaggtcaaaaaatgcgaaagctgtcagcgacatggtcgaagccaaatagcaccacaatacgaactatagccaatcgcaccaatttggccattcgcaagatggggcttagacatcattggcccattcccggtggcgcgaaatggttacaagttcgccattgtagccatcgaatgtttctctcgctggattgaggccgaaccacttggcacaataactgcagcagccattcagaagtttgtttggaaaaatatcatggtactgaaggagttcattaccgacaacggcaagcagttcgactctgaaaaattcaaagaaatgtgcgaggagctaaatttgcaaatcaagttcgcctccgtcgcacatctgcaattgaagcatggggcgatgacgccggcagaactagggactaactcaccatgggtgatgttttctggtggcgaaatgggcgtgaagtgtcgctcgaactcgtgaaagtggtgagagtcgaagcactagaacacatgcgcaagtacgcggaaggcacttcggcaacctataacagaaaggttcgaccgacagagcttcggcccggccatctcgtactaacaaagaaggcgaaccctatggcagtcgggaagctggaatctaagtgggaaggaccatatctgataaagcagagatctcgaacaggttcttttcggctggcaacattggagggcgaagagttcgaccactcctagaacgtcgcttcacttagacgcttctatgtgtaatatgggtggcacccgattcgccaattgtaaatatgttcgtattatgtaagccgttcggcacaaaaagcaaaaaaaaaagaggaaaatgaaaaaagaaaaaaaagttgggcgtagggttattatccaccttggaggcccgaaacagtataaaatctttgtgtttttccgcttttctttttctgtgaatgatgtctttgtggaaaaatcccaaggcaaactcctgatcagctaacgcgccaggggggcgaaacgaatcggtcgaagcatagctcaccgaacgtcgaaaccgtcacagctcgaattttgaaaatgcaagtcaaaacgcggttgtactcagcttacgcacaggccacgatgcttggtagcacgcctgccacaagccgaaaacagaagagcagagatgagaaataaacatatctttttgccatagtacgcagaggggtcgacacgtttcgacctaacgaaagcacgacagtgactatgcgaacgatagaataaagatatgttcaagaattcacaaagtatcaagtaaacaaaattacaacaaatctgttgtatttacgtaagcgaacctcattagaaagattataccatcagttacacatccgccctcgtttacgttacaagccggcgaactaggttcgtcatcactaccaacattgtacacaacccttaaaaggaacgggggccaaacacaaactaaactgtaacggcgacgggcgatcgcctcttggcgaatcgacctcttaaagtttcgccaaaaatttgtgctatcttcgcggtacgccacatgataacggtcatagtcctctaaagttcgggctgggtgtgcgcacatccatcctgcaacctttataaccatgtagctattgccgtttattaacatctcgcggtaaacgggccgaaaaggacacttggtctttggcaagcccttcaccgccacgaacttctcgttcttatttcgccaatccccggagggaggccgaatgcacatttttcagctacaaccctgcaagcaaggcacaaaggaacagtgcacaagggagaaatgctagcaaaatcaatcccacattccagcaaaaacatacgattggcgaaacactaatttttaattaataaacttaaagccatgaaggctacaagatgataacggcacccagccaaacacgtaaagcacctatatatatgtacatgcgagcaaaccacggccattaaggtcttaaaaagcaaaaaacgcggggcgaagggcctcacacctcagggtggtcttggcttttgttgccttcgccctcacggccagcaggcgcccccgacggctcgggatcttcactagcatcggcggcagcggcgtcttcggccctcgctatcctctccagctggtcgcggagctgggtcttcgcgccatccttgccgccattctcccagaagctcttccgaaaggtcttcacggccgacgcggcagattggtcattttcgggccagcccttctttacgatctgaggaaaatcctcaacatggtcacaaccatgttcgtgaaggaggctaagcacgaagcctgcggcaactcgcgcacagcaatcgccgtacgtgccagccacttcgacaactgagtcggccgcatcttgcgtccactcagaaaaatcgaatgtcgtctcgtcgtcacccggagcgccctacgcatgcgcaccaaggtcgttgagagccagcctaagggtgtagcaggcttgcttggctgactccgtcgccggcggcgcccaagccttggtagcagcttcggctgagacaagctgtgtttcaagggatttaatcttttccaaagccgcagcgagctggcgctcccgttcggcggccctcttgttcgctccgtccaggtcgacgcggagagacttgttttcccccgtgagggacttgttctcgacgctagatttctttatggcgtccgccacgacccgacgctcatcctccttatggcgaagatcctcctcggccttccgaaggctgagatggtactcgtccagtcactccaaggtggaccgcttcgcactcaagtgcgctgcgagaccctaagttaaggaaaccaaagccctcttagcacaacaatagcaaaaaggacaaaaagctagataggcgaaagaaaaaaaaagagaagtcctcacccgcacgaacaagctttccgcggctgcgcagctttcaccaaactcgttgagctcagtgaaaagacggcgcaacaatctggcacagcccatcgatgaagggggaattctctggccatgtggcaaactccacagagacaaagtgcggggaggtaagtgtcatgtcagacactgtcaactcaaccgctgggccttcccttcccgatgagggctggccgaagggaccgtctcaaccctttcagcaccagaggtgtttgtcacgcctagaaatttagtccaaatttccagactattttgtgtattaaatccctgtccaagaccagccagggtacacaaaacgacaagtaataaacagttccaaacgtaaataaagcataaattacttacagaagaggcacttagtcctcacaccgaaataaaagcagcagcagcagaaaaggcgatccttgcggggcttcagctccactccacaggtaaaactcaccaggggtctgagccttggtattctaacctcgtcttcagctcagaagcactacacttctgaaaagggggaataatagcaaggctgattacaaccaccgtactcagcaagccacaccaacgatgcagacgtgcaaggggaacacaaggacggtttgtggctatttgcataaaggcggttgtaaagcattttattggacaaaacagtaaaacagttaagtaattaaagtaacattaaatctccactgatcaacgctacaccacgttgaacaggcccaaccaacccacctgaactacagtgcattgcgtcgatttattaagtgtgagactaatcacggtgaatctggtcgaccgcccataaccgcgggcacgactattcgaatagttttactctgatcagaggtgtacaactgtaaccacaagacacagccacatcacacgtttccatgcgccgacatgccaccacgacataccggaaagaggccgtgacaggacccttcgcataaccccctctagccaagcacaccacacctcaggtttgacccccgtccccagcgggcaacgggcagtcccctgtcatgcctaggtgaatccggaagcgatagaggccgtcgcagggcccgccccgctccatcatgcccacccttgcctggatgcgtcagctagaggaaagctacactacaggcccagtcgttgcccacgctggcttgtggtaagtacgagaaattcttccagggtgcgactagcaaaaccatgcacccacagcccactattcagtcgcattttagttgtataattacgaccactgaaacatggccaggtgtctcgagcacgcagctcgttctattgctaaaaaggtctaatactgcaatcatcccatcaactgagctagtggtaattaagcatggctaagcatatagttctagctatgtcacataagtaacatgagctagttgatttattacccaatgttgacaaaggacagatatcaagtaaacatggcacaaccaagcagataggtaaaaccatgatcccatgtaattagcaaaacatgcatgtttatttgcaaacgataaaaaatttataaattgggatcaacatgctcaaggggaatgtgtgacttgccttgcttcttcacaacaatcttctgaactctgatccttgtgactgcgaacttctgaaacaacagaatctactcgctggcacacaaaacgagaaaaaaaactctaataaacaccaagcaaagagtacataaaaagtaaacaaacatgtagagctcaattttagatgaattttgcaagttgaatggcccaattcggagttcgaatgaattagatatgaattttagaagttttgagccattttaatgaatttctataattaataccaatttattgagcaattattaaatatttttccaaaggaaatgataagcgctgacgtcagcaaggggaagggcgccgacaggcgggccccacatgtcagcgggactacgggagggcgcacggtggacacggtccaccgcggccggggcggcaccgtggaccgagaccatgggtgtggtccacgggcgcgacccacatcgacaaaaggggaggctggctcgccggccaacccaacaaggcggcggcggcacacgctggacgacctccggcgacggtagcgcgacgcgggcaagggggcagcggaggaggggaaaaaggaggggagacggagggagagctcatcgagcgccatggcggtgaggggcaacgggcggcggcgacgccttctaggggagacggcgggggcgacctcgggcgacgaccggcggtgcgaaaaggacggccgaggcgcgggatgacctagggagggtggtagagaggttaggatggggaaaggtggcccgagacggcgtgaatcgccggccggaggaggaggtgagaggtggagcttaccggcgcgtgaggaggacggagctccggtgggttcccgacgacgagaagcgaacgccggacctcccctcatcgctgcgaagctgatcgaggaaggtgcgatggccggggatggctcggagcggcggcaagcggcagcgggaggtggctaatggcagtggcgtctcgggttcacggtgggagcagtgcttcaggggtggaggagggagatggagtggagcagtgctttgggtccctagggcggcagtagcgggcagcttgaggcggtgagtggcggtagtggcttggcctcgcggtgggaaggttgttccggcggtggaggaggaaaatgaagtggatgccgaggtgcggcatagcgtggcgaagccggtgggaccaacggcggcatgcggccgtggctttagcggcggtggcgggcgactggagggtcgccggcgagcgggagcgacgcggagagagcgagggaggcgatggaaagctctggggaggagggaaaacgaatgaggggagcacggggagggtttatataggctcgggagggtgagatggagccggggtgagttggatttgggcggcaatggccgatggatggaggtggtggagacgtggggaagtggcagccggattttgcgggagaggtggggaaatgaggaggacgtggggcggcagagtcccacggccgggtgcgggcgtgcggagtggaggaggtgggcggattcggcggcaatcgtgggcggcaacggcagccatggcggttggctggaggtagtaggaagagttgacaggtggggtctcgggtcccacctgtcggccagagggagagagaggaggtcggttgggggaggcaaaatagacttcgagagggaggcgagctgggccagaggccggaggggagaagggagggggcggccggccttagagagagggagggcgcccaggccgcggggaggcaaagcagacttgggccgaaaccggcccaagggaaagaagaggaatttaaattggttttctttttattttaattgattaaatgaactttgtattgataatgttacttcttgggctccgaaaattcgtgggaaatttcagagagtattttagggcacaaagaatattacaaaatattctcggccaatgatttttaagggaaaattttaattctcctattatttcacttgattaaattgatttaacttttatttaatttctagaaaatacattatttaatgatttttaatcccaatcgaaaatcggggcgttacaatgtcacgtcccaaaacgaccctaaaatatatcctctaaattatgcctagaataattaaaatccatgtgaaagcctccaacaattaaaatgtgcaaagttaaaagtcaaatgatgcttagaggatttttgtatatttcctaaaagcctaaaatacgtaaataaattttagtggaattttcagagcacaaataataattgttaagaaataaacaaagttaaaaaggttttataaagcaactgcgtcatgggtctggcaattttggagaaattctcgatgaatcttcggtagtacccggccaaacccaaaaagctgcgaatttgagtgactgtcttgggttgcttccaatcactgaagaaggaagaaaaatttgtgtggagcccgcaatgcgagaaagcgttccaaactctcaaagaaaagctggtttcctcaccagtgtcaatcttaccggatactcgcaaggacttcctggtgtactgtgacgcttcgcgccaaggattgaggtgccaattttcctttcactccaaaccggtgtgtggacttgaatggagtgactttgaggtacacatagtcaccaacatcgaaggtaagctcacgtcgacgacggtcggcatagctcttttccctagattgagcggtttgcaagcgctcccgaattaaccgtacttgttcgtcggcttccttgactaagtctggaccaaagaatggcctctccccggactcggaccagttgagaggtgtcctacatcttcttccatacaaggcttcaaaaggagacatttgaaatctagcttggtagctattgttgtaggagaattcggcatacgggaggcatttttcccactttattccataatcgaggacacaagccctcaacatatcttccaatatttgatttactctttcagtttggcctccggtttgtgggtggtatgcggtgctaaaagagagtttggttcccatagctttgtggagacacttccaaaaatgagaggtgaattgtggtccacgatccgatataatttttgttggcactccatgaaggcatacaatgcgagcgagatacaactccgccaaattactaacttttgatgtggaatgaatgggtagaaaatgagtcgattttgtgagtcggtcgacaattacccaaatgcagtcgttgcctttctaggaggtgggtagaccggtgataaaatccattccaatatcttcccacttccatatgggaatagggagtggttggagagtgcccgctggtcttagatgttcggctttcacccttcggcaagtgtcgcactcggcaacataccgtgcaacttcccgcttcatatgggtccaccataatttttgctttaggtcttggtacatcttagtactacctcgatggattgagaaaggagagttgtgggcttcactaaggattagttgtttcagtttgcgatggttaggcacaaccaagcgcttcccgaaccataaaacaccatccgaatcttggtaaaaccattttagctcggattcgagccatacctttgtcatctttttgggcctctttgatctgatcatataaagtaggtttcacttctagggcagcaagggaaccatgtggtaccatttctaaaccaagtttatgaatttctgaacataaggtctccgatcggggttttaccgacaagcaattgcattgcggttttcggctcaacgcatcagcaacaacattagccttcctcgggtgataatgtaaacccatgtcatagtctttgatgagttctaaccaccttctttgccttaggttcagatctgattgggataagatatatttcaaactcttgtggtcggtgtagatttcacaacggttaccgataagatagtgccgccatatttttagtgcatgaacaacagaggctaattcaaggtcatgggttggatagttcacttcatgaggtctcaattgacgagatgcatatgccacaactcggccttcttgcataagaacacaaccgagtccttgacgagaggcatcgcaatagatatcgaagcttttgtgtatatcgggtaggataagaacgggagcagtggttaacttttctttcaaggtttgaaaactttgctcacactcagctgaccatacatacttctcattcttcttcaataattgggtcataggcttagcaattttggagaaattctcaataaaccgacggtagtagccagctagaccaagaaaactccggatgtcggatggatttttgggttgtccccaatctaataccttttgaacattacttggatctacagcaactccaccttcagataaaacatgaccaagaaatccaacttctttcaaccaaaactcacatttgctaaatttggcatataggcggtgctcacgtaatttttccaatacaagatagaggttcttttcatgttcttcttcagatttggagtagatgaggatgtcatcaataaaaatgaccacaaactgatcaagatactccatgaaaaccgaattaatcaagctcatgaagtttgccggtgcattggtcaaaccaaaggacatgacggtgtactcatatagaccaaaacgggtagagaaggctatttttggtatatcttctggtctgattttgatttgatggtaacccaaccttaaatcaattttggagaacacatgagcacctgtcagttggtcaaagagatcatcaattcggggcaatgggtacttgttcttgacagcgacttcattcaacggacggtaatcaacacacatccgcaagctaaggtccttttttacaaagagagccggacatccccaaggtgaggagcttggcttaatgaaaccttttgcttgcagctccgtgagttgctttttcaattcttctagctcatttggaggcatacggtacggtcttttagagattggagctgttccgggcagcaaatctatcacaaattcaacatcccgatccggcggcattcctggtaattcctctgggaagacatcggggtaatcacacaccactggtacagcagctatatcaatggttttggcgcccgaaagagcatggagttgtggggaatgatcatcaagtgcaagaaagatcggttcgccggtattatttttgagtgtaatgagacgatggccacagtcgataacccatgatttttgtgcagccaatccatgcctaggataacacctaaaccctttgtatggaggatgataaggtcagcggtaaattctaccccttgtatagctatctttgtgtcccgactaataaattcagctctcatttctgaaccgggtgatgtaacaattaaaggtgggtgcaacatactaattgggattttatggtctgatgcaaaacctttggtgacaaaagaatgtgtagctccagaatcaaacaacacactagctgggtatgaatggacaagtagcgtaccgacaagaacatccaatgcatcgttcgcctcctcggctgtgacatggttcactctacccctcttctgagtttgctgaccctgaggtgctgacctgagaggtggattaggacatggtgctgctggtcttggtccttggagttgtgcatgatgagggtacgagcattggttgatgtagtggcccgcttgcccgcaattgaagcagttgttggagcgaacaggtgggcgaatagcttgctgatttccgcccacaggaggcgcgacacgctgctgaggagggcatggcacgaatccttgtggacgaggaggtggtggtgcttgaaaacgcggagggggcggctgccaaccatggggtttttgcgaaccacccgcggctgaaatctgcgcagccctcttgcgcttgcactcagcttcaaggttcttcatcttgctttcaatgaccacggacctgttgacaaggtcctgaaagtccagaaaagagtgtgcaacgagctcgagttgcatctccgccgacaacccattcataaaccaattttgcttgcaggtgtcggtattgacatcatccggagcatagcgagttaagtggttgaactcgcggagatactccatgacggacttgttgccttgagtgagagataggaactcacgttgtttgaggtccataatacccttcggcacatgggcagcatgaaaagc

SEQ ID NO: 59503 - DNA, 20745 bp, Oryza sativa
tttcctctctcccgttaacccttgcaccaattccttccccaaatccgctccattcatgccggattaattcaaattagttagagaaatggaatccacatcccttcctctctagttcccctaactttccccctttaatcccgtccccaatcgccgggatttaatcccccttctttgaccgccattgatgccgccggccacctcctccggtgccgtttccgccctctcccgtgaccagcactccctccttgccctataaaacgaagtcctccacctcccctcgatccgttttggtccctcccgagtctctagccacctccttctctctccccagcgtcggccgactccagccgcccctgccgccgcgtcagctaaccggccggccgtgccgtcgcctcccccggcgtcgcagtcacctccccttccccggcatgccgtccatttcccgcggagacctccggaagtgcatccccaccggcaacagtggcgttgctgccactgttccgcctccggccgcctctgccgcatctcctgtgcgtcggccgacgtcgccaccacctctcccggcaccggaatgctgtcctcttccccggccaggccacggcgtcgcccgaatttgtcgtaggctttccggagcttccattatatttgagggatgaagtgaataattcaagtcatcaaacaaacataatgaaacatccgacgcctcgagagaagaatattggagacattgctaggcctttagcctgccagtcaactttagcctgagatgtgcccgtcaaaccactcgaaggcggtgaccagatgtgttacacattcatgagacttgacaaaaatggctaaagatctacaacatctcaaatattcttaactcatactcatgtgaatctagttcccaggatgtgcactagattcacactttcatctcaagcatgattatacatagcaaacacaaataagatgaaagcgattataaactacatctactttagttacattggccgactggccaaataaatatatagaacagcggaagcttgtctacccaatccacaagcacaccgactagggatttaccccattaaattcaagtcctagaagaagcagtcgattacccgcatcactcaaagactaagtctaaaacctgcaagcaaaagattaattcaatagcaagagttagtacattattagaaataatgtactggcaagcatcaagacaagcctaacaccctacttgcaaggcatataatcaaggaaggcataatatggttctttttagcataaagcaagttttatttgcataaaacatttctaaatcaggtttactttcaaataaatttcagcaagctagtacttgacatattgggcatcaaggtaggcattaatcatgtataaatatgcacctcattgccttccatggcagcaaggagatcattctcaaatctcatcacaatttgaaggtaaattttagcattaagaagaataaacacaagtctatactcaatacatatccacacgtcgctcttgtccgtgagcacggctaatcgattagtttttactctgcatagtttgtacactttacccacatgatgcaaaataataatcatgcaagagcatggcacgcgatacataagtacccgatttattacccgcaataaagctttttcaaaattcatgatttaaccttacaccagcacgatacgtgttactccatcctaagccatacatgttatatgacctaaaaccgttaagtggcgggcccacgccttaaacttaacgccgtggtggcggatacaacgggaacccaccacgtggcacaataccgttgtattggacacgctaggtcacctaaactaccacttcgaggtaaataggaagctcctctgaattatatgaactcatacacaccggcctaccagaatgtaaggctaaaccataaataatttactaagcttgggctatcccatactagcacatgtggttgcaccgtatacgaaatgaactgacattgagtgaagtccttaggtcggtttgggcacactctccccctatcggtacacaactaatcaccatatgtgcaccacttgaggcccaaacctaaaatccatgttttccaccattttatttatcaaaatcacaagtattaaagttctgtccagattaattaaaaatcaattttcatgtttgtaatgagcccataatgacaaggaagaccattctaagcatggttaagctttatagtaacctagtgtcaccaaaactcatatataaattggtatagtcatattgttcctaaggttaggaatgaggaatatggatatatgtggatttaaggtgataatgcaaataataggagtttatctaataagtttaacaaaattttaatttattagtgtacaatcgacatgcaagatttgcaaacattttcaataacctccaaaacataggttcaaagtgatcaaagagagggaggtgggacttgccttgaatcaggaaaatgtcagcacctaaatcacttcttcaccgtttaagcaatcatctatacaaagtacacgttatgcaattaaacaccgaaatatgcgaaaaatccaaaatgctctaaaattgatgatttttgcacagtgaataggtactggtataatatgaatttaggtgaaagaatttctattttatctctttttatttgggagttatgaattttagaagtttcctcagtataaggtagtatcacctaggtagtgttataaaatatttttataaagtgatttttattagttttgacttcacagaggtgtagaggagtgttttctaagactaacacatttggtttcacaatttttggacttaatatgaattctttatgtattttacaagttataacgtgttataggtgtatagtgttctatagtttcatggctttagaggtttaggtccagaacttgcctcatctagctagtgatgtataaaatgagtattttagttaactaatctaaccttagttcataggcttatggtctttattatcatggttcatattttataaactagaggagctctagtccatgctagcaatttattatatcaacctagaaattattatatgagctaagtgccttaagttttggtggatggggatggaactatgcattcactagtctaacaagttttatttgggtttcattatagctagagtgtatttctatatacatttatatatatacatattgctcaatcgatactatgtgattagcacctatcctataaatttaaagtttagagctataacctgtacagaaggttccatattttattttactatgttgaagcccactgtttgctggttctatagatatttggttcacttcatttagactaaagatgaattttctacaaattttacaatttaaggtttctgtatgttggttattacttacataagtatttagaggcttttatcatacagtaagtatataattttattttataacttggaagtatatgttttggtgattctacagaacttgggtttactcaaaaaggatctaagatgaattttatatgaacttctaaaattcagcttatctaaaactagtcattcaaaggtaatagttttagaggcatttgatgtatagtatgtatactatttcattttgctttataggagaacataagttgtggatctgtagaaactgagtttgctccaaaatgagttgagatgtactttatatgcattttataagtttgtgtatgctttatgtatgatttatattagacccattttagagacaaggtctgtgctgagggtgccaagcttaatgttaccacattaaagttcatagttttgtgaacctatagaaagttgaatcatctcaaaataagttatatttgattttatatggattttacaagtttaggtgttttgctgttaaaaagtaaaggcttttagtattatcttttacattttcagattttaaactcatggggtccacttgtcggtctcaggccaatatgcaaaaaggcccctagggtttcaggaaatcaaaccgcagtcttatgactgttctgtgtgtcttgagcttttgcagaaagaaccctacattaacctaaattcttgtgaggaggtccctggtttgagctgaagcagatcaagccatggctgagctcgatctcaagcttgccagcggcaaacggtggctcggttgagggtgcgaccaaaagacaaaatgacgatcatgctattgtgattccattcctctacttttctcggtcagtggacatcggagtaacgccggcggcgagtccgagcggcggctgtgcttaggctgctactgcatgttgagttggtgctcgattctaagtgaatgaaatgcatgaatgcaatcctatgggctcaagtgtgctcaccgaaccttgaacgaggcgcgggaaagtctggacagcggcagcggtgaagaagatggtccggcgacggtgtagagctccggggagacggcaacggctcgatccactcatcgaattgacatccatgtgttttcatggggttagtgaggtcccagggatggtgtatacgcgaagaatcggacaatggctcaccggaggaggcggaatcgacaatggcgacggcgaccggaggtgaagaagacggtagccgatctccgcacttgctgcgccattgcctaggatttttgagggtttttgaggaagacttcaaggagaagacgttggcgcgacggctcggctttgtttggtctacaatggtcggaacgacgacgatgtcggctgcggcggcgcttggagcgcgctccggagtgccgtgggcacgacggcgttcccgtcgatccgctgcacgatagaggatgaaattaaaaggataaatcatcggcatggtgagaagagtatggaacgcgaaagagatggggattaccctggcttatttacaagtacgatagtcgtcttcttcgcggccggcagcaaggatgagggcgacggagaagttgagagcctcctccctcggtttcttcggcttagaggtggagaatgatgtgtggagatgcagctgggaggaggagaaggctagaataggagtttgatggcgtcgacacattgtggccacgcgtcgtacacagccggcgccaatctctctctctctctcggctgtctctggtcggctggaagatttgcacaaggtgaggacgagccagagtggctgccaagtgggtccaggtcgtggcaaactaagctagggtgagagggttgggcagaaacgtgggtgaacaaaagttttgaatgattttcaggattatttctctctcccactttagtaatttaaacagagaagataaattctggaaaaattatttttattcatgataaatgacctagtatttgaataaattattttacttatacacttttatgcagttaaatgcacttttagataaagtatggttttagccgattaagaactacggttaatctagtttttattagtttgactgatttatttgaggtaccaaatttagttattaaattataccaaaattacagtgagttgtatgagttgagtagagcctacaggaattttcccatgattttatcttgcacgaattattttagataattcgcaagacttatgtcttatatgtgtttccctttcctaaatgcatgtaaatgtttataaaagttatatttggactctcattaacctgaggtgatattgatatgatagaattacagtttaccttacacatgtcataagctccttacttatttatgcataagtttactttagtattaaattaagagaatgcttagagatgattaagatagaatataccctatatgatataatttatttgttcactttcatgttcatgacatgtcttcagatggatgtccaaattagttttgtgaggcttgacattagccatgttgatatattttaaggtgtatggtttctattttaacttcctctagctagcactaggccataatggtttagttgtttatctagatcttagttaatattcatcagacctattatgaaatgcaaatcaaatattcaaatgcacatgaaggactcaagtcaaaacatgttttatgcaagtatgcatgcttttactcgtgtttgcatttatgtcctaggttataaatgaaaaagttttaatttgttctcaaattttacttaggttcaagttagattgaccacacctaggttaaaaatggaaatttttagctctcaaaaatggaaaagttagcttccaactattttgataggaaatttttaaggtctagaatttgggtatgttacagaatttcgccggaacaccgccgtgcagcgccggcctctccatccgcctcgccggaatttccccggtcggcccttccttcacccgtgcgctgtcggccgcgccaccacaacctccggcatcgcagcggcgagccggcgacatcgtcctcggcatcgcctcccctccatccaaacccctctgcagtccatcgtcgtcgtctccgttcgtcctcgtcgtcgatgtcccgtcggtcgcccggctcgtcgtcttgctgcgccgcaaccatcgtcgtcatcacagcgacgtgttccgcgccgtcctcgcatccgtgcagctgctgccggctgccctcatcgcctcctcaccggttccggtcgtcatcctcccatcgtacccggtcgtcgtggcgttcgtccctccgtcaagccgatcgcgttcgccgcctgtggttcgtcaagcgagccgctgcagccctattgtcgtcttcgtcctcggctccgcgtcgtcaagcctcgtgccggccgcgtctcgccttcgtccaaggatcgccgccgaagtcgtttgcctctgtcgtccccgagccgtctccgccgcgcccgttcgtcgtcgtcgtgccgcgccttttcgggtggtggtaacggtgcctcctctcgctgccccgtcctcgtcctttcggtgttgccccgtgcccgttgtgcggttgtcaaccccggtacccgtgtaccggtgtcagtagtgttcgtgggtgcgtgtggtgaccgtgtttgtgtgcccgctcggtagccgcgtggtttccacgtgtgcagcccgcgtggtgtctggtggagtccgtttgtcggccactcgcctcggttgacacacggggtctgcttccttcgacccgtggaccgtctctgtgtacccggtccaccgtggtcccttagattgacatgtggggtccgcatgtcaacggcgcagccttcctgtcttttccaggctagcgcttacacatgttttatagttgcaaagcctaattacaataattcgtaaatctccacgtgacagcattaaacttcggatgaccatatcttggtcatacgagctccgaatcgacctgttcaagtctcctaatgtttgttataacctaaagaaccctgtgctttctttttatgttttattattgcttctttataggcttgtagctttgcttgtgtgcttcgcgtagcttctgtcgttccggaggttcccaaagtgtggttcgcggtcgtcgtcgaaggtttggaaggccgttctctctgagcaaggcaagttgcatcaccctttagcatattgaatcccagtttataaaattattttgatttaaattattgcattaccgctttacataaattcccgcattatcactgttttatttagccatgcctatttacctttgttatgaccttattattattgctattgttattattaccttgttcaccctaggataaacaaaaccccaactagtgggtactctattaacggttccactagtatgaatttaggtagatgcttcgctgattaattaggcaacactaggtggttttataactttagactttgggagttctcatatcatttggacactgtggaatggttggcttgtggtggaattgaacacacacctccccccctctattcaaaactcccaaaatggttttaggctgggctcgaggtgcatggttctgctagtagcacctcagccactataaggaccggtcttcgggcctctgttgcaaagcactaccgtactaaccacatgtctaatgggtaaggcttaactcggtgctcagtctagtccttgcaagagtacacggatggagatggacgaagtcggggctcgatggacatctctagggcaaatgaaggctacacgggctgcggctcggtattcaagatgtcatggcacagggccggtgtcctgctgctaggggctcaatcttacctacctgtctcgggattccggccgtaggcgaggttgggtcggtgcttttgtcacggctaggatgggtaaaggggttatgtcacatcctttaccacgggttccacggccgtggaatgcagagtaaagatgtgtcttgtgggtaaagatgtacacctctgatcagagtataatctattcgaatagccgcgccctcggttatgggcaagcctagcaatgtacccaagttagtggtttaattcttaaaacttgcttaacaactaaaatgtggaatggttggcctaggttggcttgggacgagctgggacctaggtcgggttgccagtttggtctgaatcatcataggccttgggttaagccaggttcgtgtgggttcagggccttgattaataatactgtgtagctctaggattgtctttataaaatagctttgggcaactaagtgactcttaaatgctgtttactgcaaaacttaacccctatattattaccctttgtactcccttgcattaatcatgcatatcccggtgtgacttgctgagtactgtggttgtactcattcttgctctatctttcccccccttcagtaagagaagctttggagaagaagtcttaggtggagccctggcttataccctagttgagcgcctgtgaagatggagccataggcccactagtccgctgctatttatttttgtttgtcaggcctgaagtgcctttgtaataatgtaaatattatcgatataataaagatgtgtcttttatatcatgtttgtcaggcctgatgtgcttttcctgggacggggattaatacactagtgttatggaaaaggtatttttccgggcgcgacaagctggtatcagagatatctcgactgtaggataagccaactggataaaacgtaaggacatattttataaatgaaactatttgcgaaagttcctttttcctcctttccctaatgctatttgcaaaaggtttacttccttcttccttcttcgaatttcaactagtactagatggtcagctttgtgaagaagaagagatcgtcaatcgtttgccgaagctccagaagactgttggatccgctagcgaagcgaaggaagcaatgaagccagctgtgaagcaggggtgaagatcttggagaacctgttgcagaacctaagccaccctctagggtagagtcgttagtcgtgtgtttccttgcttgtgtgtgtagcgcgtggtttgcatcagtggggtgtgatgtaaccatgctagattgtttgcttaatcaacttgcagaataaacctaacatacatcataacagaaaaaaaatagatctgttaaggtcctatccttagtttctaatctgtctctccccttttgttttccctctctccctctccaaacctagtaacagatggctgacaataaaaaaggcagtatggtcagaaatcaggacgtgggtacctcaagctcccgagtgaatgaagcaccagacaccagttgtatggcagtggtccaacacctgattaaccagaacaaattgcttatagagatactacagcagcatcagacgccaattctgaacccgagtcagatgcaacctcaagtgcagttggaggcagtccaagcactcacaccacaagtcagcgctccgccagcatcccaacaggcccatcgtgccatgccacttgtggactcaaaagaagcaagaatcatttgttttatctgtgttgaacaagggcactatgcaaggaaccgtcctcagcagaaaagaaaagcacaatgcgaaccgaagatgaggtccgtaagatgaccattaccggcacagaatggcctccaccaggaatgacaaaacgtcagagaagaaatttcttccgaggtgcaccacagttgacagaacatcttttggctaatggaggtagagtgtctgatagcgaagattcagatcaagtctcctcacgggatgaagatgagaagtctctccaaggtttcaatcagaataaaaaggaacataaggcatgctctcgttgtggagaaatcggtcactttgccagctcatgtgtcaccacttgcgttccttgtgaggaagaccatccacccgacgagtgtccaacgagcaggatcacttgtttcttgtgtgaaggaactaatcatgtaccaaaagattgtcaattcagttttctgctgacgaagaagatggccaaccaacccgccagttacaatggagagaagcatcaaggcaacccaaatcctcgacaagactacagtttcagcctaactccagtgccaagacagaggaatcaaaatgggaaaagaaaatgccaagtctggaaagatatatgttgcttcaattgtcaagaagtgggtcatttcgccgacatgtgcccgaaaccgagaaacatatttgccagcacatcagtccatgcaactcccctcaatcagaagcttgctcctcagcgaattgtcatccatgcgtcctgaagcagtcgtatagcccaagatgcaatagctcccactccaatgagtgcactaccacaaggtgtcaatgctcaatttcagccccagccaccagttgacaagatagaggccagtatccgcgttgtacctttggatgttccagcacaactgaaagtgcattaatccccctagtgggttttggtgattaatgacaaatgtggttaagggactaatgagttcattgagtatcttttaggtgcattagttcaaggtgtggaagatggatgcttggagaccccccaaaagtataaaatcaaagcggaccggaactcgagaagtgcataggatagtttattttttgcaatcgagtttttaggaaaaaccgtactattaagtggggttctaggtgatgctctgagatatctcaagtgctcttagtgtgaaccaagtgtcaagtttccctaggagtcatttttgcaaatgctccattggtccaaaaatgcaagtccggaacttcctgtttccaggtccggaagttccagtatgatgaaagaaattttcctaagtattatccggaagttcctgtcttctaggtccggaacttcctgtctagttttcagttcaaatttgtgagtaacggctagatgacgtcacatatacagctcgtttccagcttgttcattggccattccactttcactttttgaacctagagctgttgctagcctctcccaagtgtttcttgccttctccactcaatctagagcctaattcttatgagaaagagagattgagaggaagagaagaagatttggagatgtgtgaagactaggatcttgggtgagcacttggaatatcttgtgggctgtcatctcggtgcttattactcttggagatgatctcctagatggttaggtgtcgcccgcgagaatccgttgcatattgtggatgtcccgggtaagtttgtgaaggatctcctctcctccaaaagggaacgaggtaagttaattaagttcttgtgctgagattctagaggttttccaagtagagcaacgtatacttgtggcgaatttctagaagtagtttgagttggatcttggtggtcactcaattctagaaacttgcctaggggtgtttgtagttgaaggctgtggatttcctctggagtttttgcacaagtcaggcaaaggggttaatcgagacccagctctttggagctcctcaacggagagtaggatcgcaagatccgaacatcaggaaaaaaatgctcttgtctctttctgtgatgtttctgtggatgtttctgtgatctatctcctacttagaatacctgtgcatcatcttgtgaagattggcttagtctcctgattcgaaatttgaatttcatccttgttctgtaacccggaagttcctgtcctaagaacaccggtagttccgggcctggcaggccagaagttctggagttccttaccaggaagttccgggtctgtttgaattttaccgctgcgatttgtttttaagttttcagggacagcctattcacccccctctaggcttcatcagcacgttcaattggtattagagcaaggtgctcttgattcaagcttcactgctttgagtgatccacaatgtcggacttagggggaaagaacggggaaaatggaaatgaagatggagcgagcagcaagggaactccatcacccaagggagctactataccttttgattacagcaaacttaccattccccctcacaactttgtctccgtgccttctgggcatgctcctcaatttgatgggacacataatgccgcttggaagcacaagatgaagttgcatctaatctctttgcatccaagtatttggaaagttgtttgtacagatgttgatgtaccccatgataacatggagctcacttcggagcaagaacaactcatccaccgcaatgctcaagcttccaatgcaattctctccgccttgagtctggaggagttcaacaaggttgatgggcttgaggaggccaaggagatatgggatactttgcaattggctcatgagggatcacccgccgttcgtgaggccaagattgaattattggaaggaaggcttggaagatttgtgatggatgacatggagacaccacaagagatgtatgataggatgatgatccttgtcaacaagattaaaggacttgggagtgaggacatgacaaatcactttgtggtcaagagacttctccgtgcatttggtccaagaaatcctactcttgtatcaatgatacgggaaaggaaagaattgaagagtctcaccccaagtgacattcttggaagaattgtgtctcatgagatgcaagaagaggaagctcgtgaagtgaggcaaatggtgaagaatgccgccatgatcaaaaatcaagaagttgctttgaaggcaaaacaagaagaagagtcatgttgtgaagaaagtgaagatgaagagatggcttttattgtcaagagattcaagcactttcttcgcaagagtggctatggcaaagggaggaaggatgatgacaagggaaagaggcaatcaaagagagcttgcttcaattgtggtgaacatggccacttcattgccgattgtcccaagtcaaatgaagctaaggctaagggaggcaagaagaagccggagcatgctcatgtggcggaggcacacatggcggaggtgtggtactccggagatgaagaagatctcgaggtcaagcccaagcccaagcctcaagacaaggttgaaggagaaggtggtgttgctactgtcgccttcaagtcatcctcttcaatcaaggagcgtctcttcaacaactggagtgatgacgacgacgactcctaccactactcttgtttcatggcccaaggccgcaaggtgatgactcaaaagtcctctcacatctctcttgatgttgattctagtgatgcggaaagtgataatgaattagatgatgtgcttaagagctttagcaaacccgctatgcaacatttggctatgttaatgagagctttggatagtaaagaacaatctctcgaaaggcaagaagaattacttattcttgagaagaaaagaaaccttgccttagaggagagcctagctaaagaatgtgctaaaaatgaacaactagctaatgagcttaatttggctaatggttctctagctagccgtagggatgtcaatgaaactcttcaagagaaatttgctagtttagacaaaagtcataaagatcttgaagttcaatttgacactctttggaatagcacttctcaaccaaatgtggtttctaattcttccaacccatctactagcaatggttgtgctaggtgttacaatattgatttgaactcttatgctactaatgttgatgctatgcaagctcttaagaaagagaatgaaagattggtgtcacgtcccaaaacgaccctaaaatatatcctctaaattatgcctagaataattaaaatccgtgtgaaagcctccaacaattaaaatgtgcaaagttaaaagtcaaataatacttagaggatttttgtatatttcctaaaagcctaaaatacgtaaataaattttagtggaattttcagagctcaaataataagtgttaagaaataaacaaagttaaaaaggttttataaaaaacaaaaaaccctaaaaagtcccccttccctctcttgggccggcccggcccatctctccccccctctctctctctcctctccccgcggcccatccggcctctccccgcgcgcgcgccgctgacgggcgggcccgcccgccaccatcgctgacgggtggggcccacccgtcatccccttcctcccgccgctcccgccgcctcccccgcgccctagcgccgccgccgccgcgaatcccgccgcctcccgccgtccccgcgtgcaataaagtggggggaattactccccgtgatcccctctccctttccccccatttttccctctctctctcgcgttcaaacgggcggatttgcccccgcaaatctcacctgtaccattgatggtggccggacctcccgcgccggtttccttcccctccggccgctctctcccccttccaaccctatttaaaccctccctgcacctcctccgtccgtttgcgcctctcgccgcccttcctcctcgccggattcgagcccgcgacatcgctctctctctccgccgtcgccgccgagctccggtctgccgccgtcgtcgccctggaccgcctcccacctcggcgccgcctccttcggcttcgccgcatcctcgccgacctcgtccacctctccgtttcggtcgccgaccaccggaacgccgtcgaccccgtcgacccgagccgcgccgcctcctccctccgctccgaccgccccctccgtcgccgccgtcaccccggggtgagccgtggaccgacgcctcctttcccccttccctcccctctctcggccgccgctccgccgcgtcggtggttgccggcggcgaccctcggggcgcgggcgcgccgcctcccgccgaccgcgccggcgtggccgccctcgtgcgcgccgagtggctgctgcgtggggcccggccgtcagccgcccgcgccctcgggtgcggctgacgtgtgggggccatggcgctggccggtgcgagccgggtgcgcccggtccaccgtggaccgtgaggctgccgcgtgggccccactcccgtggacccggtccgcgcgcccctccccctcggctgacgcaataaaccctttttaaattaaaatttaaatgaagaaagtcgcaaatattcatttaaagagcatataaacttcaaatggccataacttggccatttgaactcgaaattggaccgttcaagtctctaatttttccttaagaagtcaagaacccatttttgtgctttgttcctgctggttatatagagtttattagagtaaaagccttttctttaccgttggtcgtgtagacgctgcagcttcggaagatccgctcttcgtggaggttgaagccgacgtttgggaaagtgaccaaggcaagtcacatcatccttaagcacattgaatcctagtttataaaattattttgatttaaattattgcattatcgctttacttaaattcccgcgttatcactgttttatttagccatgcctatttacctttgttatgaccttattattattgttattgatattattaccttgttcaccctagattaaacaaaaccccaactagtggacactctactcatggtaccactagtatgattttaggtagatgcttcgctggttaattaggtaacattgggtggttttacaactctagactttgggaatattctcatcacctggacaccatggaatggatggattattgtggaattggattcacacctccccctctatgcaaaaccctcaaaatggttttaggctgggctcggggtgcatggttttgatagtagcatctcggccatataaggaccggtcttcgggcctctgttgcaaagcactaccgtacttccacatgtctagtgggtaaggcttagtttgtggctcagtctggttataaacaaaagtacacggatggagatggacgaagtcgggggtcgatggacatctctaggacaaatgaaggctacacgagctgcggcccggtagtcgagatgtcatggcacagggccggtgtcctgctgctaggggctcagtcctgcctacctgtcctgggggttccggccgtaggtggggttgggtcggtactcttgtctatggctaggatgggttggaaactatgtcacgtcttccgtccgtataccgtggtggtatgtggcacgtggttacatctgaggaagatatgtcttgtgggtaaagatgtacacctctgatcagagtataatctatttgaatagccgtgccctcggttatgggcaagccgagcaatgtacccaagttagtgtttttaattcttaaaacctgcttaacaactaaaatgtggaatggttggcctgggttggcttgggacgagctgggacccagggtcgggttgccagttcggtctgaatcatcgtaggccttgggttaaggcaggttcgtgtgggttcatggccttgattaataatattgtttagctctagaatcgtgtatacaaaatagctttgagcaactaagtgtcttttaatgctgtttactgcaaaccctaaccctttatattttaacccccttgtactcccttgcatttattctgcacttgtgggtgtgtcttgttgggtacggtggttgtactcagtcttgctcaattttgcccaaacccagaagaggagcccctggaagatgaaggctttggtgtctagctcgtgcctgccgtcaagcgcctgtggtcatcgccctagtcttccgctgtttttcgtttgtcttcttgtgtgctgggtcttcgccgcccatgtaataaattaattaattacgcttccgcttgttaaactctgaattgtatcaacttttggtgtaccttgcctcctgggacaagaaataatgcacgcacgtaaggaacgcccgttgggttatttccggtcgtgacaattgggcacattggtgaaatatggatgcgtgaagacatatcattcaaaagatgccctttacaagaccatcaccgctcatcctaacaaggatggacatgggctcgggttttctggtggaagtcatgtgtctaagcgtgtgatggtaaatgggaaagaatgcttgatgtttgtgagagaaggaaaagctccacaagcaagtgaggtgacttgtcccctcactggtcagacacccggaagttccgagcaaaatgaccggaagttcctgccctgtaagacaggaagttccggacattttgtcaggaagttccgggcttctgataggccgaacggactaaccggaagttccgggtataatggcaggaagttctggctagagggtctttactatgattcatatgtaattttcaaaaattcagagggcaaagtggttgcttatttcaatgggaattacaatgatgagtaccgtacttgtgtgtgggtgccaaaggctttggtgactaacatcaagggacccaaacttagacaagtttgggttcctaaatcccaagcttgatttcttttgtaggcatactcctccagtggctcaagttgggttgtggacagtggctgcaccaatcatatgatgggagagaggagtatgtttacaagtcttaatgaggagggtggaagtcgtgaaaatattgtctttggacatgatggtaaaggaaaggtaatgggtctcgatcgtgtgtgtagtgcttgccaagccgggaagcaagttggcagtccacatcctataaaaaacatcatgactacaacaagaccactcgagcttcttcatgtggatttatttgggcccgtggcctacataagcattggaggtaacaagtatggtttcgtcattgttgatgatttttcacgcttcacttgggtgtactttctccatgacaaaagagaagctcaagatgtcttcaagcgcttcgcaaagcaagcccaaaacctctatgatctcactatcaagagggtgcgaagtgacaatggaggagaattcaagaacactcaagtggaggaatttcttgatgaagaaggaatcaagcacgagttctccgccccctatgatcctccccaaaacggcattgttgagaggaagaaccgaacccttattgaagccgcaagggcaatgcttgatgagtacaagacttcggatgtcttttgggcggaggccgtaagtaccacatgtcatgccatcaaccgcttgtacctccacaagatcctaaaaaaaacttcatatgagctcttgagtggtaagaagcctaatgtttcatattttcgtgtcattgggagcaaatgttttattttaagtaagaggcctcgctcatctaagttctcacctaaggtggatgagggattcttacttggctatgaatcaaatgcacatgcctatcgtgtcttcaacaaaacctccggtattgttgaagtcactagggatgtgacatttgatgaatctaatggctcccaaggagcgtaagttgttgtacatgttgtaggtgatgtggatccaagtaaagctataggcactaaggctattggagacatacgaccagtcgagacgcaggatgaccaacaagatagggatcaacctccgtcatcgacatccaatagccctacaagtgctgtctttgctgagctgaaagttccgggtcctattgatcagaacctccggaagttccgggttctacagtctggaacctccggaccagtggcagtgaaaacgtgccaacggcacaagtggatgggatcgatgctgcgggcactttagagcatactgatcaggctcaggtcccccagtgcaccatccaaggatacatcacactgtccaaagagatcatcccgtcgacaacatacttggtgacataagaaaaggggtaactactcgctctcgtgtcccaagtttttgtcaacacttctcgtttgtctcttctttggaaccaaccagggtggaagatgcgcttggtgatccggattgggtgatggccatgcaaggggagttaaataacttcactcgcaaccaagtatggactttggtggagagacccaagcaaaatgtcatcggcaccaagtggatcattcgcaacaagaaagatgaacatgaggtggttgtaaggaacaaagcccggttagttgcgcaagggttcacccaagtcgagggccacgatgttggtgaaaccttcgcacctgtcgctcgccttgagccaattagaattcttttagcctatgccgctcaccatgatttcaggttattccaaatggatgtcaagagtgcctttctcaatggacctatctctgagttggtctatgtggagcaaccaccggggttcgaggatccaaagttgccaaaccatttgtacaagctccacaaggcgctctacgggcttaatcaagcccctagagcttggtatgaatgtctccgagattttcttttgaagaatggttttaaaattggaaaggcggacactactctcttcactaaaaaatataagagtgatttattcatatgccaaatttaagtcgatgacataatatttggttctactaatgcctctttttgtgaagaatttagtagtatcatgactaaaaggttcgagatgtctatgatgggcgagttgaccttcttcctcgggctacaagtgaagcaagcacaagagggcaccttcatctctcaaaccaagtatgtgaaagacatactcaagaagtttgggatggaggatgccaaacctatcaagacgcccatgcctactaatggccacctagaccacaacgataatggtaaatgtgtggaccaaaaggtatatcgctccatgataggatctttgctttacttatgtgcatctcgtcccgtgtcgcgaccgagaaaattgcattttcccgaacgctagtgtattaatccccgtcccaggaaaagccggggtacaccatacaaacatgatataaaagacacatctttattatatcgataatatttacattattacaaaggcacttaaggcctgacaatcaaaaataaacagcagcggactagcgggcctacggctccatcttcacaggcgctcaactggggtataagccaagactccacctaagacttcttctccaaagcttctcttactgaaggggggagaaagatagagcaagaatgagtacaaccacagtactcagcaagccacaccggcagatgcacgactaatgcaagggggtacaaggggtaatgatataggggttaagttatgcagaaaacagcatttaaaagtcacttagttgcccaaagccattttataaagacgatcctagagctacacagtattattaatcaaggccgtgaaccctcacgaacctgccttaacccaaggcctacgatgatccagaccgaactggcaacccgaccctgggtcccagctcgtcccaagccaacccaggccaaccattccacattttagtt

SEQ ID NO: 59504 - DNA, 7108 bp, Oryza sativa
  unsure (1)..(7108): unsure at all n locations
tgctgcacacttgacgaaacgcgggcggcagacgagaacggcttgacggagggacgaacgccacaacgaccgggaacgacgagaggacgacgacgacgacgaccggggccagcgaggagacgacgagggcagccggcagcggctgcacggaggcgaggatggcgtggaacacaccgctgcgatgccgacgacggaggcggcgccgcgagacggcgagccggcgaggatgaacggtgaagacgacgacggacaccggcggtgttcggtcggaggggaggcgaggccgaggacgacgtcgcggctgcgatgccgaagatggtagaggtgcagcaagccgacgagccggggaggtggaaggggcggccgaaaggacactggcgatgaagaggatggagaggccggcgctgcgacggcgttccggcgaaaccgaggagcagccggggtggagggcgatgcggcgacgccgagggaggggacggcagcgccggctgatgcacgggcgcggtggaaggggctgccggaggagacgtcgacgaggaggaaggagaggccggcgcgggcgatctcggctccatcaatgacgccggcgaagtttgcgggaggatttccaaacgaatccgagagagagagcgagagggaaaagtgggggggaaagagggagggaatcacggggagtgatttctgtcacatcctgatttttgtttcaggatttataaattatttaataaattattattagaatttatattaaatgttcattaatttacaagtgaagttaaatgtgggaaataaaatttcctaaatataaagcatggatggatttaattttgattaaattctccatgattaattacactctctgaaattttctcagatgtttcggagctcaattcttaatttttaatcatacaaagagcatttcagtaattacccacatattaaattaatcattaaatggtctttttttaatattgttaaatactttgggtgtccaagtatgttcaagatttttcttggaattatttgagcataggaagtatttttaacaatttaaagatcatttcattgattaatttaattggaaaagtaataataatcctcttcctagtcttgggccctttccagcccatctccctcttttgtctgcacggccgtgcagcccaagtcggcccagccgagcttcccccttctctttctttctttgctttgttttcagccagcccaagacgaaaagtctaatttgcctccctcgacactgtttatcttctacctctagcagccgaactgagaccgatttggctcggtttttctcctccaaatctgacctttccccttgtgtttttctaaaattagttgaggggaaatattcctcttatcctcctctatctttacccccaaaaatcggagctaatcgttgagtatcttatccgaatcgaactcgttttcgagtttatctccaaaaccgagtttttgatttcccggatcgatttcttgcgggaggagtccgatctcttcaatccaaggctataaataggaccccctagtcctcctctttcgtttgccccctctcccgtggtctcccgtgcctcgtagcgccgccgccacgtgctccaccccgccgtcgtcgccggccgagctccatccgcgtcgcgccgccgcctccgtcgtcgccgccggtcgccgttaccaccgttaggtgcgcgggagggtggagaagcccggccgctatctccccgaagccgcccaccaccgcagccccgtcgccgccgtcgaccgaagccgcgccgccgctagacctcgtcgccggccgtcgtcgttcgtcgtttggttcgagggtgggtaccgttgggttcgtctcgtcgtcctctacgtgttcttgtcctccaaagtcgcagccgaccatccaatctccggcgaggtcgccatcttggttcggccattgatgaggtcatcatcatgacgtcatcatcgttttttttctttttcctgtttttctaatagattaaatcttcggaaattcataactaaatcatcgtaactcggttttgagtggttcaagttgctaaattcatctaaaatcaggatctacatgtttgtttactttatatgtactgtttatttggtttttattagtctttttcttcgttttgcgtgttagtttgtcgtttccgtcgttgcgaaggttcgtgagtgcgccggaagtattcaataagattaattgaagaccgattattgcaaggcaagtcacacagaccctaaacacaatcctttgagcatgttgatcctatatttaaattctctatttatttcaactgtgcatttattttcgaatgtcaccgggtggtgtgaacctattcctttgttatggccaatttgcattgattactttattccttgataccttgggttattataacttgactagttgagctttatatattggttcagctagatattagatatgattgcttagccatgcttagaaacattagcacactattgggataacttatgactcattgtttaatgatggtttaatcgtagctcacgatggttaatcgtgttatgataattaattgataactaaaacttgacaatggtgggttgtgagcacatggttttgaaggtcgtgctcatgacaattaaggaccggttcacgagctactgttgtgaaacattaaccgtaccaaccacaagccagcatgggcaacggctttaccttctgtatagcatgattcattgcggggcaccagactgagaagcggcgagaagtccgtgggggtcgctggggagtccatgcctctggttatatttatagagggggtgattatgatccaggaatggtgcactgtggtgagttgtgttgtgcaaagggtattgtcacagcctctattcgggtactttccagtatcgcgacgcatggtagacatgatgaggaggctgtgtcttgtgggtacagtggtacacctctggccagagtaaaactattcgaatagccgtgcccgcggttatgggcgggttgagcaatgtttttcgtgattagtctcacacctctcacaataattatggatgttatatctggtaataatttgcttagctcctggtttggagttagatctgtacagccgggtatggttgttcaggatggttgggcctgtgcagcatgggtgtgctgttcagtgttgattaaaatttctgattaattactccactgttttactcctcttaaatgttttgctaaatgctgcttttgcaaatgagcctatattatgccatcctttggtatccttgtgcacttgcatatttgctgtgtggcttgttgagtatgtcatatgctcattcttgcaataatcaatcaacctcagttgaagaaaaaggatccagaaggagaagacgtttggcttataccccagttgagctgcctgtgggagtggagccggaccttcgctagaccgtaattccgctgcagttttcttttcttttgaaagtatgtaacactattattgatgattctgtatattaaattgtcagtttgtgtacctcggctgattcctggacgaggattttatgcacaaataagttcggaaattactagtgaatttctgggcgtgacaatttccccctctttattgcgcgcgggggcggcgggatgcggcggaatccgcggcggcggcagcgctagggcacgggcgaggcggcgggcgcggcgcgaggtaggggatgacgggtgggccctacccgtcagcgagggtggcgggcgggcccgcccgtcagcggcacgcgcgcggggaggaggccgattgggccgcgggggagaggagagagagggagggaggtgggccgagccggcccaagagggaaggggggaaaagactttttagggtttttctttttataaactcattttaactttgtttatttcttaataattattatttgtgctctgaaaattccactaaaatttgagggctctttttagaccaaggagaatttaacaaaaattctccgggccacatttgaatttttcttgtacgtattttagtgtttgccaatttcttttcgaattttaattaattctattattccttttagaaaatgatttttatttcgggatgaatttatcaggacgtgacaaatccaccccccttacaagaatctcgtccccgagattcgaggaggctagcatgaagataggttgggcggtcttctcttcttgtttgacttcttccgtcgcgtcttctataacgaacttgcctagcaaaacttctccactctggactgcttggctcgacctcctgttgcggatggaatcttctcttcacctgacttgaaccagggcgcaccttttagctgactcagactaggttgcggtagtttaatgatgcttccgctccagaacttctcatgattcataccttcggagtcaacctcatacaagttaccacttcatgtcatgcgtcaacactagcttgtcattactaggataccatatttgtcatcataagaatatcgtgcttgtcattcacttctaacttgccaccaactgcctcatattagctttcccggtctccgggtaatagctacttctgctatttgatgcaagggtcgataactttgcctttgaattatgcttcccaagagaaccaacttatcccacttgacatactttgacgtcttcccaaatggctttattgctggatttgttattgtctaatcattatcctgccaaatctgaggcttcgttgttagatgtgcttttaatctgacctctatagattatcttcgaacatatcacttgattcataactgggaatagctctcacgaacaagcaactcggattcactttctttacattcagtttacttcccattattatcttcaggttgtcctcagttagcattcaacgtattcctttatacctttaaccttgatgtgttctttcccattggatcatctcccaagacatggcattgcctggtaaccggtgcttgcacttttcactccgtgtagcatctgataccgagttgaagatttcactctttgccttcatagaaacacttttacccaggtcatcttgcttacttaatgacaaggtgactgttgcggggcaattacaatcaggggtcttccttgagcgatgcagagcatgtttctgtttatcaatcacctttcggcctacttctttcatgctagagaacatctttgccaatctcttttatcaatcttctttcggcttatctctaacaggtggtattctttaatgtggattgcggacgcttctggggacgatgaggtcctttggcttgctgcctttcagagaaaccttgaagtagttcgtcaaaagctagactgacgattgttgcctttgatccgaagaagacacatctgaaactcttagtccaaacaaatgtctctttggttgatcacttgattttcttcgccatcaacaggttggttattaactcgagattagtatatgattcctctgaaatgagaccctaggtctcctttatcagtaagcaattatacacataatcacatatccgcatcttccaaaagaatcctaatagaacttgtctgtattacacatttctcccttattacatgaatacaaggcactaccttaaacaaaaagggaagatgcttaacatcggtacattgtttctactatgggttatgattaactcgaggcctcacaggtatggcgtttgctccagtgaccacaaggcgagtgacttgtcttcttcttgcataatggccggagtgatggcgtaggttacgcttcggctgtggacaatctctagagaaatgacctggttctttgcagttgtaacaaatcaacgtcttctttgttgagctgtccatctggggacgatcattttgacttggagttggaattggtggttggaaatccttgctaacattggcatcagtggtaccatagttgctatcaccattggagtctttctcagtgtcaaaattgctaaggttgtcattctggattccaacattgatactatcgttgacatcttggtgaatgctactgacattgcacgctttattcgagtggtcgctaatgaggcaagaaccatggttgttggtggtatcatcatcattagtattgctagtgttgttgtctgcattgcgtccatcttcttggggcaggaactcttgatgcacaacagaagatccggtgatctgaagtggctcagtgcgctgtctttggttaccacatggaaatactgggatgttgacaatcctcctcttgcagttcgtcatccgattatgctcactttcgagttgcatggctttgtccacaagtttctcaaaatcttagtaatcctctagaaggagttgcactgcaagctcatcttttaacccctggagaaacttctcttgtttgtcttcatctgtttccacatcttctggtgcatagtgagccaaacgatagaactcgtgcaggtactttgtgacggtcaaatctccttgcttcagatagcgaaactctcattttcttaatgtgatcattcctgcgggaacatgtgatctcctgaatacagatgaaaactcgttccaggtgatggtatgtccttctggccgtgatgcttcgtagctatcccaccactctgaagccggtccaaccagctgaggagttgcgaagccaacccgctcctggtcggtgcactgaatcaaccctagcttcttctcgattgtgcgcaaccaatcactggcttccataggatcgacggcaatggcaaaggttggaggctcagttttgagaaattctgataacttgcactgttgctggactgtaggtacttgaacgttggttgtccctgctgggttgttccaattctgtaatagttgaaaggctgttgccaacatgttggtttggttaaccacaatttggattagctctggtgaggttttgttgatgcttttctcattcccactggcttgggttcttgagtcatcggatccatcattcccatagcctttgttaccagtgttatccatctgtcacaaggtagaggttgagaggggaagcanacaacgaaagaatggaccagaactagggacaagaccttaaaggaactaactcttctt

SEQ ID NO: 59505 - DNA, 4049 bp, Oryza sativa
agggtagggggagggagagggagagaaaaagagggaggagagagggacttcggccgcgggccgagagagagagagagtggactttgggccaaacttggcccaaaggaggaaggaaggttatttttaggtttttctttttactaaactttgataattgtttttgttgcttaataattatttccggtgctctgaaaattcaagtaaaatttgagggctccttttaaaccaaggagaatttaacaaaaattctccgggccacattcgaatttttcttgtacgcattttagtgtttgccaatttctttccgaattttaattaattctattattccttttagaaaatgatttttatttcgggatgaatttatcaggacgtgacaaatccaccccccttacaagaatctcgtccccgagattcgaggaggctagcatgaagataggttgggcggtcttctcttcttgtctgacttcttccgtcgcgtcttttataacaaacttgcctagaaaaacttctccactctaggctgcttgtctcgatcccttgttgcagatggaatcttctcttcacctgacttgtccctggttgaacctttagctgacttcgactgggttgcggcacttgaggatggggcttcagttccagaacttcgcatagttcaaatctttggagtcaacctcatacaagttacccacttcatgtcatgtgtcgagatcagctcgtcattaccagggtaccatgcttgtcatttacttctaacttgtcaccaactgcctcatattagctttcctgctctccgggtgccagctacttctgctattcgatgcaagggtcggtaactttgcctttgaattatgtttctaaaaagaaccaacttatcccacttgacatgctttgacgtctccccaaatgactttactgctggacttgttatgatctgatcgttatcctgccaaatctgaagcttcgctgttacatgtgattttaatctgacctctgtaaactatcttcgaacatatcacttggttcataactgggaatagctctcacgaacaagcaactcggattcactttccactattctcttcatgttgttattatttagcattcaaagtatgcctttacacattcaaccctgacgtattcttttttttagatttctcttatcaatcacctttcgacctacttctttgcccgataataaacacctttgctgatatcttctatcaatcaccttttaaactttgtcaaccaagtactcttcactccgagagttgtggatgcttctggtgacaatgaggtcctttggcttgctgcctttcagtgaaaccttgaagtggttcatcaaaagctagactgacggttgttgcctttgatccaaagaagacacatctgaaacacttagtccaaacaaatgtctctttggttaatcacttgattttcttttccatcatcaggttgggtattaactcgaggttagaacatagttcctctgaaatgagaccctaggtctcctttgacagtaaccaattatacacataatcccatatcagcatcttccaaaagaatcctcataaatcttgtccgtattacacatttctcccttattacacgaatacaaggcactaccttaaacaaaaagggaagatgcttaacatcggtacattgtttctactatgggttatgattaactcgaggcctcacaggtatggcgtttgctccagtgaccacaaggcgagtgacttgtcttcttcttgcataatggccggagtgatgacgcaggttacgcttcggctgtggacaatctttggagaaatgacctggttctttgcagttgtaacaaatcaatgtcttctttactgagttgtccgtctgggaacgatcattctgacttggagttggaattggtggttggaaatccttgctaacattggcatcagtggtaccatagttgctatcaccattggagtctttctcagagtcaaaattgctagggttgtcattctgggtgccttcattgatactatcgtcgatatcttggtgaatgctgttgacattgcacgcttgatctaagtggtcatgaatggggcaagaaccatggttgttggtggtatcatcagcattagtattgctaatgttgttgtctgcgttgtgtccatcttcttggggtagtaactcttgatgcgcaacagaagatccggtgatctgaagtggctcagtgcgctgtctttggttaccacatggaaatactgggatgttgacaatccttctcttgcagttcgtcatccgattatgctcactttcgagttgcatggctttgtccacaagtttctcaaaatcttcataatcctctaggagtagttgcactgcaagctcatcttttaacccctggagaaacttctcttgtttgtcttcatccgtttccacatcttctggtgcatagtgagccaaacgatagaactcgtgcaggtactctgtgacggtcaaatctccttgcttcaggtagcgaaactctcgttttcttagtgtgatcattcttgcgggaacatgtgatctcttgaatacagatgaaaactcgttccaggtgatggtatgtccttctggccgtgatgcttcgtagctatcccaccactctgaagccggtccaaccaactgatgagttgtgaagccaacccgctcctggtcggtgcactgaatcaaccctagcttcttctcgactgtgcgcaaccaatcactggcttccataggatcgacggcaatggcaaaggttggaggctcagttttgagaaattctgataacttgcactgttgctggactgtaggtacttgaacgttggttgtccctgctgggttgttccaatactgtaatagttgaaaggctgttgccaacatgttggtttggttaaccacaatttggattagctctggtgaggttttgttgatgcttttctcattcccactggcttgggttcttgagtcatcggatccatcattcccatagcctttgttaccagtgttatccatctgtcacaaggtagaggttgagaggggaagcagacaaggaaagaatggaccagaactagggacaagaccttaaaggaactaactcttcttgttgatatgttgtttgtttcacttattctgcaagttgattaagcaaacaacctagcatggttacatcacaacccaccgatgcaaaccacgcgctacacacacaagcaaggaacacacgactaacaacactaccctatagggtggcttaggttctgcgacgggttctccaagatcttcactccttcacagctggcttcactgcttcctccacttcgctagcggatcctgcagtcttccggagcttcggcgaacaactgacgatgtcttcttcttcactgacctgaccatctagtactagttgaaatttgaagaaggaagaaaagggtaaaccttttgcaaatagcattaggggaagaagaaaaagaggaactttcgcaaatagttttatttataaaatatgtccttaggttttatccacttggcttatcctacagtcgagatggctctgataccagcttgtcacgaccgagaaaaatacgttttcccgaacgctagtgtattaatccccgtcccaggaaaagtcggggtacaccacacaaacatgatataaaagacacatctttattatatcgatagtatttacattattacagaggcgcttcaggcctggcaatcaaaaataaacagtagcggactagcgggcctacggctccatcttcacaggcgctcaactggggtataagccaggactccacctaagacttcttctccaaagcttctcttactgaagggggggggggaaagattgagcaagaatgagtacaaccacagtactcagcaagtcacactggcagatgcgtgattaatgcaagggggtacaaggggataataatataggggttaagttttgcagtaaacagcatttaaaagtcacttagttgcccaaagccattttataaagacgatcctagagctacacaaaattattaatcaaggcc

SEQ ID NO: 59506 - DNA, 5777 bp, Oryza sativa
cctcacgtgtaaccacgtgccacataccaccacggtatacggacggaagacgtgacatagtttccaacccatcctagccatagacaagagtaccgacccaaccccacctacggccggaacctccgggacaggtaggcaggattgagcccctagcagcaggacaccagccctgtgccatgacatctcgactaccgggccgcagctcgtgtagccttcatttgtcctagagatgtccatcgacccccgacttcatccacctccatccgtgtacttttgtttataactagactgagccaaaaactaagccttacccactagacatgtggaagtacggtagtgctttgcaacagaggcccgagcttaatccttatagtggccggggtgctacttcccacaactggcatgcacccaaaccccaccgaaaaacaggttttaggggctttgaaagaggaagagaggggtatgtccaattccaccataatccaacaattccataatgtccaaatgatatgagatttcccaatgtctaaagttataaaaccacctaatgttgcctaattaaccagcgaagcatctacctaagttcacactagtggaaccataaatagagtacccactagttggggggggggggtttgtttatcctagggtgaacaaggtaataataacaatagcaataataataaggccataacaaaggtaaataggcatggctaaataaaacagtgataacgcgggaatttaaataaagcgataatgcattaatttaaattaaaataattttataaactgggattcaatatgctcaaggatgatgtgacttgccttgctcagagagaacggccttccgaaccttcggcgacgaccgaaaaccacgcttcgggaacctccggaacgacgaagactacgcgaagcacacaagcaaagctacaagcctataaagaagcaataacaatacataaaaagaaagcacagggttctttaggttataacaaacattaagagacttgaacgggtcgattcggagttcgtatgaccaagatatgatcatccgaagtttagtgctgttatatggagatttgcggattattataattaagctttgcaacaataaaacatgtggaagcgctagcctggaaaagacaggaaggctgcgctgttgacatgcggaccccacatgtcaacctaaaggaccgcggtagaccaggtacacagagacggtccacaggtcgacggaagcggaccccgtgtgtcaaccgaggcgagtagccgacaaacggactccactagacaccacgcgggctgcacacgtggaaaccacgcggctaccgagcgaacacactaacacggacactacacggtcaccacccgcacacgtgaacgactaccgacaccggtacacgggtaccggggtcgacgaccgcacaacgggtacggggcgacaccaaaaggacgaggacggggcagcgagaggacggatccttaccaccacgcgacgaggcgtgggaacgacaacgacgaacgggcgcggcggacggcgagggaacgacttcggcggcgatcctgggacgaaggcgagacacggccggcacgaggcttgacgacgcggaggcgaggacgaagacgacgacggggctgctgcacacttgacgaaacgcgggcggcggacgagaacggcttgacggagggacgaacgccacaacgaccgggaacgacgagaggacgacgacgacgacgaccggggccggcgaggagacgacgagggcagccggcagcggctgcacggaggcgaggatggcgtggaacacaccgctgcgatgccgacgacggaggcggcgccgccagacggcgagccggcgaggatgaacggtgaagacgacgacggacaccggcggtgttcggtcggaggggaggcgaggccgaggacgacgtcgcggctgcgatgccgaagatggtagaggtgcagcaagccgacgagccggggaggaggaaggggcggccgaaaggacgctggcgacgaagaggatggagaggccggcgcggcgacggcgttccggcgaaaccgaggagcagccggggtggagggcgatgcggcgacgccgagggaggggacggcagcgccggctgatgcacgggcgcggcggaaggggctgccggaggagacgtcgatgaggaggaaggagaggctggcgcgggcgacggtgttccggcgaaattcgtgcgaggaggaggtgatgccggggatgagggcggcgtcgcggagccgagggaggtggtggcgacgtcaaccggcgctcaggcagggagacagaggcgcctggaggcggccggcgcggaggaaagggaagggcgacggcgggaacgcagctccgggggtctccgcgggaaacggagggcaagccggggaagaggaggcggccgcgatgctggaggaggcgacggcacggccggccgacgtgctgacgcggcggcaggggcggctgaagacggccggcggcacgggagagaggggacgacggcggggaggtggctagggaccacgggagagctcgggaggagactaaaacggtagaacgcaaagagggggttctattttatagggtgggggagggagccgggcacgggagagggcggaacggcgacgggaatgacggccgacggccatggaaagcggccggacttggcgcgtccgttcccggcgattggggcaccattcaagggggaattaagggggaaagagagaggagggaaaggggattaattccccctaatcaatttgggaatcccatgcttgaatcgcgcggatttgagggaggaatggcgctagggttcacgggagagggagagaggacggccgggcgggaggaggacgatgacccggcgcgtgggacccaccggtcaggcgcgcggtcagcgcacgcgcggcgtgcgcgtgacaggcgcgtgcggcgtggcttggggaggctcggctgggccgggacacggcccaggcgggagggggcagggcggcccgggaccgggcaggccgggaggggagggaggaacggcccgggagagagaggggagggggagggagagggagagaaaaagagggaggagagagggacttcggccgcgggccgagagagagagagtggactttgggccaaacttggcccaaaggaggaaggaaggttatttttaggtttttctttttactaaactttgataattgtttttgttgcttaataattatttccggtgctctgaaaattcaagtaaaatttgagggctccttttaaaccaaggagaatttaacaaaaattctccgggccacattcgaatttttcttgtacgcattttagtgtttgccaatttctttctgaattttaattaattctattattccttttaaaaaatgatttttatttcgggatgaatttatcaggacgtgacatagcattagggaaaggaggaaacaggaactttcgcaaatagttttatttataaaatatgtccttaggttttatccacttggcttatcctacagtcgagatggctctgataccagcttgtcgcgaccgagaaaattgccttttcccgaacgctagtgtattaatccccgtcccaggaaaagccggggtacaccaaacaaacatgatataaaaggcacatctttattatatcgataataaatacattattacaaaggcacttcaggcctgacaaacaaaaataaacagcagcggactagcgggcctacggctccatcttcacaggcgctcaactggggtataagccaggactccacctaagacatcttctccgaagcttctcttactgaaggggggagaaagatagagcaagaatgagtacaaccacagtactcagcaagccacaccggcagatgcataattaatgcaagggagtacaaggggataataatataggggttaagttttgcagtaaacagcatttaaaagtcacttagttgcccaaagccattttataaagacgatcctagagctacacaaaattattaatcaaggccgtgaaccctcacgaacctgccttaacccaaggcctacgatgattcagactgaactggcaacccgaccctgggtcccagctcgtcccaagccaacccaggccaaccattccacattttagttattgagcaaattttaagaattaaaacactgacttgggtacattgctcggcttgcccataaccgagggcgcggctattcgaatagattatactctgatcagaggtgtacatctttacccacaagacacatcttcctcacgtgtaaccacgtgccacataccaccacggtatacggacggaagacgtgacatagtttccaacccatcctagccatagacaagagtaccgaccaaaccccacctacggccggaacccccgggacaggcaggcaggattgagccccctagcagcaggacaccggccctgtgccatgacatctcgactaccgggccgcagctcgtgtagccttcatttgtcctagagatgtccatcgacccccgacttcgtccatctccatccgtgtacttttgtttataaccagactgagccacaaactaagccttacccactagacatgtggaagtacggtagtgctttgcaacagaggcccgagcttaatccttatagtggccggggtgctacttcccacaactggcatgcacccaaaccccaccgaaaaacaggttttaggggctttgaaagaggaagagaggggtatgtccaattccaccataatccaacaattccataatgtccaaatgatatgagatttcccaaagtctaaagttataaaaccacctaatgttgcctaattaaccagcgaagcatctacctaagttcacactagtggaaccataaatagagtacccactagttggggttttattttcctagggtgaacaaggtaataataacaatagcaataataatgtcttaacaatgataaataggcatggctaaataaaacagtgataacgcgggaatttaaataaagcagtaatgcattaatttaaatcaaaataattttataaactgggattcaatatgctcaaggatgatgtgacttgccttgctcagagagaacggccttccgaacctttggcgacgaccgcgaaccacacttcgggaacctccggaacgacgaaagctacgcgaagcacacaagcaaagctacaagcctataaagaagcaataacaacacataaaaagaaagcaaacagttctttaggttataacaaacattaggagacttgaacgggtcgattcagagttcgtatgaccaagatatgttcatccgaagtttaatgcggttatatggagatttgcggattattataattaagctttgcaactataaaacatgtggaagcgctagcctgaaaaagacaggaaggctgcgctgttgacatgcggaccccacatgtcaacctaaaggaccgcggtagaccaggtacacagagacggtccacgggtcgacggaagcggaccccgtgtgtcaaccgaggcgagtagccgacaaacggactccactagacaccacgcgggctgcacacgtggaaaccacgcggctaccgagcgaacacactaacacggacactacacggtcaccacccgctcacgtgaacgactaccgacaccggtacacgggtaccggggtcgacgaccgcacaacgggtacggggcgacaccaaaaggatgaggacgggcaccgagaggacggatcttaccaccacgcgacgaggcgtgg

SEQ ID NO: 59507 - DNA, 23341 bp, Oryza sativa
cttatactatagaaataaacattggaattcagattattccatgattcctatttccaagaaagcctattttttaagggaaaaatgaaaaaaagtaacctctcttttcccactcgctctctattgcatgggtataagaacaaaaataggattctgaaaaaaagtaaagatattgaaaagaaaaattgactttcgaaatccatttttatgtgtagcggaaaggggttgcgatttcttcttattcctatagaacatctagtaacaagaatatgaaatagtaaatagcgagaaattcttgccttgcgtggtctaagtctaaggaaatacaaaaaaatccacttatacaatttcatctacatcgaatttatatatcagaatagcggatagaggcctcattcaaggagtcaggtccacttactttatctttctttccaattttatggggtgggttggtttgataagacccctttttgctttgttgataaataataaaaaaaagagtttttttctataacctgcttgttttattataacaagtcctatatggaaatgcctgctgaagagaaaatctatctgattgtcttttagccaatatccaattttagaattagaaagaaaaaagaagaattttcttcttttttttattaacattaagaaaaaagaatataactaaaatggaattggcaatataatttttttgaacttttgaaagaaaaaggaaggattttttgcaatcgttatttcttgcctctgtcatatcacggaaacctttcgatttggaacggggagagatggctgagtggactaaagcggcggattgctaatccgttgtacaatttttttgtaccgagggttcgaatccctctctttccgccccctcggatcgtttgggactttcgagttggaaggaattctgacccccagattttctcgtagataaatgtatgaaacaaatccaatttgtaagaaaaaattttggatttttactcgtcacgcccaggattacgtcctggatcattagataagaatccaaagataaagagggaaacaaagaatatcactactgtataaacaaaaagtttgagagtaagcattacataatctccaagatttttttttaaggaatagattacccgtttttccttaccacacaaatccactaggatgggttttgtttattttgacacctaaaaatgcaaaaatcaatttttgaaaaaaattgcaagaattgatttataataagcactcttatcaataaattaggttaggtattgtgcggttacctaaagatacctgctcaacgtagatgcagggagtagaaaggctgatccaaatttattgctgcagctatacattcaatgtagaagaatttgaattttagaatcgaaggttcataatataagacttctcggctcttatccatttttcgaatttttttagaatgaatacatgattcaatttggcagacagagtagtaaagatttcatcgaaaacttacagcagcttgccaaacaaaggctaatagaaaaaagagtacaggtatgacaggcataaaatccacgattggattgaaaatggcataagcttcgggcaatttggcgaagaaaaaactagtcggataaataacagaattaaaacaaatacaggttaaactaagtatattaggcataacaagcgtttcgttcttgtagagtagataattggattttgattgagttatttttctaagggaaaaaggaaaaggaggattcaaaatccttttttcttcggactttcccaaacacaaaatacctccttgtattcgcactctcatttagttcacgaggataaggtgcagcaagccgacgagccggggaggaggaaggggcggccgaaaggacgctggcgacgaagaggatggagaggccggcgctgcgacggcgttctggcgaaaccgaggagcagccggggtggagggcgatgcggcgacgccgagggaggggacggcagcgccggctgatgcacgggcgcggcggaaggggctgccggaggagacgtcgacgaggaggaaggagaggccggcgcgggcgacggtgttccggcgaaattcgggcgaggaggaggtgatgccggggatgagggcggcgtcgcggagccgagggaggtggtggcgacgtcaaccggcgctcaggcagggagacagaggcggctggaggcggccggcgcggaggaaagggaacggcgacggcgggaacgcagctccgggggtctccgcgggaaacggagggcaagccggggaaggggaggccactgcgatgctggaggaggcgacggcgcgaccggacggcgctctggcgaggagggagaggcggctggaggcggccggcggcacgggagagagaggaggacagcggggagagggctagggaccacgggagatcgcgggagggggctaaaacgatagaacggagcgagggggttgcattttatagcggagggaagcgagccgagcacgggagagggcggaacggcgacgggaatggcggccggcggccatggaaagcggccggagaaaacgcgggcgttcccggcgattgggggcacgatccaagggggggggaaattgaagaggaatcaatgggatttaaaaccccccaattaattttggaatccatggtttgatttgcgcggatttgagggaggaatggcgctagggttcacgggagagggagagaggacggccgggcgggaggaggacgatgacccgacgcgtgggacccaccggtcaggggcgcggtcagcgcacgcgcggcgtgcgcgtgacaggcgcgtgcggcgcggcttggggaggctcggctgggccgggacacggcccagcgggagggggcagggcggcccgggaccgggcaggccgggaggggagggaggaacggcccgggagagagaggggagggggagggagagggagagaaaaagagggaggagagagggacttcggccgcgggccgagagagagagagagtggactttgagccaaacttggcccaaaggaggaaggaaggttatttttaggtttttctttttactaaactttgataattgtttttgttgcttaataattatttccggtgctctgaaaattcaagtaaaatttgagggctccttttaaaccaaggagaatttaacaaaaattctccgggccacattcgaatttttcttgtacgcattttagtgtttgccaatttcttttcgaattttaattaattctattattccttttagagaatgatttttaattcgggatgaatttatcaggacatgacagttgggccacttttcggtgaggttcggcacctagtgaagcctaggccctcctgccagagatttcgtctcgcccgcactgccttctagcgaagtccttgtctggtgatgtccgggtgtccgagccatggccttcgccatgagactctcgcccacatggttcccttctcggtcttcgccgcttacgtccggtctgggcttgtcgcttgaatccttggtttcggctggtccggccgaaggcccttcgtggtatgcctccaacacacacatatatacacacacacatacacacacacacatataataaatttgtttggtgctccatggtgcccgaccaccctggttgaaattgagtatatatccaattcgaatgagtatgaaactttttcaaatatttaggtattaacattaactactttactaactagttccaagcaagtttgaactgaatttgaacttgtttttgttagattttgattctaggtatatagcatccaaacatataattagttaggtacgtaatcatagattgtgaaataaagttaagcttgagttgttttgttgatagatataggtatgaatcgaatacttataattagatatatactcacaatttgaaaattttgaaaaatttggacgaatttgtatatttcataccatggtgcacaggcaccatggtatggtgccccatatgagtgtcctatatatatattattattattatgtgccatttaactagggttccatggtggcgggtataaagatttaaattgagtatatacctaattcaaatgagtatgaatttttttaaaatgtttaggtatgaacattaacttttttactactttgtaattagttcaaacaagtttgaactgaatttttgacatctttttgttagattttaatgtcaagtatatagtatccaaacatataattagttaggtaagtaataatggattgtgaaataaagttgaatatgaattgttttgttcatgaaccaaccatcggttctatcgtcattatcattgcttgtaagacacttgtaaaagcttggtaagatgcttccaatttctagcctccactacaacccttgttccgtagttaatagagataatactttttttttgttgttttttgttttctactcacaatggcagattacaccactcgtgggcatgagataaagttagatgagacacaaaccatagttgctacatcatcttccataagtgcagataatgtaagtactttgttacataaaaaatataagtactttagtgcaaccagtgccatgttttcaaataaagaaagcgaagcaaaaacagtgccacaatttatttctagcaaggttcatggttaagcatagatcatgtcgtgttatattcgatagtggtggaagttgcaacaaccttgtgagttcagatttagttgagaaccttgggttgcctataaaaccgcatcctcatcgatattacatccaattgttcaattcttttcgtaagtccaagttatgtagaattgtgaaaataaaattttcgaatggaagttaccataatactgcaaattttgatcttgtgcctatgcaagcaagttctctattgtttggtcaaccatggatatacgataaaatgttttgcataatgatattgttaatacataatcaaatcaatgatattatatatctgggatgatactaatattgcgatgctttcaactaagcctgagttattatgaaactaatgcattgttgtacctctttctttggattctaatattttgcaggtacttgagaacaaccaagataatgaggaaacaaaaaagacgtagagaaagaagacctacccagaaccgttgttaaccattgatagttgaggaggctccatgcatgtttgaagaatgtttaattaaccaagtgcctataatttttgaagataagaatgaaggtaatgataatggtgctagatttactcaaggtatgtatagtaatgacgtgctaaatatatccactatttatgctatataagagcaacccatagtgaaaacaattgttgaaatacctttgtcacaaaacaatttgcttgatgtttcttgtgatgaagaagagttgtgcgatgcttcacttatatccatggcacaactagtgaatgagcatgtttgttattttgttgaaccatcatgtgttgagtttaaacatgttattcacattgctggcgagaatgaagagtttaaattacaatcttctttaaatacttggggctatattcaatttgataatctttgtccactcaattgtttagaggtgaaattatttgctagatctgaattgccatgtccttctcatgtgatttaccatgttgttagcaattatgatagtaaagcataatataatgtgcatcgagtatatatttgttcgaaattgaatatacctccttttcatgataagatgtattgtctagagaaccacatgcatataagtaattctgtatctagttcctctagttgtttaaatgagttatatattggtttgcaaaaaagggagtgttgtggttgtcggctatcaagattttagaatccaaccatatggacataaagaaatctaactcacctggtgttgtgataacaaagataagttcaataggttcaatgacaaggtgaaaccgaagacggtttccaatcaagaaggtgaagatgatgaggacacaactagctcagatatgactatgcctatcttatgtattaatcaacaaaaggtgattatgttctatatatttatttattatatgtttgaacaaacattactacaccatgtgtttttgtatcttttcatttgtagaggtacttgcttgggtaaaagaaataagaccaagtgtaaggaatgcatggactatgaaagaaattgattggcgaccaaatcaagaccttctacaagtctactcctacctcaccacatcacttttggtccatagaaggcaagagatgaagttctgcacgttctgtattcggattcgggcctcctgatagcattaactttaaacagacctagccgctgatataaaatgaattttgaggctcatgagtgcttcttggaaaacttatggaatccacttttggatggttttggtcccatgtcaaaattcctaccgagctgtcgagaatctgcaaaacaagccatatacctcatccagtccgaatatgatttgcgccttcggacatgtgattgtgttgtggacaaaacccatggtggtgtacgccctagggcaaccctaggacatcccaaatcatatttattcattagcatcatagtttagagttgggttttacttacattatttatgctattgcagttttgcctcatcttctatttgtagaaccccaaattcgagtgtttagctattcatatacaatcgagttgcaatctaccttgttcttgcttgtgttcttcgatttgcgtgcaggaattagccttttcggtgaggtcaaccaggtagtgcatggttgataactataggaaacgtggtcctacgattgcatggttcggatcgtgttgatcggaagccagttcgtgtgtgtcaagtttgcaccaaatcgagatttatcaatacctattggaagatcgcgacatatttcctcatcaccttggatagctctccccctcggcctacaaaatggattcctctccctccccactttccctttttcccatcctgagctctattgacgcttccccactctcctcctctttctcctccaaactgggcatcatcaagccgcctgtttctcctcgttagcgcatcgctttgccgcgccgccacctccctcagctccatgaggacgagctcgatccctggcattgttcggcttcactaggaggccaccgcatcactgcctccttgccagcctctccatcctcctcgccagagaacctccagctaccctttcttcctcaccgaagcaccgccctgaccttgttgttcctttgtctgcaccgcagcaccaacttcttcgatggtctcaccttcacattgcttgaagatcgccgtagctacgccgccaccatcgactagtgccatctccactgcttcaagctcgacgtcggcaattcttgtcctcccctcgtcgtgttgcgcatgttggtgagcccgccatcctttctcagttttccctcgccgtcctcaacagcgccgcgcgcgccagcaaccttccgtagccatgccactggtgccggcctcccgcatgtgcattccctatggggcccacccaccggtgtcctccggaggctaatgtgtgggtccgattgtcagcacaccccaacccctctgtctctctctctctctctctcgctctctctctaccccctctccctctccctctagctgaaggaagcatcattattttattaagaaaaataattcaacaaattcaaaaatatccatttaaagagcacataactttcaaatggtcatatcttagccatttgaactccgaatcgatccgttgaagtctctaatttttccttataatgccaagaacctatttttgtgccttattgtactgtttttgtggtttttcttaccctagtttgtttactttgcgttgtcgtgcaaacataggtgcagttctaaaagatttgttcttcctcatagtggatcacgaatacgttgtgagcaatcaaggcaagtcatatcttacccttgaagcatgttgaatcctacaattgtgaaaactatattgttttactactattgcattacttttataaattgcatcgttcacttgttatattagttaatattattcctatgatccttgttatagcgttattgatttgatatccatgtccttgagaaccctaggcaaaataaattaactagtcaagtaccctatatgttggacttactagttaccataggtttatgcttaccatgcttagattcagcaatagaatttttgaatgaattggggtgctgtggtatccaccgaatacttgattacttgttggaccatcaactgggcagttggtgagtgggacaaacgatgtttctttgtgaaaactgaaacttgttttggggctctctcgggcatctgttgcaaagcctttccgtacgaccacaagtctatgggtaaggcctgatcgacagtttagtgcatctcaaaactttggaccaggggtctatcacagattgagtgtatccactcgcaattgctagtcccaacctgtcgaccaagggcgttgtgtgagtgctttagtgggttccaccgagggtcaccatcgggagtttcattgttttgtggtgaattacataaaaggtcttgacatggactccgtctgagtacctgttgatcgtgacgcatggaagacatggcgagaggacatgccttgtcgttagaatctattcaacttatcacaccctcagttatgggcatgcctagcaatattactccaagttggccttgactttttaaaaaccttgggataaaggaatcataatggatttaagatggtgaaacttgagttggttgtgctgaagcgcagcctcgtgaactttataattatggcttagattaagatcatgttttaaaatatactttgaacttatgaactgtttaaactttggctttatgaaaaataaaccatattatgacattcctttgttatccctatgcattattgtacttctctagtattgcttgttgagtactataagtgatactaattctagctcacatctaattcagaagatggatgctctagagaagaaggcttggactactagctcttacctccgtcgagtaactgtggttgctgcttctgtaggcatccgctatctttttgtttatcattgagtgtaaggcctatgcaccttgcctcctgggacaaggaataatgcacgcacgtaaggaacgcccgttgggttatttccggtcgtgacaagttggtatcagagcccccttgaccctaggacgagccttagatcccaagccttagcaatattttcgaaataaaaatcctttcttatttgtgaaaatcctctagtctctctctgtcctgctgcttcatttatcgccaaaatctaatctttaaattgttgcttttctcttttgttttttttgtttgtagatggccggcagcatcaaccgtcgtggtctggacctgactggcttcgttttggagctgcggggcatgtgcgttgtcttggggtatccgcatggagtggactaccagggcaagcaactcccggagcaggagggtgatgatgcagagccccacgctacttgggaggtcactgcagtgatcctcactggctcacccgagaggacttcgttggcagtcaccgtgggtggagattctttctccgccgcttgctagaacgccgctctcctcgccattggcactctgcaccagcgctacctagacgagttgcagcactcgccctaccgctaccaccctcgtcgcggaggagcccgcgactacgccaccttccgggatgctagctcggaggatgacgccaccatcatgcacctggcgcgcatggtggaggcttacgacgcggctcgtatcgacttccatcatatggtgcgtcgtgggttggtcgagaacaacatgaagatcctggagctgcgtcaggagaatctgcagctgaagaaggacctagacgcagtggaggcgcagctgtgtcagctcaagatcgcccagggagaggtttgtcgccccaagcgccgtcgcgtctgccgcagcctgaagatcaccgcccgcaagagtacctccaggcccgaacttgttcgtcagtccctggcgtggacctgcttcgtcgagacccctcgtgccgagcccgcgcctgtggttcctcaggaggagggagcctccggcgttggcagcacggaggatgcgctgctgctcaccttccgccctggcccgtcgcagaagtagacgagcagttagtaggcttgcgcgtgtgttcttctcgtttgtttttctgccagagtcgtgtggggcatggttataccggtgtgtggtataactgtgtcggagcctgtctttattttatttgcttaagcaacttgaaccttaatgaaccaatttaatagcagtaataaattcaagaattatggtagtcgtgggtggttagttttaatagtcagctctctctgtttgccggttctatgtgggattttcagatggtgacaaccaggagaagtgctactaccggtgatggcaaccaacccgaaggtagcaaccacaacaaccatggcagcccacctccgcctcctcccccgcctccaccaccaccaccagacaccaactccatcctcacccaaatcctcgcccagcaggccaacatgatggctgctttcctccaccacatccaaaatccgccacagcataatgctccacctccaccaccacccccgcaacactctaaactcgccgagttcctccgcatccgtccgcctaccttctctagctccaataaccccgtggatgctttggattggttgcatgccgtggggaaaaagttagacaccgtgcagtgcaacgatgaggagaaagtcatctttgccgctcaccaactgcaggggcccgcatctctatggcgggaccacttccaggctacgcagccagaaggacagcctattacttgggcccgcttcaccgccgctttccggaggacccatgtgcccgccggagtcatggcccttaagaaaagggaattccaagagttgaagcaaggcaaccgctctgtgatggagtatttgcatgagtttaacaacctggcccggtacgccccggaggatgttcgtgaagatgaggagaagcaagagaagttcttggcagggatggaccctgagctgtccgtgcgtctggtctccggggattatccggatttccagcgtttggtggacaagagcatccgcttggaagccaagcacaagaaactggagtcgcacaagcatcgcttggcaaatttctgcaaccaacagggggctaaccaaagagtccgctacaccaatccctatccagggggatcctcctcgcagcagcaacagcagcagcaacctcactccgcgccccgagctcaattcgtggtgcgcgttccacagctgcagcagcagcagagtcagcaagggacccgtgcgccccgtcctcctacgccagccgtgcagcctggacaaggccgcagagacgttcaaggtcagcagcgtctgtgtttcaactgcttcaagcccaggcactttgcggataaatgcccaaagccgaggcgccagcaaggccaagcgcctccccgccccaacaacggtggtaaggatgtcattcggggtcgtgtgaaccacgtgactgccgaggatgtgctgacaactccagacgtcatcgttggtacgttcctcattcattccatccctgctaccattttgttcgactctggagcttcccactcgtttatatctgtgccattcgtggggagaaatcagttgggggtagaaaggcttaggaaccctctactcatcaccacccctggaggggttatgacagcaaagtattatagccctgccgttcctatagaaatccagggaattccttttccctcgaatctgattcttctagacacgaagaacttggatgtgatccttgggatgaattggttggctcaattccaaggagtagtggattgcgcaaacgcactgtcactctgtaccgagggccggaacaaccggtagttttctttgcacccccaacctctgtcggcagttcggaacttcatcagataggactgtcggaaacccccatcgtcagtgagttcggagatgtgtttccggaagaactacccggtatgccgcccaagcgagagattgagttccggatagatcttgctccaggaacaactcctctgtacaagcaaccctaccgtatggcagcaaatgaactggccgaagtcaagaaacagttggaagagttgaaagaaaaggggtatatacggccgagcacttccccctggggtgctcccgtgatttttgtggaaaagaaggacaagacaaagaggatgtgtgttgactacagagctctcaatgaagttactatcaaaaacaagtaccctcttccccggaccgatgatctgttcgatcagcttaaaggtgccactgtcttttcaaaaatcgatcttcgctccggatatcaccaattgcgtattcgtgaagaagatatcccgaagaccgcgttcaccacgcgatatgggctgtatgaattcacggtgatgtcgttcggtctaactaatgctcctgccttcttcatgaacttaatgaataaagtgttcatggaatacttggataagtttgttgtggtcttcatcgacgacatcctggtgtactcgcaatcagaggaagaccatcagcaacatctccgtcgggtgttgggaaagttgcgggaacatcaattgtatgccaagcttagcaagtgtgagttctggttgtccgaagtcaaattcttagggcatgtgatatctgctaaaggagttgctgtggaccccaaaacagtgaccgccgtcactgattggaagcaacccaagacagtcactcaaattcacagctttttgggtttggccgggtactaccgaaaattcatcgagaatttctccaaaattgccagacccatgacgcagttgctgaagaaggaagaaaaatttgtgtggagcccgcaatgcgagaaagcgttccaaactctcaaagaaaagctggtttcctcgccagtgttaatcttaccggatactcgcaaggacttcctggtgtactgtgacgcttcgcgccaaggattggggtgcgtgctcatgcaggaaggtcatgtggtagcctatgcctcccggcagcttcgtcctcatgaaggcaactaccctacccatgatttggagttagccgctgtggttcatgctctaaatatctagcggcactatctcattgggaatcgctgtgaaatatatactgatcataagagtttgaaatacatcttcactcagtcggatctaaatcttcggcagaggagatggttagaactcatcaaggattatgatgtgggaatttactatcatcctggtaaggccaacgtggtcgccgacgctctaagtcgaaaaagccgttgcaacactcttggcgtccatgacattccaccggaacttaatcaacagatggaagccctgaatctaagcatagttagtcgtggatccttggctatgctggaagccaagcctaccttgctcgatcaaatccgcgaggctcagaagaatgatccagatatgcatgggatcctcaagaatatgaaacaaggtaaagccgctggtttcacagaagatgaacatggaccctatggaacggaaatcgtgtatgcgttccggacgacaaggaacttaaacagctgatacttcaggaagctcacgaaagtccttattccatccaccctggcagtacgaagatgtacttagacttgaacgagaaatactggtgggttagtatgaaacgggaaattgcagagttcgtggccctttgtgatgtgtgccagcgtgtcaaggcagagcaccaacgaccggccggacttctccaacctctccaagtaccagaatggaaatgggatgaaattgggatggatttcatcaccggacttccaaaaacccagggcggatatgattctatatgggtagtcatggatcgactaaccaaggtagcccggtttattcctgtgaagaccacctatggagggaacaaactagctgaactctacttcgctaggatcgtgagtctccatggcgttcctaagaaaattgtatctgataggggaagccaattcacctctcacttctggaagaagctccaagaagagttgggtacccgattaaatttcagcactgcgtatcacctgcagacagatgggcagaccgagcgtctgaaccagatcctcgaagatatgctgcgcgcatgcgttctagatttcgggaagacctgggataagagtctcccctatgccgagttctcctacaataacagctaccaagccagcctacaaatggcaccctacgaagcgttgtatggacgcaaatgtcggacaccgctattgtgggaccaagttggggaaagccaagtgttcaggactgatatcctgagagaagctgaagcgaaagtcagaaccattcgggagaatctaaaggtggcccagtctcggcagaagagttatgcagacaaccgatgccgtgacctggaattcgcagtggatgactttgtgtaccttcgggtcatgccattgcggggcgtacacaggtttcaaacgaaaggaaagctcgcacctcggttcatgggtcctttccgtatcattgctcaacgcggagaagtcgcttactagttggagctgcccgcatcattgggcaacgtgcatgatgtgttccatgtgtcgcaactcaagaaatgccttcgaatgccgtccgagcaggccgactcagagcaaattgaagttcgcgaagacttgacctacgtggagagaccggtgaaaatcctggacgccatggagcgcaggaccaggaaccgggtaatccgtttttgcaaggtccaatggagcaaccacgctgaggaagaagctacttgggagcgtgaagacgagctgaaggcagcccatcccgatctcttcgccagttcttccgaatctcggggtcgagattccgtttaggggggtaggtttgtcacgtcccaaaacgaccctaaaatatatcatctaaattatgcctagaataattaaaatccgtgtgaaagcctccaaaaattaaaatgtgcaaagttaaaagtcaaataatgcttagaggatttttgtatatttcctaaaagcctaaaatacgtaaataaattttagtggaattttcagagcacaaataataattgttaagaaataaacaaagttaaaaggttttataaaaagaaaaaccctaaaaagtcccccttccctcccttgggctggcccggcccatctctccccccccctctctctctctcctctccccacggcccatccggcctctccccacgggcgcgccgcaactcggttaaggaaaatatccactttccaacccttcctttcaatattggagccgatagcatgtacttgacaacgtcggccttgcatataacagtacactcgttggacagtagataatgcctcaaccttgtacacgaaaaatacagacacaagcataacttctccacaggggaatatctagtttctgcatccaagagccgacgactgagatagaatacaactcgttccttcccttccaacttctgaatcaagactgagccaattgacttctcaccggccgataaatataacctaaacggtattcctttctgtggaggaatcaaaacaggaggagagctaagatattccttaatattatccaaagacttttgctgctctgccccccaaataaactgctgatcggttttcaatctcaacaatggtgtaaaaggttctaaccttccagacaaattagaaataaaccttctaacaaaatttatcttgtcgatcatctcttgtaattctgtcttattctccggaggctgaatcttcttgatcgcattaacactcctttgagttacctcgatccccctctcatgaacaagaattcccaaaaactggccagccgatacaccaaaagcacattttgtcggattcatcttcaggccatattttctggttctctcgaaaaccttcctcaaatcagctatatggtcctctagttctttagacttgataaccacatcatcaatgtagacttcaaccaaccagccgattagatcatgatatatgtaattcatggctctttgatatgtagctccagcactcttcaagccgaaagtcatgacaacccatacaaataagccgattgcaccaggacacctaaaagctgtcttatgaatgtcttattcggccataaaaatttgattgtatcctgcgttcccatccataaaacacaaaattttatgccccgaagcagcatcaactagttggtcggctactggcattgggtattcatctttcggggtggccttattcaaatttcggaaatcaatgcatatcctgaccttgccgtttttcttgataacaggaattatactagaaacccactcagcatatcggcaaggacgaataaaaccagcatcatataatcttttaatctcagccatgactggttcaagcatgtcggccttgcatctcctcggaggctgttgacgtggcctaacccctggtttgataggtagccgatgttcaacaatcgatcggctgagtccaggcatctcgtaatactcccaagcgaagcaatctctaaactcttttaagagctctatcagcttggttctaaactctggagataagttcttactaataaatcatcggccttggccgatcgcctggacctatgtctacttcttccaaatcatcggccgacatgaaaccttgaccttacttgtcatcgagatcatctaccgtgtccttagtgtagacatttgaaccctccacgacgccctcaaaataatagcttgggttctccatgttcaattggctgtatatcagaatcggatacttttagaaaatctccatcccagacttttccagataaacaatcaaggtaatccatctcccaaagagctaaatcggcactggcaacattaactgacctgtcggctggcacgatctctattttgtcgccttgccactgaatcaaacattgatgcatagttgaaggaatgcaacaattggcgtgaatccaatcccttccaagaaacaagctgtaagaacctttcccatcgatgacaaaaaatgtggtaggaatagtcttactgctgactgtcagctccacatttagaacacctttggtttctaatggattgccaccaaaatctttgagcaccatgtttgtcttgatgacatcctcggcatttctacccaacttcctgaacgtagcatagggcatcaaatttaccgcagctccaccatcaaccatcattttagacatcggcttcctattgacgtagccgtttatatacaatggtttaagatgccgattctctgccccctcgggtttctcgaacactgcctgttctggtgatggaaccaacttagccgattcctcttccacctcgtcgacatcggcttcatcgatcccgaattcggctggcagggtaaagaccatgttaaccggtgctgtcacaacactcttcccttttgccaacctctttgcctcatcggctgcaacatcatcggctataggaacttgattcttaacacgccactcttgccttggctttgctttcttcagccgatgattaacttcttgttcaacctcctgaaggcgctccttgttcctcaatctttgaacccttcgcttctgattcttcgtgaaaataccagaaggacaccattgagtcttcctgattacattttccttttggccatgatcttgatttactggacccaacctttgatgaatggaaactctcgtctgccttagccgattgcccctattatatgatcgacttgagctctcgacgatatcactgcacccacggctgttttcaatagatggcaacctcatcccttcattccagcagaatctaaagaactcacaaccccaatgaggatcaaaaccatcatcgtatttctcatgatgcttctcctgctgcttgtcatacttcttctgatatttgttgataatcttagccgaattcacctaaaaaccccttgcacgggccttgtcggctgtttggccagctgtatgcaccatattaacaggaaaagggttaccatcgaccttcatcggctttttggagtcatcaatcctaatcttgcctccctcaatggccacctgaatctgctttctaaaaaccttgcaatcgttagtagaatgggacccagaattatgccatttgcaatacctctttttgcctaattccttagccgatgggattgtatgaccagcaggaagttgaatttgcttctctcggagtagcaatcaaagatcttgtcagctttagtaatatcaaagtcatacttctcctcttttccagaactttttacccattggcatggtatgacctttttactcctcacccactcggctgcagctatttcagaattgttctcatcatcatccgacccatacatgtacggacaaacatgattaaccttcttagagtttttactaacttccgcagacctatgctcatgcaaggttactttctgtatcagatgtgacaagctatcaaagtcttcagacgagaatttcttcctaatcggagcaatcataccctgaaaggccagatcggctaactgggcatcagttaaacacaagctaaagcatttgttcctcgtctccctgaatctctgaatatactcgtgcacaggttcatcatgccactgcttaatcgctgtcaaatcagataatttcatctcatgaaccccactatagaaataggtgtggaattgcttctccaaatcggcccagctattgatcgacccatacggcaaagaggaaaaccaagtaaaagccgatccagacaaagataaccagaataacctaaccttcagagcgtctacagcctatgcttcaccacactgagctaagaatcggctaatgtgctcataagttgacacaccatcttgtcccgaaaatttggagaagtccggaactttgaaccgattgggaagaggaactctctcaaaccactcagagtaaggctgccgatacaagcttccagtctcttttggtttaagcccaaactgttccctcattatgtcagcaatcacatcggcccacggttgttgctgagctaccccttgtgactgttgctgcatgggctcgaactgaccgtattgaggcgcaaactgaggttgagccaatccccctggctgatattgggcttgcggggaaggagactgatattgataattcaagttacccccttggtaattatgaaggttcggctgggtattacgtaccaaacgctcaggaacaacttgaggtattactgtgccatccggctgtatgtggtgaaccaagtgttatgggacaacttgatttgaaaattgttgtacaagctgaccaccaggcgttgcaaacccggccgatgcgcctattgaaccttggtgctagatcggctgaacgatatgctgtcttaacagcgtctactgaatcggctgcagaggctgctgtcttggtggtgtttgctgaactggttgcatgacctgttgctggattggttgcacaacctgctgaattgggggcgtctgctgaatcggctgctgctgtattggatcaacaatagattgaggtggcagaaacgtggcagcaacctgatcttgggtcagccgattcacaacctgcccgccatgctgtggctgctctcttattaacaaccgagggttcactggctggcctagcgccattgctgatggaacaggtaggggagttgacgccagtgccgtcggctgagatgttggtgcaacggagggaaccgcctgagttgatggctgaacatcgttaatcaaagaccgataatttggaaagacacctccttgcaaataaaccgggcctgcagcctgatgctcagctattgaaccatcggctatggacttcatcatgtttgataaggtattaactaacaccccagattgattgatcaaagcatgatgcacagtgtagtcaacccgatcttggaaattactgaaaaaatcttgtgccgcatcactattctgattaagatttcctccttgcaacccctcggcaccatcaccttgaactccatgcaccccgtcaccttgcactccatggactccttgagaattgtcaccttgatttcctagagagctgtcggtagcacttttgttactcagctgagccgagccatctggagcttgtttcccatctccatccttagaagaactggtccccggatcatcagcaaccacttttattttgtacttctgaacaagtgtcccctttcgggtctacatgaatgagttcaagaactgatcctgtgcttgctgcaacattgcttcaaactctttctctgctcaggtgtgaatctttctggatcgatcggcacgacgtttccttcattgacgtcaaacaaccctaatttcagcaccttttccttaacagagtctgggctagctggggatggtggtggtggttgtttctcggccatgaggacgaattgttggctgacttcttaaatgtcccaccgggcgtgccaaaagcgtgttgacagaaaacacgaagcctgggagatctgcttaactccagtgcaggtccaaagctcgccttcgaatgtatgagcgtgccagttgatttgatcctgtaatcaacaagaaatagaagcaaagaaaccacagttaaatctataaatgatagccgatcggctaggtgccgatgacacatcatttatctttgagccgatgtcatatacgaatcgatcggcggttataaacagatagtaaggaactaaatctattcgatcggctgtagatattaacgatatatagttcttatattaatatatacttaaatcaagtgattgggatagatcggtcaccatgccgagacagtataaatcacttagatcgaaatatatattaataacaggattatatatgtttatagcatagccgatcagatagatctagcgtgtatcggctaatactccgatactactctatatcaagatattaaaacaggtataatgtattaaacagaagcttaatatatttagattgcgacattatcttgacacaaagggtggatttaacatgtcattgaagcatatagatcgaatatggttaaatcagataagatcggctcaaactccgatactaccctaatcggcaaccagagtacaggctagagattgatattctaagcacgacttaagacatcaaactcaactgatgcagcatgaggtatgaaaagaagaacaatatctagacaatcaagccactggaagtttcatagagtggtagatatcttatataatctaggtcaacgtcactatttaaccaaatcaactgccttctggtaacagatgttagccgattgtaggttagatcatgatattgtcgaagattatctaagatatatgataacttgatgaattacatagacaagattagagtaccataaagatggaagcactaattccgagaacataattcatcataacaagttttacctcttgttgaagatcgaaatcgatgcagctcaacccgaaagcaagaactcgtcaaaataaaactaaagcaaaaaggtggcgatgcaccgagattgtattgaacgtgtgtgttaaaagttacatagggctcgggtctatttatacccgagaattacaagatatgtccaaaacggacacgactactatctctaacaaactcaaagataccataagtctttgcggcagacttttgcccaatcatatctctaaggaaattacataaaacatcctaattactagatacaattgccttctcaggactctatccatgtgcggcaatcaccttgaagcgcctcaattcaacccgatgtcatacatcaagttgcattgtcggaatcggttgcatcggcttacctagcccgactcaaacccagccgatcctaatcgtagccgatctggactctagccaattcctgctctgtttcctatttcgatctccgcctccaactttgcttcgatctaatcttctttcccgatgcagatattaccaaatttggttgttaacacacgtgtgaagtctgcggcggcacgggtcattctgggaatgattgcccggaaacccgtgaggaggcgatgtacatgggcaacaacaacgggtaccgtccacaaggaggtcaggggtggaaccaaccacgctcatattatcaaggaggtaacaataacggtaacttctctaaccagccctccttaaaggatcttgtttttgcacacgccaaaactactgattcgctaagtaaaaagcttgcagccaacgaaaagatcctagagaacaaaaatgtcaaattagatggcttcgcttccacatttcaaaaccagccgagcttcaataaaatgatagaaacccagttagctcagttggcatctttagtccttgcaaatcaatctgggaggattccagggcaacccgactcttccattgaaaatgtcaaggcgatcacgacgaggagaggtaagtccactcgtgatccaccgtatcctaaccctgtaggaactaatggggtgacaaaagaagtgccatctaatgactcggctgacaaggagattcagccagaaaagaccgtgccggaggattactgcgacacgcggctgctgccattccctcaacggagtaggaaaccgtcggtagacgagtagttcgcttgttttgttgaagtaatccagaagattcacattaatgtgccgttgttggatggaatgcaagtgccaacatacgcccgttatctcaaggacatactcaacaacaagagaccgctcccaacaacgaaggtggttaagctgacggaacactgcagcaacatcatactccacaagctcccggaaaagaagaaagatctggggtgtcccacgatcacctgctcgatcggggcacaacaattcgaccaggccttatgtgattttggagctagcgtcagcgtcatgccaaaatatgtcttggacaaactcaacttcacggtgttggcaccaacaccaatgcgcctccaactggctgactcattagtccgttacccggctgggatagcggaggatgtgccagtcaagatacgtgatttcttcatcccgattgactttgtggtgctggacatggacacggggaaggagacgccgctcatcctagggcgtccgttccttagcaccgcaagagccaacattgatgtgggaacaaggagcatccatttccatatcaacgggaaggaggaaaagtttgagtttcaaccgaggacggaacaatgctccaggtcagaatcaagtacgggcc

SEQ ID NO: 59508 - DNA, 17266 bp, Oryza sativa
  unsure (1)..(17266): unsure at all n locations
gtactggccaagaaattagagcagccggctcagaagagaccgcttccgcaccgaaatcaaagaaggtgtggaaggaaaagccaaaggcacccgctccaccacctccggagacgggtggaaaatccatgaactaaaacacaaggaggtactgtcttgcacgttggactttaaatgaagcgaccttcgccaacaggtaaattggtatgtatccgcatatttgctttcaacaatttgaatttttgcatcatcacatatttgaatttcaacattgcatttaggatttttgaattttgaggaaattcttcaaatgaaattttaagagcaaacaaaattaaaattttcaacaaaaatttactgtgccacgaccacaccgaccgttggaatccaacggccgaaagtggggccaattgggcccaccaggggttcggccgaacaccctggttcggctgaaccggccaggcaacggctccctgccacttttggtagggtaacggctagtggtccccatacgtcgattttgaccgttgtgggtgcactacttaagccaaccggccaggagaagggacttcaccccatttcaacacattttcattccctctccaaagtttgctctcaagatcattcaagctttgatagtttccttcagattaaaaacaaatttagttgcatatatacaagttgctttggtgaaactaaccggcgggtgaaactcttgtcatttctaacccccgccgagttagactattcttgctccattgtgcagtatgaggaggcgattgtctcgtctattcaaggggtccagttctccatcaagtcatcatggcgagtctagtactcgttcatcagctgatgtctcaatggaagacgccgacgctccgtgacaactcctaaacgacgctgacctcgaccttgtcagttatcgggagagacaagcgtactacatgctgagcgaccaggagtatgctcacacgagagaatactcaccggagctgctgaaaaagataggtatggatgttgaatttcactctatttggaaagctgttggttggcagagatttgctgtggtagatgagcctggttctcgtttgcttactttacaatttctgtgcactttgaagaaatagaagatggcatttcttttcgctttttccgtaaggagttcacgctcacatggaaaggtttgagtacacttcttggttttcacgattcctgtaaaatcgatctccagaaaggaatttctgggttcgagaaaaataggttttgggaagatatttctcgtgctctaatttgcaagaaacctagaacaaatgacatccataatcctacacttaggctcatgtacaaatggattgctatgactttgtttcctagaagtgatctgagacccattaggggagatgaattaattatcatgtttgccatggttagaaaaatcaaaatttctcctgtgaaatgtatgataaagcaatggttagaaagtataaaattctctgctcctgttgagtgcacttctctgattactcggatagcaaaagggctaggggtcgttagcgaccaaattgcttttatctcagccgctcgtccgcgtattgatgaggcttatctagtgcaagggcatattttgaaacatggagcagatggaacttcgatatactttttccccggttgtacaaatgaaatctcgttgccaaatgcgaatatcatttgtacaacttccataaactaaccattcccctgcagaccatagaagaatctcgtggaagtggaacatacagggagacgcgcaacatgacaaggaacgaacgagagagttcatcatccttgacacccgtgcagatgtatgaggcaggttgggcaccaactggggatgcacgcggatggacccaagctccacgccatagcatcggagtctcaacctgggcaagtgccagtgaggaccggtggcatgcgcctcatggcatccactggggggacaatcaaccctccagatcaagtggtgtgcctccatctccaagtgaatggcactcgagttcctcttgttgggacttgggtgaaatcactaggagaatggacacccttgatgtgcagacgggggagatccagtacaacctcacggaacacatagctcaaacacaagaatggctacaatctgctgatgctcagttcgtcaacatcaacaacatgatgcagcaacagcatggtgaccttcaggcgtactttcattatcaagggttcaatccttatcaaggaccctgagcgaaaaccaagcttggggggagacatgctccccccattgaggtaacttgtatcacattgcatattagctttccaattgcatatttgctttccaattgcatcttataaaattttgaaaacaacataaaaatttacaaaatagaaaataccaaaaagataggatagatttgagtcatgctaggtaagacaagctagttctctttgttgaaatgatgaatagttgctctgttttatatctctgatatatgggttcttggtaaatactctctcaaggattgaatataagtaggcaacaattatccgggaacctgaggtaaatgggccgcacttgctgatctaagtctaagcggttgcaagatatgagatagtaactaggagtagctatgatactgatactagtttgacttgaattccggatgtttttttttcccaaaatgataaattgagattttctcatttgatataaattcctaccagagacaaaaatgtgctatcatgattaaacagtatgcatttttgttgcttgacattccattgaactttgtcaaactcttgtgacttgtgttgatacttctcatgctctataatcaagatcatacacccacatatatgcacatgctaaactcctacactgggagctaagcatattccattccattttcatattaccaccaatataaattctccatgctttcatgtgttttctgctcctaaaaagaaaaatccttttgaagaaaaaaaagagggaaaggcatggttatgaaaaaaaaataaataaagttatgctccatcaagcatgagcatgatgttgaaaaaaaaatgtagccatgccctctcctaatcaataaaaaaaagatttttgggagaagaaagtaagcacaaaggagaagcattttttcttttatttttcctcatataccatttccactatataccacacacattatgcacgatcttgattttgagtatgtttagttatctgctttagtctaagtttttgacttagtaataaatgtgaatgcaagcgtgccatgtttggtctctaccgagctccacatataaaccttagagtaggaatcaaaaaggcatcatttggtgaggaattcaaattgatacacttagagggactaagtgaatcaattgaggaacttggttttcttttccaaaatcatttgaaaacttccggaataagagttgaataaagatcgggtgattggtgctctagttgttgttctgtctttcaaccgcccaaggcaaggagaagcagtgtctcgtgggaatcaggggtaagggtaagccaccgtgccaaagattatttaatctgagagagaatacatataccttgcacctgtatctttgagatatgcagcatagtagtaactcctgatcaacaaccaagtctttgtttcctttcgtccttcactcgggacaagcaaaggttcaagcttggggggttttgttgacggtcgttatcgatcagtttcgaccgtcaatattactaaaacaggagtgaactagtgatgcttgcaatgcatatatttgttagaataataatattccactagtattaggtttactaaccttttgcagagaatgatcataaagtggaggagaatcgacatcaacaccaacgataaatcaataaggcgatgtcgagaaccagacttatgcatgaatgggccacgaactcagaattgacacgacaaactgggccaaaattcacaagtctacgaagaggaacaacagaggaggctgctagctgagattgggctggatcgggccggccccaggttcggccgaaccagggggttcggccgaaccctccttagcgccatccgatccagggcttcacctggacggtgtggattagcccccaatgacagttgaagggcatttccgaccactccaaccgccacaaccatcattggggggctataaaaaagaagttgccattctcacttcactcacacaccttaagcaagagctctctcattcctctcaagtttagtttagtagtatctagctggtggaatagaaatagaataggaatcaggagtccggaagagttcgcgtatggctctagcagctttcatttcctcttttgtaagctttgtacttttattagaatactcttctatatacatttatgatattgaaatactttccgagtatatgagtacctactttacattatgttcttgttatattgaatgtacggctagcttatctgggagatgctttggtgcgggtatagtgtttgcttatgcaattactctatgtcatgacgataatattagagtagtatctggtagtttagacgtggtgtctagattacgggatatcattatttggggttatatattgcggatgagaggtaggccgctgatggtgacagctcagtaaaggtattcctccgcgcctatatataatcctaagttaatttcctggggagggtattcctccgtatttagccctggttggatggtcatgacgggctgtcgtaaggaactcggcagtcagaggtggcttctcgaagtaccaggagggcatcggatagagggtattagctagtatatcaattaactagaatgtatgtatactattgttgacgaaaaaatcgaacacaccggcctgggagatctgcttagctccagtgcaagtccaaatatgatgagatgcgggcgtgccagtcagtttgatcctgcaactgacaaagatatgcaaatagtagatcaaaacagccaatcggctgacaagccgatggagtagttccagccgatagtcgataatagccgatgtcgataccagccgatagcgatagggtttatgcactcggctatatgtccaatgtagataatgatataaaggcaatcggctgatgatgatgtaataaaataacaatataatccaatataaaccaatcggctagcaatgatatgataaataagcatcgatccaaaggttaaagcacacatcggctggaggtccgatgtcatgaaatccacaagattggattaaacagtgaaacctttgttgtcatcggctaaatccaacttatatgtatatgcaatcctcatgagccgatgcaacgtacagataactcaccggctgaaaccccgatgaaacccttattggcaatcaataagcaggctagagattgtggttctaagcacaacttagtagatcaaacttaactgatgcagcactaagtatgaaaagaaacataatatctagacaatcaagccgatgactgattttcagggtggtagatgcctatgctaatctaatctagcaatgcgatttagccgataccggcagaaaccctaaagcgagatatagccgatagagctaaattgatatgctaagattagattaacagagaaatatgataaataggtaggcaaatatatcatccaaaccagagcaatccaagaggtcgaatgtactgatgcagccttgaacgacgccgatgtagatgagacaattgcctgggccgacggaacattagatttaccccttcgccggagatcgaagacgatgcagccccgcgtcgggtgccaagttccgccggaacgtaaaaagcaaaagtagaagtaaaaagggtggcgatgcgccgaattgtattgatcgtagcgttagattacatagaccccgggtgtacatatttatacccatgggttgatagaagtcattgtcggacaagaaagaaactaacctaaagataaaaggaaaaaataaagtccttatcggacactaaactcactttcctaaagataaaaggaaactaacaaactatttttaattaatagataaactgtcatgccgcatcctctttaaactcggtcacttagggataagcttcctttagtagattgatttccttaaccgaatatagcaggaatccgactattggtgacttgataactcccataggctgattccgagatgttgcagccgataatgattctaagccgatgacgtctttgccgattaccaaatttcactgttaacaactatgtatattagaagtataggaatagacttcttttctcttttctttccacttagtttagataatatatgatgaggatgagtagttaaatgcttttgtgtcactctacccttggattatcttaacccctgattagaatatgattatcacaagtaatatataaattattagttgagttcgctctacatgatctttccacgggataaaataaatacgatacccttggaatactctcgggtgaaatgctacaatggtatatccgtgtgtttgctgatgaactctgtagccataatataccagatgtatttttgcgccattgctggaaattatatttctagtaatgtcgttaagaaatactaacaatgagtgagatagattgggtagacactagtggctgagtcatccatacaaaaaaacgggccagctcgatcggtcatcggctcgactatctcaggggtgttcgttttctaaaaaaaaaaaaggcacctataaccatatcataggtgcccgcttattaaaaaactggtttagatattattggtgccagtatttttaataaacaatcgacataagggattatatgcgccgatttctatatgtatatatgtatatgtatatatgtatatatgtatatgtatatgtatgtatatatatatatatatatgtatatatatatatatatatgagatggtggaaaggcgagcaaagtgatgtttttactagcacctacgaggatgtttcctattaggattttttatagtgtaaactcaagttagagatgagggacgacaaatggacttattcctattggcgttgtattggtgttgggtatgggcctcacattttattgggatggggtccccgaaggccagctctgtctaggattgctcttggaaatcaagtaggtccccaagcctccatgaacgcattctttgttcttcatctagaacctgaattcctcgtaataaatgaacgccgtcatgcatgctgaatctgctggcatgagagaaaactagaagtttttttataaaagaaaaaactaactagatggtttatattagggccagatctagaaaggattaacaggagggtctaaacaaactatacaaaagattatagtcctttttctaatggatgtatgacagaaaattttagtggggactttatgagggctcccatggttacaacacagatagtgggggctcaagaacccacagacccaccttatagacggtacgtagctgcgtctttggggactttccaccacgtacaatgcattacaattacgcttattattgcatttgcatgacctataaacttatttttcttatatctgcaggacctacatatgtctggggtgtgatacaacttacaagtgtactgtgttaaccatgtacggagtggcatgaatgcatgggctgcatgcatgcgcgtgaaacaggccggcagccactaggcaggcaagtagccgagagacctggtccagtctttgctcccgggccttccaaccactggatcggcctattccaattatatcgagatatttttctcactcatacatgcatgcaacgaattagtctgaatgcatgcgacattaccaatttgtgaccacctagcactagcagtaggtagatagcgagcgttggtgcgtgcgtggatggtggtggaaacgccgggtgtaaatatgtaaatgtaaccgagcgcggcagtgccaatgatgattgggggaggaacacatggccatgccccgcgcatgcatgcatgcatgcaatgcatgggccagccagccacaatgtaccccggcggaaacgggaaaccggaaatgaatggcagcgagagcgcctgtgactctgtgggcgatcaccaatcggcggcccttgcgctagggtcctcaacgccagtcacatgcaacagcagcagacagcaactttcccaggccgcacatgatagtaccactctcttgtacccgcatctgcacctctaaatcctaagctctctctctctctctctctctctctctctctctctctcgcaacgagctacaggcgtgtacgtgttgtacgtatacttgtacgtaactaggtatagcaggacacaacaactgaagactttgctaacagtactgactcttcagattataagaaagctacctctcgatctgcaggggtatccaatcgaaacagtactactgactcttcaggtgataatcaaagaacctaagcattcatgggctcagtctccaagattaagtgatagaaatctgaggtttagctaggcaaagtcttctaattaattaagttggagcaatgcaagaccaggcaaatgaaactagcacacaagttgcaagaccaactgctggcgtagcaaattgattccaagcgtacagatcgacagtttgtagatctatgtgtcaattaactgacaaatccatctatgaatgcatggtacatgtatttacagtagactaggtgcttggcaccgatgcaactattttcttattaatttatgacaatggcgtgcaatgttcttgcccatgcttgaaaaaaaacagagagtagcaaatgcggtttgaccaaaatcaactgagatcctctaaaagacggtcataattaatcagagtcaacttttttgtgcttagtactcctatctactggtacatcttatatatatttccatttatgtgatgaagagcgttgtttgaactttaagcaaaccatatataggttgtttgaaaatgcaaaaggcaaatcattttgtagtatatactggggatcttgtccatttcgcttttggaaagagaaaagcagactctctctgcaactcatggacacggcacatgccatgaccggaaattctgtggcacaacattttctcccactcaatgcttgcgtcgaaactgataagtgtgttatgttagttcgcatcttgcgcctgggctgacagtctatccgatccccaaacactacaggatcattagatcatgcgggttgtacgtctcttagcaactatatcaagttgtgaagatatcagtccggatgcgcatatagggtatatagcactagcagtcatcgggagtaattgcatactttgtttcactttcagtagcgatcaactgtcacaagcatgataaaaactaaaaccaacatgaagaaaccgagaatcatacaacatgttttcttttgacaaagatgactagcggtgtccataaatttgttctcattctctgtttatggaacaacgacatcggtttcaatcagaacgtcaaagtggacggaaccgctcaaatcacgttagccacactacctgcgccatctagatagccgcaggaggatatatgcacctgttcacccccagcccagtccattatgtggaatctattatactccatcattttcacaatgtaagactttctagcattgcccatatacatatagatgttaacatcaaaatgaatgtgggcaacgctagaaaatcttatattgtaaaacagaggaagtatcaatcaaggagctagagtagcctagcgctatagcttgtattaataagcaaatccggagtcatcaattgagtaactatttggtgaactccttaaacttttcctggacatagacactaaagagaaaaaaaaagatggagggcagagagagatgaagagatgaggaggccccagcttgtctggaagaacgtacagctaccctaggttttgagatggcatccaagcttaacttgttttttttccctcttccaccaaaacacacgaccccatcacccccgtggtcctgccccctcatcttgccggccctaccatgtgcacttgcacctcctcctcttccctcacctcccccataaatacccagccacaccgcccgctgcacaccggccatctccaccacgaactctccaagctcttcttcctcctgagcactctagcttcactgcattgctttgcagcagcaacagaaacagagagagagaaatacactagctgattgatccagtggaatttggtagctgtgatggcgaagaagatcgcgccggcggccaacctgaagcagatcctgaggaggtgctcgagccttgggaggaggcagcagcagcagggcgcggtgccgaggggccacttcccggtgtacgtcggcgagagccggtgccggtacgtggtgcccatcgcctgcctggagcacccggacttcctgctgctgcttcggaaggccgaggaggagttcggcttcgagcacgacgccgccatcacgcttccctgccacgaggccgactttgaagccctcctcgccgccctgactgcctgagtgaccgttcaatcgatgaggcgatcgaccacttacccggccgtcgtcgttggtggctgccgcttccggcgcacggtgctgcagcagctgcccggtcgctcggccggggcaccagagatgcacgcacacgcagtggcagtacggctggcattggttggagcttggttgtgtagtgtagaccggaaatgcaaacatgggagttccggccggaaaccgatcaatcaccgggcgggtagactctgcttcagctgcccggtggccggtgggggttccgggcttcttgctcgtgggattctttcacgaattcttgccggttcatgcagcaaaatttgctgcttttagctagctatctagcttagtgtacgtacgcgcgtatgtatataatgcggagaccaattgattgatttgttcctcgaatggttttgatcaaatgaaggagaacaccattgctcacctcaggcgcgcactgcctgatgtgaccttcttgataaaacttgatgatgattggcatatctcgactagctacagcgcctacagctagtcaggggcgtataatgggaattaacttgacaagaaagatgtgctcttgataaaacagcagactgaaatgcagactgcacctaccgtgcacgagagaggtttgaatttaatctccattacagtgctatttggtaggtttcaatcatggacaccccttccagagttcattagtagggacacccatggaaaagtagaaatggcgtacgggcgatagattcacaatctcactggatgctgctggtatctgcttttcaagctagctcctcactaccgtcgcctttacattatactcttggatgactctgtggttggcgtagatatgggtgtcttgcaatttgtcccctaacagttcgagtcgtacgtgcgtgtgcgcgaccatgtacgtctccaccaggccaccaccaaatggccaataagtttggttcacggtcaaggttgaatgggatatggcgatccatattttgttggatatggcgatccagttttttgtttggttaggtgaatatcgataaaactgtttggttgtagtgatgaaggtggatttggtgatccaatttttttgtttagttgggcggagtaggtggatgagcagatgtggtcacctctcactgtagagagggtgagtatacccccatcaaattcatatatactacaaatcacaaattcatatatatatatatatatatatatatatatatatatatatatatatatatatatatatatatagagaaaaaaaagaaaaaaaacaaagaaataggaaaataaaaaggtcttcggcgctcacatcaggcgcctccgccgagctcgccgctcccgtcgccgccaatctcgcatccggcgccgccacgaagctcgcctcccgccgccgacgagctcgcatccggcgccgcggccgagcgcgcctcccgccgccgccgccgacgagctcgcatccggcgccgcggccgagcgcgcatctggcgccgccaccgccactcgcaccagccgccgccgccgctcgcaacagccgccgccgagctcccgctggtcgccgccctcgccgtcgctctttcttggagaggagtgatgcgactgccttggtcgctcgccccgcgctcgggcggctgcatccggccaattcggccggatcccctcatccggcatctggggggaatattcctccccgggccgctccatcccacccctgcccaggaaccaaacacccacaaaaaatgggccgccatgtcctatccacctatatccctccatccaaacacaccactaggcaaaggttatgcttgtcaatgaagctcgcaaacaaaattaatgctctatctgtttcttttttatttcaagtagcattatggtcttgtatattgcgcggctagaatcattatattttttctcacataatagcatatatatttttatttttgtattattaaaatatattaaaatgacaacataattttcaattctgttctgacctggccaaactattcgatacgtgatatttatagtgtattgtatatacgcgataattaataattattttttgatttctaattttaattattttttattatatttctgtatggactctaaattacttatctttcaacagttcttatttttataatttcaaattttctttatttataaattttgttcctatatggtctctaaacccttctttccatatttcttatttttaaatttcaaatttcagttatttaaaaattgtatttctatataaactctagacttctctttcaacactccttttaaaaaaaatttgaatttccgttatttgtattgctatatggactacactcttcttttaatatttctcttttttttatttctagtttcatttatttataaattatattcctatatggaatctagaattttttttaatattcgttatgttttaattctaaattttcgttatttctaaattgtatccctatatggactatagactcttcttacagtattccttttctaattcctttattgcaggagtattactataaggtttctagcatcttcttccaatatccttttttaaaaattttgattttagatatttctaaatagtatttctacgtggactctaagctctactctttgttttcttatttttttaattttgaatttcagttagttctaaatgaacaattgttacatggatcgactagcctaggctgtaggagatatgcgaaatatatactactcatagaacacatatccaataaatgaatacacatactatgagcataaataaataaataaataataagataattccattaattcaaggggcaaatgctatttgaccctaaggagcttttaactatttgccactcttacaaatgttgcttaacgatttgccactaggcccacatgtcatatacacatgagagcccacatgtaattgatagagtatggtaaatcgttaattgccatgtcacaagaatggcaaatagttaaattttgcccaactattaaattgaccctattttttttaaggggcaattgcatctgtgcccctactttgaaagccaattgctgttttgcccccacttttagggtttgcatttttacccccactttttaaatctgaagtagccttctacccccacttgtgacaactgtttggtgggtcccacattttgtgttaaagaaataaaaacaaaataaaaaaaggttttagaaattatgtaatgacatttgtacccctgagggaaagggaatggatagggttcttcccgtgcgtctccgtgagtcgggtcgaaatcctagctagctagcgcgggggcggcggcgcggcacggaggcggcggcggcggcggcggcggccgcgcgaggaggccgcggccacgcgggcgtgcgccggcgcccgctcgcaggaggtccacagccggcagccgctgctcttccacgtggaggcggcctctcacagccgagggcaagacaaggcagaaaagggaaagttgttggccgcatgcttgcgccgtgcatcatgtacgcgacggggagggtgtccgcccccaccggcggctgctgcgacggggtcaggaccctcaactccgccgccgccgaccaccagaccacctgcgcctgcatcaagcagcagacgagcggcatgggcggcctgaggcccgacctcgtcgccggcatcccctccaagtgcggcgtcaacatcccctacgccatcagcccttccaccgactgctccaggtaattcatttgccatcaataacggttttgatctgtgttattagctgcagcttttgttaatttgcctatgtgttgtgcattcgcatgcagggtgcactgagtggatcaaagtcgtcaagtgatgcgacaatgataaaggagagatcgatccatcgatctgcagctctcattttgcggttgctatctgcatttgtcgtcagagatggagctatagaaatgcatgatgctcctccgttctgttatttcctgcttacattctgcttcgttaattgcggtttgttgctctatgcaatgaagaactggacacagagcgatcaacaattaacaaaaaaatctagggtacatgggctgttgtatttttttttggaacaattcacaactctgttgtattatccatgtacaactaaatgtggcgttgatgtgtagtttagagggttcagagtgaatgcataggccgttcaaagcctcacattataacactcacacaagctgaaaaaaaatgagggcaaaatcacacaaagctaaaaaaaatggaggcaaaactacaataaccaccaagggtatatatgtctttttctctacaactgacaccgttagttgtggcggttagaaatgagggtacacagctgcttcagattcaaaaagtgggggtaaaaatacaaactctaaaatatggggtaaaacagcaattggttttaaaagtgggggcatggatacaattgcccctttttttttaactttgctcatttgaccccgctttttaaaatcaaagccaccatctgagcctctttttaatagtccgttagtgtcttagttagcaaaatgaaaaaaaataaaattgctagtatgaactgaccaatatacccctgattataaataataaccttatccaagttacaaatctagagtcttcacccacacatctcggtggcacggctgggcgcatggaggaaggaggagcggcgggcggcggcgtcagcgagcgaagggagggacggcgatgggcgcgcgcgcttggagtagcagcagcgactgctgccaagcggagggagggagccagggaggggcggcggtccgcgcagggaggaggactgccagcgctggcgcgcagaggggaggcggcgcctgtgtgtggaggagcagcggcgtcggctgctgccgcgcggagggaggggcggcgtcggcacgcggaggcaggagaaccggcggcgcctgcaggcggaggagtggcggcacgggctgctgccgtgtggagggaggaggagcggcgccagcgagcgaaggcggtcggcgcgggcgcacggagtagcggcagcggttgctgccgtgcggagggagagagggacggcgattggcagtggcgccggcgccagcgcgctgaggggtggcggcgactgcgcgcgggctgacacaagtgctcgaatccgattgtgctctctctcttctgtcagttccggcgaactccaatgccattgacgtcggcggtggccggatggtcatccagccaacagagcacatgcccatggcacagcctctcatccccggcctgcagatcgacggcagcaacaggtcaacagcaacaggcagccactggcgccaccatcgtcatctcgacggccgagttctcctgcccggtgttggagagcgagcagctgaacactgtcctgagctccaatgacaatgagatgaactacaaatattaaaaaggactgaatgaaagaaaaaaaaatctttgatataacattggtaaatgagcaagggcaaaaatgataattgcttcacagttaacactgttatttggtcttcacggaatagggtcagctctgatgttcagttttaaaaaatggggtcaaatgagcaaacttgaaaaaatagggtcaatttagtagttgggcttcaaactagggtcaagtaagcaattgttccttaattcaaatatagtcttaccaaaatagtaaagaactaaacacacatcggaatctctaagaagactataggaccggagatactccaagcctatttctactaaaactgtagagaacacaatatagatagagagaattgctccttgaggtgtgtgttgggaagtgaaaagatctcctctatgatgaggatgctaggtctcgatctttcgataggtattgataactctcgatttggcggaaacttgacacacacaatccggcttccgatcaacacgatccgaaccatgcaaatcgcagcaccacgtctcctctggttatcaaccgtgcatcgtccggttgaccacgccgagaaggctaatccctgcatgcgaatcgaagaacacaagcaagaataagatagattgcaacacaattgcatacgaatgattaagcactcaaatttagggttccacaaaccgacctagcggcgaaactgcaatggcagaaataatctaagcaaaactcgactctaaacgatgacgactactaaatatatataattagggacgtcctagggttgcccaatggcgcacgcccctttggtctaagcgacgacataattacaaggtctaaaacccaaatcagatttggactggataaggtatgaggcttgttttgcagatttccgacaactcggtgggaattttaatgtatgaccaaaaccatctgaaagtatactccatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 59509 - DNA, 854 bp, Oryza sativa
aacaagagaaagaaacatacctttttcatagatatttcgaatatgttccctatggtaactgggttcatgagttatggtcaacaaacaatacgcgcagcaaggtacattggtcaaagtttcataattaccttatcccacacaaatcgtttacctataacgattcactacccctatgaaaaatcaattacatcggagcgtttccgggggcgaatccactttgaatttgataaatgtattgcttgtgaagtatgtgttcgcgtatgccctatagatctacctcttgtggattggagatttgaaaaggatattaaaaggaaacaattgcttaattatagtattgatttcggagtttgtatattttgtggtaattgtgttgagtactgtccgacaaactgtttatcaatgactgaagaatatgaactttctacttatgatcgtcatgaattgaattacaatcaaatttctttgagtcggttaccaatctccataatgggagattacacaattcaaacaattaggaattcaactcaaagtaaaatagacgaagaaaaatcttggaattcaagaacgattactgattactagaatttttttgttagaatccaaaagttctttactaactagaaagaaaaacgaatacctactgcttattgcaaattattcctgattttaaaccagagtagattttcgtgatgtgatttctaactatagaaagaacttatatacaatatacaaaaaaatttcctaatcccttttttcttccttgaatcttttagttttagtcagttcatgaaaaaatttatactattaatttcttcttatccataatggatttacctgggccaatacatgaa

SEQ ID NO: 59510 - DNA, 1495 bp, Oryza sativa
atagcatttctcttctgcatatctatggagttttgcaaaacccaaacacctcagagatagatatagaggtaggaatttgtcgaacgaaccacactcctcgtagacgtcaggagtccattgatgaaaaggggctggggaaagcttgaacccaagtcctacagtgatggatataagcgcaattgaaattcctggggagttatacatttgtgtattgataagaccgttcacaatttcttgaagctcgatctcccccccagatgaaccatatagccaagagaaaccatgaaccagaatagaagagcttgccccacccatgagtaaatatttcatagtagcctcattagaccgtagatctctcttggtatatccagacaataggtaggaacataaactgaaacattctggagctacaaagatagttattaaatcgttagcaccacataaaaacattccccctagagtagctgttaatacgaataacagaaactctgttatagccatttctgtacattcaatgtactctaaggtgctactaaatggaaggatcttatgaacgtccatgaatgcgaaatcatagatcgaactgccgaattggcaaaattcggtgctatcatagtatctgctaagttcacgggctggagataagcggactcgaaccgctgacatccgccacagggtaaaccaccgcctctcaggcctccccgacgggttctaccatagaggccaacgatagacaataactcccccccgaacacagcttacaactttcatcgtactgtgctctccaaagagcaactcttctcaaaatctcaaaacaaaaggtgctgagttggaatcccattctaaggattcttgtggttccggggaatccagctacaggagaaccaggaacggggagctctcccctttttccgcccgactctttgatcttaaacttaagaatgctggttttaagaacgagtgattgcccttctccgacccttactgcccaaccggagagcggacggctaatgtgttccacttattgaacagggtctatggtcggtccgtgacccctggacgccgaaggcgtccttggggtgatctcgtagttcctacggggtggagataatggggtcggtccatggattttccttccttttgccacatttcgctcaaagggttgaagggagatagtgcatcaagctattcgcaagggccaacttgatcctcttccccagggatcccagatgagggaagcctaggagagccgccgactccaactatcgtccatgtacgatccatactagatctgaccaactgcccatcctacctcctctacctttttgacagcccatctttttgtctcagtagagtctttcagtggcatgtttcagtcctcttccccattacttagaaaaagtgagccaccggttcaggtacaagatactaccattaccgcctagacaattagacagccaacccgtaatcgcaacgacccaattgcaagagcgga

SEQ ID NO: 59511 - DNA, 2010 bp, Oryza sativa
tataaaatatgtccttaggttttatccacttggcttatcctacagtcgagatggctctgataccagcttgtcgcgaccgagaaaattgcattttcccgaacgctagtgtattaatccccgtcccaggaaaagccagggtacaccatacaaacatgatataaaagacacatctttattatatcgataatatttacattattacaaaggcacttaaggcctgacaatcaaaaataaaaagcagcggactagcgggcctacggctccatcttcacaggcgctcaactggggtataagccaagactccacctaagacttcttctccaaagcatctcttactgaaggggggagaaagatagagcaagaatgagtacaaccacagtactcagcaagccacaccggcagatgcacgactaatgcaagggggtacaaggggtaatgatataggggttaagttatgcagaaaacagcatttaaaagtcacttagttgcccaaagccattttataaagacgatcctagagctacacagtattattaatcaaggccgtgaaccctcacgaacctgccttaacccaaggcctacgatgatccagaccgaactggcaacccgaccctgggtcccagctcgtcccaagccaacccaggccaaccattccacattttagttattgagcaaattttaagaattaaaacactgacttgggtacattgctcggcttgcccataaccgagggcgcggctattcgaatagattatactctgatcagaggtgtacatctttacccacaagacacatcttcctcacgtgtaaccacgtgccacataccaccacggtatacggacggaagacgtgacatagtttccaacccatcctagccatagacaagagtaccgacccaaccccacctacggccggaacctccgggacaggtaggcaggattgagcccctagcagcaggacaccagccctgtgccatgacatctcgactaccgggccgcagctcgtgtagccttcatttgtcctagagatgtccatcgacccccgacttcgtccatctccatccgtgtacttttgtttataaccagactgagccacaaactaagccttacccactagacatgtggaagtacggtagtgctttgcaacagaggcccgagcttaattcttatagtggccggggtgctacttcccacaactggcatgcacccaaaccccaccggaaaacaggttttaggggttttgaaagaggaagagaggtgtatgtccaattccaccataagccaaccattccatagtgtccaaatgatatgagaattcccaaagtctaaagttataaaaaccacctaatgttgtcctatttaatcagcgaagcatctacctaaattcatactagtggaaccatgaatagagtacccactagttggggtattgttttcctagggtgaacaaggtaataataacaatagcaataataataaggtcataacaaaggtaaataggcatggctaaataaaacagtgataacgcgggaatttaaataaagcgataatgcaataatttaaatcaaaataattttataaactgggattcaatatgttcaaggatgatgtgacttgccttgctcagagagaacggccttccgaaccttcggcgacgaccgaaaaccacgcttcgggaacctccggaacgacgaagactacgcgaagcacacaagcaaagctacaagcctataaagaagcaataacaatacataaaaagaaagcacagggttctttaggttataacaaacattaagagacttgaacgggtcgattcggagttcgtatgaccaagatatgatcatccgaagtttagtgctgttatatggagatttgcggattattataattaagctttgcaacaataaaacatgtcgaagcgctagcctggaaaagacaggaaggctgcgctgttgacatgcggaccccacatgtcaacctaaaggaccgcggtagaccaggtacacagaga

SEQ ID NO: 59512 - DNA, 3797 bp, Oryza sativa
gatttccccctctttattgcgcgcgggggcggcgggatgcggcggaatccgcggcggcggcggcgctagggcacgggcgaggcggcgggcgcggcgcgaggtaggggatgacgggtgggccccacccgtcagcgagggtggcgggcgggcccgcccgtcagcggcacgcgcgcggggaggaggccgattgggccgcgggggagaggagagagagggagggaggtgggccgagccggcccaagaggggaaggggggggaaaagactttttagggtttttctttttataaactcattttaactttgtttatttcttaataattattatttgtgctctgaaaattccactaaaatttgagggctctttttagaccaaggagaatttaacaaaaattctccgggccacatttgaatttttcttgtacgtattttagtgtttgccaatttcttttcaaattttaattaattctattattccttttagaaaatgatttttatttcgggatgaatttatcaggacgtgacatcccgacatcatgcttagtgtgtgtatgtgtgcccgttttcaagcggagcctaaagagtgccatttgattgccgtcaagagaattctaagatatttagttcacactcctaatcttggcttgtggtatcctaagggttgtgactttgagcttttgggctattccgattcggattatgccgggtgtaaggttcatagaaaaagtacaatcgggacttgtcaatttcttgggcggtcccttgtttcttggttctccaagaagcaaaattccattgctttatccaccgccgaagccaaatatatcgccgccgattcttgttgtgcccaactcctttggatgaaacaaaccctaaaatactttggctacaactttaccaagatcccactcctatgtgacaatgagagtgccatcaaaatagccaataatcccgcccaacgctcaagaaacaagcacatagatattcgccaccactttttgagagatcacgagactaaatgagacatatgtcttaccatgtgagaaccaagacccaattagccgacattttcaccaagcctttagatgagaaaagattttgcgagcttaggggtgagctcaatatcttagactctcgtaacattagctgatgggtggttggctaattcatagccaaacatgtgtcactaaaatgtaaattaaaaaaaaaagagcttttgtgtcttgagatcacttcttgtgtagaagatggtcttgatactaggaataaagctcaaacattccctctattatccaaaaacccttttgtgaaattttgcaaaattttttgtgtgtgtttttattgagaaaatttggtttttatcccttcttgtgatgtatattgaccattcttatgtaatgttgattgttggctggtcatatgcatcataagtctctatatattcataggtttttatttctaaatcattgaattctcatctattcctttgaacttgggcctgactgccctctgttctgtcaggccggaagttccggtcatcccagtccagaacttccgggggtcgggggtataaatacccgggggagcccgagcctgttctctctctcctcacttcttctcctccctgattcccaaaccctagccgccgctacagtgctcctctcggcgattttctattcaaaccgtggaaatttgattcctctccgtggaatcaactacattggtggctaggaggttcatcccgcgatcgatttgcgatttctcctctctaggtagcacttttgatcttctcttttggttcatcatgtttttgccccgatctctaaatatgtgaacctagggagaaaaccttttggatagaattgttcctgctaccttgtagattgccgatctataggattttgtcacatgcactggcctggttaaatcctctgttcttcagttttgtaggccggaagttccagtgttcttggcccggaacttccggtctctgtctagccagccagtaaccttgattctgctactgtttcttttaaccattgcactccaaccttgttgattcttgttgcagtggtcattatgcctcgtgagaagagacagaagctttcacaagatgttcctgctgactcgagccccccagttcatggtcctagggggagattgggcaaagaaaacgttggagatttttacagtgggagtcagattccgatccatttcaggagggatggtagcattgtcattcgtgatgctccccgctctccctctccagctgcatcagagtcagataatggtggcaatgaggatgagcctggttctgaaagcaatcccttgagactttacaagacaagggttgttgatcctgatcctagacgccaagagtgaactatctgaaaaatctgctcaagtgtggaaaggacaatgatgagtcctgagctttgcctgctaactctcaggatgacagattcaggaccttggtgcaggttgattggtataattctgtgatcatgcgaagatctcatccagtggtagagatgaagtggctagactggcagtacatgtcctcaaagaacaacttagttttcaatgaggtgcgcaaggtgtgtgagcgcaagcacgtggcagatttgttagccttgcagtattcctggaatgaggaagtgactggtcagttctactccactgctttctttggcaccaccaagaaggggcttgattttgtgaagtggaccattcaggggcagcagtatagtgtctctatggcacagtttgctgcagctttggggttagatgatgatgacctgagtcgcccacatatcattgtagaggatgctctgtcaccgaccaacactacctttatgtatgagaaggatgctcccaaggattgtttggggactactcgagggttgcgtccatactatagagtgttgtactcgatcttcaggtggtctttgctccccaaagtgggagatgctacagctctttcaggtaggcatgcgctcctcctcagtcgcatgcgctacaacaagccagatttcagcatcatgaagcttatctggagtgagatctacgagacagtgtgtgagccaaagaggggttgcatctatgctccatatatcatgaagatgattgaggccaagactgggatttgttatttcaaggacaatcaacacaagcctttttgtcctcatgctcccactacttcaactacttctactgccagagtcactcgtgcttccacctcagctgctccttcttcctctgctgcaccacagcgttctgagtcttcttctcccataaagaaggctctcagggctatcttttgtatgtgtgccaagatagctaagaaggtaaacaagatagagaggcgtcagaaggaagattggattgcagcaggcaaggatgactctgacatttctgatgatgaggagtttgttgatccttttgctgcttatgagactgcttgagacattgctagtggtgagggtccctctggcacttctcgtttcttcaatgaggagtcctctcactccgaggagagcagcgatgatgaggagtcagatgcacctactgagaatattcctacagatccagatgaggcagtggacgccgccgggcaagacatcgactctcctcactccggcgacaccgagatcattccttctgatggcgatgatgatgaggcttgatcctcttcttcccttgtgatattgtctctttttggtgccttgatgccaaagggggagaaaattgcaatcgaagggggtcaaaattttgtttttgctgcttgctgcctgctctg

SEQ ID NO: 59513 - DNA, 756 bp, Oryza sativa
aactgtcagtgttgccatgtacagtgaagctgctatgtccatcatgttcctgcaagtactccaaaatgaaactcttgcacaatccaaaagaaatgcacaccatcaaaaactcacctttccatatatacattcccaaggtttgtcaaagcctgagggtgagaaggctgaagagcaaggcatgtctgcaacaagaaaaggcatgactcacatcaacgtaactataacaaaaaaaaagtaaaactattgaagacaaaattcagcagtttaatcttctatggtaacctggtagcaactaatagcctcttcatttctcccagcatcttttagagcatttccctatcagtggaaacacatcatataaggtcttataccaaaaggaacaacgatttagtaggcatacaagaatgaaaaaccaaccagattattatatgcttcaacataagatgaattgcaatggatggcttgtctataacttagaatagcaagatccagttgcccttgttcatggtaggcattaccaagattccctgaaaatactaaaaattaatccacatttccacaacagagccatcattcggggtcagttagtggttgctaatatgctaatctgtcttgtacttatttttcaataaattatgaaaaggcagttgccaaaataaaaacaaacaaactagagtccaactgttgactctactacacgtgatttgatatttgaaacatgataagatatccatttgaaacttatattaaaagaag

SEQ ID NO: 59514 - DNA, 11134 bp, Oryza sativa
ttcccaagttcaggtgtgcatcgtaaaatgctggattgcatttgattgcttcctgatgtttcacaaaatcttaaaagaatcagaatattgctggacctgtcattatcctaaagtatgctataataaaagaatctgcatgctgtagaacccctgatataattgattcgtttcagaaattttttgatataatgaattctgatcatgacaaaacagcattgtcaaggctccaatgacaagctatgaatgcatcaaagcatctacaacattaataaatgtcaaagtcaatgcaaaccgcataccttgtagtagagagctgctttattgaaatctccccattgcatgagaagtccagcaatattattccatgcatttgcaaaagtaggctttatgtttagagcatccaagtagtgactgtatgcctgaataaaatgcaaatcacataaatattgcaaatgaaaataatttgaccattcatcagtcatcttattactatcatcaattcaatgcagcataacaggccagcatcagtaatttttactttgaactgaattggaggatcctccactataattagaccctattctgttagttcaacagaattgttctgaactaaaatcacaacatagtgctacaaaatatgtcatttaaccagccacttatcaagatgctaggagaaattaaagctgtcatttagcaagaaaaatcagggtaacatcaggcatctgtgggcaataaaaagtgtattaggaaacatgctagattggtacaaaatagatcatgatggatagcaaaaaaaaaaagttacaaagtaaatttgatgaagagcttgtaaaaatgaaagaataactaatgatactacggacataaacaatttgatctgcgatttttttattttgctacttacttctctgtacaatccttgtgccttcaaaacatcaccaaggttacaatatgcatcagcctatagtcacaacacaatcaattaaaagttccacactgctgcaattaattgagaacatgtgattcatcagaatgcagtaaataaaagcgttggttaccagatgaggatttagtgcaagggcttgatggcagcactcagctgcctgactgagatttccttttcgagtataagcattagctaagtttgtccacgcatcagcaaaggtaggccggagctacagaagtagaatttgttagctcgcaagataaaaaaaaaatcagatagttacaatgataaaatgcatgtaccagcatattatgtgtgtcaccttagataaaaaggttaattaactcagacagtaaatctacctgtactgcatgcacataaaactgaatggcattatcaacatcgcctttctcctgcagcagacaataaagttgaaaacacgccaacacttaataaccccaacgattatggcctacacttttccaaaatgaaatggtctcaccctccaggcattcgcaatgctgttgaagcactctgggcaattcggctggattgcaacagcctcctcgttcttcgcgatgcacatgtcaaactctcgtagctaaaccaaatccccaaatcagtataacacccacgccagcaccggataaccacggcacccaaaattccgaggagaacctggtaatagacggcgccgagcagcaggaggttctccaagagcctcgggttcgccctgtacacggcattgcagtgctccagcgccgctttgtaatcccctgctctgtaactctgccgcgcgatctcgaggcgcgcgccctcgtcaactgaaacccaccaaaaccgcgacgggttaacaaccccacgacgaaaatgaaaatctcggcgcaatcgaatcacggaacagcgagatgaatctcgatcaatcatcagagaggggaagagaaggccaggggttcctgatcgacacgaacgaaacgaaccttcgagggggtcgagccggagggattcgaccaccgtgcgcagctgctgctgctggcgcggggtgagagggcgatggtggcgcaccgcgccgtgctcctccacggcggcggcgccaccgcctccgcctccgcagcgcaccgagagcatcgccggaaagcttctccgacgatcggagaaccaaaagtaaaaaaaaataaaaacctaacccgcgcgacggcgccgcgcggcctcgagctttcgcgtacgagtcggggagggggttggactctctcgggcgatatcgccttttcgccttctttttttttttcctttttttttcggatgcgtcgtcgcgttcgtggggattgggaaagcgtgtgacgcggtcagcgtgcggcgccgctgggtttggaaatcgggtgggtgagcggagcacaccggaacaccagtgctgcgcgcgacgtgcgtggccacgataggaggggacccagaccgtcggattgggtttcggtggtcgcggcgttttttggacggtcgtgattgagccgtgtgtggctgggctgggcttggggatgattcttctggtcaagtcatcgctgttgagcccatcaatggcacaacaagcccatttttagccttctctccctacagcgaggtgagtacaactgacaagtctgaaacccaaagaccatcacaaagatcgacctcttgagtccttgcgtgagaaagtacttcgtgtctgaggaactgagaggcagttgattgcacatcgtgcatgaggatccgtgaagctgtctttgatttttgttcggtttctattgtaaagttgattgtttttttagtactttccaggtcttgtttttatgcaaagtacgagtcggttgtacctcttttattgccctgtccgttctcaaacactcctaagtttttgagtatcgtatgaaactgaatctcatcatcttgactcattaatacatgcaagattacgattcggtatgtaaaaaatggcagtaacgatgtgtcgatgtttactttcgaaatttcagccccctaaatcctaaactatgtctgttgggaaaaagaaaggagtcagtactgtgtgcacaacaagaccagactagtagagaagcagcccggaggagaagtcgctgccaatggtttcacttcaccgggtcggatcaccacgaaaacgcgagcacgtacacggtacgtccaccgcgaaaggacggcacacacacacactgctcccgtccacacggcccacaaccaccaccacacacgacgccgcgcgcgcatggggtcgacgtttcaaatcaaatcagcgtcgtcgtcgtcgtcatcatcatcatcgcctcacctcgcctcgcctccaccccgaccgatatgatatgatacatcgtactgtacgtacctccccttactacgtgtccccggacctcaccgtgcaacgtcgcacctccccaccacagaacacgtacaccacccgcgcaaccaccgtgtcgcgcacgggaatctcgccggctcgatcgatcgccacccacccgctccctccccgagtccgagtcccctcgcgtcgtcgtgtgttcgtgttgcacgagagggcgggctactacggggattgtgtgccggttgggtgcgagagcgcccgcaataatgcgttcgttgcgtgcgcgcgcgcgggggcgcccacacgacacgacgaccccaacaccggcgtacgtagtgcgtggcgtccctccggccccgtcgtccgtctcccctcctcctgcccgatggcgacgcggcgcgaccgaacgagggggggacgactcgtctcacgactgctcaccaacagcgcgcgccctccgcgcgatcgcatactgtttcgtccccccgtctcgcgcgattgcttgtgtcgggcgaaacgcatggcaattgggaaaaacggaggaggcgacgaccatgatgacggcgacgatgaatgaatgatttagcgtaattaggagagggatctacatcacgccaactacgatccagtttgcgacgctcgcgtgggtgctagtgggcagacagtctagccattggggtcgccccggttactgcagcgccctgaaaccgatctgaaaccaccctgaactgaatgaacaaacctcctcctcatgtgggagtgctacttactacactgtctactaatcttgtttttatttttttgttcaggtacggagcaacttaattgtgctggagacctgtgtacgtacatccagttgttggagtggccaccttgcatggtgccctaccggcttagtggtggcaacgaacgccactgttatggtggatgtgggcatagcctcatatgtaggtctcaaactcctcaagcctcgttcgttttcgtgcgagacccagttgttctatgctgctgcacttaaattgcagtaatctcatccactgagatggatcacatggctggggtacaagtacatttcagagtctttttggtgttcattgttgcagttcaagatcatttccatgtaaatgcatagcaacaaaggttcaggattgaatgtccctgcaaagttgcacaacattttgatggcttttgatgatgctcgcataactactgaccttcgagagtaaaagttgtcagcaagcagacgcaagcatggctttatgattgattgcttgtgtgaatggatgctgcaagaatgatagtagtaccaccaagaaatctgcagtaatagttcagaattcaatgttctaaagaaaaaggaggtcagaaatcaataaatatttggggacacttaaagatttccagtaattccaggcgtgatgtgtgcagctagatctaagctcagcttttgacttctttgttgtggctgtcattgcatcacatctcccctttgtgatgcacaacgtacttttctctgaatgcgataaacaccggtgtttgctccaaagatataataataataataggaaaaactacatctcactccagttcccatccctggaagctgaaagaaggacgaacgaacggcaataagataatggccacctccttaacagtacacgcagcaccaaatctgaccatatcatgcatctcaccatgtcaaaaaaattataaaaatcatctttgtgtttgctaattgcagaggcatgatcttgcttgcaagatgcagtgcctactcctcatgacaaccacgatcttgcctgagagttgcactgtctgtccctccatgtacaaaccacgatctcactgtactgttccagtttcaccctttgccccccttttttttccatgggaccttctcatttgttgcagagcagtctctttcttgtacctcatgacattgtcaattcccatacttattgtgctgaaaaaatcagcaggagatgctgtcaggtaatcttgaattttcatctgtggtagtacaagagtaattatggtctggaactgagtaatccaagtgcatggatttgggattgggaccagtgaacactgttctaagatgttgtgacccaattagtcatgatttggagctacctgagctataaagataaacaactgctactacagaattgtttggtccaattcaagaaaacgagtgatcagaacaactccctccgctgattccgttttttggagcgtgatcacagcctggatgatttggacctcgctgaagtagattgggagctcgaattcttaacaataaaagggttgttcagagagagcagagaaagtgacatgcagaaataatagtagtatttcttttctgaacgtagctatagatgaacaggagcagaatagcaacgcagtgaatgccgttgcactgcctgtctgatgtacgcctagctagcatctctgcataaaatcaatctgataatatattggagttggattggaaggcctcctcagccttgtcctactgctgtctctatctctgggtacttatcatacagctcaaaagcagccacaaatccagtcccccagctcacaacttgattgttccttctgtccatgtccttttacatgaactatcttctgggataaacagattctaaaattcaacttgttttctgacccctcaagtactaaaccagaatttgcatacagtgaacttcagcatgaacacatctcttccgagtgaaaaaaaaaatgaagttcagcatgagcacaatgcacaaccaagaagctgaccattcttcagaggggaaaaaaaggggataatttcagcttaaggagatcgatccatggacaggaagaaggatcttaaagatatatatcagctacaaatataatgagaatacaaataatgatattacacgtcgtccctctctgcttgagagggtaaaagggtctgaatgaagcatcatatactgcacccgacttatgtacgatcttgtagcatacatatatatactacacccgactaccgtacatggtgcgtttcatttttgttcaaagaatcattacaccaagatgggaaattagaagctaaaacactgctagggcccaacattgttagggttgaatctcagagtgctgccgcggcaagctgacttctctgtatgtacaatgggcgtcagagctttggatcgaacctttatttggtcatgtcaaagctccattttcatgtggactgtttgcaacgatcctgatccatagcagtttacacatcagaattcagttaaggtgacgttaactatggcatcaggtaataggatgaggaaacttgcctaccattgtagctattggaagaggtggcgatctcctgactttgccccatatccatctgaacaacactttggagatcatcttgccagaaagcaccaacctgtaaagcattcattcctcatattcagcatcgattcattcgaacattttgtgagatcgagacattggtgtgcatttttacctgagaagccgcatcgctaaccccattgaggaaaggatggtgcgagcccattggccggcaaaatgccgggtccaatgggtgcatagaaccctggttgtccatgccgttcgtcaggccacaaccgagagggttcccttgctgaggctggttaatgtagggcagcggcgcacctgaggtctctagtggaaaatgtgagctctgtaacgggctgcatgactggtgcatctgatcagggagaaaatcggaaacacgaggtaagttgggaactgtatgattggcacaataagagaggaaacaaatgtagtaatgagatcgcataagcttgccctcacatctttagcaaggaggttaggcaaattgttgaagtccagctggggattcacagtggccaacttcatggacaaaaactgcaaaatggatgtgaaaggcaaaggttcagatggcgcacgcccgcgcttgctgcgctctaaatcggcaaaagctgcagtttcacaatcattctgcatctgtgaatttgacactggacaaatacctcgacttgccgttgcaacgactgcacatagtttatgatttcatcgagcatgacagcctttccaaccacctgaaacaagtaagcatttcccagtttccaatctgagcacaccgagcaactcaagtaacaaacaggtgggcgatgatgcaaatgatgagtgcttttcttcagttaccttgttacaacccggcacgagatcctgcagcagcttcatcctctggcttatcttctctcttctcacctgaattgatcgaacaagaggagatacacacagcatgttaatgcacagggaagatgatgatcagaagagcaatggaagctagagctgcaagaattttgtgtgtgtaccctctcggcgaggctgtggctgtccgtcgcctcgccgcgccgggcgcggacatggatgtagtccttgggcggctcggggggcttcgacgagctgtccttcccttgcttcttgccgccgccattctcgctgttgctctgcgcggccttccccttgccggaattctcctcggcggccgcattgctctcctccgtcgatttgcaacgcttgccgctggaatcctcctgcagaacgctcgagagatgaaatctttcggtccaagaatggtgcggcgcggccatggcgagcggaattcggcgcgtaccttggcggcggaggtggacatggggctgtccttgcctttgcccttcccggaggccttccgcttccgtgcattgccgtcggaagcccccttgggcggaatctcggcgccgccgggcgccggatcagacaccgacgactcgtcccgggtgttcccgagctccatctccttcgatgcgccggccgcgccggcgtcagggaggccgaattgcgccgggccggcgccgccgtagcctcctcctccgccgccgccgcgggcgtcgaagccggagagcctcgcggcgcgctcggcgaagccagggtcggcgaggaactggtcgaggtggcccatgggcatcaggttctcgaggattggcaggcccccgcctccgcctccgccgccgcccacctgcggcggcgcggcgtagtggtggaactgccccatcatggacaggttgagcttggggggcgagctgagcggcgtcccgccaccgtagtgcggctgcggcgagatcccgtggagagcgcccgtcgagttggacgccggcgaggacaccatggagctgagcgccgggtcgaggtgccctcccgccgccgcgtccatggactggtcccagttgaggttgaggaagcacgacggcgccgtcgccggcggcaactggtcgggcggcccgcagttcatctcaaagatctgccgcaattctccacgaaacccaaccaaaccacccgaattcccgagctcccaagaacgccccaatccagcaaaagaaacgcgagaggcgagcagccaccaaatcccactacgacgggggtgagggaaggcgagcggagataaggtaaaggcaggagcttttcgtgtgcgtgacaaagcaaggaaaagtgggggaacagtaaaggagtggaaaagaagcacctaaaacaaagcaaaagctttgcaagccaaaaaaaaaaaaaacagagagagaggagagagctcgcaatcgcaagcagaagcagcagcaagtagagattgggagtgtgagcctacggggagtatgtatataggaccaggatggcatgggtcaaaatggatgggctcatgggcatcatcaccccagcctttcctgccatgaaagaaggaagaagctagagagagaggcactggagatggtagatggagtagtggtggtggtggtggtggtaggggtagtggtgctgagtttacttgcacaggcaagaggtgagtgaagagaggaagaggggaaaggggaatgaattgctgccttgctgctgactttattttgtgctgcaaaacaaaaacaaattaaaaaaatatatgttacttagtatttcctccatccaataatataatagtttttttaaagatataacgctgtccagattgataatactaaaatatatgacatccgactaaaatattttatgctttaggactgaaggagcactatactgggggtatatgcttttgcactaatctggagttctggatagagtaaattgtagctactcctagcatttaaattttatatcaaaatataagagtagctactctctacatctacctactcatctcgaatgactaaaaatcatattctattttatttctataccagcttctatatcttaaccaattacaatcattcatcatctaattttattatctccttaatcaccgtaaaatactttacaattatttatattttagaacggaaaaagtaaatctattctttttttacttagcgttatggacactgatagtctgacaaacatatctaatcattgcttttttctaattatatataaaccttatcaaaagtataacttatgaaagtactcttcataataaatatattaatgctattttcatatgaatcataatatttttaatctattaatgatataataatttgaggtttgaaggcatcgtcttttaagaatggagataataataatagttgtttttttgtgttttgttttctgatactggtagtatttttctaagtgataaggaggtgaatgactgaaggtgatggtcccgaagcaaaggggtgttgttcttttgctcatgaaattgagagatcaaccaatcattaaattggggtaggggaaggggacaaaggatgcttggtagtttgggttgtatcctactacctctagcccattgccaaaacatttaaacattttaaaacccttgttgatttttaatttgggggatacaacaacagcccattggatggaaacccgtgtgatttgtttttgtgctgcgagatttgttcgaggctgattggggttttcagccccttctgttcgatgatgtctgtgcctttagcctgacggtgaaatttgtattttttgtgttactatttggtatcccacataatttcttcagctagcttttctcatttgtgccccacttcgttttgtgttctttgaatgtattcttgcactctcttcagtgaacacaatatactattctctactatcttttaaataaagcttgagtcgattcaaaaattatgttttaatcgattcaatcaggaagtaaattctaccagttcagctagacttagccgacatagttgcataaacaagcatgcaaatggcatggaatgcggacagaaagggcaagagctttatgattggcccgcgagatttgttcaactcatctgctattgtaacatataaatacgtactatactgtagtatagtactgtatactactacactgatgagagcattgaaaccactcggcagccatagcagggcagcaggcttaccagttgctgctgctgctgctgcagctgccgtagaacacaatttattactagacctgaataatgcatttgagcaactagtacaaaacaaaattcatatactaaaactatcttgatgaaaatggagtaatagcttaattacactgttatgagtacgggggcagtaataaaatctgttcttcagaagtttcagacaggtggtactccgcagtacctactggactgagatttctttcacctgccaaacaacatctatctcgagaataacgctaatgctaatcaaagattaatcatcaagctcccctttttttcgtggaacgggaatacgggaacattagcccaaatttgtccggacagtttcaaagaggacaatttgtacaaacagtagagctgcctcttgcagta

SEQ ID NO: 59515 - DNA, 5760 bp, Oryza sativa
attcctgcagcccgtggcgatcaatgtgtaaaaatctctgccctattgcaaatgtgtcgtaccatttctgtttctgtttgcaagaggatgtgaaaacactttagaatcacagggttggcaaggtaagctgatcccctttgccttaaaatgataaaatctttatggacaagtcatccaagaaggaaaaggccaagtcattcatgcttgcttctggaacactcatagtagtttttctttctcctttagctttaataaattaaccctacttacatctttacatccaccaccctttcttgggttaaaagcgtgggcctttttactgctgcaatctgcaagtaggatggtttttgtaggagacaatatctcagtcattagtgctactcatctttccttgcaggcggtcctcaatgcaactaatgttttgcagaagcaaggtaaatagataatatcacaatgtaaatagtaccaaatttactactgtaattaccaacaaaatgctctccctgcaaataatctgaacccaaaaaggcatcaaatttctactacgaatagtccccatatgtagttgacttcctggtattcctgatttcttggcagctgtggaaggagccgaactctagtgtttttgactccgttctctctttagttcccgttgttattgattccatccactcagaaggccgtatatggtctgccgcggacatcgccgtttttggggatttgctgagagcttagtgtggcgccaccccccctccctcttgtttgttggagtagttttttttcttttcgtagtagtccatccttttttttttcttttcgcagttggttgttggagtggttttctccctcccggcataggcttgtctggccgagtgcattgtgtaacaaaatatctattcttctaatatattgacgtgcaattcttttgcgtgtttgaaaaaaattgcattagcaatttaggctctgatcggttaagtagaaaaatgaaaaaaaaacaatttgtttgattttgctgtcatcgtttgttcatgttttatcatccgagctaaaattcaactttagagttgattttaaggttttctttattaagagtttattttttcagtatcaacttttataaactcatacgtgcaagttttgagtttatgattgtttaggcccatttaatttataaggaaaatatgaggaattcggaggattttaatcctatggaagaaatttctatgaagacattaattagaaataaagcattgaattatacacccttcgtcccataatataaaaagttttagagttggacacggttattaagaaagtaggtagaagtgaatggtggagggttgtgattggatgagtagtggaggtaggtgggaaaagtgaatggtggagggttgcgattgcttgggaaaagaatgttggtgaagaagttattatatgttgggacaaatcctaaagattaaaagttgttaaattttgggatggagggagtattacttttctttaaaacactcttatagagatgttaattagataaaagtttttaagattatctctctcgttttatttatgtgtttgtattgtggcctaatcaaacggtaattcatatgttttcttttaagtctatctcttttatttgattcatgtgtttttcctgcgacttaatcatcaaacgacacttactgtgttttgcacttatattcctattaaaattttgtgccttttgtattattcaatcatgtgtttcaaaggagccctattagtttatcttttcacaagttatcagccacaacccaatcccaaaatattttagggctcttttggaacaaagggttttttaagaaattttggaggaattcaatcttataaaaaatttctacgtggttcattgatcaaaggaatattcgtaaaaaaatcctatgaaaatcttttggtttgactcaaaacataggcctatcttataatttatgtatttttactatgctccaaccaaacaagtattcatatggtttttctgtatttttttacagcctcatcttttcacttacgcttatgcttatcgaccaaaatttgaatttttaatcttaaattgaagctgattttaaggtttttttatcgaagtttattttttagcctttgcttttacatcgctaagaaaacgtatataaaagttttattcataaattatttttcgtttgcaaatatattgtttgacttatttcgcagataaaccaaacgatgcggctcttagtccataagatttcaagtgctacgacactctaactccttttcttttctttttctatttcagtgtttttaaaagttctgcgttttaaaggaggactaaaaagcaaaatttaagccggaccctcaatttgaggccaggataacaacgacgcgactggctttaatttgactcaccctgcagctcctagaattctgaaacgtgacacgcatcgtggcaatgcacacaattttctttcatggcagcgtggcaatctgtcaggaatgaactggagaaccctactccaaaacagttcttttttaaaaaaacaagaagttgaagaaattaactccaccgtctcaaccaatgatcaacgaaaccgtggacgcgctgcaaatatttttcccgggtgctgaaggaggacgcggcgtgcgtgcgtggattcgttggagggaaaggggtggggagcaagtgagcaacgctgtggccacacctaccgggagtgtaccagcgatgagcctgcaaaattaaaattttcgttttagttagtttagtagtaggacatgaacagtttcattgcacacggtttttattataattgtcaaactccccttctgcaccgtacaaatatttttgaaatttttgggggaaaggtgatggatggtcaatggccgacttgcatgagatctctcttgatgagccttggtggccagccttgtacgagtcacactaattataacatgttatcagccaccttacttcttgaatttttctcagccggccggccagctgttggaaattgtctctttaatttcttattaagagtttatgtgcacatgttataagtgaaccttttatatctagtttttttaaaaaaaaattctattgtcatttgtagtacttctacattctaacactactggagaactgatttttcgtcgtggtatctaaaatcacaaatatctcggctagattaagaaccggtactaagaatgttttagtaccggttctaaaagtccaagtccctagaaatatttttaataccggtggcggtactaacgatgactctagggttagttaaaaaataaaacatatatatcaaagttagatgtgtgtagtaagtgggatggtaacacacgtaagtgctgaggtgagagatattgagttttaatcctacatcccacatattattttgacttggtatgcatttttagtaccggatattttaacaggtaaccggtactaaagatcaagatctctagtctcgatttgcttgtcacagttattgatctctataaccggaatcaatggggtttccaaccggtgtaaaagatgagttctctactagtgtaacttttgatatctttatcttatccgatgataaaaaaaactaatcaccttagaaaacttattgtaattattcattggaagaacacagtgtaactagagtctagccaggcccctgccccctcttttggttgtaacgacagtttgttcactggtaattggctcaaaaggtttcatgcatatatcttgggaaagctttcatatgtacacggttaggttgtggcagtttgttatattattctggtctgatcatgaaagtttctttaacctgcaaattgagcttgactatgtgtaaaaatcctcaaatggggttgagaattttgcaactggtgcagaaagtgtaatgcatggaggtttgaagaagctctagttaattatcacacggttgattactgcaaagtgcaaacaccaccaaacagttgggcacctaaatgtttctttacagatggcccagcttattctaatcacaggcctcgggatcggtgctgacggtcacatgcttgttggtgaggaaaaacataaaaatatattagtgtactactgtagtatcacaaaagaaaaccatacatacagagagacaccaaacatctccctgtgcatggaaggactgcaaccagtgaacaggccagtctctcctggcccccttcttaagctccaaataattattcattaattaactaagctactactagtactagttaaacttttcacactttctctctcattcatggctcttcattaattaactaagctaatggcattaaaactttttacttgctgtactcttctctgtctgtgtcattcatggcctttttagtttaacctttgattggagtggagacgagaccacatacaaaaattcctttgtaccattgtttggtgtgtgtgctttgtaaaagccatgcgcacaaggttgaggaccataagatcacctctctgtaaagttctctctgttgatccaaagccggcacacaaagatttgcataagccaaaatgctgagtatcctgttttcaaaggaaatgctggttgcatcattgtttttaacaaaaaataatttcattcaccttacttttccatacttgttcatcacacaatctcatcaaacatataatgcatgttaaaagtcttttttagccattctgaacacgatctatttagaatggctagaaatctcatgtctctcgatctgaaggaattgcgtctaatctctgcctacctaaccacaacacgatagttaggatacgcgtacatatgcgcgcgcacgcgcgcaagccgtgccatgatcataagttgtttccacccaaggatgatctatagctgaagtaaggtaggagcacacgttttaagccacttacagcattggtttgggaccatctctactagcagtactcctcctcttccttctccacctagctagcagaggcagaagaggagggccagcctctttacattggctatagctgcaattgcatgtactgctgctgctactcatagcctgctcctttagttgcaagcaaagagctcaaggcagcagcaggaggtagttaccatctcctcggcaatcattggaacccgaaaaggccagcagaagaaaagaaaaaaaaaaggatgagatcgagcaactgcagctgactggtgaatgctcagcttgctcattagagtgagctacaagcaacaagcagcaagtcatcaaggggagagaaaacggcaagctgcgatcctgcaaagaagaatgaaaacgaccttgcttttttagcagatggttatcttggagttgatgccagctactgccagtacaatagtagtagtgtcactgttaatcttgtgtgattagtttaagggttagttatactatatgccttgttgagatctgacctgctgactcccctccatgcttctcattttctcagtggagtgattgctactactaatttattcagagatgtatagattttttgtgtaagctggagttaagatagcttttgacgccatctttctttcctgaaaacttggctttggtctccatccttggttggcccaatgctggtttccctcacattttgcctctccctgaattaactttgctgcattgcaacccagctgtgttcctgcgtgcgatggtgatgcatccagtgctgtttggtatgccaaccaaactcctgtgctcccaaaattgtttctcctgctttaa

SEQ ID NO: 59516 - DNA, 3429 bp, Oryza sativa
  unsure (1)..(3429): unsure at all n locations
attgctaggtgcaaattgttctgctagctcaacacaacgagatgcaatttctgtcttgtaatggtgatcagtgatgttaatcatatactcaatcattcgatcaacaatcacttcaacatttgttgattttgtcatcttgtaaagaagctcgaaggtcttgcgtttcaaagtgtcatcaggatcctgttcaaaagaaaccgcactgagtgagaaacaagaagggctagtgtgaaaagtataacacatccaactaaagatgatgacacagtgacatgcatctactgaggtagcaaattaaaaccacaaaactgatgccataagaacagaacaagccagcaactaggtcagcgatattgtatcaaacaacacaatataatcttctgaaaattataagtgcttcttcagctaacataattttggtctttctgcagggaaacgtgaaatgaattacaaatcagcattcttcgtaaaattaatttctgcaactatagcatgatttcagtaaaaaagtcttagcttcattctcttgcagcatgcaacaggaatatacgcatggaagcaacatactaaaaacccaatattttccatgaacacgcaagagctgaattttgctatattcctcacctctaagcaatcaataacagccagctggtgctcttctgcgatatctggatttattttaattaaccggccaagagcatcaatgcccatgtacttaagattatggctatcactctgcaaacataaaagagttaatgaagcaggttaatttcctatggacacaacatcatgaaaatcacttatgtctcacataagaactttgtgtgcaccttcagaaactttgatgttgtttcagctgcagcatcaagcatcttagcgttcgggaatatggatgaaatacagcatatgcactcatacaatattgcattgccaatgttgcttgcagtgtcacccttcctgaatatgtcacccaagaccatgtacatatttccacttgcctgcttatcaccgctacccagcaccgcaagtattttcaatagtttaatctgcaaataagaacagtaaaatctaatgacataagatggtgccaattgaagactccaaacataggaagttgaagctcaatagagttcacatacctgaataaatggtgcaggcatttggtggtaatcataggaagttggaagcctcctctctgcaacttgtttgaggatgttaacaaaactaacaaccaaatccttgtacgaatttggatcttccaaaatcaggtcatagagggggcataaagttgcacccatgaccccaggatcattatcacagagcctctgcaaaataatagcgatcaacactaagcatctctctgagaaacaaatatgtgcttcactaacagttgggaaaccccacaggctacagttgctggaaatcccaattgaggctcaaggtagatacgaagacacaatttaagacaataaacactggtattctaacatggaaacacaaacaaatagtaaacaaatttgcatctttggtgttaatcgaatccataactcttgtagacagaacctaagactagctaacttatcttaaattggcatgaacaaaacaaagcaaaagtcacatttctaggttaaataagtggctaaaaatgtaattggagaaaacagctagctgcatcatatgcaattacagacatatatacaaattaaacacagaaatgtgaaccatagtaggactgatagaatgattgtagccgagtgtgcatttcagaattgagacaatatatgactgaggacgacttattctacgttcatttcagttgggaaacgaaatgggagggatttagtttggaccttgcggaagttggagacaaggtgagagacggatgagggggatcgctggtagaatcggtggagcgccatgacggccttcttccgcacggcctccttgggatgcgcgagcagctcgacgacctggggcagcacggccgggatggcctcctccccgatgaggcggcaggcggcggtgagcgcggcgcagacgacgaggtagttgtcggacctgaggtccttctgtatggtgttgacgacgaggatgacgaggtcgtggcgctcgtcgaggaagagggagacggcgaggtagcccgtgcgcttgagcgggagggactcgtcgtgggtcatcttgacggcgtggatgtggccgaaggaggcgtcgtggccgagcatctcggcgtagacgaggcggaggaggagctccttcatcttccggcggggcacgtcggggtcggcgaggcggcgcttgaggtgatccagctcccgcgagatgatccggtcctcctccgccttggaccgcgcctcgccgatggacttgacaaggtcgaggaactccttcgactgcccccaccctccctgcgaccccatcgccagctcccgcccgatcgtccgcagctgctccattgcgcccctcttcgcccgcccgttgcccgggggcgtcccccgccggtttgctcggggaggccgaggtgatgtggggccgatccgccgccggcgacggcgacggcgagtgggttggtggcggcgcggcgaggcgaggcggtggagatctggatccggcgaggcgaggcgaggcaaggtgggtttcgggctttcggtgtagggaaggaagggggagatcgggatcgggattagtgaggaggaggaggtctagtctagttctcgtttttctttttttttccttttttttctctcgttttactacctactccctctataaagaaaatctcatttctgagtatgaatgtgaatgtagcgtatattcacatctatagttagaaatggggttttttaacggataaaatactctaaaagtaatcattttagagttttgtgaaagtaaaatataattacatttagagtaaataaagtgagaataattatatttggatctgataaaataacagtactctatttttttttattgatgtgtcgaatggataaaaaataaatttattttaaaacggagggagcaccagttgttttgctttgcaagggaggtcttgtactgtagtgtaatcttcacccttccataggtgtccttttgtttgatggagaattttgtaactttgttccagagtttttggtttcatgttaaatttgtgcgtttcgcattgcagtttgggttttatcttttttttaaggaaggcagcaatgcgtaataaagtttaagtaaaagtgttaaaatgcatttcggatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 59517 - DNA, 32599 bp, Oryza sativa
tctttattcctgcaaaattcatgtgaaattcctacattcttaacaggccaaagattgaataaggttgttcttttatgagtttaataatcaactttaaattgatttgtaaaatagaaaaatcgagatgttcttggtcctgtatgcccacacaagcgagctgactatggtctgccagaggacaaatttatttttgcatgcttcaatcaactctacaagatggacccagacatattcaacacctggtaaattctttctatatatgcgtttgttatggtaaatttataatatgtgaccatacgtgttcgttgaaacaatacctaccatgcatgctttgttggaagtattgatcttttttcctttgctttttgtcaacccaggtgcaatattctgaagcgtgtaccaaatagtgcattgtggctattgagatttccagcagctggagagatgagattgcgcgcatgtaatgtcgtattttcctattctgtctctatatctctccccacttctaacgttgtagctttggcagatgcaatctcaaagggagtaagagcagatcaaatcatatttacagatgttgctgcaaaaaatgagcacatcagacgcagtgccctagcagatctatttcttgacacgtaaccttactttccatccattattgcccttgacagttttcttatttacctgccatactcttattttctcaattatattgaatgagcagcccgttgtgcaatggccacaccactggtacagatatattatgggctggtctcccaatgatcactcttccactagagaaaatggcaactagggttgcaggttcactgtgtctagctactggaattggggaagagatggtagtcaataggttagccatctcagccaattgtgttttttcccttatggttgaactcttcttttaatcagctttgctaatccagcctggaagaatatgaagaaagggcagtctctctagcagaaaatccattgaaactcgaagctcttaccaacaagctcaaggctgttaggatgacctgtcctttgtttgatacagctcgatgggtaacttttcagtcttgaactccatgtccatatctgttgcagggttagctttttcacttccgtaaacaaaaatggcaggtaaagaatctggagagggcatatttacatatgtggaacctgcattgctctggtaggcatcctcaacattttaaggtgctagaagatgatgcacaatttccattttgagagataagaatcagcgggtcgtgtggttgtgtaaatattacgaggtaagtttattaagatgagttaactaggcagatctcttgctgtttcatgtggcttctaccacacagctaacatgagttacaccctgcagagagagaggtaacataagccttttcaccttcttaacgcacaaaaactgagaaagagttgtccgcgtccaaatcttgggggagaaactagtagaaatcttggggggagaaactatacttgtaggactttctatagaaaactgttgcgtcaagtgttaagactccctaggggatcatatttcttccagttcttgtcaccccgttctgagttttgcagagtattcttttcatagtgaacattagacaagtaaatcagagggttgattctttcttatcaatattaggagtggattgttggacatttcttgaattgatcgacagtcaaaaaaaggcatgcaaaatagatatatacttttttttttcttctgcaacatgtatgcgcgatcaggttgttggtctggtctgtcatcgtgataagtggacctgaagattggtggcagttcaggtcgtggatggtttgttgctttcttccttacaagtactaattacatttggagatctatgcagatttcatgcgcaagctggaacgctatgcctgggcgcaccttactgcaggaattgctgtgactgaacttttgatgatgtcccgtggctctgctgcatccgcccttaaacttggttctcttgtaggcttaactgtttttgcaggttgtcgttctcttctctgaaattgttggtctcgacagtttcaaacttcagtacccgccctgtccggtgttcgtcattcacggataagttggaaggcacgggtaagatatattggcacggtccatggaaacgttgaacagtgcacaaggctactgctgtttgagctccacccattccgccaggatctcctgaaatgtgtttcagggggaaaatgaaccggacagagtggcaccatgcagtcatttagcacctgccagtgcgatgacttcactaccagaagtgcccaagtagctaatcttaaggtaatctgtttctggtgctcggataaacggacacaccagaccataagccaggtaaataccatcgaatcacatcgttaacggcggcggctacagaaccatacgcgcagtttggtgagtttggtgtggttgatgacgtggctggtccgatgattggtccaaaatgccagcatataccgtcaatgatgatataccgccaaaatcaggcaggaaacgagcgatcgattctttgcccgcttcattactctcttcccaaggtacgcatccgtcaatgatgatataccgccaagtctgcaaaactgagggcaattgtttcatcgtcgcggttattaaccttagctatgggcgaattacggattagtgggattcgataaaatcataagcaatgaattttcagacgataatagagcggctacggtgatttgctaatgtcaaatttgagtcttaattagctcttttagaacacccaaagttttttccacaaaaatccttcaacatttatctggtaccgttccaggaggagccttttggttagagtggcttcatcgaccttagctcacgctagggtttagctgacgacacgatcagtttgtactgaactggatgcacttgatagtggtaatggatgtgtggttttaattttaaggtcctgtgtttaattcctaacatatttacatttttttcttaaaaaatgttcacaagtttttctttaaaaagtttggagggacatatcttcctccgaatttctcttttttagtttgtacagagctataggtgtcattgaggaacaggatttacagatgctacagaaagagagaaaactgagaagcataagctaccatcttacacaagttggactctgcagcaagcaaaatttacgccaaacatggtagatgcagtcatgctgtatgcatcttacatcagtatcatatctaattagacattagatcacctcaaagatgatgacgcacacccatcttccatctccatcaaaaggcatgcgtccatggataaccagccgattcagtatcctggcagctccgccgccggcacgaaggagaccatctcgcgggacggcacccaggccttgacgacgacgacggcgtcgaacaccagctcgtcgtcggcctcctgggcagcgatgcggaggtagtacttgatcccggagaccacctgcgtctgcgccgccacgaccctggagaagaccagcccgcggccgcgggtggccgacccccctcgccggttgtgttccacgacgcagaagagcccgagctcctgcacctccctgttcccctccacgtcctccacgtccgtcctcccgccgaccttcctcccgcggccgccgcccgccggccactgcccgtcgtcgtcggcggcggcggcggcggcgaggcgcgcggacgagagcggcgcgaggaggagaagcaccagcacgagcggggcgacggcgtaatacagcttggaggccatagttttgtactttcgcttgctagctaattatatgtttggatttcgcagttttgcacagatgtacagaggcgagagatgatataggtagggtggtgtgtactgcagtgcaggtgttcgcgtgaccacgtagcgacgcgcgcgtgtgtgcatgcggcgccacggcgcggcatcacgtggaccctgcagctgctccgcgcaacagcaagctcggcctttgtccggcgttgcgtgacgaggggcgggcgaagctagcgtttgtggactagaaaaaaggatggagtttgttccatctttttgtatgcatgttgcatggatatgaaaagtagcaaaggggtgatcattgccgtgtactcgcactggaaacggaagaaaaagagagggggaacgagaaaggaaacgcgatgcttttatacagtactgtttcaccaaaacctggctggctgccgcatgttgagatttattagcttggggtggtatttcggtatcgattttgctataaatctgttgacaaatttcttccttagaatttgtcgattttcgaaccgcttgatgaacctcaagattcgtgcttttgcgtcgacgttttgatttgtttctttcgacggccgctggctaccggcactggcgcggctcatgcacgcgtagatgtcagacgaagggcagagataaagcggcagggcatacccgaacatgcatgcatgaatgatggcctccacacgcatcgtacaaacagacattgcgagttcgtaatccctcttttacgtgagcagtgccaaacataagttttataaaggtacatctcacttacatgcaagttatattatagttacaatgtaattacatataagtaacaatgtaattattatagttacagtgtagttatactaaagttacagtgtagttatactatagttacagtataattacatataagttatagtgtaattattctatacttacagtgtaattacagtataattatattgtatttatatttgataaatttttaaaatttatcgacaaatgtatagatagtccctcgggatatttgccgtgaaagatactgtcagccgtatttctggaagaaatagctcaagtggtgtctataattttgcatgttaggtacgagggttgcaaacgtagagacgaaaatcctcgtggggcgcagtagggatgaaagccacgtagatgcactgtgaatggtcttatgtgcctggtttgtgcatgggaccaccagacaagactatgcttagcgaaacacaacttagcttagtttatcgcaacttcttaatctcttagtcttagcttagaagctttgcttggtttaaaccagtttcttatgtaatggggtatgcccttctgttgaccagtgattgcctcggtgtatcacagttgcgctagttatttttttctaatatattaacgtgcaaaggttttttttgcatcgcgaaaagacaaggttctggttctcagttagtaagaaacaaggtcgttttttaatttaatttcgtgacagccattccgaggagaaaaaaaaaactagaaaatcggtagcactagggcttttattaattgatgatttcgttcgttcaagctagtcactacacgcgatcacctctcagcattatttaagcaacgtgagctcctgagcctgattggcgatcgagtgggaaaaaaataagcataagcatatgcaaattaaacgaagaagatgtagaacaagtatagtactttattgccactctctcccgtctctctacacaaaaagccttcgaacatctattgccgcaacacgcacacgtacacttactttgttcactctctactgaatacgagtaccccgttcggtgcacaactgcacctgaaacttggtacattttttattcttacaccagctcagctgtgtcctgtgtgaccttgcctctctctgcctgcgtgctacgactcgttcggcgagtccgcggccggggcgaacgtgagcagcgtgcgcgactcgagccagggcttgaccaccacgacggcgtcgaacacgcggggctcgccgccgttctgacccgcggcgccctcctcggcggcggcgacgcggaggtagtacttgagcccggacaccacctggcgctgcgcggcgaccaccctgccgaactccagccggacgtcgccgcagtcccggctgcggcgccggcggttgtgctcctcgacggagaagcgccccagctcctgcacctccctgtccccctccacgtccctcacctccgtccttccccccaccctcctccccgcgccgccgccccgcaactcccgtatgcccccgccgccgccgccgccggatcgcgcgccagacgccgcggacgccaccgtgaccaagacgatcagcagcagcacagaggccacaccgaccggacaacgagccgccattgacacgcaaccaacgtgcacgatgtttttgtctgcgacgatgttttttgttgtgtttgtgagaagtgagcgagaacgatggatgcgggagcccgtggtacggtggcgcggggatttatacgggggaatcggaacggaaaggactcaaggactcgcgggttggtgtttggaaggacgcgcgcgcgcgcgcggcgcgcgggcgggacgcgatcatggatagggacgaggtggtgtgaggacacgtcgaggggggtggcgcgtgcgcggtgccgcgtagacgggtgcgcgcatgggcgtgggcgttggcggaattggcaaaagcttacgtgacgtcagggttgggaagctagccaaacttgggtggttgtcgcggcgctggcgtgagagtggctagggagtgtaggttcatggcccccagctcacctggatattgttgtaacttgtgtcgctgctgtctgtgtgctgggtgggtggatatgtgcggcgacggtacaccgtaatggccgtacacagcatagcaccgaaacgaacgcaatgatttttcgcgaacgcagcagcaccgaagcggcacacgtacgttatgcttatcttggtgacgcatgcagtagtcatatactccatttagcagataaaagcttaacaatcgaatttctaggcgataatgaataggatttctccagtggcagggttttcgcgatcgatgatcgatcgatcgaacgcgtggcgtgcgtgaccgcggcttcgctaatcgctagtcctccggtgcgggctgcagggctacaacacaagtccaggcctgcacctgcgttcgaggcatctctgttaaccggcctgcgcgccgggtatccctgtgggctctggtcgtgcgatgggccgttcgtccacgagaggctgcgccgcgtgctccctccgggcccatctagccgcgtcacctgcaaggctgcaacttccaggaagttgggtgattgctcctgcccatgttctttttttcgaaaaatgctcctgaaccataactcgttcaaacgggatgatacctcacaaatatcgtatgatacctagtaggtatcaactgataccccattttaacgggatgatacctcgcaaatatcgtatgatatccagtaggtatcgattgataccccatttggacatttggacaagatgaggtgtcatcccgtcggaatgggatgctgtcatgcagcatttcttttttctaaagaaaaactcgcctgacaatgtttttttaagtccaattgtttcgtttatgcttatacctagaagccaaaattaaattttaattttggagttgattttatggtttttttatagattgctttataacatttacttttaaattggacgtgtatataaatgttttatttacaaatttaaattgttagtaagcggatcgaataagcataaacaaacagccccatcgttcaaacatcatatttgcaaacgaaaagtaatttgttaataaaacttttatatacgtgttcctaacgatttaaaagtaaatgctaaaaactaaactccgatgaaaagattttaaaatcagcttcaaatttaagattgaaattttaaatttttttctgataagtataagtgaaaagatgaggctggaaatgattaaattgtagtactagctagctcgtctgatttgcgatgctacggctgtatttagatccaaactttcaactttttctatcacattaacctgtcatacacacgcaacttttcagtcacatcgtatcaattttaacccaaacttccaactttagaaggcctacatgctactaggactaggctaacctagtactagtggtagtggcagtgggtttattgtccgatcgagctgatcgatcagttaccatctttaggagtaaaaatgataggctgactagttttaacccgcactaacccgacaacaaaatgcacactaaacaaacgcataattgcacggcaacataattaaaaaaagcatgcctatatattgacctgctatatatattatcaactctctttggaggattaccctggaacgaataatgatgaaaaatagtgggagtggcaaatatctctctcaactttcttcggcaaaaaaataatgaaaggttcatggtctatcaagtcaatacactactaaacggagaaatgcacacaccacgttatccagatgatgttcactttacacttgtggcactacgaccggttgatcactactgtatgtggtcttcatctacttgataggtagagtgcatatctgaacgaatcagaaaaggaccaaacaagtctaggagcagatgtatcaatgtgatcttcctgatcgtttgtgtccccactttaacacccagtccttactttagggtgtattattgaacttgatttagctttatttttcgccagacctgattagaggaatgacaggtatgtgctgatcattaggccggaattaacaaggacatcaatcataataagttgtttatattgtggctagaaaaaaatgtttattgcatctagtttgttatgcgcatgatatgataataatacacaggatcaaacttcactcctgatcttgctgccttcactatccatggcgccacgcatgatgttgaagtcactcagtttcgtgtatattggttcaagagaaaaaacctagatgcaataatgtgcttcatttatgaaatataaaatcgtcacaaacgtccgcacctaattaattttgatatccttggaacacggaatttttctcatatcctgtagaaaatgaaaaaaagactgatatgtcgttctttccaaactggatagaattatataatataatcacatcatttctgagtatattgtcgtaaataaataagattgatggtactgcgatacgaaacgtagtaatcctttatatcaaatatttggtagtatcggcatataacaggatacaaatcttatgatacgtaaaatgacataatggcaacttagatatctatcatgcatgatattattatgagtaagttgaattttggaccagttatttttatcctagtctcaccatggatcatcaatatttttacgttggattaggtttagataccagattttgcactttaggccagtaacccatgtatcagcaaacacttccagacgagggccttgtccaactggcctattcagcaggcaagggctgtggctgcaactgcctttgttgcttgcagaactgttttggttggttgcgatatgccgtagccctgacaaccaaatatgtcaatgtgtaatatatgtaaccaagttgacctaacatgtaattcactcgttgttgttttttgtttttcaagatatgtttttacacggtagacacacgcgcatatcagtatacacgtcacattagtcatcatactcatgtacccatgaatgtatcctctaacaaactaacacatattactctctctatatctaaatataagagattttggttagtacaacgaatctggatataaagctatattatatccaactaaaatcctttatatttaagaacgggggaagtaaaagagactgaaaccaacaacatatttctaatctcactggaaatatctcactgagtttctgttgaaggggccgtcatttgacggctggtttaacttggattagcaacacgtccacgatgattcgattgatttcgacgtggattagcacggacacgtccacgatgatctcgattctcgacagcgagacaaaagaaaaaacggtggtaatcctaatcccgggacgatttgacgtcgtgtgtctgagagtgtgattagtttctgaaaaaaagttagaagtttgaaaaaagttaaaagttttaaaaaaaaggttaaaagtttatgtgtgttttctatgtgatataatgtaatagaaagttggaaataaagggaaactaaacacggcctcgatctactatctgcaagctgcatgaacagcgtggacagacagctcctgcgtgccgctggataaaggccaccgcatcattgcgctgtcaccggtgaagaatcgcatgcggccggtctggtaaaaaatgtcgtactacgagtagaggtgtacgagtaggggtgaaaacggtacggaaatggacgaaaaccatttttaccgtttttatttttatattttttttaaatcagaatcggaatcggaaacctggatacgaaaacggaatcgaatattatcgaaaccgaaaacagagcgaaaacgaaccggcgcaaatatggtaacgaaaatttatcggaataaaaaaaactctcaaactgattaatccaattctcaaatctcaacggtcaacgattcatcataaaacacaatcatataagtctaattattaagtattaatagtacatcacaaaacacaatctatgaaataaattatctatatttaaaagagtaatgatgttggtaaatcccaatgaaggaaaaaaatattcttatgtaattttagatttgcataacaaatattttcaagaaaataacaacaaaacaccatggtattctctattaagtgcttaaaaaaagaacccagggtatttcagttacaaaatttctggaaattctgaaaaaaattcctgaaattccgaaaaaaattccgaaaagtttccgaccgattgcgagttccgacggaaactgcccttatcattttcgattccgtttccgagaaaatatttccgaatttatttccgaaaaattccgaaaaaattctcaccgacagattccgttttcgaaaatagatccggaatccgaaaagtttccataccgttttcagccctaactacgagtcgtacgtgcgccgcgctgcgtggggttaaatgggcttttcgcgaccgcgcggggccaggggaggggacacacagttgcttactagtactatcacttaacagtgttaatctatgtttaatttttagctatgaatctgaacttttgggacggagggagtactctacttagggtgtgttcagtgtcccatgttcaaccggaagtaaaaaaaaaaaagtagcggttcattagcgcgtgattaattaagtattaattatttttttaaaaaatatattaatttgattttttaagtaaatttcgtatagaaactttttataaaaaaacgtaccgtttaactgtttaaaaaatatgtgcgcggaaaacgagaaagaggtgttgggaaaacacctgcttatagaacctgattgtacgtggggaaatagtttatttgggagtacagagacgggatcacgtgatggtgtagtctgtaataaacaccgtcaaattaaatctcatgggatttggtggtgattccttaataggaagctcgagatttcttcggcgactctaatatgatcggtaatgattcacaaaatcacaagcaccgatggtcgaaagggacgttatgtatgtgcattgttcttgcatatttgttgggttattcctgatccacaaagtccagcaccgagctgagcaaaatcaatatttaggtgtaggaaatcacatgcgcgtatactattagctccaaacatttggtacaagaaaaatgccgaagatcgagaggcgaagaagatgatgagacctacgtgccacgttgcgcccgctggcgacttggcgtgccatcgttgttcattctctctggttctccttcaccgcaccgcgtatcgtcacccacttggtttgctgatatctttgtatcgtggtggactgcatgtttcttataatggacttacgccattcacgcgaccaggccataaaattatcccagcatgctaccaacggttcctgtgtaactatcagccttgaatttgacccaaacttctgtccagatgctaaagaaccacgacgaacaatgctccttcgtgatcttgaaacgcacaggttcattgtatctagacgacacgtacgtggacgctttggagaacaggcaaaccccttccaccgctttggagtagttgttggctccaaaagtgatcacatcatattatactaaaaactagtgaatataataatagattgtatatactctctccatcacaaaataaaccaatttcgtgcagaatgtgatatatactaatacatcaaatatggatataggtatatacagattcgttattttaagatatgacacatatcttgtacgatgttagtttattctgtaacaaagagagtacatcctacacatttctcatagctagctttgatttttctagtgttcacttagattctacaattggctgagagtagcagcttggatgcatgcaagagaaaaatgcactaacacatcattgggagcagcgtatcacccgactgcaaattagtcgtcgagctgctctctctcttccattaactctataattagatactaatttaaagtattaaatatatactatttacaaaaccaattacataaatgaaagctaattcgcgagacaaattttttaaatctaattaattcataattaaaaatatttactgtagcatcacataggctaatcatagattagttaggctcaatagattcgtctcgcgaattagtttaagattatggatgagttttattaatagtctacgtttaatatttataattaatgtccaaacatccgatgtgatagggatttaaaagttttagtgtcatctaactgggtctcattacccgaatttacatgggaagcaagtggagtagtctacacaaccacacgcacattgatcacgcgcaaccacacccaactgtgccaaagaaaacgatgggacaggggcagtttctgtgctgcacggaatgggcgagatgccctccccctccacggccgcatgctccctccgcagctccgctgggccgcgtcgtccacttgggtttgggtattttggcttccgcgaaggggtgtgtccgtttctagcaaaaaccagaggcgggcgggcgggcgttccgcgacgcaaaccggtggcgcgcggcgtagtacgtgcctttacctacccggcctacggtcgttgcgtttgctgcgcctgcgcgagcgcgagcacgcgcgagagcgagactgcgtgcgaaacggtgggtcgatgcggggggcgcgagcgcagcgttggctcgaccaaactgtacaggaatattaggatcccgcgcgggatgggagttgggaggtggtgggccggtcgcgacggcaacgagtaaccaaccttgataacgctggccccgcctctctccgatccggtacgtgtccggtgtcctcgtgatctcgctcgcccccccgtgtgcgcgggggcctatgcatgtgtaccaccgcgaccacgccgtttacacgtacgccctggctggtggccgtttgaccctggatgtttccaccgcgaccttttctcttcggagtttgatcccatctccgctcgagattttactccactgcgtcggtgagttgtctccaccgcaatacggcaaaagtaactgtaactcgtatgccaccatttacctccaacgcacagcgcaactctgttccctcagctgataagcgtacagtaaatacttgcctcctctctttctggtgagtggtgataagttcagcgtcagctcaggaccagggggcaagtaaaaaagtttcattaaagaaatgtcatgccgtcaacagtgtagatactcctggaaacagttgcgtacagctgaacctggtagggccccgatcgagatcgagacggagacggggcgagaagagagcgtcgagatagagattaggaagaggcgatcacagaaacggatatggattatcgagtctagtggcgagaccgagacgatcgatcgagcaatgggcagcatagtcgccatccatctcgtgctcttgtccctcccacggcgaccccgcggccgcgccaagggccaaacacgggggcgcccccacctgctgctgacttggcccaatcgacgtcgcccgagccaggttggggggcccgcgtgacagtgcggataggacaaagcctcgggatgccacggcatatcctcgccacgcacggcacgcacgcaggcggcagcaacacacacacgcaatagtgcaatatgccaacacaccgcggcgacccggtttttcgagaaagctttttactgtttttatacaggtgaaaaaagcgtcacgtttgaaacgggggcttaaggttaaaaataaataaagtgatttggttgcataatcgtatattcgtatagtgcgtgtggattataagcttgcttttccacgctatttccctccattccctggacgtttcgtggtcaaatgctgtagtagaaaacagcatatatacagtgcgaacgccagctctctcgtgtgagtagtattctacatggttgaagatggaagataatttttaaaagatgcaaataactcgtccattgattcggaaacaacttaagcacgtgctaacagctgctaattactgtacacctgtcacctctggcagcagaaaatgcactgtaacaacattaaccctgtcagtatggatggacctagaaagaaaacagagataaacatttatacatgtcagccatcgagccatcaaccaacacgctctatctgtttactctctcccgtttcattttaattaacgatttagacaatgacatgatttataaaatatatccttgacattatttttctattataatatatataataaataaatatatgtttatgttttgaaagacaaatctatatatgttgttctaattttttggaactaaatatttttaaagttacttatggttaaagttataaaagtttaacctcaaacttgtttaaaagatcaattaatatagaatttaaaagatcaattaatatggaatttaaaagttcaattaatatggaactggagggagtacatggcagcaccaaattagctttgatatgtaattttttttggcgcactgcttttgcctaccatctctcatcaggaaagcatattccatggttaacttcctcaaattcgttgctcctaacttaagcgcccccactaatcactaatgatccaaaggaataaacccttcctctctctcgagttcgcctcatagccaaccaccctataaaaacgagtcacccgggtgtgcgcctcctcccctcaccgcgagctcagacacctcaaatccacgcacgccgccggcgaaaatggccgtctacatccgcctcgacgacgccgtccgcgcgcggctccgcggggacgccgggtcgtcggcgagcagcggcagcgagcacgaggcctccgcgtgcctgtccgggctcgtgcaggcgtttcttgagacggagggcgccgcggcgggagaggacggcgccgggccggcgagcaagggcggcgaagggtatgactccgatgatggcgacggtccggaacgcgcggcggcggcggcggagtccgtgagggagctgctcgacccgccggtggaggaggacccgttccgggtcaggctggctgctgccgtggcggccgcgatggaggcggagccggcgctgaggaggtacggggcggcgttccggcgcgccgtggcgcggcggctgcgggccgccgggtacgacgccggcgtgtgcaagtcgcggtgggaggcttccggtggcatcacggccgggacgtacgagtacgtcgacgtggtcgcgccggcggcgagggggcagaagagcaggtacattgtggacgcggacttccgggcggggctggaggtcgcgcgcgcgacggcggagtacgccgtcgtcgtggcagccgtgctggtgtcggtggtggtggcgcgggaggagaccgtcgggcgcaccgtgcgcgtcgcggccgacgcggcgcggcggtcgctccgttcgcacggcctgcacgtcccgccgtggcgcaagacccggtacatgctcgccaagtggctcggcccctacaagaggtcgacggccacctcgccgtcggccgccggagcaatgccgatgcccgccgccgccgccgggatggacgtcaagtgccgcgccgtcgggttcttcacgccgccgccggccgctccggcggcgaggatcaagtagactcggcgatgaaacatcataatcaaggcattaattaacggtgtttgtagatgtagagattaattagagcgagagttcctttcaactttgagttgctctcgaatttgttttgtacagatatttttggtcgagattaattattaaggagcaaattgttcttgcaaaaggtgatgatatattattgtgtagcatacttgaacttgatctttagctagggaaaagattataatatgaagatcttgcaggaaaacaaagcaagaaacgatgtacgcggcgggtgggtgtggttgaattagcgtggattgaatggtgccacggatgtttatgctttactaatggcgcttgtcggcgacgatatgtttaacaataataatacaatcagcctaatcatcctctctcgttgctgtgatctgcgtacgttattttttttctctcttcaagattcagcatcgtggattgtcgatcatatgatacgcatacttgctcccccttgatcacctagccacgaaatactctttaaatcctgagtaacgagttgcttgaaatttaaccgaaaattccatttcaaacaaacaagaataatccactataccatttgaagttttttaattttaaagcggataaggaaaagggcgatcagaggagaaaaagaatttgtcagtggtccaggaccatcagattattacggataataaataatagcgtggggcccacttgcaaggagacctgtcactcgaggctgcggtgggcccgccgcgtcctggaccagatatccacgtggcaacgaggagggcttgagcttcttggtgaaaccaccaaacgccgccacggctagcgaaagggaccttgtactgggcgtgtcgcccagtacacacgtggactcatgtaccgttgctatctctactccctccctactactcctactagatgcatcttccagctttgcttgtgattttgctccaaactttgcaaattctggccaggtaaatgtggtgtcgtactgtcgtttcaagccacatgcattcagatcgagagagatgtgtttttcctttttttaaaaaaatgagaaaattgagagagatttggtatgagactatgagccggccacggaccacctggtctgattctgatatactgcgattacaagcactcatgctgggcacagcttgcctgagttgtatacagtatacccacggagatatctctctcttctctaccacaaaactagggagatttaattaagtgcaacacaaatataaaggcacgtgtacaacgataaaagggttgatgtggctagctagatgtgacagcattgggagagcaagctgggattaaagatagggaaaatacatgcgaaatctcagtgctcagagatgagaaagcaagaagaaagagagcttattgggggaataatcaaatggatatttgtttttcagctagtggatttgttggattaggattaagcattttttttcagacttggatgtgaatccgcgttgaagttttatttttttttcgttttctttctttaatttatcctttgatctctccggcttatacaatttacatgcagcacagtacttgatttgatacaattgtttgaattagtctgtgatataaatccatgggtttgcaccaataacatactactccataatgctgtaatatactactagtagtactacctccgtcccaaaataagtgcagccgtgaatatccatgtccaacgtttgaccgtccgtcttatttgaaaaatttatgaaaaaattaaaaatatttagtcacacataaaatattattcatgttttatcatctaatagcaataaaaatactaatcataaaaaaatttcaaataagacgaacggtcaaacgttgaacgtgaatagtgtaaaactgcacttattttgggacggagggagtagtagttttcgcattctgctagtatttttgaagcacgtgtgtttatttgcttctattgacttttctcgtcgcacgtttcaattcattgtcagaatggaaaggccgaggtactgacatagtacattcacaagaagtggtccaacattaaaagaaattagtagaacctagataattaacacacagttcacatggtcactcaaaagaagagcaaggagcaccagtgattggtaccattgcacaaactaaagtttagtccttctcacccaaacactccctagagacttattttttggtgagagggagtccctctcacccaaacacccctaagtccaaacaaggatcaaatatatgagagttgtttcatactttttatataccaatgtctggaccagtaatctttaggacaaatcttgagaagcagataatatacagccaaaggcaatgtggcatattccaagcatatatgattaacctaatagattagatcaaaagcttagataactacttagatataactatattatcttcctcctggatcaattgacgttactgactcgggaagggtcacaagagaatagtttaagctcttctaagtcttgatgggaatataatttggttggagcctactcttttcattccttttcttttcctaatgaacaaacaagctaattgaaactttattctcagagcagtgagagagcaaccagattgcttccctttcaaaaagataactcatgaggaactacattaatattctctactttacagttcttgaacaactcaacctgtcatcttttctctaggttaattactctctgaaagactagtacattagtgcattaccctattatttgctttaacctctcttgagtaataaggcatagcgtttgatgctaactattccaggtaatcagatttataggataggttatttccatcagacttgtttttcgaggacagtttcacttttcgaagagtgcctttcagttttctgcacagttcatacaaaatcctatgtgcaccagcttcttgtaagtaaaattatggcaattaaaaaggaaagtttctgtaactaaaaacataggattacaatgcacgaaccctaaccttttatgtcttgagggagaacagccagtgtagtagccaagtagttctgtgattaccacgcaagtattcaagctttcagagtttaaaatacttccatcaagaaaagctaatcctgcctgcagaacgttgcagtacagagtttacatcatgagccagcggtctcaaatcctatactgctattacaattcaaatactgaaagcttatcctttgctaatcgacaacaaaaattcagtcaaaaaaagtaaagaactgaagaggcacccaacttcatccactgtaaatagaaaccaaaaggattgcatattttatggaccttgggaagatattatgattgtgtcactaacaactaatctttaatttatccccctgagacatgaccacatgaataaatatatatactcacaagtaccattgtagaatagaagaaaagggaggcaagcaagaatggctcacattctgctataggctaggcatagtaggaggattcacggcgtaggaggtattgtggcttcatggtgaatgcaactgttgcagcaggatgagccaatctgatccaagcaacaaaaacatgtaagacctccaattctccatgtccttctaactaaaaggacagtggtctacacaaacacatatattctgctaaaacagtaaatatacagagctctgtaatgcctatagcaaagatgaaatgtaggtaaaattttattggccagcttaaagcgtagtggaaaaatgcgacttcctagcttcaatttccatgaaatagaatacatggaatcattgacatatatgcacatcaagatatatcgatgtacattataatacaaacagtgaacatctaacaagtaacaatatatatcgatgtacattataatacaaacagtgaacacctaacaagtaacaatatgcatccatgttttgcttaatgaacatgcttcaagagtttcgctaccccgtaatgccatcaagtccaatctattctgccaaaacggctacagcgaaaaatgtatgtacaaaaaaaaaacaatatgatgatgctttaccataattttaggttacggtaacttggtaaggattaacgaatacacgaagagtcgaaatagtagtggaaagttcgcataggggacctggagaagacgtagagcaggttccccgtcgaggcggggcaaaggtggccgccgccgcggccgtctcctcgtagtcccagcacggcgcctgcagatctacctatgtcgcattgagttaccccccctccgacgatggcttcccggacgcgggcgagcgggacggcgaggcacgggggcaactgggcaagggattggccatgggccatggcggatgcggggaggaggaagaggagcagggaggagtgtgtggtgtgggcagccggcgccgcgccgccgcgtcgctctcgtcggtggaagtggaagtggaagtggaaggggaggtgtgtttctgacttccttctgaactgagcccatctcgtcctagaactttgttaaatttgggccatattctggcaggcttttagccgtagaaacgttgggcctagaactaacacactactcgatttgggctatgtccgcaagagccagttcccaagcaaatatttaattaatcacgtgctagaggatcggttccattttccgtgcatactgtttaggttgggaacagctcttgcgaacagagcccggtccctagggggccatttagtttcccctttgtttcatatcataagtcagtttgatctttttttaagtcaaactttcttaaatttgataatgtttgtagctaaatatagtaacgttttaatacaaaataaatattgtatcagaatatatttaacattatgatgtagaagttttttttttctataaactaggccaaactaaaaactttaactaagaaaacaagttataatatgaaacggagagaatatatgtttcttatcccgtgaagtttgagttgtaccaaatattttcgaaaccctagataatatatatttaaaatttacggtaaaagcagcattcacgccgctccccacctccgctccaatggataatatactccacaagttacattacgagagtaaagcagcattctcgcggctccttagctccactttatccttggaataggaattgtatcaaacagtccctatgaacaagttcataaaacttaagagaggtgtaaactgtagtggcaggaagcgaaccgtgtgaacaagttctctttcatctgttataaaccaaaatcagcatctgcctcatagattgacaggtgctcgagatatgagatcatatgtagttccacaaaattcgtcaacggatcatatctccaagaatgtgtcagacaaaaaactagatacagatcaattgcacagtatcatccatcataacctctctctctaactgtctacccctctgtacttctatcccgactgttgacaacatgcctacaatttgtttttttgtccaaccaaaagctatatttccttcctatctgtgggagaacaacaacacgatatgtaatgaggtatacaccaatgctagaagcttaattagtttttgcaggtcgtatcacatgatagaaatcaagcagccaatgagtgtttttcttcagcttctcactccctcgaactctcttcgtatggtctctagcaacatctcattccatgtatctacaggtcctggcatgcaccaatgtaggcaatcctgaggtggaggccttccatctggacctctttgcgtcttcttgtttgggtcagtacttctatatggaccaggatgcccatcaggcctcagggcaaagggctcagtgatgtccatcaatttcaacctggaaccatgtttcccagaattctgcactgcttttgtgaaccctgaaacctgctttccatacatggtgtccgtgaatccattcctcaccaccacatccaagggcttagtctttccagtgcatgatccaccggtattccaagccccaccttcataatgatctggtgaatatgtgcgcacgatagctatacctgtgaaatttggattggtagctagagcagttaggcatgtctcaacagatataccaaaagcatcaacattgttgatctgcatatttccagctttacgaggccaccagagctgccctccaacaacattgccattcaggatataagcagaccgtttggcaaaccagtgcccagaggagaggacaagcacatcaaaacgtgggataaattccataaaggtctcatccgggatatccaggaaaaccttatcgatacccttaggagcaaaccccacagcttcagttgacctgtgcactaaccaagacgaccagatgcggacgataattgttgaggttgacctaaaaatccacttgctcatcctgcggctaccacggtttactggggcctctacctgccaaaaagaaggtaaaagaacagatcatgtctcttaatgacatagcctacaaaatcatttaacataggaaaagaggtataggttgatctttgtgagacatttctgctactgtaaggaggaaagcccaaccagatgtgttccactatataacgacaaaagatttctcaatcagatgtttgaaaaacaagactctgctgcatgataaggaaaagtaataaacatggtatctgcttcaatcttcataaaatttcctacgtgagaccacaaggtatgctattagttcacaaagcaattctaactcatacagtttcttatctataaaagactatcatgtactacaggacattgatttgcattcttctgcttattagctgctgttctgatgctttggtaggcattttcaataggctaatcttgcaatatcctaaatttgtccacattgagaaaacaaagagccgattgaaatctaaactctaaaacagttttcttctagaaaccataggattggtacagtgtcagattgcaacaggacagcattggtttctctagttgatatcagacaacatcaataatccagcaactgaacccacaccagccaatacagttgcagtatctcgagcaaaaaacttggctgacagatgtactacaaaataagtagatttcaccaatttaaaaacaaatcatgtagaacaaatgactttgaccctttctccatttattttaaataaatcgaaataatgttgttatgaacatcacaaaactatataaaaaaattcatggtgtcatccacaagtttgtaacaaacctaactcacatgaataacaaaaatgcctagtattttaagttaataatcaatatccaggtcaacaaaaaattgtcatatatagtaatgggcaacttgtcatcagcttaactaatcatatggccaaaagaaaatcatgaatagtatcagcacctgccacagaatgcagaggagggattccatctgatttctggcaactgaatcaccaacaaatgcaattgtcttgcctctcatcaactccaggaactttggtccatcaaagcgtggtaggatgcactgttctggtttccatctataattttcataatccttatcaggtcgaccatttccttgacaattctgcatctgcgtgatgatcgggcaagagttgtttgtgtatagtggtccagaagaatcaaaaacccaatgtccatggtatagatcacagctacctgtacaattacaccataccattttttatcccagtcattcaattatcatgaataatcaaacaagccattacactaaaatagcaagaaaacaatatctcattcatgttagtcagtgctgccgagaaaacaaacaggaaagtgtactaacaccgcaccttcattagtcttctgaagattgtcggatgaatccgatgagacagggagatttctctcatcaggcactgacgcggtatcatcggtaacaactggatcttgtactttggtatcgatttcacccgtctcgctcgaattcacgccgccactctgaacaccgtgctccacgggtacttccttgccaccctgcaacacttcctcttgtaatggaacaccaacggcagtaccattcatgttcccatcagtaagcttggatgaatcactaggtctgacaaagaggtactcgtgtagcgatgccccggtcagagacgagcccaccgatagcgatatcactactagggttagcacaagagccaccaccgacacgacgacggtggagagccaccgacggatcccgcccgcaccggccggggccttcctccccggcggactcatggcggcaccaagatccaaacgccactgccaccacgcatcaaagaaatctgcaaaccaagaaaggacggattaatcgcgtagtagcaaagaagaattcgacacaaaaattcctccccacaaaacataaacaaacaagaccggagcagaactccctagacaatccaaggatgctatggcctaggagttcatcccaacaaaaagaaatgaaatacaagttggatctccaccctacaccggctcgtcggcgaaggaggcggttttgggacaaagaataccttcgagacgaggtggcgcggcggcggggaggaggccacgagggatcgatgagaaaaatgggggaaccgatcgacgccgccttcgcgcgtggcgaggacgaggcggaggatagatagagggaaggaacggaaggaagaactgctagagggcccaaaatgggctattttctgaatcttaagggttgttttcgctcacaaaattggactcgacgcgcagatgcgaacatacatttccactgatccactcacgctcgcattcacgttggtgctgttccacgcgcttggatggggatcggacgactctggacatccggtgcgttgtacagtacgaacatacaatacatacatcattcatacagtgtctgtccatacatgtactccctccataaaaaatactcgagtaaagaccatcaccggtctctaaacttgcaccgttgtgtcatcccggtccctaaactcgcaaatcgatcgttcagatcctcaaacttgttcgactatgtcatctcggtccctaaacttgcagatcactcgtttaggtcctccaacttttccagttgtgttacctcggtgcataaacaagacggtctaaagactttatatcaaaaaataattcatagctttttcatgtgaactctaatgaagacaaactttatatcaaaattatagccctcgacgcgacatacaactttgtagttgaaaagtttttgaaataaaactgtttagggtcacaaaatattgttgcatgtttatatattttgaaattttaattttaaaattacatttcgggaccaaaatgacttaaaataaaaaaaatcaactacaaagttgtagattgcgtcgagggctacaagtttgatataagtatgtcttcattagagttcacatgaaaaagttatgaattatttttaaatataaagtctttaccgtcctatttgacccaaatgatattcaaatccaagtttagggaccggggtgacacaactgaacaagttgaagggcctaaacgagtgaccgggatgacacagtcaaacaagtttgaggacctaaacggttgatttgtgagtttagggatcgggatgacacaacggtacaagtttagggaccggtaatggactttactcgaaatactcaattctagcaatgaaacctgaatatctattcagaatatgcatttatctttttcttaaagactgaggtgtacatactatatctgttttttaacacgtgtttgacaaaaaaatttcaataattaatacttattttattatgattttttttatcattaaaagtaatttaagtatgatatatatcttacgtatttacataatttttaaataaaacgaatggtcaaatatgtgtgtaaaagttaatagcgtcatctatttaaaaagtagagggagcatatatagatccaatattcttggcccgttcatcgtttgtactccctctattttttcttttttggaagttggttaaacatcgcgattgatttactatgttgtatgtgttcgctactcttggttgggaaacacttccctccggcacggaaaacggagcagtccattagcacatgattaattaagtattagctaatttttttaagaaaatggataaatatgatttttttaaaaacaactttcatatagaaacttttttaaaaaaacacactatgcaacagtttaaaaaatgtgcgcgcgaaaaacgaaaggggagcgtagagagcttggtcttgcaaactgctaagaatcaaacgtaatgacacccatgcactatcttagcgtttacggtcgagttcatgtgctatcgtacgatgactgcaatgcagataacctactgagcattgggatctgcgcagatctcttgcccttttgtaaagttcaatttgacgacacttaaaattacagtcgagaagaaaggaacaccggagtacagatacttgagcaacatctgaagtttctgaaacaaagtggattttttatattacacccagctaagaacacatcaagacacagagaatataattctgttcacatttacatcacagccatgacatttacagccagagcatactgcttcgcactaataaccaccattcatggtaagtgtacactgaaaaaagaaatctaaccaaagttcgtgcagatggttggcatgatatatttaccaacaaccatcagatattctcatatacagatcaatgatcgcttctctaactagtacaatgctgcaagactgcaagcaagtatcaatatttcacaagctatactttagcattccagagctgacttagctctcctcttttcgcacctagcgtgacaatagttcctgcataatttcagagaagaaacaggtgttggagctcaagatttctgtactaaaatctcagcagaggaatcgatgtgatacctagtgttgatgggactaggtagaggagagctggctgtccactcttcattaggtacaggccaacatatgtgcatgacaaacctgcattgagatgacagtgttgataattgatgtcaatgattttgttcttctgtgattcagaaatgcggataatattacgtaccgaaggcgtaaccgatcattaggcagaggaaatagccgtcagtcaagtcctttccatttgctctgtcatacctgcaactcaagaacagtaggtaaatattatcttgaaaaataacggtaaattttcaggagaatgaacagttgatcactagaagtatccagtagactctgatattaactgaatgcattgacggattcagagaacaaaatcttggttttgacctgaaactgaaagcaacaagtagtcctgggaaaagaatgtccccaaatccgatcatgtcatagccattccatgtatcaaactcctttggcatcttcagaaccatgggaaggctaggtccctcatcgctaccacgagcaacctgtatgcccataccaattggattaggatatttttgcactaatatttgcattatttgcactttgtcagaaacaaacttactgtgatcatgacacttttcttgaatatgaaaggtgatatgaacacccaaaaaatgtcatacatgaaagcgctcacaagaagcgctgttgcaacctgaaaataatctcaagtacatcagtgtacaaaagatgattacaattgccatatttactaaaccaaggcatcatatgttcttgatgatctcactttgatatttggcagatggaccacttgcaatacaagaatcatcatgcagatgccctgaatgaaaaggaacaatccatgagcaaacatgacaaggaaatcatcattgcactgtacctggtgcacacaacaaaccataccataagatcctgaccaacccaagcaaacggtgaattctggtgtacagcccaaacgacaacgaagatcaaagctagtggtaggatgacaagtgtaaccactgtcacgttccctaatacaggaagagctacttttgcttcgcggcaccgatcacaagttctgtcaatcaactttgcagcagttagaccagcaagcaagtaatagcactatcagaaattcagaatcaatggtgcgatgatacaaaaggttgcatggtttcagtgatcacaccttacaattagagtcgaggcaacatagtgcaatccctgaaaaacaaaggatccgtcaagagaagatatgaaacaaagctatacagtattagttagtttactgattaactgaaccaaactatgtcagattgagtaggcaattgccatgcacctggagaccactgaggcagaacagcacaaccagcagccatgcagaccaggtggatttgaagaagaacaggaacagcaggacaagcgacgcggtgacgatgaacacgagcgcggttttggtctgcagctccacgatttcagagtcagcagcttcttctccacccagtgtaggagcattcttatcctggaccaaataatatcgccgccatatcaaagtcatattttaaattcgcgccattcgtttcagtgaaaaatgcatgtgatgtgacatgatcgatgcattttgtctcactctttttcttctgcaaaaaacgtataatactcgtaatttataaaattaaacttctgaaacgtattttttgtggattgattgatatacctcgtcgccgacgacgacgaaggaccaaacggacgcacaggccacgctgccgacggccatcagccagaggaaaggtatagcgccatcgaaactcggcttctccggcgcatacatcagaatgtcaactgcaaattaagcaaaatcagaagcatatggttcacaaaaacagcagcaagaaatgaattcagcttctcgacagactaattctttttttcagcctctcaccctttgccccaccgtccatgccggagaggatcttgcgaccggcagactgggataccatcacgaccgggatgccaatgttagggaccgtgtcgttctgggtgcacaccatcttctgcaaatctacacgaagaaccctaatgttaattggataattttaccatttaaaaaaatattggaggataccatattttttagtgtaaaatttgatatcctgagacactgatatctctaagtaccaaatttttaggtatctcaggattttttttaagtaccataaaatttctcaatgttaattactttcatggtatgcacaatgcacgatggaaatgcagtcgttcggttaaaaactacacgtactgaccgtcctcgtcgttgatgaggagcagcgcggcggcgccgccggactccgccgtcttggccttctccaggaacgtgcactccccgcgctccgccacggcaatggagctagcaagcggcgcggatgacttggcgcagccggtcttcggggcggggaccacggccttccgcttgtcgccgtcggagccggtggccggcagcacctcgccgaacctcgccgtgatcccggtcaggctgctcctctcgtcgccgtccacccagtacgtcaccttcacctgcacacacgcgcatgccaccgtcacgtacgatcgatcgtcatctccttcctctccgacgagatcgacgcggcgatttacttaccttctggaaggggttgtcgcagccggggaacttgggcgagacgccgtcctcgaactccgagtccgcgccggcggcgcccggcacgcgggacgcgagcaggaggacggagacgaggaggtaggcgaggccgcggccgcggcggcgaggggaggaggaggagggtgcagggaacgccatggcgtggtggatttgccggcgagcggcgcggcgcgagcgagcgaggtgaggaggccggccgtcccgtcgtgcgtgcgtgggcgcgtagtacgtcggggtcgtacgtcgtcttccccgacgagggaagctgcatgcgtcggtcgcctcccgcgctcattgcctatactataactggggggtggctgtggattcatccggcccctatgttcccgcgccccgtcaactctaaatcgaagcgtctttctctcgtctttcaacgtgaacaccgtaaagtactctaacatccaagtttgcactgtggacatcgcgcttaaagatatacaaaccaacgataaattcctgacttcattgagggtttgtatccaaaataaacctcgatgatattattaaaatttcgacagaattttttatgtagtatttatcaaagtttggaaaaaaattaatgtatgtacatcgttgacaacttggtatgatttgaaatggtattaatctgaattgtccctaaatctatattacccatgtaaacgtgcgggtttatgagtttcgtacaaattccgcaagaatttcacaccaaacaatccatcttccgtatatctactatgtaaaataatctagtgatgatgatgaatctaacatcatctagagttgatatgattttttaaggatggataaatggtctttttgtgcatgtggcttaaactttttggttggatatttgcttgtaattctatatgttttttttctgagtatttttaagctaacaacttaagacatataattagaaatccgttataacaagcaggtattttattagtcaatgcaaagtctcacattataatcagggctaattctctagatggaaccatgaaattcacagtattctcactagaatttgacataaatcagttttgttttctataagaaccaacagcgattcatacactctgaatggaacctgatcctctaatctactggctactgcccttaagtactccatccgtcccaaaatgtaaatatttttagctatgaatctgaacaactgtgtgttcagatttatagctaaaagttgttatattctaggacggatgtagtaaactttaagtagctagcagtaacatttacacatgagagtgcagcatgtccaccactaccatttttgaatcaagaaattcaaaatgaaccataattgcccttcttttcggcccaactgatcattttaggtacggcccatctggaaaatgacccaggggccgaggctagagttcatgtacaaacgagtcgttttgtaactgcttcctcgtcgtcccaaatcaaactttgccatgtctcgtcgtcgtcctcctcacgccctcgccacgctcctctcccgcctccgcgcctgcagctccgcctcccacgcgctccagtgccacgccctcctcctcacctccggccacctcgccgcctccccggcccgcctctccaacctcctcctcctcgccctcgcctccgcctccgcctccccctccgccgccgaccacgccgactccgtcttcgcccacctcgcggaggaagcctcccgccacgcgttcccctggaacaccctcgtccgcctccacgccgccgcgagcccgcggagatccctcctctacttctcgcgcatgcggcgagccgccgtggcgcccgacgcctacacgttcccggccgtgctcaaggcgtgcggctgcgcgcccgggtgtagggtggggttggtggtgcacggcgaggcggtgaggacggggttggacgccgacctgttcacgaggaacgcgctgattagcttctactgcaggatcggggactgccgttccgggaggaaggtgttcgatcacggcgtgcgggacctcgtctcctggaactctatggtggcggggtacgttgggtgtggggaggtggatctggcgcaggatttgttcgacgaaatgcggcagagggatgcgttctcctgggccaccatgatcgatgggtacggagagatggcaggtggtgtagatcgtgcacgtgagttgtttgatcaaatgcctgacagggatttggtgtgctggaactccatgattgatggttatgccaggcatgggagaatggatgaagcgagggttctgttcgaggagatgcctgagaggaatgtgatctcatggagtattgtcatcgatggctatgtcagattcggggagccaaatgaagctttggagtttttccagaggatgctaagatgtggtatcaagcctgatagagtagctgcagttggggctgttgcagcttgtgcacagctgggagctctggagcaaggcaggtggctgcactcatacttggagaagaagaaggtgttgttcgatgttgtggtgcaaacagctttgatagatatgtacgtgaaatgcggtcgtttggatcttgccaaattgatctttgaaagcatgcccaagaagagtgtggtcacttggaatgtgatgattgttggacttggaactcatggttatggacttgatgccatcaagctttttaaccaaatggaaactgaaagggcaccaatggatgatcttagcatacttgctgtgttgacttcttg

SEQ ID NO: 59518 - DNA, 2068 bp, Oryza sativa
actcatggttatggacttgatgccatcaagctttttaaccaaatggaaactgaaagggcaccaatggatgatcttagcatacttgctgtgttgacttcttgcacgcatgctgggttagtctcagagggtttggggatattttacagaatggagaaggatttaggactagaacctaaggtggaacattatggtgcattgattgatctccttggccgtgctggacgagtggatcaggctagaaacacaatagagacaatgccgatggaaccgactcctgaattatggggatctcttcttgcttcctgccgaagccataggtgtgtggagctggctgagctatcagttgagcgtctggccagtctcggagcagatgactctggagtctatgttcttctgtccaatatctatgctgatgaaggaatgtgggatgatgttttcaggattaggaagttgatgagtgctgagggtatgaaaaagaacattggacggagtgtgattgaggtggatggacaaattcatgagtttgtgaatggaggtagttcacatccccacaaggaggaaatttacttgacgctgtggaatttatctaacatagcagcatctatttgatcctttgttgtgtaccaaatgtgccaaatcctttgttatcgtgtctgttcattgatttgacattcttgacatgggacgctataattctggagggagcttttgaaacatcattatatcccagtttgttaagctttttttccccctgaagctgaacgatgagtgtttgccattgtgagtttcttgataagtcaaactgaaaaggtatccaagtacgtactgtgttgcccttttttgtgttcgtattccagttagttctcctgattattacccggcttccttggttcaggaacatgaagtgttgttttggaggtttggaactttggcttttttcgccaaggaacttggagattgcgacaaggttgaaaatcgtaccaggtagttaagcaccctgatggaagcaaactatagtataagtttttccagcccaagcaggcgcttagttactcagatagtggtgctctttgtttttttcattttgcttgattcagttgcaggctcattcaaagttcccaaacatatatagttctttggcatccatggagtgatccatcgtatctgtttcttttttactttcacatggtaaatagcattttatttttcagattccatatgtactagaaacatatggttgagctaagaagctatgatcctgctaatgtttactatgaaatctgtctcagtgggtatattgaaaaagcgtggttctgcagctttctgatcatgaaattttttgaaatgatttcaggctgaaccacaatttcaatcctgactaagaagcctctaaagtctgaacctctgctgcgttgatctttttactttgttggaattaaggctgaaggtgtcgaataatatgcatataatactgtaagttactttcctttcctttctacattccatctaattattgttgatgaaaatggaatttagccgcatgcaaaatatagtagtaactgacatttagacatgagaaaacctcttatgccattgagcttgcgccaatcctatgatttgcttccgcatgacacatctcttctattccatgacatcccttttcccagaatatctactcgtgatgtcaaaataattagcctgtcctgtatgctcctgatctagaagcatattctaatttagggtatattttagtggcactaacaattatgaacaccatggagatacggaggtgctacagcctgcaaggctatgatgcttggtgttgtggtcacgtcaaccttggtgcatgacccgtgtgccaacgtactgggaccattctgccatcttctgtcatgcaaaacaaaacagctcgagatggatcctcctgcttgcttccatgtgaatgccttcttccttgcacgcaggaccacctcacagaaagcaactacgacctattcttaagaaaaatggtgacctcattctaccacggtacctccaaaggggtagcactggagcggtagagccacag

SEQ ID NO: 59519 - DNA, 3807 bp, Oryza sativa
tgtcttttgttagcaacatcaacactaattgcgggctaatgaaaaaaatcgaaacacaagaagattggaagaataaaacagccaaggtcagacagatcaaaacacaaatatgttccattccacactcaagacatcctaggaagttgcttggaactcatcagtcctcacaagtcataggcatgcacaatgtccttaattccactcatacataattatctggtaaatttagtattatctagttaatttcctattttgccacttctagtatgtgaccaaattcattatatacttataaagaagagtatttgcccaaattgcagggccattgcacttttactgtctgccaatgtggccaaagttcagacttcacagacataccttgaggacggctgaccttaaaatttacagcaagcactaattaaattatagtccatcagttagccggtaacaaccgagggtttgtacggaatccatcgtaaaaagaattggcaaagacaatttctgactgccaatggtgcatggcatctactgctgggggcacagtactaatcccctgttaatgattgcctcgggaagcgtgattaaacaaaagggaggctgtcttatcagcataacaacacaacaaatcagcaagtgaccaatggcagcctagttttatctctgccatgtgggattgtgccatccatccttgcagacagggagtacgactaatcccaaaagataatcacgcttattagcgtccggtcaagatctaaccaccaccaccccccctccaccctctgcaactcgattgcatcttgtaccttcattggactctcacatttggcccccactagccagaccatatcacaagagattaaccaacaaaaaaaaatcttgattttgatttgctcagatcaaaatgtgattcacaagaaattaaccaacaaaaggtgttttctttttgcaaaacacatacatacatacactcacctcacaaatacacacatatacaacatatccttataaatatctctaaaaactgaaccagcgtatcttaaaattagcaaagtcatcgtaaacgttttacggtcgacggatacaccgcttaccattaaaatgtggttcaaagtttgtaacttcattgcaatatagcttggcaacaacttatctgaatttctctaggaacatgaccgtaacccatttggaacaaagaaattttggtgttctcgttggaaaacaatccacattgcttgctaatctcgccgcattgggtgcaaaagaagccgatgctgaatcagacgacgtcttccttttcggccggcccgtgtttacaactcatcacaggctgcttattgttaggaacacactatactatatctcaaacagtgttacgttatgtcaaagtgttattttagcagggcagctttagtagtgagtgaaggagtaagtttccagccgtgcaggcactagtgctccactggtgatgatgtggagaaaagaaagctgctttttaccggtgtctgtccttcactgtctgtcagtcacaaacttcttggtaacatgggctccaatcattgaataaccgaggagtagtagaaagttttcagtactgctgctgtatactgtgattactgtagtagtattgggcagtaactgcaatgcaagagaggcagggagatgctgtgacagagggagagaggtaggtgcatagggttaaataagggaggactcacttggactcgcttctggcagccacgacttctttcaaacaatttaggcttttttattataaaattatatagctgtaaaaatctagaaaataaatttggaaacaaagactaaaaacctggttttctaaattctcaccaactaattatttactagcggcttctcgaaatctcaaactcccctaaataagacctagccaggaaccgaaaaccatcgtcttttttagattttcatcagctggatactacttactagccgactagccgcttcttataatctcgagctaggatgcagtgctgaggatagatagagagataggccgatagacaagtggctttcagagtaattggacagagatatcattgggaattgtttcgccgcaggaggcaatggcgttgtagatgtgtagaggctgagctcagtagcggtagagtagggcctctcgttgctgttggatgccgggtgcatcatcgatcgacaccaatcaatcatgcaacctgccctggcctcctcctgcagcaaatgccattcactttcacattcaacattcacattctcccagtaaaataccaacagatgcaatgcaagagcaggtgagttttcagagtggcaatggagcgaactgatcggatcatgcaaaggtgtagtacagtccaactctgagcggtcaacactctacgattgcagatgatcacagtgagtaggagtacatgtatgaagaagtactcctatgatgcattgcctgctacgagtagtaaaaagccgtatgagtaaatgttgcaagtggaattctgggagatttagattcagacattcatcagattcaggtaggagtacatgtagtagtaccagtaaagcttctgccactaggggtctgttttaagagcttaaaattctgagaagcagttgctagaagctagctggtgagaatctagagacctagcttttgacttctaattcattttctagattctacaactacagattcttaaaatctgggtaagaagctgaactgtttggaggagcttctgacaactgaagattctaagagaagctgcagctgttagaaacacctctaaacaggcccggtcacctataccgaagaactctactacgaacatcatgtgtttcgtgttaggacgatgtacgtacggctggtctccaagtcctcgtcaggatcgaaggaaaaacttaaggaatctagtagtagtagcacttgctggcgtggagcatctctgaatgtgtctgaacgattcctgtactgctggattctcccgccacgagaccaaagtccaaacacgagtctcatcattagcttagcactagtacccccgtgcaatgcatgtactgcgtgtgtgctgtgttttagtaatacgcttgaaacctagggcaggcacaccaccgcggattgccgtgcacgcgcgagcgccgcgcgttgtcccacgccacgccacggcgcgcgcgcgcgcgcggcagatcggcaacggcacggcgcccgcgcccgcgcccgtgcgccccggttgaattgactggacgcccgcgcgcgcactggcgcgacacagcgcgacgcgtcgcggcgccttccaagtgggcgtcggcgtcgccgccggcgccggggaggaacgtccatggcgcgagcgcgagcgcggcgcggccggtcaaaatcttctctctgctggtcgagccgtcgtctcgtctggtcagagtcacacatcgctgctgtcccttgggactctcgacacgccacgcagcgcttcctgccactgctgctgctgatgctgatgctgatgctgccgaggtgaagaaaaatccatggcggaacacgcgcgagcagtggcaactcgctcgagaccgtggtactcttggatgtgcagtgcagggcacacagtcgaggctgctgcctgtcacctgtgttgttgttgttgtggtggttcatcgatgacaaaccgcaaggattcggaacggacggacgcaagcaacgcagcgagctcgtgctctgtcgctggctgcgtgtgctgtagcttctggcacggacgggctcgtgtgtgtacagcgccgtgttgatgctcttggcagggtgggcagtacacaggccgt

SEQ ID NO: 59520 - DNA, 15924 bp, Oryza sativa
cagtgaggtcgacaagaaactgcaacagtgaagagtcaagctggtggtcaatgatcagttctagacaacttagtactacctccatcctaaattatagtagatactccatctgtttcaaattataagtcattttgactttagtcgtctcaagtttaatcaagtttgtaaaatacaatagtaacattttcaacccaaaacaaatatattgtgaaaaatatattcaattatagatttgataaaactaatttggtattgtaagtgttactgtatttgtatacaaacttgaacttggaatagtttgactttgaccaaagtcaaaacgacttataatatgtaatggaaatagtgcatagttaaaagttgctatattttaggatgaatgtagtactaagttacatgtaaattccacgctcatttcacccgaggatctgatgatctttgctaacagctgcagtgcaaatacgttgaagactccaagaccattgcgacaaggcagatttttcagattctgtcccatcaggggaaaaaaagttcagaggacatgaaaaaattgtaccataaattaaggatggtttgaacaatactttgaacttcgaagtaacacgatgaacatgaaggaaacagcatccttttttgactgaactcttaaaaggaccactgaaccgctgttttgaggaggcgctacacaagctaactcttcgttgtgtggaacatcaaagacgaccttagagctcactattgctagcaccaccggttgtctttccattgacggcgataagctccgtgtcaaagattagtgttgctccacctattggttacgaaaccgtatgtcagtattataggtaaatgggaaaaaacttatcacatgccctgttggcaatgtaaaatgtaggtgtgaaacatggtaaaatagccatgtcaaagttgagaatctacacatggataattctttcacaagaaaccatcaagcaaacaaacaaatattcagaccatacctggaatcttcggtggggagcctctctccccataacccatctttgcaggtatctttagcttcctcttttcaccgacacacatacctagtaacccttggtcccaacctatagataaaaacaacaatgtaggttgttggatatgcgaaggccattgatatgaactgcacagtccatttcctatttttgataacatccttggtcattcaagctacctcagtatggactatggataaatatggagaagttcagtattccagggaaaaggaataaccttttatcacttggccgtttccaagagtaaattcaaaggggtcacctctgtcatagctagaatcaaacactgatccatcagtgagtgacccctgcagcattatcaaccatttcaactcaatgatggaaatgtggaaataaactatgcaggaaagtaccacaatttttttttctttaacagttgtaaaagaggtcttttaacaaacatgacagggaaaccaggtaaaacacacaataaaagacagaatctacactgttcattcagcaatgtagtttatcactctatccacaaaactatttaatctgatccgttaaataaaacatgagtatgtacagatccatagtccaatggacgatgccttccattatatgcagtacaacacgatagagaaaaacaaaacttagttctagtccttaacatccaagttagtgtagttagctgcaatcactcgttctttgagtttcaaccactcaatcaggttttattttaaatgttggaagtttctaggattcatgtgggaatcgaaatgtttcaagttacttttcatattattaacaaagatatggaatacttacacgataatgcactttgattttgtctcctttgtgagcttgcagggtgcatgactctggcttgtactgaaaggaggatagccaaagaaaacttatgctatgcaatgcagtgaaatgcagaaatgcttaattttaaacgtaaaaacagaacaatcctaactttgcaatgattgtctttttcctgtaggaactgagcgttgaaatcaaaatatgcaaaaaacattcaataacaacaaccgtcccccccccccccccccaagcacacactttcatttgtgatgtactatctgctttgagccggtccattcagcacatgaatagatcaggtgaacataagcaatttaaaattcttatctttgttgtaaagaacaggttcaaatattcaagtgaaacaaagttcattcaacagccctttcatggaattggaaaagaccctaaccagtaaccatccatttcgcacatttcagatccgcacaacacaatctattctaccatatcgtccaagctcaacaacaccaatccatatcaaattcgtcacgcctggtacaaatcgagcttgtttgaacggattagcagatatacatcgaatcgacgaactcagcagtatcagatccactacaccccgaagcaagaatcgcaagaacaaccagaaaaaaccggttaccttcacaccgatctgaagctccgtgacatctccggacttcttggccgaagctgaaagccaaatcgagcaaacgatgtataagccaaacatatcaagaacaagaagagtagaaaaacaacagatctttacaagtcggctgagctatgagaggagatggggatggggaacggggttgtgcggataccggtcaggatgagggccgccgcgacaacgacggcggcggcgacggcgaagcggacgagccgccgctgctgctgacgcttccccattcgcttctccagtacacgatactaccagttgacgacttgacgtaggcttcgccgtatttgcacacggaatggttcgcgtgggcctacgactgcggaggcccatttttagtttgggcccggcccaaaattcaggctactacagtattttttgggctttggaatacttctaaatattgggccgtaaaatcttctctctctctctctctctcttttttgagaattttggacacaattcttttctacgcgtgcacagctcaaaacggggcctgactccttctgtgtttgctagaaaaaacttataagttttattactacacatgagtcatatataattgagagctcagaaataaagtcagaagtcgcaattggtcatgttaatttctcagtattcgaaagagtgttcatttagattaattctccggcccctggatatcagatcagccatgcacaagctgagaccgcatgctcacaaattaactaattcagctaccatatcataacgtcggccaatcaactgctacatgcgtttgcaatattggagtcagacacatcgtttattgagagagcataattaagggcaaatggagcagcagtatattgataaaatgttaataagttgtttattatctcagcagttgcaggtctacgagatatatatggccggtcaacacccgcaagctcgatcgttgagtgatgcatatacttatgttataggtgctgtccacgtacgcataaacatattttttattatattgtatttgcgtgaaaactatatttgcattgactgtctgttagtaccataacatcaccttaatccattaattagtagctagtattattaaagtttgccttctattgaggataaggaaaacacgcaatgaagtgaagaaagctgagtgtgcacttacttgccatccaagttaccaaccgaatatcaaacttaccgtggacttggcgtcaattaattaacagcgaccattattatgcaaagttatcctcgcctcatttttaatgtagttataattttttattcaatatttgaccatccaacttatttaatttttttataattagtatttttatttattattattagctaataaaactagaataatattttatgcatgatttattgttattgttattttttatatattttttaactgacggttaaatattagacaaaaaatcacatgtgcacttaaaataaaataaataggggggggtataaagtatctacttgaccgcctccagcccgagacctccgcgtaaaaccattgtccggccggcctccgcgtagtcttccctagcttcggtgtcccaacgtcgccgtccttcaccattaatgcttcaacgctctgtctttggtgactcctgtcaccacgtcagccatctcatcactactctatccctcttatcttcgggtgtgtttagttcacgctaaaattaaaagtttaattgaaattggaacgatgtgatggaaaaattagaagtttatttgtatatgaaagttttgatgtgataaaaaagttgaaagttttttttaaaaaagttgagaactaaaccgggtcttctttggctgtgccgctgcggtgccaatatatgtaccattgttattctctatcttcagtggctccacgcaaaactcccacaccctcatgatgtgtaatttcgttgagctccaaaactttagtatttttcgaatgttttaaaattggaaattaattctgaccaaattttaattaaactcataaaagaaaattaaaaaaaatcatgaaaataacggatgaaatagtgtcgtgctgggtggtgatttgtgtaccatagctaccttgccccacagccatcgatccaacatcgttacggtcatttctctaagctaaggaacacctcctattcccctaccccttaactcttcttctttccctacctaaccatttaatttaccaagattaaattgcaaggttaaaaatctatgtgatcccctaaccccaatcccctcctcttcacctacccaaaaaaaaagtgttgagtgatgatgtataatatcaggaaatatttctatcaaaacttttgagggaatgtcccatcctttcttgcatgtcatgcaaacatttatgaaaaaaataggaaaagttagatcaatactctccaaacatgcaaacttaaattcaacctctacaaattataataaaaaggacaaatatcaaactctagctagtatgtgtatattcacaccaaactttttttatttgtgtccttgtagaaattaaatttgaatttgcatgtttgtaaagtgatgtcacatatggatcgaattttcgaaatttctttatagttatctagataatatgtaagaaacaagagaaacatccactccgtgagtttaaaatccattcccatataacatctcaatatctcgacagttttgcatatatattattacacaccattgcaaacttgcactccaatcacacaggtgacaattaacaaaacatatatagatatataatagtacgtagtaagtagcacacagactgagtgtagccagcacactgcatgcacccagcacacagggttacacaatctagctacacaacacaggtggtagtacaagtttacaacaatacactctctctagtctctaatacctcgctaattactatagctatagtacttcatctccttgaagaagaaaaaccagtacttcttctaggacgtacggccatccatgaaaaatacatgacgtttaatttacacaaacactgtacaaccatgaacattattacatatttagcatcacatccgatcgatcgaagaactaaactgacgaactaattaaagttgtgtagatcgaactgtagataattttcgttcttggacacacgcattcattcatatagcatagctttcagagattcagagatgcagctgatgaacacacggacgagacgataatatggagcaaaacagagagcatgagtagagtgtcatcatcagtctttgtccagcccgaacttacggtcgatgtagccgccgacggcgtggaacgctgggccgaagaacccgccgccgccgccgccgctgttgcttcctgatccggatccagcgccgccgctcctcctcctgtcgccctcgctctcgtacttcggcgacggcgagtacgacgacgacgatgagccgtggccgggcggcgtgtggtggtagatgaccttcacctcctccgcgcggatgaacaccggcgccgccccggacccgccgtcctgcggcggcggcggaaccggccagccggttccgccgccgccgaagttgttgtggggaataggtgcggctccgcttatgatgatgctgctgccgccgccgtagggagagttgctgccgccgtagccgccgtctttaccgtaggacaatgatccgccgtaggaagtgttgccgccgccatagccgccgccgccgccgtagtaggagcctgaacctgcaacgactcccgtgctgctgccgtagtaattgttggggttgccgctgttaccgccatagctgtccttgttgtaattgctgctgttgccgccgccatggctgtccttgctgtggttgttccggtctttctcgtcgtccttgtgcttgtggctgctggtgatcttgtgcttgttcttgtctttgtcgtcgtcgctgccattgttgttgttgttgcttgtgtagctctggtaatccttcgtcttggtctccttcttgtcgccggcgccgcgcggcggcgacgacgaccgcctgccgccgccgccgccgcctcctgatccggcgccgtaggaagaggtgtcgtagtacgggctgttccacgacgacatcgtctcgatctctagcttgatccccaacttaatcactcaagatcgagctagggttcgtctagatatatatccctggatgataataagttcatgtatcagcatgtatgctttggttgaaatgaaaagtgctcgattagatgcctaggaatatacacatcgatcaactagaattttcagtaacaaactaactcttgatgatgatatgagctgtatgtatcagtatcaactagctcgaacagtgattaaagagtgaaaagaatgagaaatttaaacactcatatatgcatgctaagcatgaacgcataccagatcgacaggggaagcagatagctagctagtgtgataatcggcaagatggctctacagtgtgtggccaagtatatgttcacaacttatagaagcccctgcagagacgtcaacgccctagatagaaaagtcttcgtcttcttccccaaaaatacaccttttttaattatcacagacaaccttccaaccacagttaagattaatatacgtaaccctatggcttataattgctgattagtgattcggattgaaatccatggaccaaaaataattaaactacgagtagctaccccacttatagtacgtcgtcaacctgtaaacttgcgtattcaaacacttcagctaaatcaactgatacctgcacacttcgatccattatacactgcgtatatttcgtggccagtgtaccgaattcgcaatcagagaaagagagaggttagaacttagaacaagactgtgtcagaggaaatatctctgaaattgcgcgcatgcatatgccgacgttagcattcatacaaattgcaatagcgataaaattgattaatcctagtttgactgaatatcatccagaattgaatcacattttcataaagatttttcgtgggccggaacgccggccgaatcctatatacttatatagttcatccccactaaatatagttaatgctatttctctcttctctcgttaagccacatcactctaattatttctagcttttaaataaaagatctatgatccaaattgtctcttctttcttctctctttaaaaacatacaatcttaattatttttaggctcaaaattatttcaaattgttttagttttgataattaaattacatcttatttgcacatattatgtaacttaatttttcgcagcaacgcgacggggtattcatttagttctattaagaatcaagagagcaaattaatatcatagtgatatacaggtctagatatatattgattgatctctctcccccagttagcaactaccggccgaatggcaggcagtacagcgacatttgcagtttaatttacatgcacgtacatttgcgccaatgtggtaaatacaatatgattaatctctcaacaacattcaaattgttacattgtaagcatggtcatttttcgattgggctggaaacctggaaggcagcaaaaattaaactccccatcttaacaaacttgaaccggatattagtaaaaaaaaaagttacagaaacgtttgtggtttaattaaatgaattgtggtcattcttcgtctgattggaccggatggtctacagcaaaatttaattacataggtagatagataagttgtaatcagattagtattaattcaactgtgatgtatgcacctagctcatgatcgagtcatgtcatattggacggatttctacggctcaaaggcatacgtaatttctgttactgatatgtggtactccctccggttgtaaaaattaaaattgacgccgtcgatcgacttttaacatgatattcaaacgtaactatttgatttttatgaccagtaaaataaatagtaattaccataaatagtaattacctttttttaacaagatgcatgatcaaaacgtaatgactaaagttaactgtgtcaaatatgtatgaacagaagaaacacttactaaatacagtagtatggaagcatattgagtagctagccagcagcacactgaacatacacacagcatacagatagctagagtacaacacaaaaaacagtctccggctagtacaattatacaacacaatactagctagctagctacccacatgtgtatatactatatagtacattagcaacttcatttttccttgaagcaggaaagccggtactactggtttacacttcttcggcagttgaaaaaaaaataacaaaactatagaatcacgagcactcattaccacaaattatttggcggccttccgtgattatttcttctgaataataacttaacttaactgaaccaacgaacgcttgtagaatttgagtacgtacgaattaagtatgtgccaacatgcatgcatgcgtgcacatgcagagttgcagtagatatcgatggagtcgatcgagatgcagaacggagaggagacatcgacgaattgaattgaagcaatttaggaatctatcaggctcagtcgaatccgaacctacggtccatatagccgccgacggcttggaacgtcggaccgaagagcccgtttcgtcctcctccgccgccgccgttgtctctcctctcgccggagttctcgttctgcgacgacgacgaccctggctgcgtcatgtagatgacgttgaggtacgtcggcgccgaccctgagccaccctcctgccgcggcggcgccggcgcaccccagccggaattagagccatagccataggaggcaggggcgctgccgccgccgcctccggctacgatggcgccgccgttaccataggaagagccgccgtagccgccgccgttgccgtaggtagagccgccgtagccgccgccgttgccgtaggaagggccgccgtagccgccgccgttgttgtaggggttgtagccgctgggggcgctgctgctgtagccctcgttgttgccgtagccgccgtagttgctgtagctccggtctctctcgccgccgtcgtcgtcgtacttgtagctgctgctgctgctgctgctcttcttcttgttgctcttctttcccctgcgcctgttccggtcgccgtggtcgtcgtcgtcgtcgctgccgctgccgctgcggttgtcgtcgtcgctggtgtacctcgggtactcctcggacgtcgtccacggcgagcggccgttgccgctgccggctcgtccgtaccggtcgtctcctcctcctccggcgaacgacgagctgtcagagccagcgtagtactggctgctgctgctgctgcttttgccgctggatttcttccaccaggacatcgcctctcgacttcttgattgaacttaacttaaattaattatggtcccagctactgatcgagctagctagcatgtaattaacgatttactgattagcagcaagatatgatgcagtaaataaactcgaatgagaaattttttttgaataactcaagctgaattagcatgcatgcatactaacccgacagtagatgatcagatgataggccagataagcgcagatactcacaagagagatgcctctaaaaacttgatcttatagaagctcaaagacatcgatcagatcaaagtctcgtcaacttcaatataaaatagggcactttttaatttaatcatcacctaatgagacctaaacttcccaccaacagcagttacgcgtggatatatcagagataaaatgagacccaaggcggctgtgccctgattatgatccaaatctagggttccaaaattattagactacgagtccacttgcgaagtatggcatcacatctgacgtgtagacttgcatatgcaaaacacttgagctaaaccaaccaatccctacacgcttaattgcactgcgcactgcgtagatttttggtggtcagggcaacgaattttcgcaatcagaaaagcgaaacgaattaaagagttaactaatacaaatttagaagtagactttgtcacaggaaacatctatgaaagttcatatatatgaaataatgaaaacgttatgcatgcgacaaagagtttaacttagtctgactgaatactgtatatatccagaattgaatttgaatcacatcttttgataaagatatatatgtcgctatagcttgagagataatccccagttagcagtagcaattagcaattactagacggaaggcagtacagcgacacacacacacacacacatacatatatacataatatatatatatatatatatatatatatatatatatatatatacatacatatatatatatatatatatatatatatatatatatatatatatatatgcagttttaatttacatgcacgttcactgttgtgtcaatctggtaaaagtgattaatctcagctagctggatccaagtaattaattgttacatatgcaaggtcatttttcaacagggtataaaaaacggtggcatttggctgttaattttggccggaaacctggaaggtagcagacactatccttaattaacaaacttgatctagctgcaagtagtaaaaaaaaatgcagatatgtactgtagtcaatgagttgtagtcaatatcttagtctgattaattaattggaatggcccatatatatgggacaattacgttcttccttttttttaaaaaaaaagaaatttcggtcatgattttaatttaccactggttttttaattttatgattttcctatcatttttaactaataatttcacacatgcccttgcattttatcatgacttttgcccctttttttaatatgaattcaatttttaaatgaaaatgtgaggacaagctagcataagcttgaaatgaattttaacaccattaagtcattttaatgaaatgacaggaacaagcttcagtcaaaaaatgagagcaaagttacaaagttggaaaagtgggtaaaatcataattggaagtctcaacagaggtaaccataaatgcctattaaatatacactgattgtctagaacgaaaacactatgtaagatgtaattagttttagcattaatatatagtttgtggttttttttatcacatgtatatagtttgtggttgatgtaatgtgatgataatcatactagcttaaattaggttgtataaaaaaatttcaagcgctgcttgcacttggcctcatcaatcatatctaacattggacgaaataatactataaccgttgtccttggtaaaactacaaatcactggacggcatattcaagcagagacaaaatttggcatatagcaaggtgtgctttaacagcataggatcggactaaaagtccatttatgatcagaacttatgaagaaaattaaaaattgcaggcttggctgcgctcggccctgcagtcccccattttatgatctggagtaacttttagtgtatatttaaattagaagaaattacacttgaatttaattacaaactgattaattacaatatgatgcaatcacacatacatacattaactgagcacaaacatacgtatatatatatacgcatgccgtacacacatacttatgcacacagtgtcacatatatatctcacacagtacatgaatatatacagagtacagtacatgaaacaaaccgacactgcagtcggaaaaaaagaaagaaaaaataaataaaaataaagccaattaaccacaaacacatacatacacgttgcggccgtatgcagatgcaaagaagaaatacttattagaagcgagcaattaataattacgtatacgcacgtaaatacggtcgtacgtatactagagctcgcagacggtacgtacgtacgtatactgatagtctgatgtacgtatatatgcatgtgataatagtacaagtttcgtgttaattacgcgcgtcaccgattaattagtataattaattaattagtcgctgctgtggaagccgaaccttctgtcgaagaaatggccgacggcctcgaacgccgggcggaagaacccgccgctgcgccgcctctcgccgctgccgccgccgccgccgtagccgtcgccgccgtcgtacggcccatgcggccccccgtacacgtggacctcgcgagtgttgatgtacagcggcgacctcgcgccgttctggggagtccagtacccggccggcacgccgccgccgccgccgtacggcacggatccaccaccggtgtaacctccgccgccgccaccgccgtagtacggagtaccgacgccggcgccgtagagggtgacgctgccggcgttgtagccgccgttgtaaccgtaaccaccaccaccaccgtagttagcgccggcgttggccttggtgctgccgccgtagccgccgccggatgctgcgtagccgacgacggcggcggtggcggcgtcgtcgttcctgccgctggtcttcttcaggcgcgacggcggcggcggctggcgcttcgccgacgtcttgtcgccggcggcggccgcttcatactgctgctgctgctgctgctgctgccgtcctcctgatccgtaggtgtcagtggaggaattggagtagctgctgccgctgaaggatctaccgctgctgttccacatacctatccagcggtcgatcgaacaaattaagctaataaaattgcacgtacatgtcaagaatattcagagattcgatcgttgcgttgttttatatatagtatatatatttggtggctgcagctaatacatgtaattagtatgtgatatattgcattcagctgacggtatacatgaacggatttgcaaacgaattaaagaaccaattatcatatactcctataacggatacttcagatatattcagaagtattcttgaattattgatcagctagagtttaatgaactgtgtctgacgaatttgattatgtcgatctggttagctagtggttgatggatgaactgtgcctgatatggtagttcttcaagcttgcatggatgaacataatccgctagaacagtaaaaagtgaaaaagaaacataaaacaaagtaaaaggaggatcatagataagatacctttaatttgtggaggagatgacacttaattggatccggtataaggcaccctctgcagttgccaaggggcgttctatatagagctagtacactcaagtcaaccacacttcgagtctccggttttgcaataaaaaaaagaagacacttgtcgtcttagctatagagaaaaagcttcaaattatctgcgtcatatttgaatgccacccacaatgattaccatattttgtgttaatgtaaccgggggcgaatttactgttggggctccaattgaacaggtaacaatgtgttagagcaagcaggaacaacagtttgcagtagaggagcaagtaagaaagaaactgaccaactggtttgctacgatgaagccggccaagcttcatagcttcagattttatccaatcaggtctggtagcatatagggtataggcgatagtaaaatatgaatatcaataatttaggctttaggtataaacttacaactaatttattctttattattaacactacaaatcattttactttcatttttggtgtttcagtactaatttgaaattttatgagcgttaaatttgtgttatggattgcgacctaagagccccaactcgattttcattctacattcgccactgaatataactaaagttaaaattaattaacacatattaattctgccaatgaatgattgatcttcttaattatatgatcatttaacagttaatattcgccactaacaatgatcaagtaatgatagattcatgatttgtgcgtgtgtgtactgacactgttcacccagctagctaattaattactctcaccagaaaaaaaaattaaccctcgtggtaattaatctctgcaccaagcgagaacctttgatcagaaattaatgaaaccaacaacggtcagatcaagctaggtctcatactgtacttagaaagtagaaaatgtgtcacgatctagtatacgcaaggctgacttctagggatatacgtgtgcttgcgagttgcaagcagccaagaggacgtatgaactgtatcatttcatgaaacagccaatccctaactagtcactgcattaattaattaaataattacagacagtagtctgcactagtgcagagagctcagatcaattgcgattatactccctcagtactcattaaaaaaatcgtttagaacaacgtttaagtcaaaccttaaaaatataaattatgaataactcttaagttgttgagtttgaaaatataaaaaatatataaatagatttgtcttgaaaaataatttcataaaaatataaatatatcattttttttaataaatatttttatataaataaaaagtcaaaattatattttggagaccgtatcactatccaaaacaatttcctttaccggagggatcgagtacagcgagagctgtggacttctcagacacgcatgcattaaaccgtgtgcacgtacgcaatttcggcagcctctctctctctctctctctgtagagtaagctaaacagtgacactgaaagagccatcaaaattaaatccatgccacatcagtctgatctggattactttagaggttagagctacattttcacaaccatatatttcatgatcgatcagatcgaccggtctagctaatgaacgcccatagctcacttaagtacctaacctggcttaatttgtagctttaattaattaacgtgcacttgcatgtactgtctgaatttaacaattaatgtggtaaatgatttcaattggcatgcaggcagctcgaatggtgtgtatgataataaaatgttgacaggaacagatactatagtgttaattaacccatgatcttgagcgtgaagttagtagcaaatcctggcttgtctctacaacctcttgcatctagctaacttggttcacacgtcaaaccaagtcgatagatccatgctcgattgacccttgacttgaaccaaattttattcagaaaagtagatgaaattacctgctagcgattgctacgtgccaaaatgacaattttagtatagtagcgacatttatattattatcgcaacctttctataaaattaaacgtaatctctccgttctttcattcgttaaaccctggtcaaagttggattatcgtcatgatacgttaagctaagtagatgaccataaccatttcattaaaacccaactaattgatattattgatctctccgatataagcaagtttaaaacgtttctaaactgtacgattacttgtttctttatttctagctagaaagttcgatggatcaactacctaatattgggatattcatggccactgtatattatattcaga

SEQ ID NO: 59521 - DNA, 1371 bp, Oryza sativa
cgtgcatatgtgccgtgcgtatatttatacgtgtagctttgcacttgcacgcccgcggtgatgcgtgcgtaaaggctgacgccataccggaaaggcatttccatgttagacatcagccgtccatctgctttgagattcgtgctaaatttggtacgcgcctaaccctgtattgtttttttttagcaactgtataataataacttgtgtctttttagtaagaaaaggagagtgggtgaattacatgtaatagctctaaattcttcagaagggagtgctgcagactgcagccagccaactagccaagcagggtttatttggagagattaagattcttaaaaacctgatatctaatttctgagaatctgaaaaaagctttaaaaaaaccctagttcgtagttgctaagtttattttctagattctacaactatagtttattaaaatctaaacaaaaagctaaactactttgtggagcttctgatttaaaaggaattgcactacaataagctcttcaaataggccctaggaatgttagtaaaaagccggattaaccacttacttgcccccttactagtcatcacggtatcctgcaagccaacacgccgcactttgatagttcgacgcccgccagcaaagcccggtctctcagtcccaatcaaggaacacgttaaaaatgaagaccacctccagtagtccagcgtctggatagcatatactccaagttccacggtaatctcgcaccgaatttccacgcgaaacgataaaaatggcagattattttttgggggtttccaatgtcaaacaacacgtggctgatttaatccatctttggaaagggaatcgtatcgccaaacatgaaagcgtaaggggaagaaaaaacttacattttattattccagccagtttcagaggaagtggcaaccgagtttctagtgcccagcagctactgtatatccaatgtgggtaaatctcaaaacatatactccctgccagatgaaccgaaaaaaagcgccggcacacgcttctggaccacggtctcatcatgtacaaattacacatcatgtaataaacacatgtacactaagtctcgacaagaaattaccatgtgaaaaacgcaacaggaaaaagacccgcaaccatccacatctcatcccaaacctaccttctcccaattgggagggtaaaaggtcgtgtcctgtgaatcaaaaccaaatttacctatgccctcatgtgccctgtgctgatcgaacagcatcattcattactggttcaccgatcaggcaatcaagaccatcttggaggcaaactccacttacccaatttgagcacgcctgaacatatgctgtatattctagcctaacaagtccttgaat

SEQ ID NO: 59522 - DNA, 752 bp, Oryza sativa
tatgatgaaatctcctttgatgtcgactgggcactctctctcttttggagctcctctccttctctgtggcgagctatatgcctatataggtagagtggagaagatggtcggtcaatagcgaaaggctcgggctaccaagacgatatcgcctaattctagactctccttggctagatctggcaaggtggctagtagacagcgggtggggcggaggagacctaagctagtgcacaaaagtggcgacagggtgcgctggtggtcttgttggtggtaggactagaaatcagcccgcggaagggtgttggtttggtgtggtggagggcgcatgctgtgaacatttggatggtggagcctaagatagtgagtgacataccacaatgatacgattgtacagggttccaagcgaaagcctaggctgatgatttgttgggctaatagcgggtacacctttgggcatggtaatccccttgtggcactgttgaggtacctccttcctccctatcttgacaagaatttttaagtgaaaaccatgtctaggttccttggatgggtgacggcagcatccttggcatcgcaaccttcgtggtgactttttttttggagactccgctatgtggctatgtggtactgttgtaggcctaacgacaatcggccatgcatagcgatgacaggtttggtgcctgactcccctcttagtagcatgtgtttgtgtggttggcacatggttcctaggtgtaccaactgcccacgtg

SEQ ID NO: 59523 - DNA, 12427 bp, Oryza sativa
cgatgcagttcacgccaaggcaccctcctagcaaattcctcagcaacttcttctgcagcacaaacaaaagattataattagattaggaaaaaaatcgcagtcaagttcaactagatctccctgaaatttacagtccaactttaatctcgattaataagctccaagtgttctacaaatgcactacttaagctttttgaacaaaaagggtagtgtgtgagtgttgctattatcctaagaaaagctaattgcaaaggctcagcttatctcaaaaaaggtttgtgtcaatcacatgatagtactagaaggtaactaaagtaaaagccacttggtcatcacacacaagggcccagcaaagatgcacagattttggaacaaaacacaattacagtgtactactacttgccttcttcaccctgcagattagctttggtgagatcttgtacaggtcctcatccactgccgtctttggcttccacttctgctgctcattcagatactgctgcttccttcctccctttctcacacgcacagcattcgcattcgcattcgcgttttctttctcccctttcactcgaacaacgcactgcattttggtcacgaaatcatcagtctaaccgtttgttcttttgcagcaacgctatgacttaaaactgaactaaactgatatgataatagttaggtgaagaagactgaagaaaagttcaagttttttttttgtcagaccttcttgtagttgtaggggttggcagggaactggggcaccttgaagaggtcctcatctttctctgcttgtgctgtgaagaagaaagtccctgactcgaagtattgggtgacgggcatatcatcccatatattccagtcgccgaacgccgggatttggcgccacttgcagtcatcgagcgcctgtcagagaatggaacaatctttactgttaacttatctctgtaagcaactcatcctacatatatgtttgtgaaaaacagaaaagatatgcaggaagcagggacgttgataaagaggcatctgagaactgaatctttgagtcaacctctcattggataaggaaaactttgaggtgatcaggagattcagaaaatcagaacagtatatgccaatgcagcagaacatcacccgttcttttctccctagaaaaggctctactattaagagcagtacaaacaccacatctctacatggcaaaaaaaaggatccaaggctagatagtagaacacaagctagttttgccacaagaagccaagaactgagatagagattagtgaagaagagaaaggcaacgaaatgcaaagcatttctccatggctcacctccataacgcagtgacagaaaagaatcagatcgcgaagaggaggaggagacgaagaagacgatcgatgactcccaacgatttcaggagacaggtgagcagcagcaacggctcagtggtcaaagctgtagtggagcttgctagctaggcattggtcagtagcaacacggccgcatgcagatgagcaagggagctggtggctgtgtgcatgtatacatagccacgcgaaaaagctcgaggaggagagggggtaaagagaatgtgggggcacacacgtaccgaaactttgcagaaagcccacaagaaagcaagcgcccaaagcagccaagcagggcagtgtgtttagctgttactgaaccgaggcaatgagtgctgcactgccagtctgctactgctgcttgcttcacgctcgtacgctctcatctcacgcaccaccctattacctattactcccacataataggtgacgtttttgactttttatttgcaatgtttgaccattcattttatttgaaaaattagtgcaaatataaaaaaagataagtcatatgtaaagtacttttgataataaagcaaatgacaaacaaaataaataataatttcaaaattttttaaataagatgaatgatcaaacattgataaacaaaaactcgaaaagacaattaatatgggacggaggtattaccccttggcccttgctttacgagtttagtgtctttagtgcagtcataatactgttcatcctgtcccatcttgctcgctcactcttgtcaaggcccatgcttacttcgtttcaaaataaattaacttttacacataaatctaaatagaaggctatacttatatttgtgtaaaacttttttctaaataaagagtattttcagcttatcagcccgatatcattacagattattcatgccatgcatataaaacacggtttcttctgaaaactttctatgcaagcattatttataccaattattataggccatttgttatatttataagatatatggtttgtttggacgatggaaaataaaaatgatttcccgccattaaaagataactttaagttctagccatccaattttaccacatcatttcatccaagccctcatttctctctttttttttttgagtaaatttcacaaaactacaggtattttgaccaaattatcacaaaactacagatttaaggagttatatcacaaaactacatatttaacaccaaatttatcacaaaactacatattttaggttaaatatcacaaaaatgcatatttaatattgaacttatcacaaaactacaacttttggagtttaaatccttagcacccttgttatggtggagctataaacattattactttgtgattaaattggttctaaacctgtagttttgtgataatttagttactaaacatgtagttttgtgatacttcatcttaaatgtgtagttttgtgataaatttagtgttaaatgtgtagttttgtgataatttagtcatactatctatagttttctgaaatttactctctttttttcatgtcccgttatcccaacagacccataatatttaattctttcctacagataagcaagtagattatccactagtttctcatcccatctgcattattttacctaaaaagagcagcactctgtgtaaacacctctctatctgttaccacctgtcaacctctgagagggagagtggcagtaaaggtggtggcttttgggagcaagtcctggggctgtatgatgatggcaaacaatgagtgtgcgtgtccgatgcttttgtcacgcactgaccgggtgatagtcgatggagggccggggcggtggtcgtcccggccggccgcccggtcggcagcgcctgcccgcggccgggctgcggctggactcgaggacacgcatgtttagcgagaaagcagcgaaaggtggccgcttttctttccaaccatggccaaatcacaatgattccttggttggccggccccccctctgcacgctttgcccgcgccatgcgcctttaatttcccacccccctgcctttttcaccacttcgccattacggtgaccaggtccaggctttgattacagccgtgacgaaacctgcgtaatcttgtgtacttttgggtgtgttctttctccctttcctaatttctatagtactagcttgctttttgtgcgtacgcttttcaaactattaaatattattataattgctttgaaatcatagtaatctattttaatttttttaattagtacttaattaattatatactgatctgtttcttttttacaagtgtgaaggattagtttataatccactatacgaacacagtattaccgtggcatttggcgcttcctaactccaaagcttgtaaacggtgattttcctaaaaagaaagttatataaaatattctttaaatactttttagaatatcttttacgtttataagagttaattattaatttgtttatactctcagataactatagaaaaatcatcaatttcagctatctcaagcagtgcctaactgcctacttacctgtggctctgggctgtcatttcgataggaaaggagaaagttctgtacttagtagtactagtagatggaagaactagtacattacttattacggaaaacaagttacgaattgctgctgattagctcgtgtgtgtatagtcgtcgtacgttgagtatgagtcaggtgcgtgaggtcttgtactcttgtgtatgatgtgtgtcatgacccttttctgaaagtcattcggtgtgccactactagtcagttcgccagagcatgtatggtggtactatggtatgatgctgaagttacatgatggtggtactcggtagtacttgggtataataatacattcttggtaaagagaggagttcatgattatgtatgtatgatcaccccattggcaccatgtattaccacgcaatcagttaaagcaactttaatttagccaagttggtattactacctgcaaatgctttggatttttcatgtattgaggtttcaaattaggctatatactgcaccacaaactacaaagtttacaaaaggaattacttctggccggtctcagcaaagcaaatggaagcttaagtttactgctaatctaatctaaagttgttcttcagaaaacaaaaatctaatgtaaagttgtctacctaaagttacatagagcaatgatccgggccatgtacatgtggatacatctatatgggcctttttgttgggccagctaagaacctttcggaatctgctttgacaaagacaggtgcttaggaacctggcgaaaattttatacttcacggcccacatatatagctacccaacatcttcttccccttctttttccactttatctttctccaaattttaacatgtcttctcctccttttgattaaaagtttacagcctctctgtttaggcttttgatgtaccctctcctaatctttttttttaccttctttttgatgggtaggcctcctaatcttaggtacagtgacagtgcagagtgtcacaagtgacatctagatctgcttttcttgccagctatagctgctgcaggcagctgtagctaacagtaattaagcttctgatggttctcatctaccctactttgtgtaggtaatagacatggtcaatttgactttcttgttgtccattccatggcagagcataacatggggcaccgggaccactgctgtgatgcaaccccctgctttcgtttttggttttctcggttctgaagtttgaacaaaagctgtagcagtgtaaccgattattaatctgcagaggctgcaatgcagttctaagtcaccaggttatcaaacagtaacagtaatagaactgcatctgcatagttagagacacaaatcctagcagtatagtacaatactgtagtggagtagtagttacagtgagcatcagagcatcagttgcaacttgcaagccaaacattcatcagttagatcagtctgccttagtaatcatgagtttgacaggcatttcatcatgccaagatatgattataataattctgtaatgcaaagtgtcacagccaaaataggacttttgtgcatattctcccactcaaacaaaagaagacataatatagtttggtgatcagaaagaacataaaaaaaatcagaattggtcacgtctaaggtggtgtttacatccagggacttaacttaagtccctgtctttagacactaatttagagtattaaatatagactacttacaaaactaattacataaataaaagctaattcacgagacaaattttttaagcctaattaatctataattagagaatgtttaatgtagcatcacataggctaatcatggattaattaggctcattagattcgtctcgcaaattagtccaagattatggataggttttattaatagtctatatttaatatttataattaattttcaaacatacaatgtgatagggacttaaaagttttagtcccatctaaacagggcctaagattataaccactagcactcaggccaggccaacaaactgtcacagcctcacaggaatgcagataggttactttttacttcacttggcccggtccatgtcccattcccggacggaaaactcttttaatcactactagtaagtggatatccacccgttgattattatatcacctgaatagttacaaaaatattttaaaaaataataaaatagatcaatatgtaatatatcactccacaaacatgtaagttaaaatttaactttctataaattgtaatgaaaataacaaataaaactcaaatcagtatagatatatttgcagttaaatttgttatttttgttaagactcttataaaatttgaatttgaacttacatgtttatagagtgatatattacatatcaatttatcttgttaatttttttaaaaattgtttcataatcatttagttgacataaaataaaaagatagacgttcactcacgtgattagaatccatctccgaccgaccgcacatacaaagaaactcctacttggcgcagaacggcggccaactccagtccaattctaacccgaggccccgccgctgcatgccaccatcggctttcccgccggtacggccttgcgcccagcagcatgcacatggacacatgcaattgcaaacgcagcgcgcatgtgcaacaacgcgagcagcaatatatgagtatctcatcaaatcgtacgcgcgcctgcatgcatatggccggagccgtgtcttcacggccggcgacaagccggcgagcacatggacgcacgtcgtcacgggtcgccacggcgcgcgtgagatcccccatgtacgtacactctctatatatacaaggacatcgattgacagtacacatcgtagcctgcatcaacgcagagatcgatcgatcacaagaacagtaataagctagctaccgcaccaacagttaataagacatggccggcgggaagaaggcggcggtggcggtgctgctcgtggtgatggtggttgtgtcgttgtcggcggtggcgccggcggccgccgcaggtgcgccgttcatggtgtgtggcgtggacgcggaccggatggcggcggattgcgggtcgtactgcagggccgggagcagggagcgggcgccgcggcgggagtgctgcgacgcggtgaggggcgccgacttcaagtgcctgtgcaagtaccgcgacgagctgcgggtcatgggcaacatcgacgccgcccgcgccatgcagatcccgtccaagtgccgcatcaagggcgcgcccaagtcgtgctagagatctagctagctagcttcagttacgagccaatagctagctagctaagctcccgacttaattaattagtttcaaataatcaatggtccagtaagatttgtactcaatatttgcttcttggtttgtcacagtatttcatttggtattgtcaaactatatactccctccgtccctaaatatttaacaccgttaacttttttaaacatgtttgatcgttcgtcttatttaaactacaacatatatatatatatacctagaatcaaaatctaacaaaaacaagttcaaattcagttcaaacttgctttaaactagttagtaaagtagttaatgttaatacctaagtaattgaaaaagtttcatactcatttgaattgggtatatactcaatttcaacaatgatgcccgggcaccatggagcaccaaacaaatttactatatatatatatatatatatatatatatatatatcatggaactttttggtttgcagtatatatggggactgctatatcacgagatcgtgtttgaacaagataataacaactacatagactattagtgatatctattaagtatcgatacttgtgaggtattaaggaccttaataggtatcgaatgatatccatcggtactagatctagtaccccattggtacttgttgatacccgttaataccactcgatactcgtcgatatcaggatgatagcaattggtaccagacctgaggaagagagagaagaaggaagccacgacattgtcggtagggctaggtcaagagcctaggacaactcaaggatgacgaatagcctgggaggaggagcaactaggaggcgaagaggatgtcggtaatgacgaggagctcgctattgcacataaggagcggatctaccttgacaatgcgctttgcaaactacttgcaaccaacgaggagcttccccatgatctccaaccaactgcatatttacaaaccatatatatcagtattatgcctgtttcaatttgtacatgtcaaattaaacctatatatttgtagaatttgtagagtgatgtgtcattgatatgcattgaaaaccttttataaactattaagaccacacaaacgataactcatctccttaagagacaatgataacttatcaccgtcagcacccacaggagtgatagatccgcccagtccaaggatgacgggagtggcggtctcggactgggcagatccgccgccagtgcccataggagtggaagatctacccagtccgaagacggtgggtgtgatagcggtggcctcggatggcgggagcaacctcgaactaagtggatccgccatgggatagcggtggcccattggagcggttgatccgcccaatgggagcggttgatccgcccaatccgaccggcagctggaacgacgatggcggtgccggctgtgacaacgacgacggccacggtgacgacttcaggtgcaacggtaatgatggtggctttggctgtggcgatgatggtggtggctccgatgacgttggtagcttcaggagctatggtttcgactgaattagttttttggaattttattttttttcactgaaattgttttcacagacagacaacatatgtgcccacgtacgaaaaccccatatttgcacgctgttgcgcgcgctgcatatatgaaaatgtgttgattttggaatacacctaaatgcagctggctgcgcatcacccacatatgaaaatggattttggtcatctgcgaaaatcgtttttaagtagtaccctacctttttagcgatttctgctccgtcctgctgctaccgcgtacatatacagtaccgcctgaatctggtggccgccgcacgttccattcgcgccgaccatgaattaacttgttctaacaccgcgccgtccttgctctgatcgaagctctgaacaccacccagccagccggtcggtcgacgaacctgggtaaataacagccacttgatccacacaagatggcactccacacagatacgtccaactaaaattccagcctcctccgtcttgcccattggctgattggcttcgcgctgcagtcctcacatagggcatgtttgtgcagcttctaagcagcttttcatccagattctgagaagctgtagttataaaatttaaaaaatgaactaaaagccaaaagcggagaaactcagcttttctagattatgataagctggctactaatcagctgcttctcagaatattaagctctctaaatatgccgatagagtactgtaccgtaatacagacatgcatttcaccgtacgtgcctgcagtagcagacatgcacatgtacagatgtactagcgcagttgcgctacctgcatgcgtatatacgaccgtgtgcatgcatatgcatggcccgggaatccacggcgtctcgtgaacgtgccgacgcgatttgatctgagctttgcccatgagtccgtgacatagctagctaatggagacaaagctagcgcgcgagcacatgcacgtcacgggccgcgctaacttacccccacgctatataagccgaccgtatatagccatcttagctacgtaccacacaacgtacacacgacgaacccccacgacgcacttagctaagctagcgtatagtctctgatcgatccgatctccgacgacgacgacgacgatggccggtaaagtaagcgcggtggtgctggtggcgttggtggtggtggcggcggcggcgggcggcgcggccgggctgtcgatgtgcggcgtcgaccggtcggccgtggcgctgtgccggtcgtactgcacggtggggagcgcggagaaggcgccgacgaaggagtgctgcaaggcggtggcgaacgccgacttccagtgcctctgcgaccgcagggacatgctccgcaacctggagaacatcgacgccgaccgcgccacgcagatcccgtccaagtgcggcgtccccggggcctcctccagctgcaagtaatttacattaggtgatcgagatgatcactctagctagccagctgcaaaatcacactctagctagctagatgatcgatgatcgatgatcactagtgtgtttctagtggttaaataagtattgttggttggttaattaggggggggctaagtatgtgatcgatcgattgctagtagtggccgtgttatgtcaggccatcgtcgcgtcagctggatcttattttgttctgttgttttgagtagttcacgttctgaatgtcgccaggctagctgacatgtgctcgtgttgctcttgcatatatgcatggcgcagtctgcctgtctctatgtatcaatcttgtgattctcttgtacgtcattgctgtgtgtctaccttaatcgtgttctcataataaattttgctgcttgttttgatctaataattttgctatcttgtatatctgaaattggcccaggaagcattactgattaaacaatggcgagattaattggatgtttcagttggctaaaatcaaaattttcccatttttgcatgaatttatcaaaattcttgtttccatatataatttcttcgtgacatgcaacgtaagaaaatcataaggtatttagtagcagcaacataagaagaagaaatcaattccttggaatttccccaaatgtgttgtctaaaataaatttgcatggaattttcttttgataatctctaccaaattgcatgaaattcttgagatttctgatctctgaaatttcagaatgccccaaaatttggaacatcagttatgggcgaaaattcattatgtgtccatgaaattgtgaccaatcccttctatacctccaagttttgtccacttccttatatgcattttttttttttgtgcatcacttccttatatgcatttgaatgttggttttgatcccttttggacccattttgttagtagaccatttaattcctataaaactgttcattttgtccttatgtataaagaaatatgaaattttgtatagtttattgttgttggaagtatataaggttgttatagaagactattatattcatgacttcattgcacgaggtatattcatggtaatgtttatttttacatattgatagaaaaggtttaatatttattttatttctttattaaaagagtatgcgcagtatatttgtgtgatgctagttttgttgaatattatatgaaaggaatgctatccaaatctatgtctaccattttagaaaaagctctctctctctctctctctctctatatatatatatatatatatatatatatatatatatatatatatatatatatatatatatatatatatatatatatataatattatataaaacttcgatgtataatactttctcatacaacaaacttatgaatattacaaccacacaacaaattactatattcccaataatagatacaaatttctacatactccttgcacgtccaaggttaaaagcgatattttttacactattaaacagacaactaatggtgaattgatgggaaggctgtggaagggatcaaaaccaaaatataggagtatacaaaggagtgaagaaaattcaagggtatagaaaagattggctaagatttaagaggaattgaaggaattatctctttttctatttgttggaagcatgtaaaacacctactacttctgtgcaatcctattaattgggccagcacatggacacggggggaaggaaagatgtccccaatctcccaacatggacctattgactgttgaaaaataactcactcgtgtcctccagattaaggggatctctagaacgatgtgctatcactcgtaaccttgtaacaaattggttaggcccactatgcatgttgttcattgatagggcccatagtcaatggacaatgctacaagcctacaatggctcgattcgaagagcgtatggcacaggatttaccaggaatacatacttgcgaggtaatttataaaatgtatctctacaagtccaaagtctatgagtatgtccttcgatgtcgttgagacgttgattgtaaactcaagttgagacgttgttacatagaagtaacggactcaacatcaagcaattcataatgaactaaggccctatttgtttcagcttatgattattataatctagattattaagccagattactataagctggattataataagctagcatagaataagctgtgagttgtttgtttgtctggattattgaaggcatggattattgggtttgaaaagctaaagtctataatgccctcaactatatgttcggttga

SEQ ID NO: 59524 - DNA, 4284 bp, Oryza sativa
aaggatggttctccaagtgtattggtgaatccttatgctaggcgatgtatcagggaatatatttcccgcttatatactttttcctcaagctttaaatacattttatgagtcctagaaaaaaaatatttggatgcctttttcttacgggttgattccgtcatcccgtaaggttacaccacgctattctagttacagaaagaatacttcgagggtctacctatagtgttcctttcttcctaaaaaaagcctcctatatatttggcgaatatttttaatactgaactgtaattaacgcgtagtgttaattagtgtaactttcggtactagatcatattcttaggtgctagaagggacacgtacctgcagggccgtgaagaaccccagttgggggaaccacagccaatcatctctgactcatcccagcaaccgtgaatcagctcagggaaaaactgcggaaaaacgtaatcacatatcaatgtcctatgctagtagcctgtggttgtgcaacatttcagcactctacgacatgcagaatcagacaaaaagggaaagaaggcaagtccctacaggcttcaacgcgtgaactcgaccataaaattcagtaacttctcacaggcagtaagaatttttacgcaccgaatgcttcattgcgtgcaaacatgccctgacctggaaaatcagaagcttgcagtccgcttgaaaaaacaatattgttgttagtttgaccaagtttagatccagttgctgtctcgtgactcggtgaccatcaccagcatctcctagtggtgactgcttcggaactgaaagcaacaagagctaaacattgcccatatccaccacgaccaacatctttagaaaaagaaatagactgatgcaccgcagatcagagcttccatcaattgctttctgcaagatatccaaactgttcatagtacggctctgatagtctgattctctgaatgttgtcccaagatccaggtgcagcccatgccgtcgtgtaacaggcggtaagtgccagtgatgaacaaacaagaggtaaccggccgcagaaagccagaaatgcaagaaccaagcatctccgtctcattgctttctcgcccatcctctgccaccccaatagtgcactgcatacaacttttatataaccagatgacacgccgtgcctgaatgcttctgcatcttcttttactgaataagttccaccgctgcttagattcgctgactgtatccgctgctcggatgttccatgattgctacaaataattgtcccctctttctacatgccctagttctgtagaacaaaaagaacaaagagggtgaattaaatggccaaaaaagcatgatatttgactattcatgttcaaaatgaagcaaataattacagaaaatacgatgcagaagagcacatgtataacggacaaggtggtgcaattgaaataatgcaagtttcagacacctctgctgtgattttatcctgtgtgcgcgtgcataccagggagatgagccatctggtggtctccgcagtccccactgctccccttctcgctatacaacactgtctgcatggtatggcacagggatatgcatatgcctggcatgagcagagccacaggggtgggcaggcacacacacaagagccattgcaccagcctccgatttatatagtctccagcatttgctccccttgtgttgcttctctaatccaggcacaccaccatcctcccattctctatccatttgtttgaagaagggttatggccaatgcttgccccacatctaccacaagctccttgcccctcttcttcctcttctgtttcctgctcttcagtcatgctcgttgcaatcaagggcaccatggcagcatctcaggtacccctttgcatcagattgatatcttgtcttttcttctgttctcctgcatctattaactgtgatttaggttgacatgataaaacctatgtatttaaatgtttcaatttcatatgatgtcaaggtacagactatggagaacaatatcctcaccaaacattacctgaagaacatatacatttgcaggagaacatcaaggtacatatgccatcttgctattacaaagtatgtaattaattgagttttgtgtttttctgttcctcaagtatgttttcttaaaactttagttttatgttttattatgttcattatatatgtcaaggaaaaaagctttcccccaactgtcagcttccttggcgcataccatatagttctggatggacttttcagtaggaagaaatggttgcatctatcaactgtgcactgcttggcatcttttgctaggatgagaaaatgattggtagcaacttgcctcccatcttttctcctaaagtagtatgaaaagacttaagaacaagaccaaacaaacatgaatgccaaagttaaatcagaaagtatgtaaatatctggaagatactatggttaagatgatcttcaaatgtatgccattaggttctaaacaaggagaggctgcccaaatatgcaaggagaatgttgattggttcgactgctccaatatgcacatacaacgagtgcagagggtgtcgattcaagtgtactgccgagcaggtcccagtggatgcaaatgaccccatgaatagtgcttaccactacaaatgtgtttgccacaggtgatcattaataattaagaggagcttctgttatgagtagtagtttgcatccattttattctctttttcccccttctacccttctaggctcaaaaggttcattttttccccttttgttttaacaagtggccagctagtagaggattagagggcattttgtattttaagatgttcaggttgtggactggtaattttggaagtaaatgttaaaaaatttgaaaaacagcttatttatactattgtgcagacaaaatgttccttgcttacgtattgcaccactgtttttagtctatgaacaaacctcgatagagttgtctgccagaatagccttggagctctcagctggatcatctggaactagtggtctgcaactgtgctagcctttcaaggcatataaatgtggtaaatgttctattgcatttgaaatttctcagtaccttcttcattctgggctgcttcagctctcatgggcttttgtcattcgtctttccatagtaacaaccatctgtacaatgagcagtaaattcatctagacaaatcacagaagaagttaaccaagagtaagggtaagcaataaagaagactttcgtgcagaccacactccttcattgaagtagacattgcattctaaattcaatcgagcagatatgtatgaggaaattgccaagactcagacaatcacatgcacactgaccttaaagttaccaagtaaacttatcaatagtattccagtaaaaagaatcaatagtagttcaaaaatatcaattgaaaccgtttcagtccaaacagggcatttattttgcaagcagagagcttgcagaggtgccttgtatttattcaacaaaatatttttagaggaattgtcttggtaagaaacacttattagctaacttcttttactggaggtgtaaggacaagagtaactcatgcttattagaggatactgacaaacgtagtcacattcagacagtactttccttttgcaagaagtgttctcttcagttttttttacccaagtcacataaattactacagtcttttataagccactgctcacccaatatactccgtagaagttttgcttgtgcatgagtgtgtgacatgactgtcaagctgcggctgcaactagagtgagacgagcaggtagcagaactatggtgatttgactgattggccacctaggatggctacgccaggtcttgtataatctatatatatggtttaccgaacaccgagatatgcacagataattatggtgttttatggtgtctgcttgaacattattcaattagtgaacaaaggaactggtgagcatgtgtccaaagaaatatatagtaatgtctcagttgactgaaaaacttcataacttcctagttcttatgcacacaaaaatcaaaagcccttctgggtgggagtgggacacatatactaattcttttattcagttggtaataggatacttgaagtcttgagctaagaaatagactgagcaactatttcaaacatggccagctcctatagtgtgacaggtgatgtgtacaagcccccagaactcaactttataaatggtcagccttgcagcaatggagacaaactctgcaagcaagtaaatcacactatttct

SEQ ID NO: 59525 - DNA, 1266 bp, Oryza sativa
atgaacaacatatatctgtaagattcagtggcaaaattaacaaaacggagaagaaaataagcatgtttatgtcaaggagcaggcggtacctggcgatgttccattgactgaagatggggagcaaaactctgacgaagttgaagatcgtcaagctggagctgtgcagtcaaagggaggcaatctgcgtcgtactacaaggcctgttaagcaaaaccccaagtactgtgggcctaactgggccatgtaatagaagtccatattgtaataggctagcgtgaacaaggggaaagaagagagagataggatatatatatcagatcagcgagctcgagggaaacttgaatggcaaccacggtggcgtaggcggcggcggctccattcctgttggaatcggagaagactactatattgagttgccataattcctcttgctctaattctctcatcgttgcaattctctctgtaatttgggtgtgagttgtgggttgttgacaaaatttagtatcagagccactccgctccgcagatctccttggcttggttgtaaaatcccagggtaggattggaactgttcttcggaactgattctgcgaaaaggcaacttgccttctcctggttagccgagttcgggaagcgagcgagtgattctagtaccaaactgttccgtggagtcgagtatgtcgcaggaaagtaagttagatcttcttctgaaggtggtcgaggagaacgagaggaagagagtggcggcgaaggaaaggactcgagcagatttcgccgatctgaagaagatggtggaggcccgactgccggtggtggaaaagaaggtggagacactcagcgtttcggttcaaagcttgagccagaaggtggagctgatggaagggagcatgctcaaatctgaaccaccaacggaagggatcgggaacaacgcatcttggcttgctagtaagcgtgatccaaatctttaaacccctgttcattttgctggtaaggccgagtctgaattgccatcaccaacttctgcatccactggtaccaatcatgatttgagtgcttgtatccccccaatgatctgcccaaaatttgatggatctaacccccagatgtggaaaagtaattgcaagcagtactttgatgtctatggaatatatcctatgtattgggttaaggtggctactcttaattttgttggtaatgttgccttttggctccagtccattagatctcagattgttgacattacctgggtcactttatgtgaattag

SEQ ID NO: 59526 - DNA, 1391 bp, Oryza sativa
tattattttcatagaaaatagtgaaggatccagctaagcattatttcagggaaatacagtgtatgacatcgtgagatataatcttgattttttttcagatattaaatatgcatcacatcagccaaccaccaacaattttctccaatatattactagacagaaactacaaacaacactgtgattgacttttgtagtttatataggtcacgagggtattaccaaacagtgatcgcggtagtgttccagagccaaaagcaaacacatctgtctgtggtttccgtcgacgggcattatgatcagaaagtcgtctccggcagctccgtttctcctgatcaaactccgaaggcgcgtggaaccttgataatcccaagatagaacaaaaaaaatcatcaaaacgacataaacatgccgcaaaacgtaatgaattattgtttataaccacaattaaaagcagaatttggtcacagggagtttctggcaaaagcagatgcaagaatgcaactatgcaaaatactactatctacacatagcaatcactcattgtactaacacacacctctttgctgaaaatacacattcacatagacacgcaagccacaggccgtcctaccagaaattcaggaagccttgccttgcacagacaattcactgtcttggcagctttccagatgcagggcgtacaggcaaattctagcacagtactatcgacggggaaacaggatcttacctccccaaatcaggcaaggggcagagaaccttgtgaccaatcagtcatgcacagagtttcacactgtaccagcacaaaatggccacatacatatttataccctatcttttactgcacaggtagtatagtaatagtcgtactaatgattactactatgcacttaggcatatcgaagcaattcaaacagggcgcgaattcgcccaatcgaatcactaacggggcgattgaatcaattactagtagaactttagggcttgtttagagagcttcctgacggccgcagtttctccagtctcctaagagaagtcagcttctccagattctcaccaactatgcttctcagaatcttaagcgcggtattggaggagaggagagcgagaggggaaggggaggagggctgagtggctgacctgctgcactgctggcagaagcggcggtcctggccggcgacgacgacgcggaggcacttggtgtggggctcgcagacgcggtgcttgcggtagtactccttgtagcctcccagctccagcccgcagccctccacctggcaccgcggcgcctccgccgccaccgccgccgcatcccccgctgctgccgccgacctcccacgcttcgccgacgccgacgccgacgacgaatccctcccgccgcgcttcccgggcgg

SEQ ID NO: 59527 - DNA, 2959 bp, Oryza sativa
caaataagtttcgcatgggataataacgctccacttaaccatgcaaacaccacttcaagttcctcgtggacatctgacttacagctctcccaagtgatggacataagcaaaaggtcacgaaaagctggggcagacagtgcaaatatccgtttgtcaaatgctttgccaactctttgtcatgacacaaatgagctcttgccaataaaaggtatggctccatgatctttttatatcatgaatggaaaattaatctactcgaataattttacttatgctgacaaagttagtttacttcacttagcattcatgccatgtgcagtgacaggcttaaaagataggctacaatgctaaatttgacagcataatatgtatctctactaccttaaaagcgcaaccattctccttctgtcctcttcccactgtgcgcagtcgcctgctccttcatgtgtgcgtaaccaccgtagcatccagtattttatccttaatccatccacccagccaatcgcccaatcctcaattgtatgagcttggtacgttgcaaagcactggcatattactagtaaaaagaagaaataaaacagtaaaatccatatggccactacccaaaatgggttgatacatcaagtttgttgatactggcatctatcccgaaacgaactttaaacatgtgtaggtacattgatatttgaattttgaggtttatagttcagcattctttctgtaaaccaaactcccaatttgttgtttcacaacattgcaagtttcttatgcagtgccaaaatcttggctgcagattttttccccccatctttgaagttaggaacatttgaaatgaaaattttcctagttactatgtatatttgaatattcacaacccatgtaggactagcaatccagcattccagttacacttgtggcatcatggcagatacctatagcctaggtatcacaccattgaccactatgcacgagtgaacttatgagatccatcctattgctaaatgctttcctcctccgagccccttgatatgctcaatacaatcagataccgtgtcttgagagtagtattttctctagttttatttactggcgctgtatgcttgatttttcatttcatacgtttctgttatcacttaccactattttattttctttcgactgtcgctctaatgctttgatggtccaattttgcaggtgcagatgcatctgaaactgcttcaaaactagatggagcactagatgttcagcgtgctctctctcttctgtcagctagttcaaggggtttgactgaccccggacaccaaacatcttctatcatccaatttacgaattcgaaccaaaacagcacattgcccagtgtaccaagcgaaggaaactctaatgtacccttttgggttgatggacaacatcaagcagtagagcctcaggtgtttcagttcacaatggacaccggtaacactgtgtttccggatctagagcggatcaaaccttcctacgagtattcaatgtttggtctgaaccagatacattgaagcctgcaatgatcaccagcacggtcgctgctagtatggatgaataagcacacgtcctggactatccaagatcgtccaagacttgccccaatctgccgagtgtcaatgctatatccgtgtgtttatttaccttcccataattcagataaaccttgtgaacgccaacatctaagtatcaagcgttcacaaagtgtgctagtttcaaccttatttctgtcaaaatgtaattgctgttgtgcaattctttgttcttcgtgttgtacaaattattcattgttcttggcgttgtacaatctactgcctaaccatttgtcagaatattagctctttcgggaaacaagacatgatttttccctgtgcatactgtttttcagtgtctaatagtataatttgaaatcttaacatgtttaaagtaattttatccctctttaaaaaagggagagagattttaccccgatatgccgttgcgcttgacttctggtcgcctggacagcatatggtttctttctgactggtgcggtgtactatgtgcatcttaccagctttttacacggtggttaacgttatattttttttatcattaatttctgtcataatgcattatcaattactacaaaattaacatcatatataaatattttaaaatacgaataatgatactacacacatgccaccaaaaacatttttaattcatattagttaaaaaaaatattaatgtagattttatggaaaataaaggtttcttatttttagcacaaaatcttgtcccaaatgaatcaaaataaagctatttcttcacccatcatcttctctcaaccaatcataataattcttcatctacattctttttgtgaatcaatcataatattcctccaatattttcacctacttttttaatatctgttcctacaaaaaaaaatgccaacattttggaacagagaaagtattttagaacggagtactccaataagtggaagttcaacagactataggtgtttagaatttggtgacacaaaaccacttggaaaatctgcataatttacctggataatcaaaaaccggagtggaaccggcagatacattttagatttgacttcgacatagatgataggcatagataagtatcatggatccatatggaaaacaacacaaggagaataatatgaaatggatttggaggcgcaaagaatggcagcatatacaaccgactcaaatcaacaagaccaggagatgatgaccacaagtaggtcgacgcttcagacaaagaacacacaacagctgctgatcaaccagcaaatacagctgctattatttcacaagatagctcatttcggagaattacataacacggctctttgctaagatatacaatcatacaaggtaccatccatatttgataaagtagaaatcagcaattttaaaccttg

SEQ ID NO: 59528 - DNA, 4660 bp, Oryza sativa
tctatcctgcattagtttcagtctgtggtcattggccccgcaatacaacagcggaaacgtgccctgcggacatttctcataacctctatctcggcattctcaagcatgacaacgatctcggcaaatgatgggcaacttcagggtttgcgtcccaacagcaagtcatgatcttgctcagagaatccacacaatcctgcgggattgcaggacgagagcccctgtttacgacagcaaatgcagcctgaacggctgtcatgtttgtgaaggggagcatgccggttataagctcccacaagacaatcccaaagctgtaaacatctactttatgatcataaggcctgtgctggatcatctccctgcatgatggcaagataagcatatttgacagagatttaaaaaggtaaacagtaggcaatgagcgtgaatgcgtgattatgacttacggtgccatccaacggtaggttcctgtctctggggtcattccctcagtttgtacctcaattcgagcaactccaaagtcagctatcttgatggatttgtctgctgaaattagaaggttatctgattttagatccctatggataaatcgcaaggcatgcacataagccatcccccgagcaacatcaagtgcctgcttcacagccagccccagaggcacagacttgttctgccttcgtgcaaggaattgccgaacagatccaccttttgcatattcagtaatgatacaccaaacaattgatttccggcacgccccaatgaaccttacaatatttgggtgcctcaacgtagacaacatcataacttcctgcacaaactgctgttccatcaattgagctctctctgggtcattctcaggcttttccagcagcttaatagcaacgtcttctccattgtatgttccccgataaagcttcccaaatgccccttgagcaaaaggagctcccatgtcgagcttacccagatcaatggtccactcctcgtaattactaagtatctccgtcggatggcttggatccatcaatacccgagccaatgcatcctcattcagagtaggcgccatagcccggttcggatggatgacgctattgtgaaccgaataactcggcgccggcatatcacggaggccagggtgtttgagcatgaccgtgcgggactcgtttgatcccacgctgctgttatccaccgacatggcaaccgaaccaccaacaaagttcatcatgttcaggttgtcggcgttatccacggacatgtgggagctctccccgaccttgtggtagtagggcatattgtggaagccattcatctcgttttcttgccttcctctgcaacctataccacctccaattccagcaccgcccaacatattctgaaaccttgacccctcaatcatcttcaaacaaccaacactaacagtagggttgctttacgaaacagtagaatcgctgaaaaacatccatttctcagttttcttcagtgctcccacggtatctagaatcaaaacaaaaaactgattagcgcctaaatacgcatatagtaaagtataccatcaaaattatgctaaaacaggggcggatctaataaactgaacccccaaactatttggggaacaaccaaactactattcgtatcaagtttcaaggcaaattaagagaaaagcttcctccgaggtctagaagagaaacaacaagggttcaacgcaaaatttggggaacaagcaaactactattcgtgtcaagttttcaaggcaaattaagagaaaagcttcctccgaggtctagaagaggaacaaccaaagggttcaacgcaaaattggagggaaaaaaaaagtgagtgggtacacagcgatgaggaagaggatgaatggatgctcaccgggatgcggcggaagcagcaggacgaacggcggcggcgcgcctcgcgggatcggcggcgcaggcggcggggcgagctcacgaggagtcggagtcggagtcggaggcgacgacgaggggaaggggaaatatcgtcgtctcgtcgaggcaccgcacaacgatctcctttttgttttccctttttttttcacaactacgctaggaaggatgctgattatgaaacattggtactactatcttttacggggaatgcaattaaaacgtagaagctcatggcacctgcaaactcactcccacaatataagttattttaacgtgtgtacgcttcgtacacacgtacatccatgtctacgagtaccttcggaagattgagctgatatatcttgagattaatgaatcattaaaatttcataattttaatataaatttgttcttctctatactgggggtaaatatctcagtattctttcgctattttattttgttttgttctcatttttctctattttcgacgatgatattgtttaaccttacgtgttaaacacggttagcaaactcgagtgtccacaatatgtactacatatttgtatttagtaaaacataataatttattctagatgcctaacttggtatttgttcaaatacatcacggatacgtatactaacacaacaacattcatatgagaatttgtattaaaattccgcttggaatcgacttaatctgagaatttgtattgtttttgaacttttaaatatctaattttaaagtagactattttttaatatgaacttttagtcataccaccctatctaacgtaactgaaaaataaccaatgctaatgttatcctaccaaactcttaaatagaagacgatccaagtatttttttactattgtagaaaatcttttatatattttgtgatgaagatagtaaaatattccatcatctcgcatcatggctgcattagcactttatcagtcaacccaaagtctcgaacctactgaccagagcacacacattagattcatcaaaccatgtggtccaattcatcccaattgatgagtagattaactagggaaatcaagcaaatttcgccgaatttcttctgccaccaccgtcgtcgtcgtaccgtatcatcatccataattgtttacgcgtgtttggatccggacgcgcacgtcgtcgatcgtttgccggccagcgattttcccccgggtttgaagtcaacaaaagcgatcggctggcggcttccgtttcgtcaggtcctaatcgcaaatctctttctccatgacgccgattaataaagtatatacaacttcagatgcaaattggaatctttgttcttgtttagtactctttccgtttcacaatataagtcattctaacatttcccacattcatattgatgttaatgaatctagatagatatatatgtcttagattcattaacatctatatctatctagattcattaacatctatatctatctagattcattaacatcaatatgaatatgggaaatactaaaataacttatattgtgaaatagagggagtatttttttagtgtgactttaattaaagtgagcgtgggacgattctgattcgcatcggcgaataatctgcgtgattttatgcaattatttgaaacgatttgagttcaaaaagaaaatcaaatgattatagcccaaaagaaacaaaggaatacaggctgatgatgagactgcgagagatcatcaaatcccacctatctaaagactaatgggccggaattctggcctgttaaatgggcctacatgggccgcatgattaataagcccaaatcttagggccgaaacataataggccgtacgtataacgggccgtaagttaaaacggcccgcagattaacaggccggatttttccacgttgacttgtcgcacgaaaaggtcatgtcaatgggcagcttaatgagctggcacttcgaagccccacaaatacttagcaggccgaaattttgtttgaaggttaacaggccgaaatttgacactcaaattttcaggtttttggaggaaaacacaaaataataatccctccgtttgttaataattgataattttgactttctcattaattatttttacattgttagataaatgttaatagatttcattgtgtatcatttcattaaaagaagagaacacgaaaggaaaagtgtccaccaacctaatccaaaacaggccaaagcctttacaacacaagcaaaaacctcaccttcaaagggctatccacttatcaacaaataaaacaagtgatcaaatttctaaagcgaatattacctagtgctagttattaagaaacgaagggagcagtcttcgacgatgcttatatgggtagagtttgtgtgcgtacgttcatagagataagtgcacgtgcgctgtgagtgtctgcgttgtactatgtaactctaaaaaaaaaaagaaacgaagggagcagtattaactaatccaaaattacgcccttttttggcacggctctaagctgtgagttctagagaaaatagtttgtagattaaactaaagtaccacagtttagtactttttatgtaaattctaaaacatgaaaaaaaatgcctcactctaataagcagttctaactcaaaaaatcattttggcaggtgaggctgcgactacctataaattgcgacattgtttgtattggttgcagcgcaccaccaagcatccaaacagacctagcaacaaaatccaaacacaggattttcaagtcacatgatttttttaaaaaacag

SEQ ID NO: 59529 - DNA, 6160 bp, Oryza sativa
gatctcatttgatcgaagggtgcatgttgctttctactgtcatcctagttagcggtagtagaaatttagaggggaaaaaataggggtatacttgttatttagcagtgagccattgactaaaggcatgttcagattgtattcaaaataaaccttttttttttcaaaaatcgagcgttgtttcaccaagtagatcgagaatgtttcactaagtagttcgaaaatgttttagtcttttaaaaagctgaaatacaaccaaatcacctcgtggaacattttgctacaacgtatgatacaaacggtttccaaaaaatcagacgttgtttcactctatataaaaacaatatttcaacaaatagcaaaatactatttcaattcactgcaacatttgatccgtacatagtgaaacatcacgagtacactagctgaaacatttttggtggaacaaaaaatgaaacggattcctttactatagcgtttccgtaatatgcagttgatttgttgcaacaacgtctgtgatgtgcacttggtggaggcggcgcgcaagcgtgggaggtgcgggtgcctgatgcatgcacgcaattttcgaaataaaccttaacaaattttggcaatgccaaaattttaggaatttggtaatattgccacatctgttagcagcgaaatttgataagccccgaagacatcatcggactagagtcagaattggcttcagaatcctataatcggccaatcaaaattatcacatcgccaatagtcggattcctgctatattcggttaaggaaattaatcgaattaaaggaagcttatccgaagtgaccgagttcaagaaggatacaacatggcaagttatctattaattaggaatagtttgttagttttcttttatctttaggaaagtgtgtttagtgtccaataaggactttatgtttccgttttaactttagaaaagtttctttcttgtcctacaaggactagtatctatccatgggtgtaaatatgtacacccgaggccattgtaatgaatctctagatcaatactactctcggtgcatcatcaccctctttcccgaggtttttacttatcaaccagcggaatttggcacctaacaatataaaataacaatataatcaccatcttgcatctatttatagcaattgtacaagagctccgaacgaaaaagccggccaacgatatccatgcagcaccgtgcatccatgcatggttttcttacccccccacccacccccaaccaccataaatacacacccagctgcaacatggatcacaaaacacatcgatccatctaaagtttatatagtactacgagaatatcaatctattgcaaagtatctaaagtaaatacacaattggttccaaactttaaatagaaaaaaaatctttacactaccaacgtgttaaaaggaactagaaaatatatcattagttccaaactatgtatgtaaagaactaataaatccttaaggcctaaaaaatgtagtggtggtttatgatccctcgtccatcgtaagcccatcctcactcccatgccctctcgagcgagtcctgcacgcatgatgtcccttccactgcatgaatggaatgcccccgacccccaccaccgatcaaaatcaatcaaccatcattccccggtgcttggccatggacctcctttcacgtctagctctcaacctgcaggatgtaacgacatgtgcacttgccaataaaaaattcaactgaatttatagtgtactcctttttaatgtacaatctacacccagacctagaattgttggattattttcataaggtcacgtgctcctccccacatacgcctcatcgagttgtcatcttgtattcctatcaaatgtattgtatcaactgccaccaccgctcgatatccagctagctgactaggtgtgctctaccaatttacttagcaccagccccatctcaccataaatgctaacctatgtcccctatcgagcagacccgcaacgggccaacacatgagcccatccgtcactgccacggttccatcaacatctagctgctgatggcccctctgcaacatctactatggatgctacacggtggccctttgtgtgcctggccatcactcccgaccgttagctctaccacccctctgttttccactagcatcttcgcccctaatattttcatgtcttggtccatatcctccataaacggaacatcacaaatttttattatttgtaatttaaaaaaaaagtacagaaaacatggaaatgcataactactttttgagaggtctgcatgtcctgcaccagcgaaacaatcggaactaccaagtttgcatctatttataggaattgtattagacttgctcgacgaaaaagccggccaacgatctctatgctgcatcatgcgtccatgcctggttttctttgccccctgccaccataaatacgcacccaactacaacatggatcaccaaacacctcgatccatccctctacccttcaagaaacaagaaagataacaccaacaaactagctagctcgccaatggcctcgttgtcctccttccggctctctgtggcagtggcggcattgttggtcgtcggctcgtgcgccactgaggtcaccttcaaggtcggtgagggttctagcggaaaaagtctagagctcgtcaccaacgtcgccatctctgaggtggagatcaaggagaagggcggcaaggactgggtggcactcaaggagtcatcgactaacacctggtcgctcaagagtgaggcggcgctcaagggccccttctccgttcgcttccttgtcaagaacggcggctaccgtgtcgtcgacgacgtcatccccgaaagctttacggccggctctgaatacaagagtggtatcaacgtctaattaatagacatgagtattcttgcattgggttgcatgataattattaacctctaaataattttgtcttgaaagagatcatgctatgcgtgagcaagcaaacaattaatttcttgtggttattttgttgtaataagccagtggcaaaataaggcatacatgtgtccttccaaaacattgttgtggagctatatgtgaacacgatttcaaatatatgctgtttatagtggatgtatggaaaaatgttatatttggttagctttcattaagacgattgtgtgtatttgatttctcaaaattttagtacatatatatgtccaaatcaatgtagcccatttctcccttttagcttgtcataaatattgtttacagttgtttttttaaaaattttgtggaacaaattgttgaatcgatcacaccgtgacatgaaactataagtataaagaatcagtacatcgtttagcttattcagatgctaaaacaaaatgtaagtcacattaactaatcatatcttctggacccccgtttttataacaggaatcattcgtgtaaacagtaccatttccctggatcaagtagtctggtacacacgagttcatagctgaaataccaaaagcacatacacgagagtctagtgctaattattacatcataagcccgcaggcattgtcttaaatcatcggaccgagcagttcggaatacatccaaaatgcagaaatagataaggcagcggaattcaggcgcagcggcatgccattgccacaggcaacgaccgtactaagacctactgagcgccatcgtcttcatctccctcctggtagtaggcatagggatcctccaaagctttatctcctgcttctgattaattttatatttgcaagggtgagtaccaaccgtactcagcaagccaccacaacaacaatgcatatgaaaaggggtatttcaaaggatggctatggctcttttgcgctaagccagttttgtaattcttttcacaaacctaagacctagcatagactgatcaagttttaataccagtgttcacattaaacaacgacggttctgtccaccatccattgtgatcccaaggatagcttcccgccattgagtcgtcatggttttctgaggacgtccaccttccctcctctcaggaagtggctccatcagcataaaaaatcatcatgcaatatcccatcccacacaggttaagaatttagagtctagccaagtgtaatacatgtcccggtgctcaataaccgcgagcacggctattcgaatagatttggtttactcacactgcagtggatgtacactttacccgcactccgcgactgcccaacacatgagcctcgtcccaacacatgagacgcgtcacggcaaagcttttcgataacctcgcattggcagtacccgctccatgaacttaaatcctcatgcactctaggcgtccatgtttctagtagtgagaggagttctggcgctcccaggaaagagaagtctcacacacatattaaattatggttcaagttaagttctctctctcacatactcatggcagtcctaccaatggcgacaccgatgtagggcacgcttctcggccctacctcaacggctgtcccatcgtagcgcacctgcctcactcaggggtgaaccatctatgcagggatactgcctccgctcggctatctaatccgctaggtctatacccattcgagaagtacagttgtacgggggtcgtttcatgcttaacttcatggctcggtccttaattgactggggacggtactagccttttccagataccacccaaatcatccgtccgccccagtcgaaaacagttgttttcgctttattttcctttcacaaatcatgttatcaatttcatggcaatgtggcgctcatgtctccacataccgcatctcaattaccttcccaaaggtaattgcccaagcatttagcatttgataaatatgagtatgcatgatcctagaatagcatttctaagcaattgtcataattgactagggactcatacgtaaacatggttacgaaggaataagggataaacaataatcaaggcatggcataatcacaagtaggatgttcatcattgcatgcaattttatttataaacaaaataatttcgcaattgggatcaacatgttcaaggaatagtgatgacttgccttgctcaaggtcttgggggtcttggccttcacttggatccgcaactccctcgggctctatagttacgtgcgaaaactgatttggattcgattagaattcaaataaaaaatccaaataaatccaaatggaagtcgaacgcgaaagtcgattcctttattttaactttattattcgcgaactaaggcaaacccaatttcgattcaaactattttgcgggtataaatgttttgttgtcataagtttttaatttaatctacccgagcattatatccatataataggttagagatttctatcgcgagctaaatatcggacgaaatcctagaaatattatatgatttaatttagtctatgactaaatgattaaatataatatacggctaaaatccctagtaaataaatccgaatttctaccgtgaatcgattacttatagagattacccaaaataatctataatagtctataagaattcatctaatcgtttagttcctaattacagttaaactactaccgcgaattgatttcttgtagaaattaccaagaataatctataatttatattaaattttgcaattctatgaccataattaatctataattaaattctaattattttagattttcttaaactattaacctccttaatttcttcctaattttctatttatttttccttttctttttctccattctctcttctctttttctttctttttctttcttttctctctctctcgttttctttcttttctctctttctctctttttctctctgccggcctctcttttcctctccctctctctcttggctctctcccaccagagcggcggcggcggtggacacgagggggaaggagggcggctcaccggcggcagcagcggtgacgacggcggcagcgacggtggcgcacggcggcgcgggagcggcggcacggcggcacgggaacggcgccgcggcggcacgggaacggcggcgtggcagcacacgggaacggcggcgcgacggcacgagagcggcggcgcggcggcacgagagcggcggcgcggcggcacgagagtggcggcgcagtggagag

SEQ ID NO: 59530 - DNA, 8140 bp, Oryza sativa
acgggcgacggtgcggggctcgagacgggcgacgcaacgggtggcgtggggctcgatgcggcgatggtgacggcgcgcggcgatgggactgcgactcggcgggtgtcgagcgagcggcgtgacaggcagggcgacgcgacgcgcgcggcggcacggggctcagcgcgatggaatgggcggcgcggcagcgacgcagggtgacggcgaggggacggccgcgcggcggggcgcaggcgcgaggggacgggcgcgcggcggcacaaggcgcgaggccgacggcgacgcgacggtgacggcgcggcagcggcggcggcgcgcgcgacgggcgggcgacgcggcacacgcggcagggaagggggcggggccagggggaccacgatcgaacacctatgccgcaatgaacagtaacttttcctatttatcccgattttagcccattttctatttaaatatagtcctataaattctaacttttgcataaatgaagtttactccatatttgtgttatactaactaaaaattcaccctaatttatatcactcatatttattttatataatttatttgaatttttaattagggttaattctcattccatcgtactaaaatttaattattgctaatatggtcgcgataatattttatatatttccaatcccacctaatatttattttaatttatattttaattatttatttagccaacttgatttttagggtttattcctagttagttattcattatccgcgattaataaattccgagatcaaaatccaatgaaataggcgaataaaatcggcatgatgcaatttattacttaaaaagtttttgaaaatctgtatttttggtgttttgatttcgttggtcgaattttcagggtgttacatatctccaacatgaataagtggtaatggatagaatggaagcgaagccagctttgagaggtgctaagttaagcttcatttcatatagttggccaaggccccaagctatagtcatcaacaaagtttatataatactacgagaataccaacctattgcaaaggatataaaataaatacgcaattagttccaaactttaaatagaaaaaagaagcttacactgtcagtgtgttacaaaggatctagaaaatataccattagttccaaactataaatgtaagaaataataaatccttaaggcctagaagtatagcggtggtttacagtccctcgtccatcttaagctcaacctgactcccatgccctctcgagcgattctcgcacgcatgatgtccccttccctgcgcgaatggaagcacacccctgacccccaccacccgatcaaaatcaatccaccatccttcaccgacgctttctgcggagattatgagtaccgcatacccacacggctgggctatccgactggttacaggggatagatcatgtatatagaatatgtaataaagtaggactcggtcgctatgttgccttgtattccaaggcagggtataaagccccaatcgggtactaccatgtactccctctatcccaaaatataagcatttttagcatagtgacaagtcaaacatttttaactttgaccattaataacaaaacaataaaaacgatcaatcatgtaaagttgatgttattagatttatcattaaacaaactatcataatatacaactctttttatttaaaacatcttacttctatagatattgttagtcaaagtagcatctcgaagaccgtgtcagggtccaaaaatgcttatattttgggatggagggagtaatagattaggatactgataacgtgtccggctaggtttttcctttgtaaccctgccccccaacctatataaggcgggcaaggagccccctccaaggggcatgggcagagattcacaatccgatcgtcagatcaatactacaacccgacgaattcaaatccctaaataggagtagggtattacctctcattgagagggcctgaacctttttaaattcttgtctccgcatccatccacttttaggtctcgtgcgctaccccctttataatgccgaattctagttcttcccgtggaccttctttcatgtgtagctctcacgctgcatggacataacaatatatgcacttgctaattaaaaatcaattgaatttaaactatagtcttgttttagaaaaaaaaaagttagaaaaaaagtatgttatctctcatttttcgtcggtgagatactggtacataaaagactagtagcctacgcagacagcagcaacaccagccctacaaagtacgaattgaatctttcggttcccgtgaataagaattgttaagtagcatctacactaaaacctgtatcattgtaggattattctcattatgtccacgtgctcctccccacctatgcctcatcgagtcgtcatcttgtatctctgtcaaatgtattacatcgactgacgcaccgctcgatattcagctaggtgtgctctaccatattaattagcaccaaccccatttcactatagacgctaacctatgtcccatgtcacatagccgcaacaggccatcacgtgagcccctccatcactgccacggtggcgttaacatcgagtcgttgatggcccctctaccacatatactatgtgtgccacagtgtgcccctctgtgccatacgattactcctgattgttagctttaccacccctttgtcttccactagcatctttgatcctaatttgttcatgcgttggttcacatcctccataaacagaacatgagaaggtgattaatttgttggttgtaagtttttaaaaaatagagaagagatagaactacataggtgctttttgagaggtctacatgcccttcgtcagcgaaacaatcagaactatccagtttgcatttatttatagcaattgtataagagttcctcgataaataaactgttagttccaaagtttaaaagtaaaacaactaataaatctttaaatttaaatgtagtagtacgttttttttttacaaggcagacgtgaaatgctcgatcaaggtctccgatgtaaaatcggcggcgccggttcggcgctgggttggcgctttggcaggtggcgtacgtcgtcgtgcgaggcagaacgagcgcgcgtggcgagacgaggcgaggaggaggggtcggcacgcgggggaccgggagaagaagggcgagagacaaaccgcgtgcgcgcgcgcgtggtggtggagtggatggcgacctcttttttgggcgttttccgccccgaaaatcctccgttcccgcgtcctcaccaaagtacaactccagattggtttcgtatctatctactctaccaccgcaattaccagtattttctaagatttcgagttattgcaatgatgatgatgaagctgtcacacttgtaataacaagttgtgtactcctgctggagttagtgggcagaggatgtgattggaaggcgtacagaaatggattccgctaagcacaaacaaaaccgagtggagaaacgggggtggtggcgagcactttgacacggtggttgattgattcatgccatgctgccgcccactcaaaagcatcccctctcctcgctaatgccatttcttaaatcattccatggaaccttccaaacctggatctcgcaactttgggcaaccacaaaacaactcgttcccaaagcatagcaaatgcaatgctactccctccgttccatttgaagtgcatctacaaatttccgtgtctaacgtttaaccatccatcttatttattttttttataattaatatttttgttgctatttgatgataaaacatgaataatattttatgcataacttattatctttatttttttaataattttttaaaataagatatacggtcactgcatttaaaatggttcggggagtactagtagtactacaatacagatggctctgctcccatgtggacgtacgcctcgcgcccccatgtggtgtcttggatttggttcggatttaggcgtaccgagtccatgccaatcacattgtttttccacgccaaattgcgtctcccagaacaccaaacatatggtggccaagaaaatgattgatacgcacggtggatggatggatggattggtggcgatcgatcgattggtttgatgatgaaaagaaaaacaaatccgaggagcacctggaatcggggacatgcgctgaaccgggacaaggaaacagccccttgttttgcgaacttgtagttgtagagttcgtgtggagttgctgtttgctgttgccgtgttggggtatttttctgccgtttcttggagtctttgggcagtaggttcaacagctaaaggagacaaacctctctccggccgtgttgcgaattcgcaatgcaaaatgcaaccgacggtctggtctggtggtgttgctagtcttccatttcaggtgccattgtcaaaaaactcaaaagggcatcacaggcacagcacagggatttctgtccctcggaaactcattgataaatttattacaaagacctagctttgttttgttcttgtgtcttttaatcgtgtcaaatgaggtgtttaaatctatgggtgtaaagttttgacgtgtcacatcgaatatacatacacacatttgaagtattaaatatagattaataagaaaacaaattaagattccgtctgtaaactgtgagacgaatttattaagtctaattaatctgtcatcagcaaatatttactgtagcactacattgtcaaatcattaagcaattaggcttaaaagattcgtctcgcaatttacacgtaatctatgtatttttttaatatttaatactctatatatgtgtccaaacattcaatatgacataatgaaaaattttgtcatgggatctaaacaaaccctaattttagccagacgtgtcacgtatatgatatttccttggctaattaaatttaagcatttgaaacaatctgtcaaaaacataaacatgcgcatatttgaatcaatcacataaagaaaaaaatgagtaaaattaagtgaaaaatatgatgctatatttttaccaaataaactcatatggccatatatcacttaataaccaattaaccatgatgccatcagtcaaaaaaagaaaaaaaaaccatcctaactaaaacccaaactaaaccactgtcacggccaaatcctcttttcaaccatgcagcacattaatcaaacccccataaactccaagcctctccaatccaaccataaagcaacaagagagaaaagaaaaagaaaggaaaaaaaaaaccaagcctcagctcagctccccagttgcttcccctgctgcatttattaatccaaagcagcttccttttactctcgcttccctctggcacagctaatccaaatcctcctctttttcttgttttttttttctttcttcgtcttctccaacgcccaaagtaaaacaaaggaaaaaagaaaagccgcatccaagaacgcaccagaaatttcggcgacggttgcgcgcgaatccatccatccaccggcggtcggagggcggcggcggcggagcaattccgcccaaccaagcggcggagtcggtgcgggcgaaatttccgggttggtgcgcggggcttgggttggtggtggtggactggtggtggtgtgtgttcttgggagtggatctggcaggaggctggcgatggggaggcgggagtagggggagcggcggattggagtgggaggcgcggtgttgggggctcccatgggcggatgcttctcgctggaggagcaccggctccagggcaagacaggttcgtccgtgttctttcttgcctcgagctatatatatcttacttagtctctgatgtgtgtttttgcttgtagtagtagtagtagctgtgtgcatgttgcatggaagtgaagtttttgttgtaatttggttgtgaatttagtcgtgcggttgggtttttgggcgtattgggggctatggattttcagcgtatattcagcttcagaagatttggtttttgagcgagaattgctgtctcgtttatgtcagagttccgacaggatcaattttgtctctggggctatatcatgtagtaactcgtgttgcaaattcgggttttttaggcatcgcgtggttgatgtttgattcttctgtgactgagtgtcgagtgtgaggaatgccattctctaagtgctaaaagttttatcttattggacatcgttacattcaggcctctatctgtagcttagtttctcttttttctttgacaaagacgaaacttgcatggtacaaactttgctctttgatggctggtagaggacacgatattatgatgtactggtatgttgtctatgaaatttgcagtcacggttcctgaaaagtcaaactgcagcaagtcaaatttagctcataacttggtttgaactacattggcaaagctgctagaagattttaagttggttggatggaagtatcgagtaacccgtaaattagatgcaaaaggtttgttctgcatagaagattcttgttcagagactggaagagatgacaaatgttgtcctgcatataggaccatgagcagcaaatgcgtgtttggagctattctagaattttattgagataccaaattaaattgggaccttcctttgtcatgtcatggcctttagctgcacattaacctgccacttgaacgtggaggatgatcaatgaatacttttgttgctgtagagctattgcaaaatgacattgtagcttgacacaatggaacacatgtttcttaagttagaagatgaacaccattttgggtaggttagtggtatttacaaactaagatgttatgcttatcagattatcattttgacataatgcacaacaacattacagagactgcacagcaggagctgtatggggggtgttatatgaattaaaaaactaaagtactaaggcaaaataatcacgccacattgtagctcttaatgttcgtatgtaattgattattccctgatgttttttcttttctattaattctataagcagaagctggtgggccagatgggttaaggaaatgcaaatctgattctaaagctacagcaagtgtccttgcccctccaaaagatgtggaggacctgcaaatcgaaggatacggaaatgttaatattttcacatataatgaactaagagcagccacaaaaaacttccggcctgaccaaattcttggagagggtgggtttggtgttgtttacaaaggtgtaattgatgaaaatgttagagcgggctttccatccacacaagttgctgtgaaagaattaaacccagagggatttcagggtgacaaggaatggttggtaagtatccttgctttatttcattttttttgaaaccatgatgaactatacacaagtctatcagccttcatcagctaattagattttacgattcaatttaatgatcataatagttgtttgttattgtagtttctatattacctgacttatttacattttatgattttaagcaaggacattgaaagagtacttttatactgattagtgtttgattaaacagcatatatcagatacttatagttttattatttgtttccaggcagaagtcaactaccttgggcaacttagccatccaaatctagtcgaactgattgggtattgctgtgaaggctctcatagactgcttgtttacgagtacatggcttgcggcagccttgaaaagcatctttttcgccgtaagctgaccctttccttcttgacagttatcactcccacctactgaatggccgttgtccatggcagcagaacctgcaacatgtttattgtttttgcattttcaaaagtaaaaaggaaaatggtcagtttggtgcacgctgcatgaacaaaaacactaatttattttcaacaagatgagcagatctatcagtagaattaatataaatgcattcacacttatatttctttcagtgctcgatttactggtgcaatttaatctaatgagtagtgaccactatatacaatttagttgtatctgtgtacccgttccctccatgtaattttcaaaaataaaggattttcttttgaaacgataatggttagcatatgttttgaagttctcccaagtcccaactagctactccctccgtttcac

SEQ ID NO: 59531 - DNA, 3415 bp, Oryza sativa
agaatgacttacattgtgaaacggaggaagtatttaatttaccggccgtatcatcaagttggccagttgattttgtctgagttgaactgtttagttgattctacaatctgcatgcacatgctaactacgctactagtgaaaaaagaagaaacgattttcttgctgcatggcttgctcacctttgattgatctattgagagaacatgtatttttccatgctaaaggacacttttgttgatttatcttcttgctcgtatgataattgataacaggggtttgccttaatatgccatggtctactcgaatgaagattgctctaggtgctgcaagggggctggaatatcttcacggagctgagagatcaattatatatcgagatttcaaaacatcaaacatcttgttagatgcggtttgtacttcatctactatctgaatactttgatatcattaccctttttcaatcacttgttataggaattccatctcatcaggctctagcaactttgttctttccaacccagacaagattccatttcctacattgttctgaactcttggaatgacagaactaacagttaaccggataacttagcctacatgctagccataaggcccataactgtctttacagaatccaagattctgaagtagtgatagaatagtgtgcttgccctccaaaccgtcatggtggtttcagttgctgccagcatggtcaaagctactaaatcttctgatgaatgaatgattcaattctttcagcagtaagattctaaacatcagcgatctcaataacgtaccagtttggatctggtcccgcttgctcttcaacacagtcctgtttaccactgatatttcgactgaaatctttttaatattctcaatttattagtgtgacacagcaaaaagtatgtaaggacgattacaaatgaaacacttgatcaatcatttatttgtccctggtcctcctccatggttccactttaaatagtagatattatgtgtgccctcatccatccaattaaaccatgcaactctgcacaaggaatactgatctaaatatcttatttcagatcttgggatgttatatgttgacgattatcttatgatactgccgcagtctcactctgtgtcacctctgcaggattataatgccaagctgtcagactttggcctagcacgaactggacctagtggagaccaaacccatgtatcaactcgggtcatgggtacttatggctatgcagctcctgaatatgtcatgacaggtgagcaatggaatctccctgtatttttagaatgccaacccgttcattcttgagtgcatttaatgttcttaagtatgaatatgcatatcattgtagctgacatcatgtatgttaaattgttactctaaccagtttgatctgttacaggccatctgacagcacgaagtgatgtctatggctttggtgtcgtccttctcgagatgatcataggcaggagggctgtggacaagagccggcctagccgtgagcacaacctagttgagtgggcacgtcccctcctcgtgcacaatcggaagctgttcaggattatcgatccaagaatggaagggcagtactccaccaaggctgccattgaggtggcaggccttgcgtaccgatgcttgagccagaatcccaaaggacgacccaccatgagccaggttgttgagacctttgaggctgtgcaaaacatgcctgaatgccaagacatactcttgcagaactgcatgacgggtgcagtgacactctacgaggttgcaaaggaccctacggagagcgtcgagccggagaagataaaacaagaacaaccagcagcaaaaacggtcaccgtggcaccggcaccggtaaatggaaaacccgtgcctcagagcaggagaacacggccagggaatggccggagcaagagcgagccgtctttggaatgcaagctgtacatcccatctccagactctgatggccagcagccaggcctggaggcattgtcatccccttccagagatggaagcataaaggatccaccggacgaggatttgtacaagatataaaagtcacacagaagttttttatgacgattcaagttttcgctaccggcgatttcgcattgccatccatccatcttgttgtcaagatcgatcagagtcaaagttggtgttaaaattttttctgatggcggaagaactctacctcgttaggtttcttgctgttccgactagcaattgtatgtagagaggagcgttgtggaaagcatttgtaatgtgagatgcctgccgcgacgaaaagttcgtgttgtaaacttgaaaccattctctgggaagaggaagatccacatcataatcgatgtgtcagtgttgttgttgctcgagtgtttttgacttttctgtatagatgatgatgtccttgcaaacttggtacagttctacaggaaatcaacaagaagatggaaaaatataagatgaatcagtgtccgtttgttgacagtttgtttttggagtatggttttgttttcactgcccatctggaaattattaggaatgtgagatacaagagtatgcttgaatgacacatcactatcgaggatatatcatctaccactgaaacaataagtaaatgtaaatgcgagcatcccctagtgagttaattccactaaaaaaagaatctaacgaatataaccagttgaggtagctcactttacatctatttattatattataataaggatagttaaaaaaaaaaatcactacattgacggcctataaattatcacatagaataaaattttattacacaaaatatgaaaatagaagctaagaattgtataactccaatgcaacttaaattccttaaatttttactgagactatttggtagggtaatgttgctgcggcgcagctgcagtcacgaaaccttcattgttagcttctaactgcaaccacacgtaattaaagtaaaaaagaaaactgaacaaacactgattcaagcctcttagttttacgagtactactaaatacactgtaggttaagacctaagaaaaaaataatttgaagttgtataagaacccagactttcacttcaatgggctggtttagtttccaactttttcttcaaactttcaacttttccatctgtcggtgatatgggaccgggagtatcatgaccagaggcttgaggcagacgcaatcgcccacgtggcctggcaccttcggggacgtcgggcccgagggtgaggtgtccgccctcctcctgatttcccccgaggggggggggtcgggttgcgcttgccccggccccgagggccgaggcaccccgaccccttaaggaagtctgcgccacatacatgggataagtgatcacagctgtgctcacctaacagcatttattgcagtctggtcaa

SEQ ID NO: 59532 - DNA, 23482 bp, Oryza sativa
aagaatgaccggtctggcactggtcgcgtcagcaacgggcagccacgatcccacgttgcgcctgtctccgccgggagtggaggtaggtgtgggctgtcccatcggagtgtcattcggacagcaaccataccaatctccgtccataaagagaagaaaagtccagtttggaaagggaagggtgcatgtggtatccccttgaagtataaaaggaggaccttgcccatagagaggggggggattcttttcgagatttagagcttagaacgggggatttttggtcctttcggaaggctgagaggaaaggaagtcgatcctttgtaacttgtccatacacaaatccacaaaaacacaggagtagggtattacgcttcgcagcggcccgaacctgtatacatcgtcgtgtctcgtgtgtcttgcgggcagacgatctttccagatacagagggagagcgagagcttgagatttcaccctaagcccccggccgaaccggcaaaggggggcctgcgcggtctcccggtgaggagccacgagctccgtcatctggcgcgccaggtagggggctcagcgtgtgttttctgagctctcagactcttccgtgtgcgccaagtttttcttgttcagcctaatggccgagcagggaaaagcgcacgacctctctccgagtgtgagcggcgacgacggggagccgaatccacgccgtcgagctcgtactcccccacctcctccgcgccaaagccctaagcagggggaggcgcttgagagggtcgacaaatccgtggcatcaccagtcgcaggtgatgcaggagaacggcgagatggggagcgtcgcctcctcgtctacggcgacggcagcacgcctcagggtgcgcttcaggctgctggcgcgctcctacgacacccgcctgtcgtccatgacccggagtctccagcccaacgatggctggaagacgtggccaacttggtcatgacggcacagcagcgcctgggtgctggtggacggtccgccaccaccaagacctccggcgccgctaccaccggctccgtgtcatcaaggcggagggcgcggcgagcggcggcggctgcacgtcattcggctgccactccctcgtcgacaccgtcgactcgggaggatcagcatggggagccggatgcccgcctcaacatcgagcgcaggcgtaatagccggcgtactccccgtgcaacggagggcgcctcctcgtccagaatgtcacctcgacacggacgtgaagatcagccctccgtgcccccggccggtggtgttggctgtagagcctttgtggcgagtcttcggaatgtccgttggcccccaaggttccggcccaccatcaccgagaagtacgatgggagcgtcaaccccaccgagtttctccaggtctatacgaccgggatcgaggccgctgggggtgacgacagggtcatggcgaacttctttcccatggccctaaaaggacaggcgcggggttggctaatgaacctgccacccgcgtcggtccactcctgggaagatttgtgccaacagttcaccatgaacttccaaggcacatatccgcgcccaggcgaagaagcggacttgcatgcagtacagcgaggcgatgatgagtcgcttcgctcgtacattcagcggttttgccaagtccgcaatactataccatgcatccctgcacacgcggtgatctacgcgttcagggggggtgtgcggcacaaccgcatgctcgaaaagattgcctccaaagagccccagactaccgcagagctttttcagctcgcggaccgagtggctcgtaaggaggaggcctggacctggaacccctccggttccggtgtggcagcttcggccgcccccggatccgccgctcagacagggcggcgtgacaggaggaggaagaaaaggtcggcccattccggcgacgaggggcacgtcctcgccgtcgagggcgctccgcgggccacccgaaaggggaggcctgcgagcgacaaaaagaaagaggctggtactcccaaccgggagcgcccagccagcaagtggtgctccgtccacaacacctccctccacgatctcgcggactgtcgtgcagtcaaaaatttggctgagcgaacgaggaagtgggaggaggacaggaggcaggaacgccgtgagggcaagtccgcggcagttccctccggtagacggcgaagtgaggccagacagaaggcccccgccgttgaccccgatgacggtgatgatgacctaggtttccaagaacctggggccaccattgccactgtcgacgggggagcgtgtgctcacgtttctcgccggagcttcaaggctatgaagcgagagcttctagccgcggcccctactcatgaggcgacgcgtcgggcgcggtggtcggaggtggccctcacctttgatcagaccgaccacccaccgtgcgttgcccggggagggcagattgcgatggtggtttcccccactatctgcaacgtgaagttggggcgtgtcctcatagatggaggagcggctctcaacatcctttcccccacggcctttgatgctatcaaggccccggggatggtgctccagccgtctcaaccgatcatcggtgtgacgccggggcacacatggccgttaggtcacatcgacctaccggtcacctttggtggatcagccaacttccgcacggagcgggtgaacttcgatgtggcggacctcagtctgccctacaacgcggtcctggggagacccgcgttggtgaagttcatggcggcggtccactacgcctacctccagatgaagatgccgggccccgggggccccatctctgtccgtggcgaccttaaagtcgcgctcgcttgcatggagcagcgcgcggaccacctcgctgctgcgaccaagcccgagggtggtgacgagaggcttggcacctccgcccccaccgccccgaggcagcggattgccacatgcgacgaggtcccggtcaaggaggttgccttgggcgacggcccatccaagaccacacggattggtggtcttctggatggcaaataggaagacgcgctcgtctccttcctgcgggcaaacgctgacgtcttcgcatggagaccagcggacatgcccggggtccccagggaggtgattgagcaccgtctcgccgtgcggccgggcgcaaggccggtccggcagaaagtgcggcggcaggccccggaacgtcaagccttcatccgcgaggaggtggcgagacttctggaggccggattcatccgtgaagtcatccatccggagtggctggcgaacccggtggtcgttcccaaggcgaacggcaagcttcggatgtgcatcgactacaccgaccttaacaaggcatgtcctaaggatccttaccccctgcctcgcatagatcagatcgtcgactccactgcggggtgcgaccttttgtgttttctagatgcatactctggttaccatcagattcgcatggctagggaggatgaggagaaaactgcgttcattacccccgtaggaacctattgttatacatcaatgcccttcgggttaaagaatgcaggtcctacttttcaacgtactactcgaatttctttgggtagccaaataggacgtaatgttgaggcttatgttgatgacttggttgtaaaaacgcgcaaccaagaaactttactttcagatctagcggaaacttttgagaacctccgctccgcccgcataaagctgaaccctgataagtgtgtgtttggtgtacctgcgggcaagcttctcgggttcttggtctctgcccgaggcattgaggccaaccccgagaagattcgagctatcgagcggatgcgcccccccagcaaacttagggatgtgcaatgcgtcaccggttgcatggccgccctaagtcgtttcatatcaaggctgggagagaaggcgctacccttgtttaagctcctcaagcgctccgggccgttcacttggacggaggaagctgaacatgcccttactcagttaaaggcgtatcttagctctcccccggttctagtcgccccggagccaaatgagtccctgttactttacttagcagcgaccccccaagtagttagtgcagcgttggttgtggagcgcgatgaggacaatcctcattctgcgcacccccactctgtgccgacttggcccgggagcaggcagggaggagaggcccccgagtcgaacggtggcctaaggcccccgacgaccggagtcggccctctgcccgcttgtcagacggtgctgggtgcccccgaccctcaggaaggccccgaggccactgagggaaggccgcacttatcgccctttggccccgaggctaaccctgtgctgactcgacccgggagagagcagggagaagaggcccccgagccgaaaggaggcctgaggcccctgacgaccggagctggccccttgcccgcttgtccgatgacgccaggagcccccgacccccaggacggccccgaggccactgtgggaaggccgctcctgtcgtcctccgaccccgaggtcatcggcacagaagacgagtgcaccccgagaggccacttggatgaagaacgccccggggatacggcccctagcgaaggggatcggccccgccgaaaggtgcagcggcccgtctactttgttagtgaggccctccgggacgccaagacccgataccctcaggcccagaagatgctttacgctattctgatggcctcgaggaaactgcgccattatttccaggcgcatcgggtcactgtggttacgtcttaccccctcgggcaaatcttgcataatcgagagggtacaggacgggtggtaaaatgggcaatcgagctttctgaattcgatctgcactttgaaccacgccacgctatcaagagccaggccctcgccgattttgtggtagagtggaccccggctccagagaccgtctcaatccccgaggccagcacgaacccctcgcagctgcctcacaccacctactgggtgatgcagttcgatggttctctgtccctccagggtgccggtgcgggggtcacgttgacctctccgaacggagacgtcctcagatacttggtccgtctcgactttcgagcgactaacaatatgacagagtacgagggactccttgccggactcagagtggcagctggactggggatccgccgcctcttggtattaggcgactcccagctagtcgttaaccaggtctgtaaggagtaccggtgctctgacccacagatggacgcctacgtacgccaagtgcggcgtatggagcgccatttcgatgggatagaacttcggcatgtacccagaagggataacatagttgccgatgaactctcaaggctcgcgtcctcgcgagcccagaccccaccgggcgcctttgaagaaaggcttacccagccgtcggcgcgacccgaccccttaggggagacggatgcgcctgaccggcccccgaggcccgtcggagtccaggcctcgggacccgaagggagcgctccaagctcccttagattgattgcctggatctctgagatccaaacatacctcacagataagactctacctgaggaccgcgaagggagtgaacgtgtacaacgcatttccaaacgctacgtgctggtagaagggaccctctatcggcgcgcggctaacggaatcctcctgaaatgcattcctcaggaacaaggcgttgagcttcttgctgacatccatgagggcgagtgcggagcccattccgcctcgcgtaccctggttggcaaggcctttcgtcaaggattttattggccgacagctctcaatgacgcagtcgatctggtccggcgatgcagagcgtgtcagttccacgccaagcaaatccatcagccggcccaggccctgcagatcataccactgtcatggccatttgctgtctgggggcttgatatcctgggaccgttcaaacgggccccgggcgggtttgagtatctgtatgttgcgatcgacaagttcactaagtggcccgaggcttatccggttgtcaagatcgataagcactctgctctcaaattcattaagggcatcacggcccgttttggagtacctaaccgtattattacggataatggcacccaattcactagtgaactcttcggcgactactgcgaagacatgggcatcaagctctgcttcgcctcacctgcccaccccagaagcaatggccaagtggagcgcgccaatgcagaaatcctcaaaggccttaaaaccaagaccttcaatattctcaagaagcacggcgattcatggatcgaggagttgccagcggtgctctgggcaaaccgaaccacaccaagccgagcgaccggggaaacgcctttcttcctcgtctacggcgcagaagcggttctcccatccgagctcaccctgaggtctcctcgggccaccatgtactgcgaggctgatcaagatcagcttcgcagagatgacctctactacttagaagagcgaaggcggcgcgcggccctccgagccgcgcgctaccagcagagcttgcggcgctaccatcagcgccacgtccgggcccgatcactctgcgtcgacgacctcgtcctacgccgcgtccaaacgcgtgctggattgagcaagctctcaccaatgtgggagggtccgtatcgagtgatcggtgtcccccggccgggctcggtacggctggccacgggcgacggcacggagctgccaaacccgtggaacatcgaacaccttcgtcgcttctacccctgaaagggggggggtcgggtgtcaggttttggctcgggccaaccccgcacccccctcgggtgtgcaggattggccgggggctaccacacatgcacatatatccctttttcctttatttcagcatttcaataaaagcagtttcaattttctaaaggttgtgtctgtgccgttttttccttttgaagaatcttgacttgaaataatgtcactcgtgctcaaccttgccctcgggggctcggttcggtcagctaaaatcgccaaacggggcccagaaccgagccgtgccccggggcgtggtgaactccgggggggaatcggcaaaaacccacaattgggtcacccataaccctcggtcaccacgttcccggcctggccagtctcgacatgcggatctccccaggcactagccccgacccgcgcttttcgaggactgggacttgggcatgggcccttatttcaagctaagacgcaaaaagaccacggcacagatcatcctcatctcacatatagcaaaataaaactaacacaaaaattttttcatcatttctcattgcagattaagttaaattgtacaaaaaagaggcatgaaggccttagaagaaagaacaagaaaaaagttaagattggcgggggcctgggggctcattcaaatgcgcccgggtcgccggcctcgtcgccaccgtcgtcctcgccgctggcgtcgccctcctcgtcggagctgggggcgaacgcgagccgaggggccgagccctcgaagccgttgacgatgtggtcagcagcatccccgacgcgcgcgcgcgcgtcgtcctcggtcccgggagggaactcctccagcgccatccagggagagaaattggggtcccgggcctggtaactcgctagcacgagttcaaccgccccccgggcgaggtccctcgaggatgacttgatggtcttctcgagctcctcggggagtcgttcgaggacccaggccatcctgttgaggtgcggagcgaggccttccagattggtggggggcaccgtcgtctggcctctccagaggcctgcttgacgaccggcgcgcttcatgcgggagaccgcatcccaaagcatgtcgggcccaatctcgcccgccaagcgaagggcctcggcctccccggtggaggagtccagcgctcgctgcatttccgcgacggtgtgttcggcagctgcgaggcgggcggctaagtcgctttcgcccgcggccgccccgccgataggcgcccttgcgtccagctccttttcccgcgcctcgaggtcagcagcccgctgctccagtgtggctctctcggcgcggacgcattcgagattgcggcgcgcctgctcctcctgcgccgcctcgcgaagggacaggctgtccgccagccgtttggtcgtggcctcagcctcctcgagagctcgctcccactcagcgagtgcgtcctcgcggaggcggagcgcgcactcctcctcggcgcaggcggcctcatgcgccgccagcgtcgcctctcggagaccagcggcggcctcgcggtccgtcaagcccctctccacggcgccggcgtgttcttccagcgccatggcacgggcctcaagggcctcctcgcgccgctgaaacgccgcttcagtctccgttacccgccgctctcgggcagcggcggagtcaaggaccccttgggcggcgtcgagctttttcttcagctccgcctcccagcttgcgtgctgaaggcggagagtgtcttgcgcctcgatcatcgcggtggtggagatgagggcggccgcccgctcctcctccacctcacgggcgatctccgccagcgccgctttccgggcttcaagctccgagacatgacggcggtgagccttacggcccacctccaccatggcgtccaccgagcgccgcccctcctcaacacgcgcccatgcggcctcgagctccgctcgttctgcacgcagggcctccacttgggtgttgaacccatccagcactgcggtgtttgcggcggccagggcctgcagaaggggctcggcgctcagcggggcgacagaagatgaggagaagagccgccttggagaaaaggcgacgcggcttggccccccggaggatgcgctgggctcggggatgtcccccgggcccgtttggtcctgggcgtcgcccggtgaggtaggcccaggcgatgcgcccgcggcctcgtcgcgagccgcctcggaggatgtcgcctgagggccgcccaagggagtaggcccaagtgacgcgccagcagcagctgtcgcctcagcctggcgagcccgggcggcctcctcccgggcagcttcttcggcttggcgagcccgggcggcctcctcccgagcagcttcctccgcttggcgaacccgggcggcctcttcagcttcccgaaggcgggctgcggcttcacgccggtcagactctcgcctccgctcctctgcggccgctggatcttcggcctcggactggccggatttggggtggcgggaggaatgcgacgggacatcgctgaagcagaagaaaaaaccaaaagacgaacaaaatgagtaagaaaaaacttctctttgggagaaaggtggttgcaatgagagtgagacgaacctgcgagggggtcggttgaatgaccaccttggaggagaaatcaggttcccccggcatggttccgtctcccccgtcttgcggagccgtttcttcttgcgctccccctcgggctgcgacgtcggcgcggccccctccgggcgccgactgctggcacgcgccgccccgccccctcggggaggagatgggggaggtgttcctcccagcttcctcttcccctgggcgtcggcagggcggctgctccccgagcccccggcgcggggcccagaagcacgaccccctcctggggcagattgttcccctcggcggcgctcgcccgcgccgtcgtggcccttaggggctctctcctctgaggccccgacccccatcataatggttagaatggaggcgcggtcgggatcgctgcagagggggaggatctcctgaggaatgcgagacgcctccgcggagctaagattcagcaccctttggaccacgatcttgaagtcctcgggagcccaatcccatctggctccctggtgggtccgcatgtagtcttcaggcccagtgtactcccaggcgttccgggcgcgccgttggagcggcgcaatccggcgacggaggtaatcgccgtacaccatggccccggtgagcccctgggatcgcaggcccgccaggcggtcgaggacggcgtcgtagtcctcccccagatctaccggtgcccgccagctggagacctgcgccgggggctggcttggaagtcggaggcgcgcttcgttggcgaggggggtgtagaaccagtcgctcttccagtcgtcccacttcttgcgaaggacgcaggggatgtagcggttcaacaccggcccccgcggctggaagtagcagccgccaaccaccgacggcggtgacaccgactgcacggtgaagaaccaccggaacagctgaagagaggggcgcaccccgatgaacatctcgcacagatgcgcgaagatggccaatgtcatcaccgcattaggggtgaggtgcgccatctggaggtcatagaactccaggacatccatgaagaaatgagaaaatggcgggaccagcccagccatcgcaaaggggaggaagaagatggaccgccccgggtagtctggtgccgggcgcccctcgcccagcatcactatctcccgaccggtggcggactccggcatgaagcggcgcggcagtccggcgtgcctctcattcacgatgcgggaaggcggtagtacactgccgtcgagcagagcagagccccgtgccatggcggcggaggaagagatgattgagaacgagcgcgtgtggcgaaagtagggcgtagcagagaaagagttagagctcaggtggcgaaggcaagaggaacaatggcgaaaggaaggaagcaaatccttttctcgatgcttttatacccttgccatcgctgggcctgactcctcgtttctcgcgcccactacctcgctccctcgtatctcgctatctcgctccctcgtttcccgtgcccacgcttccactaatcccattcgcccgcttgcggcgcattgagtggatatgcggttgtggcaatcgaaatggattgtatcgtgcgcgcgttaattacgctcgccgaccgaagcggcgttaccatatctccgggcgagacaaatctgctcacccagattcgcgcgctgctcaagtggcgtggcagtcttgaatagaccgcccattatggacaaccaaagttaccaataccaatgtgcatggattgagaccgttgggtattttgcccaactacggagaccggtcccacctgtcaccaggctttaggggtggcgtcacacctgaccgcttcccttgggaagggaaattgctctggcataacgccgggggctactgtcggtgatatgggaccgggagtatcatgaccagaggcttgaggcagacgcaatcgcccacgtggcctggcaccttcggggacgtcgggcccgagggtgaggtgtccgccctcctcctgatttcccccgaggggggggggtctggttgcgcttgccccggccccgagggccgaggcaccccgaccccttaaggaagtctgcgccacatacatgggataagtgatcacagctgtgctcacctaacagcatttattgcagtctggtcaagcgtgtcacgctgcatgcaacgcagtacagcgcgtttctttatccggtctgtgaccagtcacagaccggtcagatcacgggttaggtggcgactggcggtctgacgcacgccttgccccatcccgtcaagacgaaagcctctaggcactcgtctcaagctggagctagcgtgttatctcttagagatggcacgttagccctggtcagatttataccaggcttcatcctaaccattacaggcaaggtgttacacgaagaagggcaaacatgcacgttgttaagctgacgcgtggtggacaagaatgaccggtctggcactggtcgcgtcagcaacgggcagccacgatcccacgttgcgcctgtctccgccgggagtggaggtaggtgtgggctgtcccatcggagtgtcattcggacagcaaccataccaatctccgtccataaagagaagaaaagtccagtttggaaagggaagggtgcatgtggtatccccttgaagtataaaaggaggaccttgcccatagagagggggggattcttttcgagatttagagcttagaacgggggatttttggtcctttcggaaggctgagaggaaaggaagtcgatcctttgtaacttgtccatacacaaatccacaaaaacacaggagtagggtattacgcttcgcagcggcccgaacctgtatacatcgtcgtgtctcgtgtgtcttgcgggcagacgatctttccagatacagagggagagcgagagcttgagatttcaccctaagcccccggccgaaccggcaaaggggggcctgcgcggtctcccggtgaggagccacgagctccgtcaccatcacatcaaaattttcctacacacataaacttttaacttttccgtcacatcattccaatttcaatcaaacttctaattttagcgtgaactaatcacaaccaaacacctgttttcttggtctttttttgataggaaaccatgcagggaaatacactgaccgacacatgtaggaaaggaaatttgtcaaatctatacctaataaaaaaattcttaaggcttccgtcattatttttggtccgtcgccgatttcccacacgcgcacggcggtttttttctgtccgtttttttttcgcgcggttttttttgtccgtcagggtttttttcgcacgcggttttctgtgggcccatccaccttttttttgcgcacacgctctttttagtgagtccgcctttttttcaatgcacgcgtttttttagctgtccgtctccagttcccgcatgcggtatttttgggcccattgcccaggaattacaaattcagtccagcacataaattacatagaacccaaacataagaattacatgaccgattaggatacaaacaacttctcaacctatatatagaataaaactgaaagcacaaacaagactaatatatgcacccagaatttggtgtggaactaagcaatctctgctcggcgctactcatatacccagatatttttttgaaactgagcaattcatgttcggtgtgagactcaatctgcttttactgcatttataacgataaaaggtaattctttagaccttaatgatgtatacattatttatgacatataacgaacaattaacataaatcagtcaatcttaagagggaaaaaatacatggaaataaaactaccaagctcagcaaggtaacaccagattgatcggatctcataccttatttaagaggcaaccatcttttattagtaattctgaagaaaaaaccatccatcttctattagctaaaaaaaaggggagtagctatatttatggcgccatatttttcaccaaaaaatagtcggtgtgtatttacatcgtaagtttataaattacatatgcaattttattgtatttacaatgtaagtcacaaacttacatatgtaagtctcaaaattacatatgtaagtctcgaaattgcatatatgtaattaatatataatcatctctcatcatgatgtatgtgtggaaataatcttcaacctcacggaagcacagttgggaggcctcaggcctgtgcggttgtgtggcatagcgcataggcatgcaaaccgactgtaatcaatggaattttatggtgccagaaatttagcaaatccaaaaaaaaattatcacaccaaactattaaccaaaataataccactattacttcattatatttttatttgctacacttatttctgatttcggatgtatagtctgccaaacaatttcccttaactacgcgcgcacacaaaagaagacctacgtataaagtttaaatgtttggcctatagcttggtgttttgtgtacataactgttgcttgagttcccctattacttcctagggccataacgtgaaaggtatttcaaatagcataagtaaagcataaaaaaaaacttaacagtatttgcatatagagaacacataaaagaatattatggaacattagtaaaacaaaacaataacgaataacttgcctagaaaatcaagtggaacctctatcgcatatcagaacaaaagtttctttagatcaagcatcatggcatagcaaactaagacatgaaatttttggtactacattggtacatgtcagaattgagtgtttccaaacagatgaccaatgaagcatgcacatcgcaaccaaaacagagcaggaaacaaccatgtgatcagatattacattggaagagaaaaaaaaattggttgcagtagtatggctgtagtttgcacaaaattgataactgaccttgctcaggcaagctatctcaacattgagatagaataatccccaccaaaagaattggtgtattaattgattccatcgaagtccaacacatatataaacacatcctgcggctcatttaaatgaacaaaatcagctgaaaaaacataagtgaatgattaaattatttttgcttctcaccgttgttttcgagaagatacatcatgcttttgttgttgataatgtttatgtacagcttcatcttccaagctagatgcgccatctggatcatcgtccccattcttagatcccaatacacgaagacagagacacaaagctgtatgcgcaaaatgcctgacgaaaagaaggaatacttaagaaacgtcatgacgcctataagcgaaaaaaggattcaaatgtccttccaaatgttaaggacgcacattgcattaattatgaaggtgatcagcaaagctcatcgcatgctaaatctaataaagttaaacaatatatgcttcaagtttttttactaacagataatttgacccctctaccagaccagtttcaccatcatatgtagtcacaatgtactcatgacttcagagagaagcaaaaaatcacttctaatttttaattttgtgatgaaaatatactatggatttaacgaataaattatatctataacttctagctcattacaaagaataactcattatataagaatgctgaccaggttagatcatactgtacttgcatcaaatacccagattattttctaaaaggaagataactttgagttaggataaaactaaaacacattacattttggaacggtgggagtatcagagtgaaaatgtaatgctgagaatcacaaaaaataatacttgaaacaaataaatgacagtggattcaactctcaatttagtttaagcaaaggaaaatatgtaacatgggatgtaaatgatattataaacaacataaaagcatgatcacaaaactgttgtccagcaattccacatttcaaaacacaagctcagataagaaccgtattctaatttctaagcaaccggattactactatacaagatgatcccaaaatttcacatcaacaacatgatatattgtcttaaaaaataaagcacctgggaggcagtggctggaactgacggcgagtcaaggacgtcggtcgttggcaagcacggcgcgggccaactctcctcgaactcagccggccgcagcctggcctcgaaagaaattcagtataatgcggacattgtttctcccgtaaggcttgcctatcagcatagctccagtgagccggatgatgtttctgaagatctgaagaaatgtagattaatacacaactagattatctgcagtgtatgtagcttggacactatgactacataaggagtgttgtcaaacacggttctccaccagaagaagcagagacaaatctgatgagctaatggaatgtggtgaaccccataaggacttaaaaagaagttgcatcctcaaatgcgatgtgcttagcaaccaacaccgggtcccctgacttatcggtgaaagcacaaaccaaaagatagcaccaagtatcctggatagaagagaaaatcaaaagaggatgcagaggaaagtgtctggatgattgggttgaggactcacattggcgtcgttggactggtagatggtgacctcctcctacggcggcgctgtcagatcgagatggatgaggaacgcgccagcgccatcagtcgctaggataagggatgccggatccagatgctcgacggaggtcttggcgaccacctctcgccaccttcgcctccatctcatcgaccgcccacttcttcattcttcacccaccggaccatgcgcctccccttcatatcccttcctctagcgcctcccaccgccgccgccgccgccccttatcgcagccatcgaagacggcgtgggggagaaggaggcagcaggggcgggggcggcgtaggggccgcgcgtgcagaggcggcggcggtagggaggccacgaccacggtagaaccgccggatcttgaccctcccgttaacaccggcggcggatctgcgtgagcggggcacggagagacaacgggatctgagcgggagaggaacaggtcgccggatccaacccctcccgtcgcagctgatgacggatctgtgcgagaggggaccggaaagacgccgcatcgaattcgccgtcgccgtcccctagcatccgcgccgcccatacacccatcttaccgatctgcgttgccaggccagttagccgccaccagaattgccgtctccgaccccgatctacacctggacgccccccctccttgcccccgtcagccggcttgaagagtaacgagagagagagagtgggagagagagagaacgagagagtgagagtgagaggataaggatctctaaatttctctccaaggtaatgtacaacaaccatctttcttttcttttcttgaaaaaaattacggtcaaattgtgctaatccatggattcaaattgtacaacaaccatctttcttttcttttcttgaaaaaaattacggtcaaattacggtcaaaaagaaaaagggaagaacatgctcgcgaagctccggcccctcatggcgacggcggcggcggcggcggcggcggcggcgaagccagctccggctttgtcgttttccacggcggcggcggagggagacgaacacgcgcactacaaccacaccgacgcgtgccaccacctccggtggacagccaagtaacggctcccccccatcacttcctccatcgtctagggcttatctgcggcttggggcttgattggtagtaactgttttggttttggttgggcactgcggctgcggcagggagagctacgagtacatgtacgcgcggccgtggagcagggtggtcgacttctacgccgagctcgtgcgcaccggcgccggggcagcggggctcgccgatttgtttgggaaggatgaggtgagaaggaatgatattattattttttaaataattatccatgtgaaaccctgaggtagtggttcttcgcattcggtaaattggaaggggaaaatgtgttagtgttagttgcaattcctcttagtgtgccaaatgttggtactttccccatctaagtagtacacattgttttagagaaattgaaatcttttgggtgaagacatttttttcttggaggatagattaagattttggaatttgtcggtgcaggcctgtttctagaattatccatgtgaaaccctgaggtagtggttcttcgcattcagtaaatgggaaggggaaaatgtgttagtattagttgcaatttctcttagtgagccaaatgttggtattttccccatctaagtagtacacatcgttttagagaaattgaaatcttttgggtgaacacattttttcttggaggatagagtagattttggaatttgtcggtgcaggtccgtttctagtacttttagtttgtttcagtaagatttatcggatttttcttcaacagaatggttacagccttgatacgaatggagaagattacacagcaccatcagaaaatcaaacatcaactaaatcatccaaagatcgaggaggacgatgggaaagagtaaccttcaagattgtcctttcatatcatggggggtcatttgatggttggcagaagcagcctggcctcaacactgttcaagggtaaggataaataagaatggagttatgtcatttctatagacatatctggcacttttattcttcacttcctttgcatctcaagacagatgacaggataaaaccatttgttgcactctgtatttcttgcaggttagtagaaaaacatcttggccagtttgttgacgagaagaaagctaaacagcttgaagcaagatcattgccattagaaggctgtgctgttgttgctgggcgcacagacaaaggggtgactgcccttcagcaagtttgctcattttgttagttgcacctgagaacacactattgttttccagtggtccttcaactaattatccacttttatgaacatgtcatattacaaactattccctttgttccaaaatttagctacctttccacctctcaaccaatcgcaccaatccccatttagtttctccacctacttcctcatctcaaccaatcacaacatccatcatgtttacctttttctttaatatctgtggccaactctaaaataccttatattttgggatggagggtctacttctcaagaagagcttatgtgcagttattttgtagagttttttttttttggttgaaaattttgctttgtttacagaagcatttgaacaagtaatttgcttctgattataaaatcattaacacaacaatttgtcaataccaaatacaccactgttttcctatcaaagaagtaatagcctggagatatagcagtgcagaactctggcctacgtgcaatgaactgctaaccttcttatttgactaactccaccaatgcatgccattcatttcatttgatatgacatgaagaactcatttgcacaaataaatagacaatccttgtgtacttatgtgagaaattaactctaatggaatgctgagatacaccatgggactagatacattacttctcctgatagctgacatgtgtatttacttctaatttccttagatacatggaggaaggatgtaaagtctagtgatataaaggatgcaataaacaaggctgcacctgataaactaagacctttgcatgtgtcacaggtatttttcttttgctttttcagaatatatgactgcacttgatatgtatgctgcattgctgctagtggtagaattgtccatttttcatgtaaagttcttagaatgtcaagacatccaccatgggtgatgctacgcttgttattaactgatggcataatttgcaggtctcacgtgaatttcaccctaattttgcagccaaatggaggagatacctgtatatatttcctcttgacgaggatgtaaaactaatctcaggggaagaacagtccgctaaaacagtagagggtcctgagtgcaacataaaacctcaaagctttgatgtgggtaaggttgacaaaatcattagacaactggaaggaaaatcactatcttacaagatgtttgcacgtgatacacaagcttcacgaagtgtgtaagtttataactattgtgtatttgtgtatttttcaagtacaaaagtggttctcttgctgttttatgataattaatcacctaggcctgacatatttgttcatctttgttggaatataacattattgttttccttgtaaatgaccatgtcactatttttatgctcgccatcaagttcaaccaaaaaaaaaaaaacttctgttgatgttttgttgttttgcagtggtccacctacagagtgtttcatgttccattctcgagctgcagtggccaaactacacactgctgatgaggtgatgctagtctaatacattgaacttttaaaccagaaaataacaatgtaacttttgctggtaatatactatgtcaggaatcaggttacttcccagtgcttccattctagtactgctaatctctacataaaagtaacagtattattttgtggtatcgcgtttgtaaccttaactttagttgctggacattggcatagcttgagtatggcattatgacgtgtatgcaattgtggattatatagttttgagttgctgatatcaaaactaaatatattatgtggactcataaaatttagcatcatggctatgcaatcgataactcccttatctgttttttttttcaattagcattctgcatgcacatatatcatttcaactggtaataccatgttccattccgttttcccaatttttgcagaattgtgaagaaggcaccaccagggccatatgcattgagctagtcgcaaacaggtttctgcgcaaggtattatacatcaagttgtttcatggcattgtaatttatccagtcgtcccccgaattctagttaatattagtaaatttcattgaacagatggttagggttcttgttgcgactgccataagggaggcagctgctggtgctgaagaagatgctttgctgaacctgatggaagccacttgcaggcgagctactgctcccccagcgcctccagatgggctctgtcttgttgatgttggatacgaggatttcaatagacaaaggtgtttcattgttgattaaacagaacagtcatattcctgttggagcagaacaagatatactgattcaacaatcgaaaatctgaatttttggattcccgagatgaaacttagatcattctggttgaacagtgaacctataagcagcactctcctgtaggaaatctgacctgcttcctagtttccatgtatccatcaactggaattttttgtattatctgagactgaaagagtgttgcttacaccattcgttcaactacggtcaaagtctctctgaactaaactctgaagaaagaagaggccgccgtgcatgctttttcaggttttcacactgtaagttttcttcaacatatttacattatcgaataatttatgatccgaaggtagaacaatcggtggaagttctactgcagatgtcgaatagaccaatgcatcttcctggaccaatatttgctgtcaaaacaacaatatcacgaccaaaatcaaggtacattccaccattttatatgaatgtgacatagaaatgggcatatatagctgtcaagttcagatgattttcagagaacaaaagcatatcaacttaaggcatatcccagcagcaacaacatcatctacaactattgctaatcacatatataattatccctaggccttgttcttgtcgtgcgataacttttttttgcatgatgtatgtgactatgttctatgtgtgtatatactataattcatgggccacgtactcgtgatttttctcttgaatcgtgggcgcgagttggcggcacgaaattctttaagacagcgcgtttgtcggtgggcgcatctcttgtgattaaccaaagcttttgtcgcgcatttcgcttccagaagtgaaaatgttgtgattaattcggcattaaaggtgtgcagatcgatgtgtcactggcaaaaatagtgaaaatggagagccaaacttgccgatgtgctttagaaaaaaaaaagaacaacttgccgatgtgctgctagatggacaaagagtaaacatcatacagctctgaactgagagagagggtcctctgaagtaccgtacgtatacgtacatacagtaccgctcgctgacacatgggtctcacagattcttagactgacatgtcagtaccgtacgtatacgtacatacagtaccgctcgctgacacatgggtctcacagattcttagactgacatgtcagttagcaatactgcacgtacagtactgcaaaggatctacatatagcatacaactacactaggcccttgtttagttccaaactttttttttcaaacttccaatttttctatcacatcaaaactttcctacacacaaaaacttttaactttttcgttacatcgttctaatttcaaccaaacttttaactttggcgtgaactaaacacaccagaattgaggcttagactattgttcttctttaaccgttttgttaaactattatttggtatccccatgtatttggtatccccatgtaatgggttgagtcttatgtactcttgattgtggtttgggttgtgtacaccttctaaggtgtagaggccgggttaatataatccattatctaaaaaaaggaagacaacttggctggtaaaagaaaaatcagacaactttctcaacattcttggcagcctgcatggtttggttatgaaaattattgtataacccaagagattatcacgtttttaaaggtactttctttttaataaaaagtcatatatattttttttcgtcattgagctttgctggaggtctattgtcttcaccctaagtaaaaatagttatttttcgctccagacaattttaaatccaaataaatgctatcttcatttttaatatataatgccgttgattttttatatgtttgcaccatttcttttaattatatatgtttgcacaatatataattatcatttattttattgtgatttgattaccattaaaagttctttaaacattacttattattgtcatgtttgtacaaaatttagttaaacatatctctaaaagttaacgacatcatatattaaaaaataaagagaatatcactcaagtagggaaaaacaatagtagtgtggtgatttaagttgatgtataacttaagtcactaagatttacatcctatttagccataaatgttacatataagcagaaacaacggtttccaaatagtctttgaatttgtttggagaagcgttgtttccaaatagtctttgagtttgtttggagaagcttctagctgatacatcttttccaaatagtcatttttctgttcggattataaaaagctgtggttgtagaatttagaaaataaattagaagtaaggagctgagaaatccagctcccaaacaaaccctttgtcaatgtgcgagcaagcagccaaataagccattgccaaccgaaacaaagaaaaaacagaagtgatgaacaagaaaacgttgcagtctccagcggcgactcccacaccaaacgccagctttttcctcctcttcttctccctcggtgtctaagcctaagcctaagcctcccgccaaataccaacacacacacacacacgcttcccgcgctattcttagctgctctctcccccacctcgcgatctccctccccgtccctcctccccctccgcgcctcccgttctttagccaccctcccgcgcatgcgccgcacgcctcccgcacgtcgccgccaccgccaccgccactggtagccgccgccccgccgcccgcccgcctcatggccggcgtcgccgccgtgcgcctcctcctcctgcaggccgcggcggcgctcgccctcgccgcggcggcggccgccggggggccggaggccgccacgctgctggcgttccggggggcgctgcgggggccgcacggcgcgccgccggagccgctcagccagtgggccaccaccacccccggcccctgcgccggcgccggcaccggcgtgtcgctgtggtacggcgtgacatg

SEQ ID NO: 59533 - DNA, 7939 bp, Oryza sativa
attcctgcagcccaaattatggtgaatttatacattttttaattaaaaaatggtgaaattttgctacctgcctgttcatgcattcgtgcatgcacgaattcctagtgaattactggactagtacatgtttgatttgcaattaggacagaacatgcgatcaataaaaggatttagggagtaatggaattttgttgagatcatggtggtgttcttttctcctgaagatgaagattaatttttttacgtaaaacgaggtggtattaacgtatgattaattaatttttaattattataaatttgaaaaatagattgatatgatattttagagcaactttcatataaaaagttttcgcaccaaacataccgtttacctgtttgaaaaacataccacgaaaattcaaaatttcacccaactttcatatgttgctgttttacacatttgtctagtcaattaaggatttctttaagcaaatccagattgatgtctcactgtctcagaatccaagaataaaatgggctgcaagaactatgtaaatacaaaataaaacaaagtactattcctaccaactactgtaagtggctctttcgaggttgtacagtacgtcatgaccaattaagaaacacttacatgaagatgttaaactcagaagtcaacatccaacatgatcaaacgtgctaattaaactaaccacataaaagtattagattagtgcactgtaatataatactatccttttgctagtgtacaccaaattgcagtattcctgaatgcattgcaatattctacctttataattcttcttttttggaagaacaaaaactatagagcatatttatcaagcacatcgattcaatcaaaaatccaaacccttgattggtcgcactgtttgggctacttgtgaacgcatgatttcataggattttcgcacgaattagttcaattcctccaaaaatccaacaaaaacggattatacaacataccatgataccactgttgttctaaaataagtttatttttcacccttcccatacatatatgatatatataccaatataaaaacaaaagattaaaatactgtcactttataaaatatccatgcaactgtcccatactatctctactacaattcatttgtcttttacttttacaaaccacatcaattcgtactgcttgggtactttggaaaacacgaatttagttcaatttctccaaaataaagtcctctaaaattagtttatttttttgctcatgcaccatctgatccaaacctctccccatggaaatattcaggaaacaaaaatctctgcggcccgccggtcggcgccccgtgccccgaagtgccaatcctcgcgtcaccttcgccatcgccgctgtcgtcgtcgtggtggtcgcctcgcagcttgaagatcctcatgatcatcgccctcgtggtggtcgtcgtcggcgcgctcctggcattcgccggcgcgttgacggcgatgctcgcccgacgccgcgaggccaccaccgaaacccagggcggcggcgtcggcggcgccgccgccaacgccgccgccgccaggatgaaggccacgcccaatccggccgtcaccgtcgcacacggcggcggcggcggtggcggcgagcagcagccgcacgtgacggtgtcggccgtgccggcgaagcgcggcgggcggcgggacgaccacgggcggctggtgttcatccaggaggggagggagaggttcgagctggaggacctgctccgggcgtcggcagaggtgctcggcagcggcagcttcggcgcgtcgtacaaggcgacgctggtggaaggccagtccatggtggtgaagcggttcaaggagatgaacggcgtcgggaggcaggacttcaacgagcacatgcggcggctcggccgcctcgtccaccccaacctcctccccgtcgtcgcctacctctacaagaaggacgagaagctgttcgtcaccgagtacatggtcaatggcagcttggctcacctcctccatggaggtaattaaccacacaatccttcccatcttgacacaacctgcattgcatttatttgatttatgttaatgtcgccggcgacgcgtgatcggtggcgtacgtgcagggtcgagcatggcggcgctggactggccgcggcggctcaagatcatcaagggcgtgacgcgcgggctggcgcacctgtacgacgagctgccgatgctcaccgtgccgcacggacacctcaagtcgtcgaacgtcctcctcgacgctgcgttcgagcccatcctcagcgactacgccctcgttcccgtcatgacgccgcgccacgccgcgcaggtgaggcgatcgaacgacggcggcggcgacgaacgcccgcgcgtataggccggcacgcattgactggggatggttcgtgtttgcaggtgatggtggcgtacaagtcgccggagtgcggggagacggggaggccgagcaagaagagcgacgtgtggagcctggggatcctgatactggaggtgctcaccggcaagttcccggcgaactaccaccggcaggggcggacggggacggacctggcggggtgggtgcactcggtggtgcgggaggagtggaccggcgaggtgttcgaccaggagatgcgcggcgctcgcggcggcgagggcgagatggtgaagctgctcaaggtcggcctcggctgctgcgagagcgacgtggacaagcgatgggacctcagggatgccctcgcccgcatcgaggagctccgggaacgcgacgccggcgccggcgccgacgacagcagcgccgcctcgtccgtggccagcggcggcggcggcggcgaggcgtcgcgctcccactcctcgtagcgaaacagcagcgatctcaccttgtgtacgcgcgcgtatgtttcacagctttttcggtgcatctgatcagccctacgattcgaaagggacggaggagatcttccgggtatgtgaacgtgtgagataatactgttcagtgcgtgtaaattaattttcttagatttattaaaggaagggaagggttgtggtgaagtttttttttttaccttttgcatacgtacattttcacaggtgatatacgaagattgttggtagaaagagagaatccattagagtttgtaacaggtatacaatttacttttgcatatgccattgacttttttcttaccttctacgatttttaccatcgccgtccggttagtctatgtgtactgtacaattttatctaaatgaccaaaatacccctgggacaaaaacttctaaagtttgataaaaaaattctgaattatcatattttaagtttttgacaaaaattggatgtttacaatcttatgtttataatattgatatttcgaaatttttgtccaaattttggatgtttttgttccaggagtattttgatcatttggataaaaaatgtataatactagggaaggttaaccagacggcgatggtaaattgtagaagttaagtaaaaaaaaagtgacatattgtaaaacgtgacaaaatcagtggtaaattgaagacatgtaacaaactcagtgacatataatggattttctctagaaatattgtgaaagtatagtggtgatatgagtgagcagatgaaaggccaagggcctttgcactcgatgaatttgcatatcatgattgcattgatgacgcagtagttacgacagggactcaaacaaaggcatgcagaaactgctgactttcgtatgcaatttaacacatcactccttacaccactgatctttgctcgggcgtcaaaatcagcaaatatccatgcaaaaaaggcaatattgcaaagaaaataaaacggtactccgtacttcattagtttggaactcggctagccactgccacttggctataattacggtgacaatactttctagacaggggttggtaagctgctgctatgtactgatcatagccttgcaagtactaaaatccaacggtggcaaacaatcttgatgacgtgatgcaccatataggatgaaatggaattaactacatttagtatggaccaactgtatagatttataagattagcaccggccccatcttgtcattgacgctaacctatatccccaatcgcagagctgtaacaggccagcacctaagcccctccattgccaccatggtgccagaaacatcgagctgttgatggccctacttccaagtctacaatgtgtgccacacggtccgcccctatgtgccttgccatcacttccaaccattggctctaacaacacagccctctggctttcactagcatcttcatccctaattcgttcatgccttcgtccacatcctccacgaacgaaacataaggaggtgattaatattcattatttgcaagttaaaaaaagaagaagacaagagatgggacttcatagctgctttttgagaggtctgcatacgctacgcaagcgaaacaaccgggactatccaaatcacatatatttatagcaattgtataaaagtccctcggcgaaaaagtcagccaacgatctccatgctgcaccgtcagtccatgcctagttttcttgcccccctaccaccataaatacgcacctagctgtaagatggatcacaaaacacatcgatccatccctctaccagtacataaacaagaaagataacaccaaaaaattagctagctcgccaatggccttgttgtcctccttccggctcgccgtggcagtggcggcattgttggtcgtcggctcatgcgccactgaggtcaccttcaaggttggtgagggctctagcggaaaaagtctagagctcgtcaccaacatcgccatctctgaggtggagatcaaggagaagggcggcaaggactgggtggcgctcaaggagtcgtcgactaacacctggtcgctcaagagtgaggcgaccctcaagggccccttctccgtccgcttccttgtcaagaacggtggctaccgtgtcgtcgacgacgtcatccccgaaagctttacggccggcactgaatacaagagtggcatcaacatctaattcatagacatgcgtactcttgcattgggttgcatgggaatcattaacatctatataattttgtctaaaaagagatcgcgtcgcatgtgagcgagcaaacaattaatttcctatggttatttttttggtaataggccaatggcaaaataaggcataattgcgtggttccaaaatattgttgtggagctgtatgtgagcacgattttaaatatatgttgtttatagaagatgtatcgaaaaaaatatatttggtcagctttcattaagatgattgtgtggatttgatttcccaaagtttgagtacatatgtatgtccaaatcaacgtagtccatttctcctttttagcttgtcaaaaatgttgtttgcacttgttttttcattttgtggaaacaaattgttgaatcaatcatactgtgaccagactataagcataaagcatttttacatcatttagcttatttagaggtcagaaaactggaagtcacgttatcccatctctagcatgaatatcatatagaagcacacatgtattgaagcgaagccaactttgagaggagctaagcttcatatcatatagttggccaagaccccaagctatagtcaacaacaaagtttatatagtactacgagaatatcaatctattgcaaaggatctaaagtaaatacacaattggttccaaactttaaatagaagaaaaatctttacactgctagtgtgttagaaggaacaagaaaacataccattagttccaaactatatatatgtaaagaactaataaatccttaagacctaaaaaatgtagtggtggtttatggtcccttgtccaccgtaagcccatcctcactcccacgccctctcgagcgagtcccgcacgcatgatgtcccttctgctgcacgaatggaagaacaccctcgacccccaccacctgatcaaaatcaatcaaccatcattcctcggcgcttgcccatggacctcctttcacgtctagctctcaacttgcatggacgtaacagcatgtgcacttgccaataaaaaaaaaggaaaaagtacgaattacccccccccccccccgaactatcgaggtcgaacgaattacacccccgaactcgaaaactagacattctacacccttaactattgaaaccggacaaataacccccctactcattccggggtggttttgggtccacatggcagtccagtcagcatttttttaaaaaaaaaatcagtgggccccacctgtcagttctccacccctctctatctctctatactctatcccaatctctccctctctctctctcatctcaccagcacggcgccggccgtgcgagggcgggagcaggcggcgctgttggcggcggagggcgccgggcggctgagatggaggcggagcgggtggctggcagcgggaggcagagctcgcccgcgcaggttgccgtgcaggttgaggcggcggaggagcgctgtcgttgtgtgttgctgccttgtcgtcataaaacaagcttctcttccctcaccttttgcgtggccttgcctgcccttgttcacctcacctcagcttgtctctctgactttgatctcgccatcccgagttcgccggacacgcccacggccaccacggcggcgatggagggcgccgtgctctgcgccgccaaccacgcgccgctcacccccatcaccttcctcgaccgggccgccctcgtctaccccgaccgccccgccatcgtcgcctcctcctctggactcacgcgcacctagtaggagaagcgggaccgctgcctccgcctcgccgcctccctcgccgctctcgatgtccaccgccaccacgtggtaagattgaccttcgcggtggcgccaccaatcgctacaataattggatttttctcccgaatctcccccttcttcaatttttcatgcttaaaaaaaccaaatcgcttagaatttacttgttgaatcttctaatttggttccaaattagcagctgagtgattcgcattttcagaagaaatcgttgccttgttggttgtctctgtgtgcaagtcgcggtgttcacgcagaatattccggtgatgtgtgagctccacttcggcatcccgatggccggcgccgtcaactgcatgctcaactcccgcctcgacgcttcccgatgctctccgccgccggcagcaccgcctgctcccgccctcgcgcagccgccgccgtgctggtgagaagagagagagagagagagacattgggatagagtagagagatagaaagggatggagaactgacaggtttggcccactgatttttttttttaaaaaaatgctgactggactgccacgtggacccaaaaccaccccggattgagtcaggggggttatttgtccggtttcaatagttgagggtgtagaatgtctggtttcgagatcgagggtgtaattcggtcgacctcaatagttcgggggggggagtcattcgtactttttccataaaaaaatatcaattgaatttatagtgtactcttttttattgtacaatctacaccgagacctagaattgttggattattttcataaggccacgtgctcctccccacatacgcctcgtcgagttgtcatcttgtattcctatcaaatgtattgcatcaactgccgccaccgctcgatatccagctagctgcctagctgtgctctaccaatttacttagcaccaaccccatctcaccataaatgctaacctatgtcccctatcgagcagagccgcaacgggccagcacatgacccatctgtcaccgccatgattccatcaacatctagctgttgatggcccctctgtgacatatactatggatgctacacggtgcccctctatgtgcctggccatcactcctgaccgttagctctaccac

SEQ ID NO: 59534 - DNA, 1378 bp, Oryza sativa
atttctcaaagttttagtacatatgtatgtccaaatcaatgcagcccatttctcctttttagcttgtcaaaaatgttgtttacagtttttttttaaaaaaaaaaatttgtggaaagaaattgttgaatcgatcactccgtgacatgaaactacaagcataaagaatcagcacatcgtttagcttattcagatgctagaacaaaatgtaagtcgcattaataatatctccaacatgaataagtggtaatggatagaatggaagcgaagccagctttgagaggtgctaagttaagcttcatatcatatgaggtcaccttcaaggtcggtgaggcctctagcggaaaaagtctggagctcgtcaccaacgtcgccatctctaaggtggagatcaaggagaagggcagcaaggactgggtgacgctcaaggagtcgtcaactaacacatggacaatcaaaagtgaggcgccgctcaaaggacccttctccatccgcttccttgccaagaatggtggctaccgtgttgttgacgacgtcatccccgaaagctttacggccggctctaaatataagagtggcatcaacatctaagtgatagacatgtgtgtttttattttgaaataattcttaacctctctataattcttttttatttcaaaagagagatcaagtctgcattcggggaagccaataattaattttctatggttattttgtgaaatatgccatcaacaaaataaagcattccgtatgccatgtctgcatgttgctgcagaggtatatatccagacgattttgagtatattacgtatataatatttgtgggaaaaagtatagttggtgaaacttcatcgagatagtttcttacattttatttttctaaagtttgagtacatatgtatatgtatttccatatcaatgaagctcgtttatcttctttagtatgacagtatgacaaaaatgctacaaaagtcgcatttacaatagtgattgttttgtgaccacaaattgttcaactatgacacctacagatactataagcatgatgcattggtacatattttagcttactcagaaggcagagtgcccacaaatcatgttcatcccatctccagcaccgaatgtgtggccatggataaaatggaaatgaatccaacttcgagaagattaatctatgcttcacgtcgtacaattggccaacaattaaagttttatctaatatcagttatccgtgtgttgcttcggataatagaaatatatttaatattatctgaaaaattaaaatttgctttctattaaatgtgttaataatatgtttggtaaagggaatattgatcctaatttaattttatactccctccgtattttaatgtatgacgcc

SEQ ID NO: 59535 - DNA, 2514 bp, Oryza sativa
tcttacattttattttctaaagtttgagtacatatgtatatgtatttccacatcaatgaagcttatttatcttcttcagtatgacagtatgaaaaaaaatgctatgaaagtcgcatttacactagtcattgttttgtgaccacaaattcgttcatgcgttggtccacatcctccctaaatggaaaatgaggaaatgattagttttcaatatttgtaagttaaaaaataagtagaaaaaagatgggattgcatagctgctatttgagaggtttgcatgctctacgctagcgaaacaaccgggactacccaaatcacatctatttatagcaattgcataagaattcctcaacgaaaaagccggccaacgatctacatttgcaatgtgcgtccatgcctggttttctaaccccaggcgatataaatagatgtcgtccacatcctccataaacaaaacatgatgaggtgattaatttttattatataagttaaaaacagtagagaagatatgtgaatgcattgctactttttatgaggtctgcttgtcctgcgccagcgaaacaaccgggactaccaagtttgcatctatttataggaattgtattagatttgctcgatgaaaaagtcggccaacgatctctttgcagcaccatgcgtccatgcctgtttttctttgccccccgccaccataaatacgcacccagctgcaacatggatcaccaaacatatcgatccttccctctacccttcaagaaacaagaaagacaacaccaacaaacaatctatcttgctaatggcctcgttgtcctccttccggctcatgcgccactgagcttgccttcaaggtcggtgagggctctagcgacactagtctagagctcgtcaccaatgtcaccatctctgaggtggaggtcaaggagaagggtggcaagtactgggtggggctcaaggagtcgtcgactaacacctggacgctgaaaagtgaggcgctgctcaagggctccttctccgtccgcttccttgtcaagaacggcagctaccatgtcatcgacaacgtcatccctgaaagctttacagctggcactgaatacaagaatggcatcaacctctaattaatagacatacgtgctcttgtgttgggtcgcatgggaattattaacctctaaataattatgttttagaagatatcatgccgtgtgtgagtgagcaagcaattaatttcccatgattattttgtggtaataggccagtggcaaaataaggcataaatgtgttcttccaaaatattgttgtggggctatatataagcatgattttgaatatatatattgtttatagaggatgcattgaaaaattatactccctccctcccaaattgatcatcatataatggaattcaaaatttctcaaattaatcatcatatacctgcatgtacacagatttcatcagaatacaattactgcagcatggcagaatatgtgcatgctaaggtgtaattggcatggtgttttaatcgatgcatgcattgtgggagaatgtgtgcttgatgtcttgattgatgtgatttaaattatccttggtcttggtgcataagcatatatgatgatcaatttgggaaggagggagtatttggtcagttttcattgagatgattgttggtgtttgattttccaaagttttatagtatgtccaattcgatgtagtccgtttctcatttttagcttgttaaaaatgttgtaaaagtcaaatttacacttggtttttctttttcatgaaaaaaaattgttgaatcgaccatattgtgatctaaaattataagcataaagcatcgatgcatcatttagcttactcagatgcgagaacaaattgtaagtcacattaatcccatctcaggtattaatgagtggtaatggatagatattaatgagtggtaatggatagagtgcaagtgaaacctgcatttggaggagctaagttaagtatcatatcatatagttggctaaggccctgagctatagtcaacaacaaagtttataaaatactaagagaataccaatctattgcaaaggatctaaaataaatacaccattagttccaactttaaatagaaaaaatatttacactaccaatgtgttgcaaaggatctggaaaatatacagtttattccaaactttaaatgtaaagaactaataaatctttaaggccaaaaaaatgtagtggtgatttatggttcctcatccatcgtatgcctagcctcacttccacgccctcttaagtggttcccgcacacatgatgtcccttccccttgcacgattggaggcatgccctctaatgcccaccaccccgtcaaaatccatccaccatccttccccggtgcttgcccatgtacctcctctcacatgtagctctcatgctgcatggatgtaacaatgtgtgcacccgcccattaaaaatcaattgaagataaagtgtactgttgtatgaagtacaatctacactaacatctggaattgca

SEQ ID NO: 59536 - DNA, 9717 bp, Oryza sativa
tggaattgcaagattattttccccagggccatgcgctcctccccacctatgccttgtcgagttgtcatcttgtattcatgtcaaatgtattgcaatgactgccaccaccactcgatatccaactaggtgtgctctaccatattaattagcaccatccccatctcgccatagacgctaacctatgtcccttctcacagagccacaatgggctagcacttgagcccctccatcgctgccaaggtaccatcaacatcgagctgctgatggcccctatgccacatctactatgcatgccacaccgttgcccctctgtgcctggccatcaatcctaaccgttagctctaccacccctttgttttccactagcatcttcgccccttatttgttcatgcgttgctccacatcctccataaacggcatgatgaggtaattcatttttattgtataacttaaaaaataagtagagaagatatgggaatgcgtagctactttttgagaggtccgcttgtcctgcaccagcgaaacaaccgggactaccaggtttgcatctatttataggaattgcattagagttgctcaacgaaagagccagccaacgatctctatgctgcaccatgcgtccctgcctagttttctttgccccctgccaccataaatacgcacccagctgcaacatggatcaccaaacacatcgatccattcctttcaagaaacaagaaagacaacaccaacaaactagctagctcgccaatggcctcgttgtactccttccggctcgccgtggcagtggcggcattgttggtcgttggctcatgcgccactgaggtcgccttcaaggtcggtgagggctctagcggaaaaagtctagagctcgtcaccaacgtcgccatctctgaggtggagatcaaggagaagggcggcaaggactgggtggcgctcaaggagtcgtcgactaacacctggtcgctcaagagtgaggcggcactcaagggccccttctccgtccgcttccttgtcaagaacggcggctaccgtgtcgtcgatgacgtcatccccgaaagctttacggctggctctgaatataagagtggcatcaacatctaagtgatagacatgtgtgcttttttttttgaaataattcttaacctctctataatcctttttttttcaaaagagagatcaagtctgcattcggggaagccaaaaattaagtttctatggttattttgtgaaatatgccatcaacaaaataaagcattccatatgccatgtccgcatgttgctgcagaggtatatatccagacgattttgagtatattactgtaacatgctgaaaattagatattttctaattatgtatcatgccggttcttatgttcttaataaccttctaaatctaggaaattatgattagagggaccttctagaactaacttgcataaaacccctctttgatatttaacttcttttgtgtttttcatttaaaaatatatttggttaaattgaggtatttcttgatttggttttaaattaaaaccttctttcgacaaaatttcctcttattcaaatttagtttaaaaacccttttcatttgtataaattatggtccaagaaaaccctccaaaccaactctttgtaattccaattttaattggaattaattgtcgacccatcctttgattccaaacctatccttagttccctttccaaatctcaaatatccaaattcctccttttgatctaaccgccaatttagttcctacggcttgatcccttctcggcacaagaatggtattattacaaatattatgaataattgctcttgtgctaagaaaatatattttatccttctcttccacacatccaaattcctattagcctcaaatacttctctaaaatccatgccatatattttggggctaaaatcctattattttcctctttgtttgcttgcctcattcccaaaaatattttgaggaattatattgttaatttctctcccatttgagtgcatcaattccaccataccccacttctaaaaatattgcactcaaataaatagaagatctttatttcgaaatttatctccacatataaactccctccaaatataattccatctatacacaaaatcaattctactcaatttgggccgaagttccttcacctaagcccaagtctgaaagtctaatttccctcccttattcctttcctcactgtgggcgccgccgccgcccagctgctcccggagccgccgtcgtcgccttgctgaccacgccaagccgacgccgtgccgtcctctacctcctccgccgcccaaacgcagcagagccgccgcgtggacgcgccgccgacgccgaccaatcacagagaagagccggcgccgttttcttctcctccactccaccagcgccgtgcttcccttgtttttctcctctctgaaccgccattgaccacctcctttcgccgcctataaatagccggcgaagccccttcttttcccccagatccgagcctcgagctccatccttctctctcgtccccaatgccggccaccggccgatctccctcgtcggactatttccgaccaagccctcgcgccatcggcttcgcctcgatggggcaaacccattccctaaccttccccttcctttccccttccaagattagccaccaccgttacttcccaaaccggccggggcaagcttttggccatcgccgttccggtctcctctctcattccccctgccggacaccaccctccccagatgcgcgtcgttcgggaacacattccgccaccgatgtcgccgcctcccaaccaccagagccctggtgcccctcctccccctcctctcgtttgctcggctggaagagaggaggaagacgacgggaggaagaagaaggaaaggaaaaagaaaaagaaaggctgacaggtgggcccatgaacagtgcactttcatcttttctagatttaattcaaaacctaatctttagaaacccatatctcctaaaccatagatccaattccgatgaaacttagacctaaattcatctaaattcaaaatctaccttttggtaccaaatttactattctaatattttatttgaattttcttaatttattcaaatactatttgaataaatatttgatttaaacctatatttgcttttcaaatattttattttatcccaattacccttttagccactaaaaagccgccggttggaactttgcgccttccatggggacgttcacggttttctatccccgacgtcgaaccgttggttgtaaagcccggcataaaccaaacccaaggtcgaagtgctgctcctggcaccccacgcctcgatgcgtatagcggtcggagcttcactattccatcgacctccacagcacgccgcacagttagctctcgggctctgtgtaatcctagccgctccgtcgccactcacggttatcggagtaacacttccaccccactaaacctgcacccacctactattcttctagccgatatgatgtctatcgacacctgctagaaatgataccaaatctagtcgctatactgtccaactctagcgacaactagcaaacacccaaaaccctagccgatatttatcctacctcaatatcggcttaaacaactaaaccctagctaacaccttgctagttaaaacccaaccgtcatccaaataccccacctaccaatatcgcctatccactatacgcagccacctactctcctagaacctatacagagcctagccaatatgcttccctattccgtagtcggcttaaatataaccaaaccctaggtattatactacctaaacctaccaccagctaatactagccatataccagttgaaccagttcaattacccaatatacatcccatcctttcagcaatcaagccacacataaaatacaagtgaccctgattgcttaatcccctctagcctccaagcctttagaacttacacatgaaatactagcccaataatcctaataacctataaaagagataggctataccctaaaccctatccctcttaaccgtttatcgctttcttgctattttatggcttttattgaatttagttcttcctcttcttcaagtagagtctattgtattttggatgacaacctgtggtatttcgaggatcggataatcaggttgtctatctcggatttatttgcgttggagcaaggcaagttattattcctccccttgagcataattaccctatattctatatctctattctatgcattagccattcatgattttgaatgcataacctgaacatatagcaaaccagttatatgctagattttgcttagccatgcctagttagattgcataaaatataatgaacttagattggaatagtgtggtagaaatggttgatttccgggtggctagtactgttccaaccgacataagactgccaagtacatgtgaagaacatacgagtacgaccgcaattctcgtatgggcatagacctagctgattaagttatctagaaaaggtggtacctctgtatagtggttcttcttaagtcctcgcgcaggaggcaaatttatgccgcgaagggcaattgtgatatttaccgaggcgcaggtaaatatgagatttattgacgtcaacttgtttgtgaaccctgattgtgatgacatggtgtcatacaatcagttctctctaaagacctcgggaacgccaaaactcctctcgctgctgataacgttacgttcagagcgcatgggaactagagttcatggaacaggtaccactaatgttagtaactgaaaagctttgccatgacaaagctaatgtgtttggcacgtcatggattgcgggtaaagcgtacatttactgcagtaaaatataaatgaatatattcgaatagccgtgctcacggatttgagcattgggactcatatggtatttggttagaaacctaattccaaactttattaaatactgttgcattaaaatcattacaggctttctactttttctgcaagtaatcatagccctactcaaataccactatttcatacattcatattgaatttaatagcttgctgagtacgttgtactcacccttgcttcaacccctcttttcagagtcattttggaattcttatcgaagccgggagttcagttatataagttagtctcattctaacttagttctcaagtatagattagatagatggtttacgtctatagtaaaacactagagttgagtcattctatagcttctgctataatagttagccacaatcttgtaaataccctattattttatgtaagagaatccccatggaagccttgctcaaatgtatgcaatgaagatccagattgttgaacctgtatcaatttactgatccagggcttgatacagttaaacatgtcggtttccgaatcattagttttgggacccgacaattacgtatataatatttgtgggaaaaagtatagttggtgaaccttcatcgagatagtttcttacattttagttgattagtttcttacgttttttctaaagtttgagtacatttgtatatgtatttccatatcaatgaagctcatttatcttcttcagtttgacagtaagaaaaaaatgctacgaaagtcgcatttacactagtcattgttttgtgaccacaaattcgtccatgcgttggtccacatcctccataaatggaaaatgaggaaatgattagtcttcaatatttgtaagttaaaaaaataagtagaaaaaagatgggactgcatagctgctatttgagagatctgcatgctctacgcgagcgaaacaactgggactacccaaaccacatctatttatagcaattgcataagaattcctcaacgagaaagttggccaacgatctccattttgcactgtgcatccatgcctgttttctaaccccaggcgatataaatagatgtcatccacatcctccataaacgaaacatgatgatgtgattaatttttattatataagttaacaaaaaaagtaaagaagatatgtgaatgcattgctactttttaagaggtctgcttgtcatgcgccagcgaaataactaggactaccaagtttgcatctatttataggaattgtattagtaaatacgcaattggttccaaactttaaatagaagaaaaagctttacactaccagcgtgttagaaggaactagaatatatatatacatatatatatatatatatatatatatatatatatatatatatatatatatatatatatatatatatatatatatatataccattagttccaaactatatatgtaaagaactaataaattcttaaggcctaaaaacatgtagtggtggtttatggtccctcgtcaatcgtaagcccatcctcactcccacgccctctcgagcgagttctacacgcatgatgtcccttccgctgcatgaatggaagcacgcccccgacccccaccacccgatcaaaatcaatcaaccatcattccgcggcgcttgcctatggacctcctttcacgtctagctctcaacttgcatggatgtaacagcatgtgcacttgccaataaaaaaaatatcaattaaatttatagtgtactcttttttattgtacaatctacaccaagacctagaattgttggattattttcataaggccacgtgttcctccccacatacgcctcgtcgagttgtcatcttgtattcctatcaaatgtattgcatcaactgccgccaccgctcgatatccagctagctgcctaggtgtgctctaccaatttacttagcaccagccccatctcaccataaatgctaacctatgtcccctatcgagcagagccgcaacgggccagcacatgacccatctgtcaccgccatgattccatcaacatctagctgttgatggcccctctgtgacatatactatggatgctacacggtgcccctctatgtgcctggccatcactcctgaccgttagctctaccacccctctgttttctgttagcatcttcacccctaatattttcgtgtcttggtccatatcctccataaacggaacatcacaaatttttattattcgcaatttaaaaaataagtagagaaaacatgggaatgcatagctaccttttgagaggtctgcatgtcctgcaccagtgaaacaatcggaactaccaagtttgcacctatttataggaattgtattagagttgctcgacgaaaaagccggccaacgatctctatgccgcaccgtgcatccatgcctggttttctttgccccctgccaccataaatacacacccagctgcaatatggatcaccaaacacctcgatccatccctctacccttcaagaaacaagaaagacaacaccaacaaactagctagctcaccaatggcctcgttgtcctccttccggctcgccgtggcagtggcggcattgttggtcgtcggctcatgcgccactgaggtcaccttcaaggtcggtgagggctctagcggaaaaagtctagagctcgtcaccaacgtcgccatctctgaggtggagatcaaggagaagggcggcaaggactgggtggcgctcaaggagtcgtcgactaacacctggtcgctcaagagtgaggcggcgctcaagggccccttctccgtccgcttccttgtcaagaacggcggctaccgtgtcgtcgacgacgtcatccccgaaagctttacggccggctctgaatacaagagtggtatcaacgtctaattaatagacatgagtactcttgcattgggttgcatgataattattaacctctaaataattttgtcttgaaaaagatcacgctacgcgtgagcaagcaaacaattaatttcttgtggttattttgtggtaataagccagtggtaaaataaggcatacatgtgtccttccaaaacattgttgtggagctatatgtgaacacgatttcgaatatatggttgtgtgtgtgtttttttgaaataattcttaacctctctatgattccttttttttcaaaagagagatcaagtctgcatttggggaagccaataattaattttctatggttattttgtgaaatatgtcatcaacaaaataaagcattccgtatgccatgtctgcatgttgctgcagaggtatatatccagacgattttgagtatattacgtatataatatttgtgggaaaaagtatagttggtgaaccttcatctagatagtttcttacattttatttttctaaagtttgagtacatatgtatatgtatttccatatcaatgaagctcgtttatcttctttcgtatgacagtatgaaaaaaatgctactaaagtcgcatttacactagtgattgttttgtgaccacaaattgttcaactatgacacctgcagatactataagcatgatgcattggtacatattttagcttactcagaaggcagagtgcccacaaatcatgttcatcccatctccagcaccgaatgcgtggccatggataaaatggaaatgaatccaacttcgagaagagtaatctatgattcacgtcgtacaattggccaacaattaaagctttatcaaatatcagttatccgtgtgttgcttcggataatagaaatatatttaataatatctcaaattttgcaaaattataatggcatggttccaattttcccttctattaaatgtgttaataatatgtttgctaaagggaatattgatcctaatttaattttatacatagctttccatttaatgcttgtttttctaataataagatgctcaaaggctaatttatatattggatgggaataggtggggtggcagattcactgccaccagcactattttttcaaaggagtatagaccatcataataccagcgtgttacaaaggatctcaaataattatatttgattattgtgtggtttcattggctaatcaggtgcgaatttggtttctggataactggatttgctcctcctttggttcctgtccgtttcttgatttcctccggctttgcattgattaattccactgctctggtactggtgagctgtagaattagagattttagtacttttatttggtatgaacatttttttcatgaagtgtttgaatcattaaatcgtaacgagcgtaacagataatcccagattgcatcgttgccaatcatatattgagaaccgcaaaagctatcataatcacaccatcccgcttgttattagtggtgaaaatgtcagtgtcaatggaaggcgacagtgacaaccatcatcagttctttatttaagttttactctttttttcccgttacacggaagacgtatttgtggacaccatattcacctatccgtgaaaacgtcctctaacacaagctcaaaaaggcagagacaacggacatcactataaggccccctttgtttataggcttataagccaacttataagtcgaaaagtctaagcctaaacaaacaagcagcttttccgtttggcttttttaaagccataagccactctaacactattaagccaaaagttagattggagaagcttttttggcttatatgaggtagatgtatgactcaaccactaaacttaagacattaaatccaccggcttaaacaaagagggcctaaacttgttgaaagcacaacggtgtgttcttgatatactcattcacgtgctttcctt

SEQ ID NO: 59537 - DNA, 4162 bp, Oryza sativa
tacagagagaattgcaacgacgagagaattagagcaaaaggaattatggcaactcaatatagtagtcttctccgattccaacaggaatggagccgccgccgcctacgccaccgtggtcgccattcaagttgccctcgagctcgctatatatatatatatatatatatatatatatatatatatatatatatatatatatctcctatctctctcttctttccccttgttcacgctagcctattacaatatggacttctattacatggtccagttaggcccacagtacttgggggttttgcttaacaggccttgtagtacgacgcatattgcctccctttgactgcacagctccaacttgacgatcttcagcttcgtcagagttttgctccccaactttagtcaatggaacatcgtcaggtaccgcctgatccttgacaatcccctccccttggaatttggaaagtcgctggaaaacgagcacggagttcctccaaatcctcctaggtggcatcctctgctgcagtaccagaccaatgaattagcacctgagatacagctgaattacctttattgatcaccctggtatcaagaatttggagtggcacttgaaggtcagaaagagctgaaggcaaagtagactggatgtctccttgaaaaccacaagctgccttaagctgggacacatggaacactgggtgaacattactagtctcaggaagctgtaatttgtaagctactataccaatcttctgcagaacctggaaaggcccaaaatacttgaaggaaagcttgtggttagctctagtggctacagaagattgcacatatggttggagcttgagatatacccaatcaccttcagcaaacgacctgaaactccttttcttgtctgccatgtgtttcatttgttgattagctctattcagatgttgctgcactaaggcttgcatcaactttctttccttgagccattcctgcagatctgggattgcacatgcttccacagaaataccaaagtgacgaggagcatgaccatataagacttcaaacggagatgccttcacggaagagtggtaagaggtgttgtaccaatactcagctaaatgtaaccaagtggcccatttggagggatttgcatggacaaaacaacacaaatagatttcaagacattggttaaccctttcagtttgaccatctgactatgggtgataagatgtactcaaatgcaattgtgtaccagaagatgtaaacaggtggttccagagttgactagtaaaaatcttgtccctatccgagataatcaccaaaggaagcccatgcagtttgtaaatatgcagcataagagttttgcaacttccagagcagtgtaaggatgtgcaagaggaatgaaatggccatatttagagaacttatccacaattaccaggatgcagttaaaggacttagacctgggcaaaccttctataaaatccatggatataacttcccatgatccatcaggaacaagcaggggttggagaagtcctgggtatttagctctatctggcttagcttgaatacaaatttgacactgctgaacaaatttcttagcttgagatttcattcctggccaggcaaataatttcttgagtctgctatatgtgactgggaaaccagagtgaccaccaagtgggctggcatgaaattcagttaacagtttccattgtagctgagcattattacctatccatatcctccccttgtatttgataacaccagattgcagttggtaacctggtttagagtcagcttgcagagccaaagctgtcagtaattcggtagcgtgggaatcttgttcataccccttaaccacatccagtaaccaacttggagtgcagttggatataatagacaattctgcatctccttggaacttccttgacagtgcatctgctgcagcattgcttgtcccctttctataacagattatatagttgagtcccaaaagcttagtaaaagctttatgctgccaaggggtatgtagcctcttgtctgataggtgcataaggctgtgatgatcagtgagaattatgaactctcccaattgtaagtaggacctccaatggtcaacagctaaaagtatagccatacattccttttcataggttgacaaaccttttgttctaggaccaagtgccttactaacaaaagctattggatgtttgtcttgtgacaaaactgcaccaatccctgaatctgaagcatttgtttctactgtaaatggtttgctaaagccaggtagtgctaggactggtgctgaaactagagcttgtttgagctgttggaaggctaattctgtttcctgagtccatttgtaaggaacccctttcctcagaagatttgtcaatggtttactgatgataccaaatccttggacaaacttcctgtagtagccagctaagcccaggaatcccctcaacttcttttgattggctggagtaacccaattaacaacttcctgaattttaattggctcagtagcaaccccagcagcactgataatatgccctagataggtaagttgttgctgagcaaatgaacacttggagagtttcacctgccattgatacttctgtaacagggacagtacttgctgtagatggtccagatgggaagacagatctggactgtatatgaggatatcatcgaagaatactaaggcaaatcttctcaatactattttcaaagtttcatttattgcactctagaaagtggttggtgctcatgtcaatccaaatgacctaaccttgtactcataatgaccaatgtgggtctgaaatgttgttttgtattcatcaccttccttcattcttatctgatgatatccagccctcaaatccagttttgaaaaccacttagcacctgacagctcatccagcaattcatcaataactggcattgggtaagaactcttaactgtgatagcattaagctgtctgtagtcaattactaacctccaagttccatccttctttctaaccaataatgcaggtgaggcaaaagcactttggctgggttgtatgacccctgtgtgtagcatttcagagatctgggactctatctcatctttaagggctggattatacctgtaaggtctaaggttgacaggttttgcactaggtattagaggaatactgtgatcacaaatcctcttgggaggtaacccttttggttcctcaaaaacactcttgaattgatccaaaatttttctgacagaatcaggaatttctgcagattcagtctgaaacatagaattcaactgaattaagtacattaaggatccattcctggccatgcctagacactgatcagttgatataggagggcaaatagtagtctgagttgtgatgccttgtagggtgatcaactttccttccaacataatctccaaccatttgtttacccagtcaaccttcatgggactgaactgctccaaccagtccatccctaaaatcacatcatagcttcccaagttaagtaacttaaaattacttttgaacacatggccttgcatccaccatttgcacccccagaatttgttggttacaggtcatggtacccccatcagctatctttacaattacaggttggcgcaaattagtaatgacagagagagtgctgccaatttctatatcaatgaaagagtaggaactccctgagtcaaccaacatgagtatctcagtgccttgtatccatcctctcaaacgaatcgacttggaggattcagtaccccacagagcctgttgggatatagccatcaaagtaccttcatcttgctctttggttccttcaggactagtatcattttcagaataagattcagactgcagagcctctaacaattcatgtacaacatgtaaatgtactgtagtggcacatttatggtccctaccccatctctcaccacaaacaaagcacaaccccttagatcttctgtaggccttgagtgaagccactctgtcctctttaggtttggttgattcagtcaccttaccaccatcagaagaactaccaggaaaaaatttatgccctggagtggcaggaatgaagctagagaatcttggaacttgtttatagacagatggtgagtcggctcttttgctaacagtgggtttgcaactat

SEQ ID NO: 59538 - DNA, 7984 bp, Oryza sativa
  unsure (1)..(7984): unsure at all n locations
acaaataaatcttaccatgtgcccttcccacatattgcagcgaagctatatatgtgcacatgattttgaatatgttgtttatgtaggaattatggtaaaaaggtatattatttggtcagccttcaccgagatggttgtttacatttgatttttccaatgttttaatacatatgtatatctagaacaatgatgttcatctatcattttgcatgtaaaaaaatcttgtaaaattcgcatttacacttgtgattttttttgggatttctttttgggaaacacaaattgttcgacataccatattatgacctgaaactataagcagcattggtggttcttttagcttattcagaagttaaaacaaactatatatttgtggatgtgttctagtgttctaacggatgatggattatatatgaactatgtttattacaataattcaagggcacaacaaaagaatagataatcattttccgttaaaaatatattatagtgagtgatgaacctatcatcgcttactcccaccaccacctgatatgtgggttctattgaatagtgagtcatgcaaacggttccttctcaaacctaaacatgttcaaatattgtttgtagcaacgcacgggtgtatttacctagttaacaccatgtgtcgaaactcgaaagagtttgcctatgtgacatatactttggatatatatatgccaaaaatctccacttaaatactatgtttccctattttttcactctcacttacaaactagtacatatacaatataatagtagcatgacatcactatagagtataaattgatggccggtgatcagtggcatgtgcatgttatattatttattcgattccactcgtttgagctccaaaatatgccaaaccgtcatcaaaaccatattaggggtaatataagtggtgttgtaaagtttttttttttggagagcagaccatgggagggggtgattggatgtccgatttaggactttttcctatttgaattatattaatgcactttgcattttgagaggtctacatcattacatgtcaagacaagactaccaagctcggagctatttatagaaattgtacaagtggttgtctacaaacaagctggccagcgatctccatggtgcaccacacgtccataggtaagctttcttgccctcgccacccataaatacgtgcccagctgcaacatcaatcaccaaccacattgatccatccctctatcaatcaagaaacaagcaagattattctagccaactagctagcttgcgaatggcttccttgtcctccttaatgctcgtcacggcagtggccgcattgttggtcattggctcatctggcactgaggtcaccttcaagatcggtgagtcctctaccacctctacactggaactcatcaccaatgtcgccatatctgaggtggagatcaaggagaagggtggcagcgactggagggggctcaaggagtcatcggctaacacctggaaaatcaaaagtgatgcaccgctcaagggccccttatccgtccgcttccttgtcaagaacggtggctatcgcatcgtcgacgatgtaatccccgaaacctttaaggccggctccgtctacaagagtggcatccaggtccagtaatggacatgcatgtccttgcattaggtcacatggaaattattagcctctaaataattatctattcaaaagagagaccgagtctgcatgtgaacacgtcaatagttaaatttctattgttattttgtgacaacagactattgacaaaatgaagcataccatgtgcccttcccacatattggtatggagctatatgtgcacacgattttgaatatattgtttatgtaggatttatgggaaaaggtatatttggccatcattcatcgagatggttgtgtacatttgattttccatagttctaatatatatggttgtgcactaaactacaccttggatgcgcaccccaccccctctcccctcccgcaccttttctgttcccacatcttcttcccgcaccttcctaccatatatcttccagcttttgttaataaataaattactctaaactagtctttgttaagtaaataaattacttataagcaattgatcttgccataaaatctgcatttgcgtccctttcaaccttcattcagtaaataaattactcctaactagtctttagtcagtacataaataacttaaaaacatattggtcttaccacaaaatcttcattggcatcccaacctttcttatcacttggcaaactatctgcattggcatcccatcatttctcatcactcggcaaaatatcttctcattatgcatcgttagtaaatattttactatcgagattaatatcattagtaattcttttactaacattttatcaatcgggcccctcttgtaccttctatctgtacagtaaatactttactattgatataatatttgcagtaattcgttcactaaaagtattaattattcttatacctcctactatccatattagtaatacaattattaaaatggcacctattaaaatctacatgacaaaaaggtggcgctgaatgtttttccaccgcctatatgggaaacaggggaaaatcacatctcaatgcctatgaataaaaagatttactcttgaatcacaccagtagaaattacactcaatcaactgcctccggtgacacactggcgaaggggcaacgtcgacatgcaaaaggaaagttacactcaatcagattgatgcctgcacgaatccggcaagcaggacataaggacattacaacaccaactagctagacctggtttagttctcaatttttttttcgaaaagtcacatcgaatctttggacacatgcatggagcataaaatatagacaaaaataaaaatcaatttaacagtttgcatggaaatcacgagatgaatcttttgagcctaattaatctatgattagccataagtgctacagtaacacacatgtgctaatgatggtttaattaggctcaaaagattcgtctcgcggtttccagacgagttatgaaattagtttttttttaattcgtattcgaaaacccctttcgacatccggtcaaatgtaacacctaaatttctcttttcgcaaactaaacaaggcctgtacacatagacgtcgaggtgatgcagcactgcagcttcctagagacccagatcctcctcgttgacagatatttgtcacccacagtcgcctccaacacgagcacctgcatgggctgaccctgctggctgtccatcttgctgcaaacaaaaagctataatgtaatacatccaaaatctgtaacttaacgaatcaagaatcagctcgtgaagtgcaacgacgggatgcggatttccgatatccaacgggaatacaatcaataagctgctgacgctagtggccacaagtaaaattaagaatatctagtctaaaaaaagtttattctgtcaaaacattcagataaaaaatcaacgggaccatatgtaatgagcagttcaggaaaaaaaaaacaatccatctgctttcttgaaccacaaaattcaagagaatcgccatcaagctccttgagttttcatgtattgaaaatttcagaaggaacaaaacaaaggagctcaagaaaaacatggctcagttgcaagcaaatgaacctctcaactagcggacccatcgtgctgcccgcagccccctgcccatgtgggatcgatatgccatcgacgaggctgacccatcgcaacagaactaaagcttgtatacccttcatcccaaaataagctcatttataggtttctgtatccaatcgagcttaaaaaagtagctcagttgcaaccccaacaaagcaaagcttcacatacacacatacgatgcgttaattacgtttctaaaattactcccgcatgacacaaccgtgattagatttgagaaagatagtgatgtgtgtatgtgttatattatttgttcaaatctgctcgtttaaactccaaaatatgcagatctgccattaaaaccacattaggagtaatataattggtattgcaaagcttttttgggggggagggagggggtggttggatgtctggttttattaatttttcctgtttggattagatatgaggattgcatgccctttacattttgagaggtctacatcactccatgacatgtgctaattttgcctgacagaaagacaagcgggactacctatcttagatctatttatagcaattttacaagtgtttgtcgaagaacaagccggccaacgatctccatttgcaccatacatccatagcttagctttcttgcctcgccacccataaatacatgcccacatatgcaacatcaatcaccaaaatcatcgatccaatggcctccttgtcatccttcctgctcgccacggcaatggccgcattgttggtcatcggctcgtacgccactgagctcaccttcaaagtcggtccaggctctagcaccactagcctgaacctcatcaccaatgtcgccatctctgaggtggaggtaaaggagaagggcaccggtgactggacggggctcaaggagtcatcggctaacacctggacgctcaaaaccggggcaaaactcaagggccccttctccgtccgcttccttgtcaagaatggcggctaccgcgtcgtcgacgatgtcatccctgaagccttcaaggtcggctccgtctataagagtggcatccagctcaagtaacgtacacttgtgctcttgcattggatcgcatggaaattgttgatctctaaataattcttttttaaaaaaagagagatcgagtctgcctgtgcgcaagccaataattattttttatggtccttcccgcatattgttgtgaagctatatatgtgcacatgattttgaatacgttgtttatgtaggacttatggtaaaaaggtatattatttggtcagccttcaccgagacggttgtttacatttgatttttccaatgttttaatacatatgtatatctagatcaatgatgttcatctatcatttttacatgtaaaaaaaatcctgtaaaattcgcatttacacttgtgattattattattatttgtgaaacacaaattgttcgacataccatattatgacctgaaactataagcaacattggtggttcttttagcttattcggaagttaaaacaaactatatatttgtggatgtcatgtgttctaatgttccaatggatgatggattatacatgaactaagtttattacaataattcaaggtcacaacaaaagaatagatattcattttcctttaaaaaatatattgtagtgagtgatgaacctatcaccacctactcccaccaccacctgatatatggggtccattgaatagtgaatcatgcagacagtcgttccttctcaaacctaaacatgttcaaattgtttgtagcaacgcacgagtatatttacctagttaacactagatttgaaagattgatttaaaaggctctctaaatattgatgaagaagacttccgtataaatcgtaccatttaagaaacaccatgggatattttggccatgtacaacactccaccgtgggtagtggccacagcactctagctaagcgatgggtaaattcccttaaacctactctattcatcatgcgctaatggcctaattcgttttacgtattttcacagccttctcctctcctcttcttttatactcccttagtttcatattataagttgctctaaactttttagtagtcaaacttctataaatgttatcaaatttataggaaaattgatcagcatctataacattaaattagttccaattaaactaacatttaatatttttttagtatgttcattttatattgacaatgttactatacttttatataaactgaaccaatttttttaaaaaaatgactagcaacaaacttaaaattaaattaaaattaaagtgacttaggatatgatgagacgaaagtaacagctctttttctctaacaacgaactggcgtacgtggaaggaacacggccacgatatcgtacagacaagagaagccgcttcgagaagacagccgctgtccatgccgacgcgactccacgcgcgccccgcgtctccctccgccgcagcagcctcgtcagctcgcgagatcaacgccggcccagtcagcccagccacatcaccgcccactccaccaccccaccccgcatggcccggatctaataaccaacggacgcggctcgcgggcccaccggcccacccacgcccgcccacgggatctctcgctgactcggacgacgacatcgccttcgccgctttcacagtgtgggccccgcatgtcggcgccacggggggccacgcccgcctgcgctggatccgagtcagcctcgcgtcgctgtcacactgacgcagccgcgtgttatcttaatcagccacaactttttaatgcctaacctttaaattaagccgcgacgagcactgcacggtggtcggaggaaggcgatgatgaagaagtgcccgtcggagctgcagctggaggcgttcatccgggaggaggccggcgccggcgaccgcaagcccggcgtgttatctcccggcgacggcgcgcgtaagtccggcctgttctctcccggcgacggcgagatgtccgtgttggatcagagtacactggacggaagcggcggcggccaccagctgtggtggccggagagcgtccgtacgccgccgcgcgccgccgccgcctttcggccacggccgacgagcggacgccggcgtccatctccggtaggtacacatgacataatttgagtttttttgagttacagagctattgtgcaaacagcccattttctatgcgtttatttggagttatgaaacacacccaaatttagtcaaattcatcacatgttgggttcattttggttgcagatgaccccaaaccaaccacctcagcgaaccacgcgcctgaaagcgactcggactccgattgcgattcgctgttagaagcagagaggagtccacgcctgcgtggcacgaaatccacagaaacaaagcgaataagaaggtacatagtgatcgatcaatcttgatttctagcaaatgcaacaaatttgaacagagaacgcattcttatgaactgcttgttcgaatttcaggatggtgtccaacagggagtccgctcgacgatccaggaggagaaagcaggcacagttatctgaactcgaatcacaggtattataaacttcaaagttcaaatttccagatgcgttgatgcaaatatcagtgtgatcttacagcaatccatctatgatcaggtcgagcaactcaaaggcgaaaactcatccctcttcaagcagctcacagagtccagccagcagttcaatacagcggtcacggacaacaggatcctcaaatcggatgtagaggccttaagagtcaaggtaattagaaaccaaactctccttcagccaccaattatcggcgcatttaacttttcgccacttttaagatgaggtaattaagaatttaccacccatagtctatgacaacatatgggtctttatcactttatgtgtctatgacatgtgagtccaattgcaaattgtcactcgtaagagtggtaaatagttaattgtttctgatgatcggcttccggcatctctccaaacttaccaattcttggcttcgatcccaggtcaagatggctgaagacatggtcgcgagggccgcgatgtcgtgtggcctgggccagctcgggctggcgccattgctcagctccaggaagatgtgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 59539 - DNA, 9609 bp, Oryza sativa
tggtaggattttttattctttttttcctttttgaaaagaagattgacttggtagttgctgatcgtatgcctctcaatgttgcatgagctactagtagttaggccgatagtcatacaatactttgaccatcattgagacgcatatgaaaatccgctagcttttattaagagcaaattccctgactagattatcatgaaactacagatttcaaagggtatattataaaactatagatttagctctaaatttatcacaaagctatagatttagatcgtttcagaaaattaaatatttagtgatgaagttatcatataactatagatattttcaaatttagatctatagcactattattttttcaagttacagaagctaaaattttgtggtaatattgatgttaattatttagtttagtgataatgataaatttgatgctaaatctgtaattttaagatacatttttatatataatctatagttttatgatattttgataaaaaaaactgtaattgcgtaaaatttactcttttattaataacgagtctttttgtttttttctctttcttggttttcatggaaatataatctcgatggtcaaacacaacactgttaattcgaacatcaaatttctgcacgagttttgtatcatgttttgtactaggaaagagggctttcaccactttttttttcatgcatcctatagagacatgaaaatgatcatgccgatcgacttctcttattttcttaaacgtgtagaatttgctcatgtgattgttgagaaataattgcctatgtcagcagtagagtataaaatcattgtcatcataaaaggaggcattggtggtcgttttccgtttctttcggttgtcttttcgtcgtgaaaaataagaacaattctttgataggagggtttatgtgtgataatgacgatgataagatgatcaacccattgtcacaagtttttcccttgcttctcaattaccctacagttttctaatacctattcaagtttttaaatattttttgtgcccttagtattgcacacttaccattttgttgtttgcaccagaaaagtacaattctagatattaaaagggaaaaataagaaatcagtactaggtttcttctgccacttacccaataaactaactttaattatttcctaaagaagcataaagagaaacatatataaatagaccctgaaatgggaatgatgaattgatgagtcactgtccagcgtccacttgtccagtgtagatgatttgaacattttgaattcattattgtttgaattttgattggcctggttgagaaaacaatgaaacgtgagtctactttgattcggcaaaatcaaaatctgccaatagaggcaacacatgtgtacatgacgcagctaccgcttttaggtcagatccgaggtgtaagcggatccaaattttggttataaaatattgcgattttcggtaattgaatcttcggagagatctgttgacatgaacggcaaccacgtcatccacgtgaattttgctcgtgggcatttttaaatggtgagacaaggttgctcattttttaagagtaaattagtcatgaatcagaagcaaatcagaaccaaaaactagtatatcaacgtgacagaatccggatttccagtgacgcaaatgagctgctgattctcatcttccgtatagactccttcggtttatgccgtagcttaaatttaacttcaaaaccatagtcatacagttgattttgatgtttttcattttgcagtactagcttttaaatgctaagaatacatatgaaaaaggtttttccttatagatttttttcttttgccgctaaaaaacggtacgttttataagccactataggtttaacgataaaactgtgttcaaatcgataaaactgtgttcaaatcgaaccttttcaactctactttttcattttttacatgcatattttccaaactattaaattgttattttttttgcaaaaaaagttctacttaattaatcatgtgataatgagctaccacgttttccaaaaggttccaaatctttatcctcgaatgcagctagggtcggaacaaaacttcgtatggaaaacatgaataattctcgcgattctctgaaattgattcccgttttgtaattaatctcaatcatggcctacttacttaatttccatttcattttttgcagattttggtgtcaaatcaagctcttaatttagccaacattgtaggccaagacgatggagatccatactgctactcgatgcagcagcagaattggtagaggggcggcacacactgccctccctgtgggtagcctccggccgtcttgcaccagttgtcgcagtcacgtatatcctcgcacttgcctcggcacacgaacttgccctctcctgcatccatcagaaaagaaaaatgccaatgtttagttcacaaatcagccacatccaaacagagtaaatcataatttgaaactccgatgttctctttcgatactgagtaattatgaaccgtaaaaatcagaatcgtaatagtgatttgagaggaacaatattatctatatctatactaatataaaagatagtagtggtggtgatgagtctgccaccaccaccacccaactaccatacgggacccatgaacggtgagtgcttatctcttagcccccacatgctatagatcttatagaaagaaaaatataacaatagaatattatgaaaattttcatctttacaaaatgatagaaaaataaacaaaatgataatatattagacaattagaagaaaaaagcatgttgcaacacacgggcattatgctaatcttagaaaatcttgcaatgtgtacctgaagggataaggagagcagcaatggctacagcaatgacaaggatcttccacataacagaagagaaggtggcagccatctcgctgttaattgcaacccactgctgaatgctcttctgattggatttgttggaagcaagatggtttgagactttgagtgatgctgcatcgcagtcatctctgatcatgtgtatatatagcagcacgatagtaaataaagagggtaattttggtgaatagtagcattcagctaatctaagcctctagaaggatatgcatttatgactcttctaagtttaacatgccataatgtctctattagttagattagatacgacaaggataaggcacttaattatgtgccaaagataaccatgctagggctcttttaccatgtgactatttgtgaccgtttttagactcattgacaatttgacacatggcagagtaaatcaaccacctatttttatatttaatttaacaaattaggttcacatttattttagaacaactaggttcatattacctttatggaattaagatgcctgcactacatcagcacgataatatttggttttactattgcgtttcacagaattaaaatgacttccaagtttatacacacccccagctggtttatgagccactgtttagtattgtaacagagcaatatttctgcagtcgtaaattgaaatctttgattaaattagctaacaagtgtgcggacatcaacagctgaacagatttcagattgttcaaaggtgacctgcagtctattttacaaacaacactgacctgacaagtgacaatcaccctcatgtacaaaaaaaggaaaagaaaaagaaaacgacggcgcaatgtgcaatctattacgattagaaagagctgcggaaaagttacttcatgctgtggaaaatttgactcaggtagaagataaaactcccatttcaatcttgttattactcttcaagtttttggtgcttttgaaggaacacctttgatcttatatcagcctagcgaaggatgaaacgaaacgtcaaattagtacccaagatacaacgtgctgacaagatgaaacttgaggtatactatttacaaaattctacctggcgaatgggctcgggaatgcgataattactacagaacttcactatcccaatggctgagtcaagtgaaatgcgatgcccaactgagatgtagatcggcttcgacaaactagggcaggagcacattgcctgggataagttaatagtttagttccaacaatagaaaccttttcattatcaggaaatatatgacagaaatgaagtgaaggatgcattcagaggtccaatatagaatctcctacagctccccatgttgtcccagactgtccagtcaataaaattaactccttgttgcagttttcttttgcttctaattgtcttctcaattcagattggttaaggccatccacatggtgcagctggggcattcaaaacactgaggacttagtcttctctcagaggatcagaacatcagaaaaccatcaagtacttgaaatggtcggaaaacaactagatgagagaacttccataggagtagttgcaatggcagtaatattaatacattttttccaactccaatggtcggcaggtctgcaaggacaccaagatgacaagctaaaccaaaacctgttgaacatatgtaagttagagggtcatgcattcaagtagtttattgatgcagcttgcagtgtatatgcataactagacatgctgtacgctatcaccaagtcaattgactagggactacaaggactgtcaaggtagttcgttctaaaagaatataatataatcatgttatgtgtgtgattctgcagtttttttctaatcacatgaatcatcttagtcttacaaactaagattgccatgatactaatcactaatgaggtatacctcgtggatgaagtaatccatttccatcaaccatgagtacctgtcagttcatcaagttaaaccatagagaaggcactggcataactagtgttaaatgtaaaactagaagacgctaacatatctaaaatttaatgccaatgcttatgccattaagcattccagatcaaaattctagaataaatgatatttatgatgacaaatgattatacatcagcgcagacaattcacactgttttcacagtcaaaatggaaacaacatatgacaacatggaatgctacaaagcataaagccacagtaaacctatttacagaagggtaaattgcaacgacaaagcaacctgagggtagaaatgctggttgtttgtcttcattttttccaagagtcctagaagaattggagcctgtaacaagtagtgcatgttgacacttttagctgtataacaatatacttgatgtatattttaaaccatctaacaaagtagaataattaaaagaatagttagcatataacaacagtttatccacgtccaatcataacttgattttgcattgaacatgctagacccatatatggttatacagataagaagaaagaatagttagcaaaaacacaataaatatgaatgtacccatcttgattttgtttcagtgtttgcttgtctgcctgttcatcactacagaaaatgaaaatgtctaggcccctgaataataatacagaaggcatggataaactgttgctcatgatctagcaaacatatgttttgacaaaccaaacacgccaaaataagaggacacacaatacctctctgaaagcaagaaatcctggaatatatggcacttgcagccgaacaacatcgaactcttcgtggacaacttctaaggtaccagcatctaaaactaccagtgcagcacacgccgtggaagggtcttctttcgagaagctaatgtcaacacctcctatatacttcaggttgcccttattattagcattgctctgatctgaatttgagcccattgaaggtaaattccacccaaaatcatcctcaagaatgagcttgctctttagcatgtcttgtgttctacagcacaggaaaaaaccagcatgagatgtgaactgactcctcttgattggtgaatggttctgagggtatacttggcccattcttgtttctgctgcatcaactcacaatcatctcctcctcctgaaaatcgtggggtattatccattcctcttgtgttcctcacaagcctgcagaatcttgcacagcggtccggaaatccaaaaaaaaaaaaaaacggctgcaaacctgaaaaattctagctgcgttctgcatcagcataatgatttgtcttgaaccgtaaaatttgagcactgtggaattgcggggcgtactgacagggaagagaatcgaagaatcggatggcgagagaactcgccgagattctctcacctgatacgtcgccgtcgcccgatgccgccgccggcaagcctaccctctcctcttccccttcaccggcctcctcttctccccgcaaccgctactcccgtcctccacctcgccggcgcccgcctgctcgtgaccgtggcagccctcgtgatgacggcggcggcggagccggagaggcgaccttcgccggcgaggcggcgcgagagatgcagaggaagtcagcgagacacggagactgacaggtggggcccacaaaagagagttgacagatcgcaatctcggcccatctcgctttgcccgggaaacttgcgacggatgggccacaattgcggcccggatatgtcatacaatgggcctttacttcgaagaacttttcctgatgggactgtctaggcatgtggcgtgttatttttgagaaaaaaatcacccaatttttttctcccctcgtatctgcatccaacggtaaaaaaaaaaataacaatacagagaaaccgtccaagtagcatgtgattgtacttattagtagagtagtattcaataaagattaacacaaatgttgcatttataactaaaattaccgacaaatgttgcatttataactaaaattacagtgttttataactaaaattacatttataaaaacaatagatatggcatgtaagtgcactataatttatttgtcgttttagtataaatacattgcttgagaaaccatgcagatatctgaagtgttaaatgttatatttataactaaaattacagtgctttataactaaaattacatttgtaaaaacagtagatatgtcatgtaagtgtactgtaattttagtacaagtgcgctgtaaattttggtaactagaatatttgtcgttttagtataaatacatgggtgtagctatatttatggcgccatatttttcatcaaaaaatagtcggtatgtatttacattgtaagtccctaaattacatatgtaattttagtgtatttacaatgtaagtctcaaaattacatatgtaagtactaaaattacatatgtaaattggggtgtaaatgaggtgtaactactgtgtaagtggctgaaaaaaaatcgactgtagcatatggcgccatatttctagcaactccgtaaatacattgcttgagaaaaccgtgcagatatctaaagtgttaaatattgcatttataactaaatacagtgctttataactaaaattacatttgtaaaaacagttgatatggcatgtaagtgcactataattttagtacaagtgcgttgtaaatttgggtaactagaatatttgtcgttttagtataaatacattgcttgagaaaccgtgcagatatctgaagtgttaaatattgcatttataactaaatacagtgctttataactaaaattatatttgtaaaaacagtagatatggtatgtaagtgtactgtaatttattttagtacaagtgcactgtaaattttggtacctagaaaaaagaaagaaagaaatagatagaagaagtaaatggctactgacaatctgacatgcgtgatgtacatgaatccatcgatataaagtcaggttgacttggtcatggactcaactgaccctgcttttgcacaaatcttggaaaacatcgtgcggctagaaaaacgtcaaatactatgaaaaaaaatcacccggcaaaaatttagcaaaatcgtttcatttccggattcgttcatactacaattttcagataaaattcttcgaaaatcatctgaatgagaactcgtacgtataaccaatcattgagagaatatgaaagcttgatggtgtggacgatcttgccgaaatcagtcaccaaagttttttttgggcattttggcaatgttgttcaaactcgctcagcatggtcgtgttcctaaattctctccctaaatgtttttaggcccgtttgaaactccttattagattatagcatattagcacataaaatgagacggcccatgaataattactaaacattataaatttcaaaaatagatttctttgattttgggtaatctgcatttcagtaaatgaaatgggagagcgctgctctccttcttaaaaaaaaatatttctttgatttatttttaaaaaacttatatacagaaatatttttttttacaaaaacacattatttagcagctcgagaaatggtgctaatgaaaaaggataatgttgtagtttggaattgaagttttgggcatgatgtgcttgatcatgcccaaactcaccaaagcttttggaattttcacaatctataacctatttcaaacccgtagaccacgatcgtgctgcttaaatctctctgcaaatgttctcagtctgaaactctcaactcggtatcgatatatactctgaacattctgcatacatcaatcaacacaagaaaccaaatctgcagggagagatcatccgactgctctgccgacgtactcgacgtcgaagaggagagtggagttgggcgggatgacgcaggaggtgggctcccagcctctgcacccggctcctctcgcgccgtaggccagctccggcggcagcctcagcgacctctttccacctgaacattcaaccacatttccattcagcttcaccatttctctaaattgatacaaaatcgaggtgaatctgatcgagtatggtgagttcatttcagatttttgtcatttttcagggttcagttcaggcagggagacgcaccggcgagcatcggcgggatcccttcgccgcccactatgccctggtcccatcctttgatcacctgaagaattatcagtgaatatgcaatgtgagtgatcttggtatcagagatgagtctaattcatcgtgtagctgcgtaatctgttgccgattagtacaatgtttgaatatcttgcagaatctgttagtgtgcttgattgattgatcgtgtttacctcgccgacgccgacgcggaaggtgagcggcttcccgcgcttgtagctgctgtcgaacaccgtgccgtcctccagcctcccggtgtaatgcgcctgcgtgggacgaacgaaacacacggcgaggttagcaagaaccccgagacctcgcctcgccggcggcggccggtgggcgggcaggtgcgtgctgtcgtgctgaccttgatgagctgcccttgctcggcggcggcgccggtgccgacaacgcggtcgcagaaggcgagaccgttgggcgccacctcgagcgggcactcgccgccggacgcttccgccgccgcggggagcacgcgggagaggatggatgcggacagcacggcggccacggcctcgcgccggcggagggcgacgacgggggtgctgttcttggcggccacggcggcgccggcgttccggctcg

SEQ ID NO: 59540 - DNA, 4001 bp, Oryza sativa
  unsure (1)..(4001): unsure at all n locations
ataaatttggagaatttctatattataggaaaatcgtaggaaagtcttcgaaacaaagatttaatcctatacttttgttttaaaatcatataaaatggacaattctacaaaaaaaatttagaggaaaattacaagaactctaaacccttgaaaaatttcatgcgagtctatttatctaattcgattcatgtgttttttccgcggtctacacaaaccactatttctatatttttcttatgttttgttgtactctattttgcatttatgttcacgtttaaatcctttgctctttttccattattccattttttttcaatactacgtttcaaagaaccatgtaatttggattaaagatgatggatttgtttatgtgaattagtcaaatattatatattacaaaccttaaaaataaatttaaacacaaagcagtctaaacaatgaacagttctaacgtttaaagtttacggagaaatcgtgaagtaagcgttgctcaattgtttagattcttcgtggtggaaccagcctacctgggtacaagttctagatttgacacatgtactcacattcacggctaattattctttcagtggtaggtgctgtacctgccgacagcgagacaacatggtgacttcgtcaatctcgagatatgtcgacatagtcttccgaaaggtcatagcggtagggtgtgcgtgtgtgcattcataggagtgagagtacacgtattgtgagcaaatgcgtatgtatgtttcgaaaagattttgtagaaatcgaatttttttggagcatggcacgagtaatccacaaccaataatctgaggtctgagattttgttgacatggcaattggcaagttgatctgttccactcgtgctaactaggaatttatgtggcaaaaccaaaagtggcccccgcatgtcatcatcactgtcctcccctcttctctctagcttctctctctctctctcctaagggggcgcgcggtcaaattggagcaagggctgccgaatcgaaggagaagtcgcggccgtcatctatgttgggacctcccctttgaacttatctagcaaacagtgtgagtgtcttaccggaagacggcggaccatgccgatgctacctttaccttcgacctcatcagctctatcgcttctgtcgaccagtcgaggagcgacaaagaggtgcctggccggaccgccaccgttgactcgctgtggagcgcgtcccactggtggagacgaaccaagattcggtgaataagccaaagaacgagcggctcgggacgggaactaggacatggtgacgcaaccaccactcaaagctcaagttccacctccacggctcctcctcctattctcaacatgattgggtggaggcggcgagcccacccctagtggtggggaggaacgtcccacgaggatgagcatgagtggtggggaagagcccactccagcatcacaggaccgcaggagtacctaaggcggagttgctggggcattggatcctctccttcactgatgccttctcgcggatggctggctccctcgcctcccttctcttttcctccactatggctgaccaccagagccacctcatcaccgacctcccaccgttgcctcgtgcggacggtctagccagctgtcaccgctctccttgccgacgagctcctatgaaagagaggggagagatggaataggtggggagatgtggaagtccacttatatgtgggcccacttgttttttaatttcctttttgctgaaacacgtcagcaaaaacaagtatccatattgtcacgggatctgacttgaatggttttactatgatggggttgaagatgtctgatattgcagtttagagttatcaattaaactcgacggaaagttgaggaatgaaaatggacttattcctccctagatctctgaaaatttctgggccaaagccttcctggcctgctcaacattatccggcccatctacccaacacacctcatcttatagcccatacaactacccaaacctgacatccttcatcaaatttctgcaggcaaccaacgtgattctgaacaaatgcgatataataaaacccatcgatatcctcgtatacagtacactcatggcgatccaacaccgtcgctgtcttcagttacacgaacgcacgatctcgccggaaagaccgccgcttcggccggcgagccaccggagttcggcgtgtgagccttcaaatccgcacgcacaaatggcgtagcaaaacttcgttaggtttcggtcattttcacaggcaattctgatctctcaatctcttccacacacgccgccgccgcagtaatggctcgatctgcagcatgtgcctgaccaaactctcgatccacatccatcgatacatcggttaataagtcaggttttgtactttcgtttgaactggtctgcgaggaaaaacaaaataaaaatctttgttattggagagacagtttgatcacaaatcactcctgtgatcgtggtccaaaatccagtacttgtcggtgtcagtactaccgttctgttgacaagtaactcatggtgattgatgctcatcttctcttctgatcttctccttgacaattgtaggaaatgattaattcccaattttagactttgtttagataaaaagaaaagaaaggagagacaatcttgcgaagttaggtttcatgcgttgcaaacagcggcaccattaacaggagcatatcgtcatctctgacatctagtgagtcaagtgacacagcccaggacttgggccagattaccagaatggataattggagtcgctcacctgctcgtgatccatcatctctcttcttctgttgctttaggttgcttgcttcactgcatcttaagcttgtactaatgcaaaacttgcactcaaaaagattagtgttgttgttttgctaaccacacacacagacatgaagtcagaagctcagatcatctgctcttctcctgcatatgccaaagccctccaactccatgtttcagaaaccatgacaggagcatccacacaaccaatttttagcttagtgatcagcaaagcagcattgtgtatgtcatgtcaaaatccagtgattaattagcggaaggtgacttaatccagatgcaccaaagctatactatccttatccactgaagcacccaaaaaaagtctttcagggacaaaagtgcagtgcagtgcagacggcaggcctgctcaactgtattttgaccggctgctgttgcgacactaccaagtacaccaaaccacttcaatctcaagctttctttttatggtcctggatctcactggcgtcatctcttgacatcttaattttattttggagcttgctaggctgctagtttcccttgatttgctcttttcgacttattcaccgaattattaaaacatattatttattacatgcttagaaacataagttttctaaaaaaagacattcttccaccacacattatttaaggtgcgttcgtttaagcgaatgactggaactcttcagtcaaacacaaaacagatactccctccattgcaaaatgtttgacaccgttgactttttagcatgtgtttgaccgttcatcttattcaaaaaaaatttgtgaaatatataaaattatatgtgtacatgaaagtatatttaccaataaataaaatgatataaaaagaataaatgattacttaaattttttgaataagacgaatggtcaaacacgtactaaaaagtcaacgatgtcaaatattttgaaacggagggagtatatcgttaatatatgattaattaattattaattactttaaattttaaaaatagatatgctgaatttttttgcaaaacttctatatagaaattgttgcacaaaacacactgtttagcagctcaggaaacttgctagcaatatattttcctaaaaaaaannnnnnnnnnnnnnnnnnnnnnnnnnnnnnnnnnnnnnnnnnnnnnnnnnnnnnnnnnnnnnnnnnnnnnnnnnnnn

SEQ ID NO: 59541 - DNA, 703 bp, Oryza sativa
  unsure (1)..(703): unsure at all n locations
attcctgcagccctgtaggttaagacctaagaaaaaaataatttgaagttgtataagaacccagactttcacttcaatgggctggtttagtttccaactttttcttcaaactttcaacttttccatctgtcggtgatatgggaccgggagtatcatgaccagaggcttgaggcagacgcaatcgcccacgtggcctggcaccttcggggacgtcgggcccgagggtgaggtgtccgccctcctcctgatttcccccgagggggggggganagccgctcctccatctatgaggacacgccccaacttcacgttgcagatagtgggggaaaccaccatcgcaatctgccctccccgggcaacgcacggtgggtggtcggtctgatcaaaggtgagggccacctccgaccaccgcgcccgacgcgtcgcctcatgagtaggggccgcggctagaagctctcgcttcatagccttgaagctccggcgagaaacgtgagcacacgctcccccgtcgacagtggcaatggtggccccaggttcttggaaacctaggtcatcatcaccgtcatcggggtcaacggcgggggccttctgtctggcctcacttcgccgtctaccggagggaactgcccgcgacttgccctcaccgcgttcctgctcctgtgctcctcccactttctcggtcgctcagcccaaatttttgact

SEQ ID NO: 59542 - DNA, 1139 bp, Oryza sativa
tgctttaccatggaacatcttcaaaaaattaatcatgatttgacatgcttattgtaacatgaatgacgtcccagtgtcatttaacatgaatgagttgacagcattgctttactagcatttttttatttggcggaataagatatatttcaatattgaaatgcaaatgctaacacattaaatattccaatgaaaaaaaaaaaactataaccatagaaatcgtctcacctgagccaacctctcgtcacgcctggcaatcttcctctcacgactggccttgctcttggcacgcttaccctcaaactggtcagagagtgtcttctctcttgccttctcagccttagacttgcggatactttccatgagaacacgcttgctcttgaacatgttacccttgaccttcatgtacatgtcatgatacatgtgcttgtcaatcttcttggcctcacgatacttgcgcaacaaacgctgagcacacgcatcctactgatccacaggatcttggtggggagcctagcctccctggtacccctacgcttacctgcaaaatggcagaataaggaatacgcagagacattttcacactaaaataacaatgaacttaattgtacacaacgcaccatagccagagtgacgtcccttctgcttggcctcatgggctctccgtgcacgggacctggagtgaatcttctggggcttcttgataatgaacccatccttgaccaacttacggatgttctgacctgcaagcacaaaggaaaaaaaatcagatagccttccaagaatttcaggcatgtgatatgagtcacagatatatacagggcaacaaacttcagtatctagaacagtaaataattaataggatattttattggttcttgcaggaaatgagttgtgacctattccaataggacattacacaaactcgcttgcagataagctacaccataattcatacgctcagacaggatcataccacagttgtacaaatggtgatgcagaatcaaaatgaaccaatgagctttagaagttggaattgcaattgcaaaactgacaaaaaactgatcctttaatggtaatcatcatttgggcatgaattgccagcatcctaactgatttaggtaacgaataactcaacgaag

SEQ ID NO: 59543 - DNA, 782 bp, Oryza sativa
cgaggcggccggtcggtgaagtcgatgatgcccaacaacagcggcataataggccggccgtgcaagcggaaactccagtcggctgcagacgaagcggccggtcggtgaagacgtagacgcccaacaacggtggcataataggccagccgtgcaggcggagataccagtcggcggcggatgaggcggccggtcggtgaagacgtagacgcccagcaacggcggcataataggccagccgtgcaggcggaaacaccagtcggcggcggacgagggcaagccggtcagtgaagacgtagacacccaacaacagcggcataataggccagccgtgcaggcggtgacaccagtcggcggcggcgaaagcaagccggtggtgatgttctgactgatcccattcctgaagcgtaagagataagcttaaagccatgaatcccttttatgcatatctggatctggatcctgtaaaacaaacatataggatgagtagtatctgatataaatataatactcgagaaaaattcaagtattttaaaatatttataaatatgtatttctcctctactcaattttgatttccccgagcagatgactccgtacgtttaaacactctgtccgactagtcatagcccccgagcatcgggagtcggcctaggcacttcccaaacatgcatatgagtgacatgagttcgtcattaatggaacaaagtttcacgaatcagaatttactactcgggtacttttgcaattgtagagagcagaaaatagcatttatcttatctcta

SEQ ID NO: 59544 - DNA, 986 bp, Oryza sativa
gcattctcgcgcccctcactccttcttgtatgactttgagagagagatagagataggagacctgatatgtgggtctagaggtattttagaattttcacgctatttctctcccctactctactagaaatgattattctaatgggcacgatgttcattagaaaatttccacgtttacaaagtaccttctcccaaaagtcattttatgtggtacctcaaagttacgatgaactctaacaaaatttgcctagaatataattatgtgagattgtattataaatattttattgcaatgaatgtaacggtgtgaattagatggtaaattagataagtattttaaagaaaaaatataagaaggaaaaacctacatacatgacctaacaaaaacactcaatcaaacattatcccatagcgcacatggctaccaatcaagcctcgtcttacaagactaaatattgtgtgtgtactactatttagattttgtgttaattgtagcatatgtatcaacttgcctgcagcccatttgtcgaatggttggttggcacgacacaacttttagacgggttacaccgcgacaaacgagggtgatgcgattgctcgcgtttgatcagttacgaagtgggatgcaaatgcaagcgataacgaaaagggagcatcgcttacgaaaatcgatcccaaccaatctgctgcgcgcgcgcgcgccgccaaggccactcgcaagtcgcaaaatcatataccttcatcggcgtacgtgagtgagctcgagcaacttagcaagcacaccgcacgccgcgtcgctccagacccggccgccggcaacggtgacatcggccgcaggggcaattactgctcgatcgttgctccactcctcgccatggcccagggatgccgatgccaatgccatcataggcagcgctggcgctgctactacacttgttaataaatggcccgcctgctggctaaggaggaagccaaattccactacgatg

SEQ ID NO: 59545 - DNA, 858 bp, Oryza sativa
ctcacctacagacaatatgatagtagtatgttgggctgtacagagaggcaacagagaggacagcttcttctcgtcctaatcctcctctatgccattggcctacccagtagacagtagaaactcgaaatccacatttaaatcaatgtaatcgcttgaatcacagcccattgatgaaaggggaaaacacagggagctgctaatcacgcacctaaccgccagcggcgacagtgacccgtcgaactcgatgcgtcgtcaccacgtcgaagacctccaaaaaactgttgggagagccgcagcgaccttaaatcgctgggacctccagcagcagccgccgctgccaaacccctgtgctagaggctccgacgccgccgccaggtccccgacctcaaggctatgttgaaaccgccgttgagcccctccatcgagcgcagccaccaccgtacactttagggaagcactgttggaggacgggtaaaacgatggcgctggaaaggccatggaagaggaggaggaggcggcgccgcgtcggaggagcatcggcgcctccggtcaaagaagcgataagcgagatggggattgggatgcgacgtggagagacgagagatcgtggattccacgtctgggtaaggacggaaccatgtacatgggagacgaacgatcacattatgtccacgggtgatatcgaacggctctgattcgatggactcaatcgtaaataccaaaatggtaagggcttttctgcaaaaattaatggcgtggatcaactaggtttgcagatacgtgtcacgatacgattagttgacggagtccaaatcgccctggttgcggcaagctaggagctttaagatatctagtatt

SEQ ID NO: 59546 - DNA, 1047 bp, Oryza sativa
ccattcatattaattcagttgattgatcccgtgcttgcatggacagaaccgatctgatgaccccgcgtaactccggccgttttccccatggcttatgtttttttcaacccgcagtgatcagaagaattcacagcgcggcggcacatgtaaccagagaggaaaaacaacagaaaatcaattgtgattatagatcaatctgataacaatatattgaaacgacaaaccgattaacatttggagtcgtcgaactcgttgagattaatctcaatgcttgaattgattccatcgcactcgtcgacgggaaactcgacgcatcccctgcctggcgcgccagctgtcaaaacatgaattcggcaataataaaacggggtagcgcacgaaacctaaaagtatatggatgcagagacaaggatttagacaggttcaggccctctcaatgagaggtaataccctactcctgtttggggatttgaatccgccgagtgtagtatagatctgacgatctaattgtctcatgccccctagagggcctcctgcccaccttatataggatgggggacatgattacaagatagaaaccttatccaatacggtatcggtttcctaaatctactttacaatcttatcaaaccaggactttaggccgttccgtaatatacaaggaaacgtaatacccaagtcatgatctgttacatatttcatatatataagttatcccctataactagtcggataaccgtgccgtgtgggtatggggtacccataatctccacaagtgcgcccgcgagtcgaactcgaagatgcatggtgtgttgtggcaacttgggaacgagctgcttgcattggcgttgtttgggtggttaatcgatcgaggcgtgcgggtgggtgatgggtgtggcccacatggctcacgaggcgcaacagtcaaaatctctgtcactgcaactaaaaggtcactacaactaaaaggtggtaaatgtctacttggacaggcaaagtcaccatccgatcccacgcccctacgacgcttcttttccgtgccgatag

SEQ ID NO: 59547 - DNA, 2421 bp, Oryza sativa
actgtgacaataccccttgcacaacacaactcaccacagtgcaccgttcctggatcataatctccccctcaaaaccagaggcaatggactccccagcgacccccacggacttctcgccgcttcacagtctggcgcactataatgaatcatgctatacaaaagataaagccgttgcccacgctggcttgtggttggcacggtaaaagttttacaacagtagctcgcgaaccggtccttaattgtcatgagcacaaccatcaaaaccatatgctcacaacccaccttaaccaggttttaatcatcaattaattaacatcacacgattaaccatcgtgagctaccatttaatgtaaccataattaaaataataatgtaacatagtttataattaatccctttagttagctaacgtttctaagcatggctaagcaaacttgcatatagcatttagttgaaccaatccaacatataaggttcatgctaatcaaattataacctataggaaaataagatcatcttcggccattaattaattgggaaaggtttaccacccgatgacattcgaaaacaatgcgtaactgagataaaataatagctttaaatgggttcaacatgtcaaagggttgtttgggatctgagtgacttgccttgggcttacgcatacagctcaagaacctttctcatcggaaacactctcctccggaacgtcggaaactaaagcaattaaacaaaaattaacaaaacagtacaaaaacaagcatacacagtacatgtggatatttttaacatgtagatcttgattttagaaaaatttagcaacttgaactacctgaaacggatctacggttatttagttatgattttctgaagttttaatctattagaaaaacgggaaaaagaaaagatgatgatgtcacgatgacgtcatcaatggtggccggcccgaattgacgacctcgccggagctagggcggtcggccggaactttggagggcatctacacgtagagaacgacgagacgaacgcgacggtacttaccaacacaccgaacgaccaccgacgatagccggcgtcgagaaggcggcggcggcggctcgggttgactggcggcgacgaggctacggcggccggcggcgaaggggaggaggcggccgagcttccccacctcttggcgaaaccagcggcggcgacggcaagcgacggcgacggcggaggcggcgcggcggcgcaaccggagtccggccggcggcgggtggcttgctaggcggcagggcgacggagctacggagcacgggaaaggacgggagttggggcaaacgaaagaggaggactagggggtcctatttatagccttggattgaagagatcggactcctcccgcaagaaatcgactcgggaaaatcaaaaactcggttttggagataaactcgaaaacgagttcgattcgggcaagatactcaaccatttgctccgattcttgaggggaaagatagaggaagatgtggggataaaaacccctcaaaaatccggactaggggtggagagatcggggcggaaacggaggcagaaggcggcggctcggccggctcgggctcggcttgcagccggccggaggtaggagacaccaccgacaggtgggccccacctgtcggcctccacgcgagggaggggcggtggtggcgggttgggccggatgggccggctcggccacgggatgtgggagggatgttgggccaaaatggcccaacggcttcagggaggagttttggaactttttacttaaaaataatttgtgaaatgttgtttcatttattaaaaatacttcccttgctcaaacaattcccagaaaattctagaaaatagaggaacaagcaaagtatttaataaaattttatctagctcaattttatgttgaaaattttcctagataattagggtttagcttgtaggcttttaaaataatttctaaaaatgatttaaacaatgtatttttaatttagttgatttttagggcgtgacaaccaacaaaaccatgcacccacagcccaccatgtgatttattttaattgacccacaccgaagcggtggcattaatccaacattaccattagaacctacagtctatacattaataggattttccccattgtgtgctagttgaactaagcatggctaagcaatccctagtccaatatctagtcatgttatatcccaagctaacaaaggagcatggtaccaaaatagcatggctgtaacagtaggtaaacatctcatagtattactgaaaacaatgcagtatttgatggaaaacattagaacatttgcaatataggatcaacatgttcaagtgacaagcatgacttgccttgctctgctgctggaggaacctcggcgactatctcaaagtacaccggagcgtca

SEQ ID NO: 59548 - DNA, 5054 bp, Oryza sativa
cgctaacgggcggtgtgtgcttgatggagtgggcggacttcaaaatgcgcacccaaaatccctttaaataggcgcacccccgacggtgcgaattccaaggaactgagagaaatccccgccggaaatttctaggtccattacgcgcggcagtttttgacttaagttcaaaattcactcgtgaccgttgggcttcaaacggcatgttcgactacacgtcatctccgtggttctcgtacctggaatgataacgttctcgacacccgaagtcgcgaatggtcgcacgagttcattttgagcagaagtcgggagctactgtcagggttacgggtcaggcataccctctacccttcgatatacgttacgtatcgacatggcatacccacgcgtatgcggatatttcctttatgatctaaggaaacctttcacgaaatcaatagacgggaagagtccttctcggataagaactgggttacctacgtattgagctgggtctgggtctggtgtgttcgagtcctactcggagaccaccagacctgcgatataaaagggaccccccggggagggcatagaggatcgaatctcagagccaacacaacccacacagcctacgaagccggagcctgcgaggggccacgtcgtcaagagctagtcgaatcaactcgactttaatctcgccggattcgacaagttccatctttcctttgtaacctgtgttttccaccatataatcccatatcaaatggattagggctattacctgtcaaggggcctgaaccagtataattcttgtcttttgattacttgatgtcgtactacgtagatccttgtaccagcgtaccccaataccctctatatccagtctacgtacagtggcgcgccaggtaggggcacttggtactcaaggttctactactatgccatcaagcttcgtcgacaacaacgtcaacaccagctccagtcaagcactctcagcttcaataatgctggtatggactcaagtcggcgaaatcgtcttcccggtttacaccacgatgccgatctcaaccggtcctccaatgactggaaacgagaacgcagtggctatgaaccaggacggctccatgtcgaaaaatccacccgttgaaacagagaacggattatcgactacatccaaactcgtgaaggattctgatgcggccaagtcttgtccctccgacataaaccacgggccaacaaagatgacttccgaagttatctggtctttgtgtcctatccacaaaaccaagaaacatacccttcaagattgctaggtattcatcaatgtccgtgctgaaattcgcgcctgcaaagaacgcggaattcagcgtacttctctaactcgggatgtctattgtcctatccacaagacaaagaatcacgacctctcgagctgcaaagttctcctcggcgccgtgaaaactccgtctcctaagtcatacgtccccgttagggataacggcaaggaacaaggagcgactccagcctcagatcgattcgttggggtaatcgatctcgacccccacgaaccatcggtcttacatctcctcgaagactgtgggtcatcgacaacaagtgcgtcgcgggaggtattggctatcgatgacgttggcacgtcagcacaagccaatgcagaggcggcaaatcaatcgactactccagcccagcacatcagggttgttcaagccatacagagggaaactccttacgatcccgttctgaacgacgacctcgagcgttggacggaacgattacgggagtcggtgaccaacctcagcaatgcgttcgaagaagccgctaccgcagcacaccaagatcagccaccgatcggcgacaccaatggtaaagatccggagcggagggaattacctcgacaggctacccctccacctcgtggcattggagatcttcgagatcaaatcaatgatcgccgagaagcacgacgcacatgggacgacgcaaatcgctcccggcgtcatgtctcttcacgacgccatgatcgaggaaatcgcccaaacgaggaccgagactacaacgatcgcgaacggcgggggccagacaatactggtcatggccgtcgccgcaacgacgacgacgaaggcgatcggcgccgagacaacagcgagagacaacgacaggatgcccgggatccaggtcgtcatcctcgtaatcgtacgccagaaccaagcgacccatcgtcatcgtcatcatccgcgtcctcttcatcgttggacagacatccacgaaggtcacgcgaccgccgacaaaccaccgcccccagtgctgggtgtagggctttcggtcgttccctatgtgatgtccgatggcctgagagattccgacccagagccattgaaaattatgatgggagcgccgacccagaagaattccttcaagtctactcgacagtgctttatgctgccgcagcagatgaccacgcgttggtgaagcatttaccatccgcgttaaagggttctgcgcgttcatggctgatgcatcttcctccctactcaatctcctcgtgggcagacctgtggcaacagttcgtcgccaatttccaaggaacatacaagcgccacgcgatctaagacgacttacatgcgttaacacagaactcgggggaatcattgagggaatacgttcggcacttcaacgagtgcagaaacacaattcccgagattaccgacgcttctgtaattctcgccttcaagtctggtgtcagagatcgctacactacccaggagttggcgacaagacgcatcacaactactcgaagattattcgagatcgttgagcggtgagcccatgtggatgacgcgctaagacgcaagaacgacaagccgaagactgggggagagaagaaactatccgcagacgcatctgagtcaagcaagaagaaaaatcgcaaaaacgggaaaaggaaagctcaagcggaagtcctcgcagcagaatacgcgaaccctcccaagcgcccagaccgacagggcagcgatacaaagaaatcatggtgccccatacacaaaacggacagacattctctggaggattgccttgttttcaaaaagtcgctcgagaagcacatggcgtttgaaaaaggcaagcgagtacgcgttgttgagaagaacaaggagacacctcctcacgaatcggattctgcgtacccagactccgacctccacgtctcacacatattcggtggttccacaacgtactcctccaagcgagaatacaagaaagtggaacgtgaagtctgttcgacgtggcagggggctgcaccctgatcaccttcgatgtcgctgaattcgatacagcttataacgccatcatcgggagaactgcacttgtgaagttcatggccacatcccactacgcatatcaagtgctcaagatgctgggaccgaagggaacaatcactatttaggggaacgcaaagctggcggtgcagtgcgacaagcggagcctcgacatggtcgagcaaacgcccaccccacccgccacgtctgagccacctaagaaagtgagcaagccaaataagacgccaaagccagacggcaccatcaagatcgttccgctctctagtgctaaccccgacaagactatcaaaatcgggactacactagatgagaaataggaactcgcgttcatcacattcctccgcgataatgccgacgtgttcgcttggcagccgtgcgacatgccgggggtccccagggaggtgattgagcacaaacttatggtgcgacccgatgccaagctagtaaagcaaagactgcggagatttgcaccagaccgaaaacaagccatacaagaagagctcgacaaacttttgaaagctggcttcattagagaagtacttcacccagagtggctagccaacccagttatggtgcggaaggccaacggaaaatggagaatgtgtgtcgacttcacagacctcaacaaggcatgccccaaggatcactttcctctccctcgaatagatcagttggtggattcaacagccggttgcgagcttctaagcttcctcgacgcttactctggctaccaccaaatcagcatggcaaaagagaacgaagagaagacagtgttcatcacgccgttcggggtattttgctacgttaagatgcctttcggactgataaccaccgggaatactttccagcgtacggtccagggcgcacttagcaaccagcttggcaacaatgtcgaggcttacgtcgacgacatcgttgtcaaaaccaagacaagtgactcattgattgacgacctgcgggaaacgttcgacaacctcggacgatatcgcctcatgctcaatctagagaagtgcacgttcgaagtaccgtcgggcaagctactcggattccttgtttctggcagaggaatataggcgaatcccgagaagatcaaagcaatcgagaacatgaagccgcccacatgactcaaggaggtgcagaagctaaccggatgcatcgcagcattaagcagattcgtcgctaggatgggagaacgaggacagcctttcttcgccttattgaagaaacaagacaaatttgtatggacacaggaagccgaagaggcatttattgcactcaagcgctacctatcaaacccccctgtactcgttgctccccaacctaatgaagaattattcctttatattaccgccacgccatattccgttagcaccgtcattgttgtcgagacagagaaaatacagcgaccagtttattacgtcagcgaagctctccatgacgcaaagacaagatatccacatattcaaaaactgctctacgcagtcatcatgacatcaaggaagctacgccactactttcaagcccacagagtcacagttgtctcctccttcccccttggcgaagttgtgagaaacaaagacgttgtcggccgcatcgcgaaatgggtagtcgagctaagccaatttgatatccactttgtgccgcgaacagccatcaaatctcagatactcgccgacttcgtggccgattggaccatgccagataataagtcagacaaccaaggtg

SEQ ID NO: 59549 - DNA, 3609 bp, Oryza sativa
attcctgcagcccagcactccagacaatccctctgacttggccgttctcgtgctgggggctagacatacttgggccattcccacgaggacagggcggctacagattcctatttgtagcaatcgacaaattcaccaaatggatcgaagcagtacccactggggaaatcaaggccgataacgccatcaagttcatcagaggtatattatgcagatacggactaccgcaccgcatcataactaacaacggccctcaattcatcagcgccgatttccaggattactgcatcggcttgggagtcaaaatatgtttcgcctcggtctctcaccctcaaagcaatggacaagtcgaaagggcaaacggcatagtactacaagggataaaaacccgcgtctacgacagactcatgtcacacgacaaaaaatgggttgaagaactcccatcagtactatgggccatgcacaccacactgacaacatccaataaggaaacacccttcttcctcgtgtacggctctgaagccatgttccccggcgagttacgacatcaaagtacacgagtacagaagcattccgacgagaaccaggagaaacagcgagacatcgatgtaaaccttctcgaggagcatcgtgagcgagttgccgttcgagcagctagctatcaacaagccctccgccgttatcacgagaagcgcatccgagcatgcatactttcgatcggcgactatgtcctcagacgagttcaaacccaagcagggcaaaacaaactctcaccaaaatgggaaggaccctacacgatcacacaagtcttgcggccaggcgcattcaaaatcgcagacggcgacgatcgcgaactagcaaattcgtggaacattgaccaactacgtaaattctatgtatgagtcaataccactgtacctgtaagcacccttacagtatcaataaagcctatttctaagtcacatgtcacgaccaaagtgttttcacccaatgatcccttactctgacgacacctagcgttgaaacctgtccttatgtccctttacgccgtcttgacaaggcctccgaggaacctaagggatcttcgactggggacgcctagagccgataaggccttgtcagatcctttagagacgaaagaccatgtaagatctggtcgtgtaagagttctcgccgtgcgtattaaccaagtcgtgtaatcggaaaccgagctttccaacttcacggctgggtgctaggatcagagcttattcaaccaagacaggtcaagggtccaagagccttgtcctccgagaaaattcctccgacgacaaagctgggggctagggagagtgtacgactcaaacggctaactaaagtcattaactgagaacacactcatacacacgacatccagagtaagaaacatttgttaaagatagatttctttattcacaaaatatttcttacagtttgtacataaatatttcgctgcattacatcttcccctaagatatctggtcgcagggtacaaatactaccaagaaagccaatgccagtccattgactggaaaatcttctcggccaacggcgacatcgacctcgcaaggtggtctatctccgccggattcctccgagaacaagaaaaaccttcacggaggaattcgagatccaggcgtgggcggtgatctcgcaggcaagctaacacatgtcctccgaaatatcggctcgcaagatgacactcttgcttcaaggcttcgtcgattcgcttgccgatgccatcgagttgggcacaggccccgttgagccacgagatgtacccggccgccgattcttcatgatcggcgcggactactcgaagctgcctgcataccctagccatcgaggtgcaacaattcttcaagtatgacccaaaccacacctcgcggcctcagagcgtctccacggcttgctctttcttcacggatagcatgattctctcgagttccaccacttcaaatttcgtcttccagtattggatacgacgatcttgggtcgcaagggcatccttgagatctgctaaacataacgaccactaagacaagctggaaatccccaaaacaacacaaaggtagaactcgaaggtagaatggctactcacttgaggcagttgtagtcacttcgacctccgcatcaagagtttggtcctcgacgtcatgtgggacgtgtggttcaaactcgaataccggaattatcgccagtgactcgggctgcccgcgctgctggacatcctcgtcatcagcatctctacagtcgacaagaaaaaacttccgagatcaacggtgaacaaggatgataatcacacgcacgaaggcaaccagagttcaagatttacaagtcacaaaaaatacaagaagtcctactcttcaaaaagggggaggacagactcccccaggtcatcgacttcttccatcaccttcttacgcgtgtcgcttgccgccccctgatccaagatctcgcgcatatcgagttcaggacgcgacaacctcacacacgcgaggacatgacacgccccggtatagatgccgttggacgtctcctccgcgatcctggccgtatgcttggaggggatttccccatcgccgtcgccagctccgcaagagaagaggtcaacgagaactcgtcggggttcgccgggatcgtggacttgatgccgcactcctcggcaagctggtggagaccggtgtaggtgacccgcagcgaaccacggatctcggagaggttatccccgagttccgacatgcggtcctcgagccccttgcgctggcgctcgttgccggccaccagctccctcatcttcgtgaggtcctcgcgggcctcagcagttcccgcaccaagcgctcggcacgcgcgttggccgccgccgtctccgccctcgcctctgagatctcgcggccgatgccgcgagcaccggcttcgagaaggcgccccatttcgacttggagctcctcccaggtgaggacggcctctggcagaccacgacccccagcgggatcgctgacggggccgcttggcgtcgcctcccgactcccgaccacgggcacgacatctgttgacgccgtgacaggggacgcgctagacgttcccccggacttggcccgagcaacgttcgcccgcgcctccctataaaccgccatgaatcaaaattccactcaaacagaagacacgagaatctaaaagtttctttacttacttctcgccgatcgtcacaatgcgcttacgtcgcgcaggcggaggagacacgtcggaagcctacaaaacaaccaacatagagtgagaacaaaccttccttgctacataacctgacgacaaggtgaaaattactgagggagtcgccgccttgcggcggtgtccgagcacagacgagaatttcctcgccttagtcggagctttgccaccactagtggtggcagcgtcagacgccaccttgacgaccttctctttcagagatgccgccacctgatgatccgcgagcggaccgacgacatcagtcaaaggaagggcctacactaaatcatgtcataagctgattttgagcaaagaaggcggacgcttatcgaatgaactcacattgattgcttcgtcgtgctccgt

SEQ ID NO: 59550 - DNA, 1390 bp, Oryza sativa
aaccagtataattcttgtcttttgattactcgatgtcgtactacgtagatccttgtaccagcgtaccccaataccctctatatccggtctacgggtatcacccgtcgacaatcgtaatcaaaaaggtgcatcgaaacgttatcggaagggaaaaaaagatacatttttgaactaaacaaactatcagaccagcaaataaatgatccacccacacagtacatttagattaattaggtgcatgcatgtttaggaacagcccatgcaatacaccacagaccacacttttttgctaatattaaagcacaaactaacaaagtcagcagtactactccatccgtcccaaaaaaagacaaaccctaattttcgtgcccaatatttgacgtccgtcttatttaaaaaaattatgaaaaaaattaaaaagacaagtcacgcacaaagtgttaatcatgttttatcatctaacaacaataaaaatacgaattataaaaaaatttcatataagacggacagtcaaagttggacacgcaaacccagggtttgtctttttttttttttgaaggagggagtacttgtcaaacttggcccatctgggggtaagagccgcgcctatttagcatgccacagttccgatcgtgcggtaggaactagtagccctcgtccccacagtatcgtcgacatgagttcttgaggatataggtcccatatgttagtgggcccatgtttcttttgtgtgaatgactaatgggtcccatgcatattttttaattctaccgccacgtaggtgctacgtcaacgctacgtggaccgaaaactcggtcaatattgccacgtaggcaccgcacggcgccacatcagcaaaaccgcctcccaaaacggtccagggagtcaaatgcaccggttttaggagtttgggggtcgagatatccgattttgtaatttaaggtcgtggacatttgagggtcataaagtgaacttattcccgctgcaaaccccaacacactgatgggcccaaggcccatgagtctccccgctcgggctgaaaccctagcccctctcactatataaacccccggcgccgcacgcggccaacccttgcacccccctcaccacacactccacacaggtaagaagccggcggcggcggcggcgatggtttccctcaagctgcagaagcggctcgcctccagcgtgctcaaatgcggcaagggcaaggttggctcgaccccaatgaggtcaacgagatctccatggccaactcccgtgagaactcccctcctcgtccctcccccccataaccctccccactgcccgaccgtatgatgttctgtgcctgctacttgtgtggtgttgatgcgtgatttgcttagatctgaagccgggctgcaggaat

SEQ ID NO: 59551 - DNA, 1280 bp, Oryza sativa
ctggtactgcctcaatgcatataattggatcgatatttaccaaacggctaaatctggatcttagctgccgtatggttcataactagcgatcattcaaccaaggttgcatacacacattcaacttggggtacgcgtgaaatagctgtacctttttactaccctgtcttgctctagacaattgcaatttgtcaccatagatggacactggacgaattgcagtcctgcagacgcaaaacatgatgcatgaatagtgatagtgacaatcaattagttgcaaaaatatgaaattattaataaaaaatatgcaattgtcgctaacaagaaaacttgtttatccgagaaatgcaactgaaccaaagggaaatttgaggcagcactggaaatccgtgatggtagccaagtttgtcataaaattagaaagctcaaaccacatgttttttaaatacttctcttacggttcatgtttcctacttctatgagtttttttttcatttgttatcaagattgggagctcagaaatattttgtaagacacttatatacagtttttcctacattaaaaccatagctatccagctaatggaatgtatgtcacatatttttttcgacctgaaattggtatattttgcactgtagtatttttataaaaaataggaagtagcacatcaaattggattaatcaagttgaagttggagaacgacatgcaaacaaaatcatttgcacgtgatgttcaaaaatattgctctcatacttcaaacagcatcgttacttccatcatcgtcattaattgctgtcccgcttgactgcccaacttctagcatttcatcatagaaatcgtatcttcatcttcattgaaaacttcaacatcatcctcactattgtcgctcagtgcaccaagagcctcttgatcataacttgcattatcaaattctggttgctgctgaggataaaatacatcaatttcagtgaagaaaacaaaaaacaaaaggcacaaagaaagcacagataaaaaaaaaaagctcttaccttatcttccttgtctattagagactgttgccactcaatccattcctgtaattgaggacagttcgtgataatacattactgaagctgctgttgaagtggttgtaaagggcactgcaggtttgggcaatcttttatttttagaagcttgagggattcaaggctgaacaatcctaccacagaaaatagcccccggcatccacttatagctagtgcctccaggattggtaggttcttattgtcaagttcaaggcaca

SEQ ID NO: 59552 - DNA, 1136 bp, Oryza sativa
caatccatgcacaaattttattatccgagcattgcatttcaagtttgaaaataagttggaaatatgtttaaattcattatttttacaaaaagatttactgctgttacatcattgcttgttgaagcagttggtggtttgtccctgccgctctcgtcttctcacatgatcttctcttctgtctagttgaagcagttcgggggatccagaggccgaagggcttgttcgccaacctagctcacttagctgccaagctcggctctattggtaaggtggctgcttaattgccctcatgaatcacctactgcttatatttttgattccattcaccaacctctctgtgagtgttatgggtgagttaaggatataattattggggatcgctagaatgaaatgcctaggccataacgcataattctttgtcttatatcacagatacaccttacctttcaaaggtccaattgagttagtaaagtcagaaaaaaatattaaagaacttgaatcttttaaaagaaatttcatgttacatagctatattttactcacttaccttcaaaagaggaagcaggtttgaatgaggccatgttctgtttggaatttttataagtgcataaatagaattttctctattatgtttgctgctaaacatccaaatgaaaactgattgtctttgttttcataaaaaaaaattgtagataatgttgttttcataaaaatggaagctcaaaaaaacgtttctgtgtgttcttgattaattcatttactgaaaagagttcataattttacaaacatatagagaaaagtccaaacaggacatggcctcaatcaattgctactgccatgccctgttttcagtaaatgaattaatcattatgagctaataaaaaaattctggagaaaataagaaattctgtagactgcctaaaaagattctgaaaattctgaataccacatagaaagttctaaaatttgcttgatttttgtaagctatttcatttttgagagctatgcattttactcacctcacattcaaaagaggaaacagacttgagtgaggactgacatgccctgttcggaatttatactagggcataaatcaattgctctctatatgttagcgtagaaaggtgcggtctaca

SEQ ID NO: 59553 - DNA, 757 bp, Oryza sativa
tataaaaggaggagctcattcactctctcaacacactcaagcaagctcaaatatctcttctacactttagtttagtattctagtgctaagtggagtagaatagaatagcatctcggagttctcggagtcttcggaggaatttcggtaaggttgtaatagcattcttcctttcttttgtaagacttttggaattaatgaaatattcttcttcatatgctctcgatactttagtttatctaagtattgtctttactttatgtctgtatcggtacagtcgtatagttagcctaccagagaggtgcagttgtgtgggtttaatgtctgattattcagttgctctatgtcatcttgagggatatagtgtagtatttataatgtacacatggtgtctagattattaggtatcattatctgtgtttatatgctacgagtcagtcgaggtgggccgctgatggtgacagctcagtacgatcctaaaaaactttcctggggagggtattcctccgtatttagcccccggatggacggccatgacaggttgtcgtaagaaactcggcaatccggggtggtctctagaagcaccaggagtgcactattaggggtattggctatatggttgtatactaacagatgtagactaaaattgagtgtatattataattataggaaatgacggtttttctatttcttcttatgcttagtctagaaatgattaaatgagatatatgagtgctttgcttcgtgtcactctacccaa

SEQ ID NO: 59554 - DNA, 865 bp, Oryza sativa
ttttgtccttgcaagacagtgacagcatacagtgactgcctttgatcttgttccatgattacttttccttatcttaccaagtagtactttaatgcctttatttccctttcgactttttttttctctctttctcactctgcatctgccgctttcctatactactacctaatctaatctgcagccaattcatgcttcctttttgttcttccatgattgccttgctcatcacctccaataacagtacgtcacattggtgtcatatgattcataggttaattgattatcataatcaagcaaatataaataggatcatatctaggataagagtactttttgggagattatctataggcacctatccaactagtgctgagcagaatcgatcaaaaattaattctgcgtaagttaatgaatcaactagttgagttggtaccaagaatcgaaatcgtgcaaaacaaaaaaactttcttgaaataatttcagttccttcatgagcaaatttttgacaaattgatgcccatcaagtctgaagatttttgcatcgtggggttgcattctgtactaatttcacttcaatttccaggtgacggcaaaccggaggtagagctcaaggacgacatcgagacactcttcgaccttatcataccggcgacgttcccggcggcggcgccggagcccgccgccgccgcgacggccgcctccgccgcgcccaaccactccagctccgtctcgcagcacagcagcgacgaccaggaccactccaacggcgccgacgtcctcgacctgcccatcctcaccggcggcggaggcggctcgtcggagcaggacgactggagcctcgacggcgccgcctgccagtgggaca

SEQ ID NO: 59555 - DNA, 1415 bp, Oryza sativa
ttgtgcggttgataagtgggtcccacgtcgatttttacacggtgttggcattagggatgaaaacggtcggaaacggtcggaaaaaccctctaccatttccattttcattttttttctcgaaaatggaatcggatcggtatactcggaaacggtaacgatatcggttatatcggtatctcggaaacggaaccgtcggaacgggaatataccgatatcggacggaagtcgaaaattcatgtcggaaacagcgagcttgtggtatcatcccgcatttaactatgtatgaagataaccttataatttcacccttgcatcatgcagctcctaccatacgctgttatatgatgattaataagtggacaattagattgatggataatataaataaagttcaatgatacttcaacatcaatgtggctaaagcatacaatgtggcttacatgataggattacagcataactaatattgtccgactttttttaggatatagatttgaagtcttcgagaacaccaagctcacaagctggcatggcttcagctgatcagctccttgtcaaacatcattcattatttcatcatcaattgacatagctatatcgtcgtcctacagtggcacattgcataagaacttttatgttgacactgtataactactgttgtaattaagtttcatgctaaactagactttttggtatttccaggtcgatcacagagaggagtcaagatggtggggcccgccagtggatcccacagtctttcttttcctctctttcttttattttttctctctctctcttatccttcccttctctcggttccttttcctgctctctcgatttcttctctgttttctctctcgttctcttctctgcctttggctccttcacgcgcgcccgagaggagagaggcgccggagatggcggcctggcgcagggcggcggtgggggaaggagagaggagaaaggggcggcatcggtggggaggaggaggctggggcggtgcggcggcgctcggtgcttggctcggtggcacggaagccggcgatggagcatgggggagggaaggtggccggctgcgacgaaggccgtcggggcgaaggaggttgcggccggcgtcggcgacctggtggcggcgcccaacatggcgcggcggtgccctagcgccgatgaagacgacgatgcggtcaggcctagttggcttctttattcggaatgggctgctccttaatgcctaatgggctcctcctcctgctagccaggcccagccgacttccttcttcggaattttgtcggaaatttgacggaaattaccgataaaaaacggttaccgacaaaacggtcggaaaaaaccccatatcatttccgctaccatttccgaaaaagattaccgtttccatttccgataccgacaatta

SEQ ID NO: 59556 - DNA, 1888 bp, Oryza sativa
aatgagtagatttatttctcttgccccatgtatcctcctcccaaaaattctcctgcagtctgatgatccctctacggctctaccccatcaatttgtattgatgtacatgaatcagtcatttcctccaatttccttcccaccaaactgcagcattttggtccaacaaaatgcattctaacaacatttatattcagtttgtttatactatcatctacttatatgcttcagtttccaaggtttcaataccacatactatgtggaacaataactcttctcaactacgttgcttggtcctacagttggtatcaacactcatcaatctgaaacccgccgtcgtatcgacagcctcatcttttcgcttatgcttatcagccaaaatttaaattttcaaccataaatttgaaattgattttaacgttttttcatcgaagtttatttttcagattttgcttttagatcgcttagaacacctatataaaagttttattcacaaattatttttttttataaatatgccatttggcttgttccatctaaaagacaaatgatgggggccggaatatagtacgccgcttcgccggaaatcaccggatgtcaagatcaccttggtgtttacttttattgggatgcatgctactttgcttggtcttgcgaggccttaatcgccaagatgaatgcaggccggatctgatcgcaccatatggtcacaactaggagtgaaaactgtacgaaaactttctagattccgaacctatttttgaaaacggaatctatcagtcagaatttttcggaaacggaaatgaattcagcaatattttctcggtaacggactaaaaaatgagatgggcagtttccatcggaactccagaattggtcagaaacttttcggaaattttctcggaattactgaatttttgtaactgaaataccctggattcttttttcttaagcattgaatattgaataccatggtgtttggctgttatttttttaaaaaatatttgttatgcaaatctaaaattacataagaatatttttttcctgcatttaggatttatcaacagcattactcttttaaagatagataatttattccatagattgtgttttgtgatgtaccgttgatacttaacaattggacttatatgattgtgttttatgatgaattgttgaccgttgagacttgacaattggatttatcagtttgaggggttttttccgataaattttcgttaccgtattcgcgccggttcgttttcggtttcgataatattcaattccgttttcgtatccggggtttctgattccgattccgaaaaaaaatatgaaaacgaaaccgataaaagatggtttccgtccatttccgtaccattttcacccctagtcacaactactgtagaagcatggttgctctttattttttcatcaaaaaggaattcaattcaataagatatatgtaaaaatgcgtaaatcagatgtatccaattcaactattatagaccccttccaacccaacccctcctccttgcagcccaacccaattgacccacaccacccatacagctgcttcttgctagaacttttttatatttatatttatttttaaaagatttacaaaaataaattaccgtttcaaatatttgcaaaaatatcctcctcccgccctctaatagagagcgatttatgtgatgtagcagcacggggttcaaaaatatttgcatttaaatccttctcaccctctaaatgtaaaattttctgcaacacatagcatgaagtatttgtatgattgtaaaattctcgtatgatgtcggatgaagttaaagttacatgaaaattatatagctcgacaagatctacaactttgtagttgattaatttttcattaaaa

SEQ ID NO: 59557 - DNA, 3469 bp, Oryza sativa
tttaggcccttctctccctctattagggtgggcgggaggagtatatttttgccaaactttaaaatggtaatttattttttaaatatttttaaaaataaatataaatataaaaaaaaattccttcttgctacaccaagagataactcgtaccactaccaagccaaattgtatatactaatgtccattcgtgtcgattttggtctttctgctagttctagaaaaacacatagcaatcctccgtcaacctaaaagaatggaaaactcactctctctatctatatatatctttattcaagtatcgatcttattttcccataattaaagagttctccatagagcatattaaatatatagaaaagagagaaaccacaaataaaacatgaattatcaacgacgacagctagtgacactactatacaaatgatttttgtgaatgagacccctttaaattgcaagtggaccataattaaccgtgtcatgtacggctccttaaaatgcatgtatgcaaaaatcaattttcgcaagcggacctcttaacttactcacataaaaaaatgagcatattttcacatgtggatcttttaaaggaccgcatgagaaaatatattttggtgggcaggcctcttaaggggatccgctagaattctaacttgccttcttttccctctcaacactacaattttttccaagtcccttattatctcccctcctctccaacctcctctccctcattcacacctcctctctctatctctctcatttctcattcctcccctctctcattccaaagcggcggcgacgactcggtagtgggtagcggctggtggctcggtagcgggcgacgcccgggctcggtggtgtcatcgcccactcggatttggcgacggtggctgtcccccacctagcctcgcacggatccagcggcggtggaaggagcggggccccacgcgaactcggtgatggcgatagcttgcggcagtggacgacgatcggctcgacagcaggcgacgggctcggcgggggctgtccctcacctggctccgcacggatctggcagtgacgacgagaggagcctaaccccacacatactcggcgacagtgacggcgggcggcagcaccgacgacaacgagcgtcgacggcaagatgttttgatttttgagatttttgtttttttttggttttttgtttttgcgtgaggacgacataagcacccacacgcgaaaatcaaattaccgcatgcggttgcgccacctgcatgaaaaaatagcgatttttgcagacattttagggcagatgagcggctcaaccacacgcaaaaataggaaccgaccgtttggaaaaatggttttttaagtagtgtgaggagttaacgtgcagctcttttgctctacaagggcttcgaggagtctaaaatttgaaattaataaaaattgaattgtttcgtgtttggagactcaattatagagttggcattatttaataaaaaaattgttaataatacgtagttgtacgcggttttggggtcccaattacatcatttttcttgttttaataattttataaaattgaaaattgtaattattttgttctacttcagtatagactatcagttacagatttttttttatgttttatagttcatagttaatatatgccaacttgtcataattaagcccatagcttataatagatgagctctaaattacccaacattcagaacagttgggtttttaatatgcagaacgatgttaaatgcaaatctacagccataacaatacaattcatccaaggtcttccggtcttattatgtgtgagataataccaagtgcataattagaatagttatttacttgtgcgaagtcaatagcaaggccgtatatatgatacgtggaatttcagtaacatggcatacgttagtttaattttgaaataatggagtattacttatcataagagggaccaatctttttaggagcacacacaggttggggggggggagggggggattagaatgaaaagagctcaaaaaatattttattatgcagaaaaatataataaaagcatcccaaaacacataattaagatagatacatgctcccaccggtcacaaatattaatttaacatttgtaataagatttttttcaaattttgaccgtcaccaataagtactgttgtaatctcataaacttattagatcttataatatttatctaatataaaattatgatttaagccatgcattggaccttgaaaaaaaaaatctaacttcatatattatctgctagaggaagtacttggttcagagagatcagtgtaacttattgttgaggatgcaaccagcacaaatttatagatttaaacaaatcctccttccagtaggtaaagtatagtagttcctaattaatgaatacctgaagagatgttattagtaagcaaaccagaaactacatcttgaaataagccatgcatcagacctacaacttggatggaaaatgtcagaagactcaggatcgcaagataaatatatatataattatatagctatatatattcaacttaattccttccgcaaacctataaaaacactccagcatggaaaaaattgcagatttaactgtgaacatcatgcacaatacatagtactacttctaaagcagctagtctgtgtgactcgtgaaccccagaaaagatgaagcatatatatatatatatatatatatatatatatatatatatatatatatataggacactcatatggggcaccatggtgccgggcaccatggtatttaatgcacaaaatcactcaaattttttaaaattttcaaattgtgagtatatacctagttataataatttgattcatacctatacttatcaacaaaacaactcaaatttaactttatttcacaatacatgattacatacctaactaattatatgtatggatgctatatacctagaatcaaaatctaacaaaaacaagttcaaattcagttcaaacttgctttaaactagttagtaaagtagttaatgttaatacctaggtaattgaaaaagtttcatactcatttaattgggtatatactcaatttcaacaatggtgcccgggcaccatggagcaccaaacaaatttactatatatatatatatatatatatatatatatataacacctttaatttgggaactgatccgacgaactccacgaggtaggaagatcggagaggggacatatgcttgagcatgacacactacatgaagtaaggaagcaaggagagatattgacgcggctcaatccaagaaacatggctgcatgcgctagatcggtcgaggtgcctgtaatcagccatgccttcggattgaggcacgccaatacctctttttacccaagcaaaaagaccgcaacaagcctagcagctctctttcttcctcttacaagcttactggtcatcgccctctcgata

SEQ ID NO: 59558 - DNA, 792 bp, Oryza sativa
ctagatgtttaatatggcccgaggagtttgataagatgtgtgacagaattcaaaaatatatttcaatagaatttttgttgtcacctctaaataaaagaataatgttctaaatgataactatattatgttgaatcatctctaaagagttccttctgtttttgttcccactggttccatttacatggtcatgaagcagtttgcttgctggaccttttgcgtcgcttacatggctcctcccattatatctggcttttaggtaaagactattcatttctttgattgttggataactaagccagggtgatgtgaattgctgattgctgattctactgtatttaatacaaatttttcctatctttttaacagtgcttcagagggcaatgaattcttctgaagttttccattgttacctgttttcagtttcagtaaaaaactaagctcttcaatgtaaatgggacaacaatttgaatagttactataagatcttttgggatcaaaagatttacttgttgcaggcttaactttcatttacattgcagaaacttatcattggtagataaggatgtgttaaaaggggcttgcttagtacaactcaaggcgaggctaatactatggtgggtatgaatttaaaattacaatatctgagttcaaattatttggtataagattgtagtttaagatgttgactgctaataattttaaagttgtaattgcatagctcactggccaaccacgtgctataatgaaatatttttttaaaaaaaaattgtaagcaagtactattaaattgaa

SEQ ID NO: 59559 - DNA, 706 bp, Oryza sativa
ctggttgtgagttcttcagaccatgcgaatttggatttgagtacattaccagtgtcaggaggtatcaggatatttcaagttgtaaattctatggatgacaatagaagatatttttcatccttcttcaaaaataacagaagatgcttctccaagttgttctcacatcacattaaccttacaattgataatgagctatggagcagttttcggcatttgagaactttagacttaagccgcagctcaatgacagcattgcctgattcaattagaggactgaagttgctcaggtatctaagtattttccaaacaagaatctccaagctcccagaatcaatttgtgacctccttaatttgaagatcttagatgcaagaacaaactttcttgaagagctaccacaaggcattcagaagctggtcaagctccagcatctcaatttagtcctttggtctcccctgtgcatgccaaaaggaattggaaatctgaccaaactacaaaccttgacaaggtatagtgttggaagtggcaattggcactgcaatattgctgaactacattacttagtgaatatccatggtgaattgaccattacaggattaggtagagtgaccaaagttgatgatgctcaaacagccaacctgattaataaagagcatgtgcaaactctaagattagattggtctgatggattctactctagtgaatgtg

SEQ ID NO: 59560 - DNA, 1910 bp, Oryza sativa
tcttgacgagtttcaataaatcgccaaatgccttgcactaaccccattttttgccttccattgcaagaactccagagtggtatccaactttttgtgcccctgctcgcaacctgggtacaacgaagttctgtggtcctccaacatcttgtccaatttatgggcctccttttcactttcgcagtcctccctggcgtcctgcaacatctgaccaagatcatccgcaatgtcgttaccatcagcagctatttcctcctcgcccgtttgattttcttcaaatccatcatactgagcaaagtccggaatattgtcgtcttccacttcatcttcttccatttcaacaccttgctctccgtgggatgtccaacaattatagcttggcatgaaccccgactcaaacaagtggaaataaatagtcctggatgcagaatactccttctgattcttacacttattgcatggacaacaaataaaacccctttgcctgttagcttcggccactctcaaaaaatagtgcacgccgtcaataaactctttggaccgccggtcagcgtacatccattgccgatccatctacatgagtcaaaaaaaaccgtacacaaataattattcttacaataatgacagtcatacaataattataagatatctttattcatacaaaaatcataaaatattacactaaataattcttaaatactatttgtaaagttttaaacaattttaatgtgttttacttcttttaattttcattttagtttgttttctattatttaagattaactttcactagagttttccttctcaactattttataaaaccttgtttagcaaatgaactaaatttctatatattctttcttccccacacacattttctctctcatcaacttacaactaaattttggagaaaaaaaagtgtgcaaaacataggtgcaaatgtagtatgacaaaaaaaacattggacgatgaagttgcaaaccttttaggcacctccgatttgtatgtaatcaccaaaataaattcaataaaaattttggcatgacctcccctcttttttgaagaaattttgaagcttgctcaggcagctggagaaggaagaagacatatctataggggtgggactttagtcccggttggtagcaccaaccggggctaaagatcaccaggatcggatctttagccccggttggtaataccaaccgggactaaagttacgatctttagtcccggttggtaatagatcccgggggggcctgacatgccctgacagcattcgaaccgggactaaagataatctttagccccggtttttattgcatccgggactattgtggaaatcgtccgaccgacgaaagatggtttctccaccagtgagatgtatactagcattaatgcatcattagatctaaacatgtaaactaagcagtaaaacatgaacagatcaaatatgcgcaacatgtcgaacacgtaccgaggtaacggaaagaccggttgctcggcaggaactactcgcggttgcgagcgtcgacgaaggcgcgcagcatgcgagcggagaggaaggcgagccgtcgcggacgaacagggagcagtcgcacgaagcgcttcccaaaaaccttattgccgccttctcccggtgcaggtcgtcgaaggcagaagttccggagacctgctctcccgatcgcaggtgcacgccgacgagcgggatggagtagtctacgagcgacggtgcagcacagaggaggaggcaaaccctagattgatttcgtgtgttttgcgtgaaggcggcggctcggtttatatagagataggtcgcttgatcagggcgctcgcacgatctccactccgcataaccgaaccggataagtcgcgcgtaacttatccggactccacgccgttttcacgcaccggat

SEQ ID NO: 59561 - DNA, 30603 bp, Oryza sativa
ccaattttgcggaccattcgacgcgtacgtcgtgcacgtgcgccgcctgccctgccctgccaggccaggccaggccaggcgagcgagtgtgttccccctcttctctccaccacacatgcttcaagtggctaggagggcatcctcccttttaaggagatccccctcttctagaataagcaaggtggtactaaactccacatgcatgccatcccatgaggtgcgcttttgtgattttccaaagaattaatcttcgaatgggccttagcccatctatcaattccaacaatcccccaccaaatctcaaaatcccactgagatttgccttttccaatgtacttttatataccaacggttcgatggagactgatcaaggttgaacatccacctagaactccaagctacacttactcacaacttgaacaatggactacgccttgaattgcatgtcttgtgcaagcaagtttcactcaaagtcttatctggtactagaccgtctgtagactacccctcgggtggagcatataagtcatactcctaggtctttagtaagcttcctagaagattcacccaaaatcttcatagactgcgaccaacagtcaagcttacaaaggtgagttctttcatgaatgctttgcaggacagcatcttcgctaattaaagccaacagaactcattaaggcatagccaacctgccttgcagctcacgagagtacatgcatcttcacttagagagggtatagattggtactctcctctagtttactaatggtttgttcttcccaggttctaattcacggaatctccgatcacatagactgggttaccaccatagtataactcacatgggtctcaaacacatctccttcgatgcattatctatcacatttcgtgatagtcccttcgtgaaaggatctgccaggtttctaactgtttggatttaatccaacgttataactccagagtttctcagtttcctgacagacttcaatcgtcttttcacatgtctagacgatttcatattattcttagaactattcactttgacaattaccgtttgattgtcacagttcataaggatagccggcaccggtttttcaacaataggcagatccattaatagatcacgcagccattctgcctcaacagtagcagtatccagtgccgtcagttctgcttccatggttgacctcgtcaaaatagtctgtttgcaagacctccacgaaacagcaccaccacccagtgtaaagacatatccactagtggctttgatctcatccacatcagagatccagttagaatcactatatccctccaataccgcaggatacccagaatagtgaagccccaattccatagtacctttcagatagcgcattactcgctcaagcgcacgcagtgatcatctcccggattagaggtaaaccggctcaacttgctcacagcaaaggagatatcaggcctagttgcactagccagatatatcagcgagccaatgatttgggagtattctagttgattcctagtaattctcttattcttgcgaagcaacaagttaggatcataaggtgttggagaaggcttactatcaatgtagccaaagcgattcaagatcttctccacataatgggactgcaagagtgtaatcccattctcacctctaattagcttaatgtttaagataacattagctactcccaaatccttcatatcaaaattttgagacaataatgatttaacctcatttatcacctcaaggtttgtcccaaatatcagtatgtcatcaacatataagcacagaataactccctcacccccaccatggcgatagtatacacatttatttgtctcattgactgcaaagcctgcaaatgtcaatgttttgtcaaatttctcatgccattgcttaggagcttgtttcagaccatacaaagacttcaacaatttgcacactttgccttcttgaccttcaactacaaaccaatcaggttgatccatatagatctcctcatccagctctccattaagaaaagctatcttaacgtccatttgataaacgagaagaccatgtgaggctgctagggaaagtagcacatgaattgtggtcaatctagcaacaggtgagtaagtgtcaaataaatcttcgccttctttctgagtatagcccttagcaacaagccgagccttgtacttttcaatagtaccgtcaggccagagcttcttcttgaacacccacttgcaccccacaggttttcacctcccaagtcccgttagcgataatggaatccatttcactacggacagcctccttccagtagtctgcatcaggagatgcgtatgcttctgaaattgacttaggagtgtcatccacaaggtacacagtgaaatcatcaccaaaagacttagccgtcctttgtcttttgctccttcgaggagcttcactgtcatcctcctctgtaacatgttcatgtgtatgttcagtttgttctggtggtgtgattgaactgggtattatttcagagggtcgactagaactactatgtgtatccttcattgggaaaaagctctcaaagaaggtagcatcacgagactccataattgtaccaacatgcatgtcaggtacctcagattaactattaaaaatctataggcaatgctgtggtgagcatatcccagaaagacacagtccacagtcttaggtccaagtttgcacttcttcgttattggtacattgactttcgccaagcacccccatgtgcgcaagtaagaaagtgatggttttctcccaatccatatctcatatggtgttttgtccttatttctgttaggaactctgtttaacacatgattcgaggtcaacaatgcctccccccaccatgccttaggtaatcccgcggtgtccaacatggcattcaccaagtcgatcagtgtacggttcttcctttcagcaatcccattagactcgggagaatagggaggcgtcctctcatgtataatgccatgttcctcacagaataagtcaaactcgtttgagaaaaactctccaccacgattagacctaagtctttttatctttctgtgaagttgattttcaacttctgccttataaattttaaaatagtctagagcctcgtctttcgttttcaacaagtacacatagcaaaatctagtagcatcgtcaatcaacgtcatgaaatatcattttccacccttcgtcaacaccccattcatttcacagagatctgagtgtaggagttctagaggtgccaagttattgtcctcagcagccttgtgaggcttgcgaggttgctttgattgcacacaactatggcacttagaacctttgacaatggaaaacttaggaattaaacacatgctggaaagccgagacatcaagccaaaattaatatgacataaacgtgagtgtcatacattagcctcatcatccacactgccaaaaatatggttcacagacttattgcagaaatcagaaagggaaaagcggaacaggcctctgtactcatgaccttgacaaataaaatatccatgtttagacacgactactttattagactcaaaaaccaacttaaatccgtctctagtcagacgggagccactaacaagattcctgtcgatagaagggacatgttgcacgttcttcagctgcacgatctttcccgaagtaaacttcagatctaccgtgccaacaccatgaacagaagcatgtgacccattccccattagtacggtggaaccccgtgcgacctgataagaagaaaacaatgagatgtcagcacaaacatgtacattggcccctgtattaacccaccaattagtagactgattaactgaaaaaacagtaggtaaattaccatacccgcttccatctccagtgttgccaatggtcacattagcagacttagaggtctgccctgcaggtgccttcatccccttgcgttgtggacacttcctggccagatggccaggttgaccacacacaaaacaagtcctctcatcctgattagaattgttgttgttgtttttcttcttgaagttggtggtctgctgagctttgtatttccccttgctcttgttctgggccttgtgcacaacattggcagtggactgcccaccatcgcccttagacgcgacatctttttcccgagctttctcctcaacatcaagagacgctatcaacccctcaacggatcgtattcctgtctcttgtgtttgagtgcagtaccgaaacctctccaagatagaggtagtttcgcaataatgcacccggccacaaatttatcgggtaagacacacttaaggagttcgagttccttagccatggtttgtatctcatgagcatgttcgactacagaacggttgtcagccatcttgtagtcatgaaactgctccatgatatacagatcattgctagcatcagtagcaccgaatttagtattcagtgcatcccacaactccttagcatcggtgatatgcatatacacctcgaccagacgatcgccaagcacgctaagaatgcatcccacaaagagagtagtggcctcatcgaattctttctgctgatcagcattaagaacgcccataggcttgccagtactcacccagaagcatttcatagctatcagccacagagtgatcttgatctgccatctcttaaagtgcacaccggtaaatttatccggcctcagtgcatcggcaaaaccagccatagtaaaatcacagcgcctataataaggtttttggattgttgagaatataggcatataatgatttaatatattccataaataaatcatgacattacagatgtataatagcattaacgcatcattagatctacacatgtaaactaagcagtaaaacatgaacagatcaaatatgcgcaacatgtcgaacacgtaccgaggtgacggaaagaccggttgctcggcaggaactactcgcggttgcgagcagcgacaaaggcgcgcagcacgtgagcggagaggaaggcgagccgtcgcggatgaacagggagcagtcgcgcgaagcgcttcccaaaaaccttattgccgccttctcccagtgtaggacgtcgaaggcagaggttccggagacctgctctcccgatcgcaggtgcacgccgacgagcgggatggagtagtctacgagcgacggcgcagcacagaggaggaggcaaaccctagattgattttgtgtgttttgcgtgaaggcggcggctcggtttatatagagataggtcgcttaatcagggcgcccgcacgatctccactccgtgtaaccgaaccggataagtcgcgcgtaacttatccggactccatgtcgttttcacgcaccgaatttttcggaatgtttccaaaacaaaacaaatccgaattttcctgcagcaaaacaaaactgcaaaaggaggctgcatctgcagcaagggtgaggagccaattttgcggaccattcgacgcgtacgtcgtgcacgcgcgccgccacctgccctgctagacgaggcgaggcgagtgagcgagcgagcgcgtgttccccctcttctctccaccacacatgcttcaagtggctaggagggcatcctcccttttaaggaggtccccctcttctagaataagtaaggtggtactaaactcgacatgcatgccatctcatgagataggcttttgtgattttccaaagaattaatctttaaataggccttaccccatctattaattccaacatgcaccaaaccaaataaccaatacacctacaccatgcggccctatgtatgaaagaaacagtactatatatatcctctgctttttctcggggtatatattccggctaaattattggcatcgcaatacacgcgcagtttcggatgacactgccagtacgtatacatatctagctagccggtgcagtagtgcagcatcgatcgccaacacacatgacaacgagttctcggcacgagatcgatcgcgatcgatcagcagcaaaccaaagtacacctatacaaaagcacgttaattatatgctctcgtactggatgccgctagcagctagcgttacatttgacaggacaagtagctatctagctaggccggttggaaactacctgtagaaagaaatacgtttttccgttccggtacatggcctcgtcgatcgtagctgcagggtaataattagcgagcatctggctggcccgcggccactgatctgtactgccgctgcacctcaatgatcaaatcaaccatggaccggaagatgacatgcactcgatcgagatcgcgcgaggctggcaccggcatctgcaggttgatctacactacgcaccagcacagtagcacagtagggagtgcaaccgcccgctcggcgagagcgagaaggcagtagcagatactagattaattgctttttcagcatgcgtacgtttcggctttgcaacggcatcggaatcggttagcttttccccatcgaccggccatacggagggggccgggagagagagaggtcgaccgagagagatgggtgagagggtgatgatgagtgcacgcacacggaaccagccgagccgagccgagccgcgccgtgccgtattgccgtgtagtgcgatctatcctatgctagtcgctgcgatcgcgatatatgcagctcgtacgtaatatttctagctcgttcctgtgtgttcgtgctcgatcgctcgcagtgacgtgccgcggtataccgatgtactccatggacgaagagatggaattaatgaggtggtcagcgacagtcgacagacgacaaaaacccccagctctcgccggagcgagcgtatgctgccgttggtgccaaatcgtgccaaaggaccgttgtagtagatttcgtgcgggctgtagaaattgctgtgcatgagaacacgcagaaatctatctatctatatatttatatttactagtaaaatacccatgatttattgtgggcaaaataaaatacacaataatatataacataaacaagttctttaaaaaatatgctagtgttatttatttgcttattagagtgtccttgatattatgcatcagcatctttagtgtcttttatactactatagatatgtatatacgaacacttcttacgagttgacacattaaccaatcaatattgtaattagatagatcatattattgtgatcgaatatttatatttaatagtgtgctatatcaaaaagtcatttgttctagatggtgttgccacgtcaaaattcacctaaattttgataattagatatacattaattattaatttaggaattaataaatctctactattatacaaattgaagatgtcactactagaaaaacgatttttcatggcgtttggaaaatagtttttatggcggctaagtggaaaaaccgccagcacaaaaaatcgtgggggtcacgggctgccagcggaaacacatcttcgctagcggtcatcttaagccggccgccagcgaagataggatatcttctctggcggccctcttaagttgacgacagcgaagataccatatcttcgctggtggtgtggtgacgtggaccgccagtgtcggagaatgaactcctccaccaaggaaccgtgaggcccccctttgtgagttcggccgggagcagcgggtgagattcgagggcttggtgagcggagctgtgtgatctaagggcgttaggccccaccaagacgatgagacaaaagaggtttatacaggttcgggccgctgagaagcgtaataccctactcctgtgtatgattgattgaatgtagaacacaagtgcttggggttgcgagacccaagcgccagttcgctccgaagtcccccctccaccactaggcctagaccttcttttatacctcaaggggttaccacatgggcccaacaacctaacctagctctggtggagaagtattataatctttgcattaaattcatgtcttgtctcttgacttgggaagccaagcacacgtcatcttgatgatggggcctgtcaaatcttgccgcttgacacggggggtgcccctgtcagtcaccatttaatgggtgaagacttctgggctcctattacaccgggaaacgggagccttgctttgaccagagcgggaggacctactccggttgggataaaaggatgagaacctctcaccatcactatttgatgggacatgtcaggctgcacgccgcctgacacacgagcagcgcacaggcgcactagccagtcccatcggtcattcgaccggtcacagaccggttgagtgtactgcacgccgcatagcgtggcgcgaccgctcgggacgccataaatgcgggtagatgggcacctggaagcggacacctaacccaccgtacgtggtgacctagagagggggtcgggggtgcccgacccctagtcacgggagggggcagccgccgcccgacctcgggcccgatcccccctcgggggggagccatgtggcgcctggggcggccttctccctctagtcttggctagggagtggccgccgccctacctcgggcccgacccctctcgggggagggccacgtggcattggaggacagcctcctccatccagtctctaggaaggagtggccgtcgtcctacctcgggcctgactgccctcgggggagggccacgtggcatcggggggcagcctcctccctctaaacctgatactatcgggctcatatcaccgacagtagcccctggcgttagccctgaccaaaaccttccccaggtggtcagggttgacgccactttcctagtctgatgatatgtgggcccgatctcttattctttctttgctggcactaggacccatgcgcctttttcgccccagcctgagggcgactcgctagcccgtaccttaggctatgaacttattttctgtatatatttagcaaacgttgttatattctctcgggcccgtgaccttacgccacgtacctcgcttgcccctgccatttgttaacctctgttcatgttctacttcatctactcaaatgattattttcgtgagtgtgaggattgaactttccatagccagcaatcttcacccgcgatcaagctaagctgggcgccgtagccagccagcggggccaaagccagccgctacagaagagctagcacagggggccccgggcgtcgacggtacccagagctcgacgcagggctaggatagagctaggaatcgtagcccccgcactttaagcaaagaatcgtttgaatggatgaagcgaatacaaactttttgttaccaagggagtcaagccggcgcgcgacacataggtaccgcaggaccgcgaggaagagatgggcgagagataaatataagcaataataattttatgcaaacgattatcttcgcgtgagtgtgaggactgaactttctatagccggcaatcttcgcctgcgatcaagcgaagctgagcgtcgtaaccagccgacggggccaaagccagccgctacggaagagctagcacagggggccccgggcgtcgacggtacccagagctcgacgcagggctaggatagagcttggaatcataacccccacacttatagcaaagaattgcatgtatgaatgaagcaaacacaaacctttagctcgaagagggcctcccaccatgggttccgaaccatcttgggaaacatgtgaccacttagcaaacgaggtcaggttcccacgagcctgtgtccccacgctacacattctgtttgctctttcctttcagtggcctccttccaatctcttttccttctacatggacgattactttcgcacgagtgtgagagccgaaaactctagagccagcaatccctgtccacagttgagccaggccgagtaccgtagccagccggtgggaccaaagccagccgctacggaagagccagcacatggggtcccgggcgtcgatggcacccggggctcaacttaaggctaggataaggctagaaaatttagcccccacacttagcaaagaatcgttcatgtagatgggagagaggttgtgctcttaccaccgagggagcaaacaaatgcgcaatacgcgggcgtttcagggccatgagaatagaatggggggaaataaatataagatttcaagctaatgaattgaaaatttgaaaatacttgaagcttgaaaggacgatcagttgagccgggccgggcatcgtagccagccggcgggaccaaagccagccgctacagaagagccagcacaggtggtcccgggcttcgacgacacccggagctcaaaactgcaagagtcctcccaggagtgaactgaggcggcagcaggttcatgggccaacctcgcgcttggccactgagggccatggggaagacgttcgccatgacccggtcgccaccccccgccgcctctatgatcaccgtgcagatctggagggactcggaggggtcggcgccatcgtcgtacttctcggtgaggcagggctggagctttgggggccctcggacattccgaagactcgccacaaagacctggtagccaagcttacctggtggagatgtggggggccttgccccctgcctggggtggcgcgacactcatgaggatgctgcgccttcccccgtagcggcggcgcgacactcaccatgccggcgctcgaaagaacctcaaaaatcacgaacgcgccccctacctggcgcgccagatgtcggagaaagaactcctccaccagggaaccgtgaggcccccctttgtgagttcggcctggggcagcgggtgagattcgagggcttggtgagcggagctgtgtgatcttgagggggttagaccctcccaagacgatgaaacaaaagaggtttatacaggttcgggccgctgagaagcgtaataccctactcctgtgcgtgattgattgaatatagaacacaagtgcttggggttgtgagacccaagcgccagttcgctccgaagtcccccctccaccactaggcctggacctccatttatacctcaaggggttaccacatgggcccaacaacctaacctagctccggtggagaagtattataatctttgcattaaatgcatgtcttgtctcttgacttgggaagccaagcacacgtcgtcttgatgatgaggcctgtaaatcttgccgcctgacacggggggtgccactgtcagtcaccatttaatgggtgaagacttctctgctcctattataccgggaaacggaagccttgctttgaccagagcagcaggaccgactccggctgggataagaggatgagaacctctcaccatcactatttgatgggacatgtcaggctgcacgccgcctgacacacgagcagcgcacaggcgcactagccagtcccatcggtcattcgaccgatcacagaccagttgagtgcactgcacgctgcattaaatgcggcatggcgcgaccgctcgggacgccataaatgcgggtaggtggacacctgaaggcggacacctaacccaccatatgtggtgacctagagagggggtcgggggtgcccgacccctagtcacgggagggggcggccgccgcccgacctcgggtctgatcccccctcaggggggagccacgtggcacctggggcggccttctccctctagtctcggccagggagtggccgccgccctacctcgggcccgacccttctcgggggagagccacgtggcattggaggacagcctcctccatccagtctctgggaaggagtggccaccgtcctacctcgggcctgactcccctcgggggagggccacgtggcatcggggggcagcctcctccctctaaacctgatacccccgggcccatatcaccgacagccagcgaagatacctacatcttcgctggcggccatcttaaccctccaccacctcaaatcattttctatggcggttcaaacgaaccgacatatgacgaccgccattgaaaatgcgttgaactatatcacccagctacagtaacttcgagcactattaggagcacgattttctctctcttaagaacacatacacaggggataaggttttgatctcgaatcttttgatgattgtttggtatgtcgtccgattcgagtacggatacgatagtccgacttcaaatccgtatcctatttaatcgccataaaaaaaagtctcaaatacatgtacatgtatgtctcgaatttgttgctcgcatgtatagaagaagagaacaggtcatcagatcgattcgtactagaatatactgcacagacgtaaatttctctttattagtttagaaagaagcgcagctagcatcggctgcatgctcttcctgatccgattgtgatatggatgagatgatacagcttggctatttttcaaaggttgctgcataaacacccatgtagacatatcttcatgttatttctatcatttatgaatttggaatattcctattatgtttttttttgtgagattttcataatcaggatgaagccatcgcaatgcaataaccagccacgtgagacaatttcacaattcataatgctcaaatactgcataaaaaatatgccacgatttagtttttccgtagcaacgcacgggtactttttctagtcattaaaaatagtaaagtccatacaaccttgataatattaactccgaattttataatactgataaacatgaaaatggctacaattcagaccccgaatcgagtacaactcgatactagtacatatttggaatcatgctaaatctataattaggacttcaaaattttagacttaccaaacatggaatagctcactactagaaaaacgatttttcatggtgttggtctattattttcgttggcggccatacacgaaaaccactagcaaaaacatatcgaggggtggggggccatggaccgccagcgaaaaccgattttcgctggcggccacgctcagaggtccgccataaaaaaaactctattttttttaggcggacttcttaagtgtccgctagcgaaagtcacgttttcgctggtggtaggtaagaaataccactacaaaacttttttgaggcgaacaaaatccacccaccgcccaccgccaagtccgtccttatcccttttcccttctcccttcccatcgcccagtccgcctctctcccttctccgtctctcctcccttccttctccaccgccgcgcctcgtcgcctccccaccaccgccggctgccgtcgccgcagctccaccgccgcatacgaccgccgatccggccccattctcttcctcttctaactccctctctccctccacggagtgggcggcgaaggcggcggtgagctcgggcgcgggcagcggctctcaggcgcgggcgcgggtgctggcggagctcgggcgcgagcgcggcggtgactctcgggcgtgggggcagcggctctcgggagcggggggaggagctcaggtgcgcggggacggtggatccgccgccgccgggcctcggggaggccggatccgccgccgctcggccacgggaaggctggatcagccgtcgccggaccacggggagggcggcaccgacctcgatgccgtcgaccgtgctcccgcggctcccccctccgaccatgctgctatatttgatttttttttccttcttttttttgcatgttgttccatatgatgcacatgttttgatctgtgtaaatgatgtttgatctgtgctgatgatgattttgtatttcatgtttgaatttggaaatgagcagcgaatctagatgtggatttgaattttgaaattaatgaatcaataggcggctgcatgggtattttcgctggcggctgtatagctgcatgggtatttctttttgggctcaaaatagattttcactggcggccgatttaacacagccaccgatttaacacagccgccagcgaatcgctggcggccgtcttaagccaatgctagcgaaaatggttttttgctggcggctagctcaaagacgaccgcccgaaattggatttttgctggcggtcaataaccgctagcgaagatcttgattttcactggcctttgctttgtggcggttgcaaattctgccatcaaaaatccaaaatggccgccacgaaaaatggttttcgtagtagtggctgtcactaagaatacaaactataatgtatttcatccggtactaagtcccatatgtagtaattatgaattttagaattattaatttgtgaaaatcatatatcaatactaaaagccgtccgacttatgttgctcttaactaactacttgctaaatcgtatgccctccatgattttcacatgttcaaatacgagagtggattttaaactctcgaagggacatcccctcattgcttacataccactcaaatagttatgaatttattttttttaaaaaaaatattaacatgtgatatatcactctacaaacatagaacttaaattcaacttcaatacatcacaacagagaaaaaattgaccgtgaatatatgttaactagctgtagtttatttgttttttgttgcgatatgtagaagtcgaatttttaagttatatgtttgtgaaataatatattacatattaatatatcttcttattttttttataactatttgagtgagatgtaaacaacaaggagacattccctcgagagtttataatagtttcccatacaagtataggtattctgctcagttttattctatttgcttattacaggcacccgtaacgatcaagttggaataagatggtaaatttcaccgaaaagctagaccaaccagtggagtgcatgtatgtacttactttattatattcctgccaaggcaagcaatattggaatatttgataaataatgctatattcccctgctctttagttcgtctcagtacaccacagacttgcaatctctacactttaattataccatagcaaacgtagaagtactgtaccatcatatggtgcctgtctgattctcgtcagctcattcctgcaaattttgcacaaatttaaaaggcgcttttaagatcactttgccgtcgtccagccttagcttatgtttgctttgcatcatgaacagtcgttagcctttaagcgacaaacctctcatagaagctacacaaagtacgcatgaacctcacttttgctttttcagaggtcatttataaaccatatctgcttgggcaaggtcgttgcctaattgggcaactgcagatttgtaggcatcaattatatggccttttagatttttgttaaacaaatttgtttttaaaaggttttacacaaagctgttgctttgtttctagacctattttatttttcagtcaggtacaatgaagggttatgcacattgtatgcgacgatgcaattttttttcgcgaacacgtatgcgatgcaatctacggaataagttctcttaccaaggataatttatcatgaaaaagttgaaatgataatccagagactagttttaggccaatctacaaaggtgtgatgagaaaaaggaatccatttttcttgcatgccaaaatttagagactatggttatatggattttcgtcaactttgaatcaagatttactaatagggttcatgtctaaataagttgtatctcttatttttgttgacggagtgattatttgtctttcttttcattcgatgttagttactttttgttgagcttttaagtcaacaattaggcaactgggccgcatgttatccaccatcaaaattgatatagaagatatgatttttttttatggttgtcattaccctcttccacgcttatcagttacttatcaaggaattatagtagcaacattggtatgagtttgctatgagggctgctatacgtatgatatgttttttacgatagttgtacgatgaaacattctccgatgttccgttccggctataagtttggtctcgcatggatggatatatcttgaatcgctcagcccatatgcatatttaaataaaggatacggctagatcgcgcgctagcggcatattgctaaccagcgacgcccttctattccaaaaaacagttactagtacactcaacagtacatgtctttttttttcttcctagagaattttctcctaaattacttatccgatctataatccgattacaccattatggttgttgcaattaaatctttacaataagatcttacacgattatattctgataaaaatatctatattgtaaattacttttattatatatgtaagttacttttgtcctatacataaattactttcagatttaagctctttaataacttatatcttttaaatcacgtataattttcatgatctatttacatcattatactctacgtaaaatatgagacaaaacaagatccatgttgaatatatttaaacatttcattaatttaaaagtaatttatttaaattgtagtagtaacttagctatgcaatagaagtaagttagcacaaaatagaagtaagttgttacaacattaaaagtaaattcgagagaaaaatattttgtatctaaaaattaaatttaaagtccataaattatagaattgactaaaaactataataaacataatcaacttaaagcattatgaatatataaatagtaatttagtcaaatctcaaagtaatttatatatatgataaaagtaacttaagtatataataaaagtaatttacaaatataaatattttttcattgcagtataatcatgtaagatctagttttgaagatttaattgcaacgaacacatgtaatcggattatagatcgaataagtaatttgagagaaaactttgtaagaagaggaaaaaaaatacatgtatgtgtaatagaaaaaaaagacatgtatgtgcgctggcttctccacggcttctatggttggcgttgcgcgataagacaatatcgaaaggcctcgccgattagtttttgcgttaaataaattgcaaaccaaagtttatgatgacatgttttgcaaagcaaactttagattgaaacaatataaaaaaagtatacaagcgttaatttacatggtcctactcttagacaatgcacaggaaaaaaaaaagagggactagcgtaacaaagaatatgtttctgaggccaaataaaattaagctaataggatggactttcctctttatatgcaatctagattagtattgttgtagattagatcagaccgtaagttcagatattaacttaattaggtttatagcataaataaaaaaaaggtaaaagactgcgatgagtttgtaaactttgtatatggacttcggggccatgagcaactcttgcatgtattctcatcacgtatctgtttctgtgccgtctgtttggtccgcgtttgatcgtactaatttcttactatgatgttttccgattgctatggtgtttcaatgcacggatctatcatacttcctccgtattcgtaaagaaaatcattgatgacaatgtttaaatcaaaccttagaaatataaatcataaataactctcaagttattaagtttaaaaatgtaaaaattatatgaatagatttgtcttgaaaaatactttcataaaagtatacatatatcactttttaataaatatttttatagaaacaagaagttaaagttgtgttttggagaccgtgtcgctattctaaatgacttctttacgagtacggagggagtatttatgaatgaagatagtaggtagtactatcactaataatcagatgtagccataattgtttcttttattacccttgaccccgggaaaacaaaaattctttaggtaatgattgttccgaagagctgtggctttattatacctcatgagagatataaagagattttaatgaacactaccagattgggaccataagttgatatgaaggcccacatataatcctcatttttcaatattctccattcatagtatgatgatagtacaatcttgccgatagtcactacagggggccaagatttctctgctcaattaacgcattctttcaacagtctgatatgtctggaccgtaccccatatggccatatactgccatacacagccaatcgcataaaagtcacacctctgggtctgaggttctcttgtgaaactaaaaccgttacatctgcccatcttattagggcatggccaacgcagagtatagtctcataaaaaagggtgatgctaaataggataaaatcacaccagtgatatccctcgcacagtgtaagccatacccccatcttaatttttaattcagtacatgttagtcggtcatatttttgcttttaaacccttggattattttaatttgcatatacgtccaatatttacagtataccctctaaaaatcacaaacatatataaacgtcaacccctcctctcatcaccatatctcccacccaatctctccctgcgtctcctttctctccgcttctcccctcgccggcaccgccggggagtctctccccagcgcgtcgcctctcccctccccggccctctctccccggcgctcccctctccggcggtgccacctgtctccccggcgctggatcgaggcggcggcggtagggcggatggaggctgcggtggcgccggatcgaggcgcggcagcgccggatagatgcggcggcagcggcggtgccccatcttcttctcccccgcctacttcctcgccatttttggccttggcgcgggaggtagttggctacaacgttccagggttacggtacggagcgacgcctctcccccaacacggctgctcgcccgttcctcgccaaaagctaatgaaactatgcgatgctatgcggggggtcagggagctctacgagagcgcggtcccggccgagctggcgcgaatattcgcgtcgggaggggtgagaccacgcgacgcgaatattcgcgggtgagaccacgctctagcatggagcgttggccatggccttagtgctctctaactttccagtagagtaacataaggttctctctatcataagaacgatgcatatgaatttatctctgctactttttcttcgttactccctgcgtctcataatataaggaatttgtcacatccctctaaaatctcttatattatggaggcggagagagtaccgatgaagaatatgagcacaacgtcatcattcctgatcaaaaatggctggcactatttacccaacgctcccgccggtagatcgaattcttatcgtggcttctcagttttgctcgcggaacctgcttgtctgctcgcccatcgaccatcggcaacttgggtttcatgtgagtcgaacagcgtgcagcgtgcacgcacagtacttgcccagcaaacagccgctgtctcgggaggggaaaaaaaagggcgccggcgcgatcgttcgtgctctcgctttgcgcggatggctgggaatcgccggcacgaggcgacgtgacggctgattcgtgtccgcccgcgcgagcgcacggtggtgtgatgccgctttttttttttttttgcgtgtgtgtgcgccttttgctgccgcggggagcacggggcccgcggccgcggaaaagaccggcgctggatcgctcacggggaaaagagaggctccggcgcaatcattcgcgtgcaatttcccaaggggatggacggggccgcggggtcggtgttggcttctcgaggtaacggaatggaaaaggatgaaagtttaaaggtgcggaaaattgttctatggtctatggacggagtgcgtatttaagattaaagcctggtttagttttcaactttttttttattaaacttttaattttgacatgaactaaacacacctttgtaaaatttatgtgaagttcttgcattctgagttagggtggcaaggcgtggcaagatattccagttcattagtactaccggagtagcatgttctttcgggattttgtggttcaacgtactcagtaataccaaagttaaggcgatcctaaactagttagagcaagtacaatagcacactattaaccagctaaaaatatattttaatgagataaaatataagaaagaagagtagcgagctacagatctatagctagctacagtatagactttaagacgcaatgtatgtatgacaggtgagaccatatattaatagtatagtaagcaactattatatgaattaactattagatcggctataaatgaattggagttagtagtggactattctattatacttgctcttagaactaggatagtaggatgatgcatgatgcatcggtagccaagaagataaaacgtttggcttcctctgcagctctgctcgatcttgcggaaacgcggttgtcgctcatacgtgcggcccgtaacttgtgggctgctagaacgtgttacgtgaggcccatccatcatgggctggaaaggtattacagcgaacgtgtggcccatactggatggaccggaccggtcactcttgtatttatggaccagaacgggattgggacatgttaaggccttgtttgtttaacgaaaaagtacgtatgaggtccctgtcatcggattacaaaatcgtccctcaaccaaccggatataagtcatccctcaactatcaaaaccggataactctgggtccctaggtggttttggctctggttttatccgacgtgacagctgagtcagcgtaggacccatatatcggtgtaaccacatcatcaccctctatttcccctcctctcccttcctcctctctaactcagtcttctctgtgtaggctggcggcaggtggggaggaggctggcggggtgggccgaggcaggagaagaggagggcgtcggcagccggcaacgcagcggcggcggccggagtggcggcaacgacgacgccggagaaggtggtgacatcgccgcgtgtgcgagctcggggttggagcggcccgagaggcggaagaaggaaaagggcatcgtctgcggtcggtgacaggcggggaaaacctggggtttcgtgggcaacgtcgtcccccgctcgccgtcgtccctccccttcgtcggctgtgatggggtgcgcggcgtcaacgacggacatcgctgagcggcggaggccggggccgttgcctggccaccacgagacgtccaccgccactggcatcctggcagcgcgccacgacgaccagcagtaggatgggaggaggcgaccgcggtggtgccaccagctcaaccggccgtcgccattttctcgacgacggcacacggggaaaaggcccggcaggccggtgtgcatgggcgcgcgggcgcaggcgtcaccgagctagaccagccgtccccatcttctctacaacggcgcatggggagaagggccggcagatctaggtgaggaacacgaagagggggagcaggaaggggagcgacgtcggccgctttaggaagcgcaacagcgacgacaacagcgatgacgacgacacaacagcgggggccatagcgcgatggctatccttgggttcgccatggatgggtgggtggcgagctggtggtggtggtggctcccggactcgagttacatcgaaggtcgccgcccacgcccaccgcacctgcctgccgtgcccagctactcccccgtcccgcccatggagaggagagagaggagaggagagaggaagagaggaggagaggctgacgtatggagcccacgtgggccccacgctgagtcaactgccacgttggataaaaccggagtcaaaacagccaaaggacctagtttgcactggttttgtaagttggggaatatgttatatccggtttttcagttcaagaacaattttgtaactaggtgacaagttgagagacctttggtgtactttttcctttgtttaatccccaggagaaagaaattggagggtattgatagggaataattctatacgtgtgaaataaatccctttaaattttccttaatcccccgtgagtgtctgcgaggattgtggtgagaaattattgtccttcaatcccattcaattcctctattgaacaaggtcgaagggcataatttatgggccggaatgagattgtggcctactgttaacgaccaaatttggtaatatcatcatcggaaaggaggattggatcaaagtggagtcgaaggcgaagatcgatctgagaacagagcaagaatcggctggagtccagatcggctacagtcaggatcggctgtgtccgagttaaactaggtgagccgatacagctgattccgacaatacgacttggtgtacaacatcgggttgggttgatatgcttcaagatgattgccgtgcatggatagagtcctgagaaggcaattgtatctattaattaggatattttatgtaaattccttagagatatgtttgggtaaaagtctgccgcaaaggcttgtggtatcttagagattgttagagataataatcgtgtccgatatgaatatagtttgtaattttcgggtataaatagaccccgaacctcatgtaatcaattaacacacacgttcaatacaatttcggcgcatcgccacccttttgctttagttttatttcgacgagttcttgctttcgggttgagctgcatcggtttcgatcttcaacaagaggtaaaaattgtcatgacggtttgcgttctcgggattagcgcttccatctttatgatactctaatcttgtttatgtaattcgtcgagttatcatatatcttacataatctttggcaatatcgctatctaacctacaatcggctaacatctatcggtagagggcagccgatcttatctgatttaactatatttgctctatgcgcttcattgacccgttaaatatgccctttatgttaagatattattgcatctaagtatattcagcttctgttttaacatcgtaatatagagttgtatcggagtattagccgatacatgctagatctatctgatcggctatgctatgaacatatataatcatgttattaatatatatttcgatctaagtgatttatactgtctcggcatggcgaccgatctatctcaatcacttgatttaagtatatatcgatataagaattatatattgccaatatctacaaccgatcgagtagatttagttctttattatctatttacaaccgccgatcgatttacatatgacatcggctcaaagataaatgatatgtcatcggcacctagccgatttgctatcgtttataggtttaaccgcggtttatttgtttttatttcttgttaattacggaatcaaatcaactggcacgctagcatacccgaaggcgagttttggacctgtactggagttaagcagatctctcatgcctcgtgttttacgtctacacctacaggcatccaacatttatatggcccagaaatgaattgtggtagacgtgcactccaccgctgcggcccgtcaacttaaccggccaccgctgcaggctgcagccacatcccacgagttccctgctggcctctgctgtgttctacttctacgccggctgcagctttacatccggtttgcttatatatggctgaaaatttgtgcaaaattttcgcacatatacctgagattcattcctctgtacaatttgatttgctgttcggatgttcaaatcccaatattactggcgtttgtggttcttttcattcaaatttcagagaaaaagagcatgctggtatagtttctgtacactagagctcgagcgaagtaatctgttgccaacaaacaagatcaagagtagtggttaataaaatatcccttcttctgaaagattgttctgtaacgaagatcagaaacattagtgaacttcagtatcctaccgtcgatgtacatgcttgcctgctgatctcctgtctccaccactaactgaggagaagatgggctcattcagagcctaattacgaaccaaaacctctacttgcagaagacgaaaaaaaaaaccattcacgaacatcgcagggtaaaaattattggcaccacgtcacaatcatgggatcacatttccgacagtcatactcaacacaaccaaaactatacatatattgtacttcggtctcatcctttgagtcagacgacagcaaaatacatcacgaggttttcacggttatatagatcgctgttcaaaatagtacttaatagagcaggacacactgacgtcactgagcaagttgacaatacgtctggttggtgctgatggactggctagttatcactttgcatgctcctgatcatgttcaggatataaaggaacaagttgaggatgtcaaggtagagctcaacagaggcccaaatgtagtcgtcataagtgtggcgctttatcaagttctctgtgtcgtagatgatgaaacctgagaaaactaaagctccaaggccaccaaacaatgcaactggtccagagcccaatgggaagaacacctgcaacacagcatatcacggcaaagtgcttattacaattggtggtttcgtaatggtaagatcgctatttgaattaagtatattgtatcaaaatgagtgtacacttgcctgaataaagcttatcacaacaagtaaaacaagagcagaaaacagaattggtccaagataaccaaattctttccccttctttgaagcccagaaagtatacgcagtcaaagaggcaaccacagctgaggtcaatattaatgcctcaagcacaattttccctgcagcacacaaatgattgttatgtaaaaagtacagttggcagttgaagaaactaactaaaacttgcaaaggaaagaaaaccaaccttgagtgttagcacatgccacaccaatactgaaactcaagcacaacgtgaacagacccaggtaaacaaagttgtgtgggtgtttgtgctgataatgatacaatgggaccatcactgcaagaaataacacaaaattagctgagagcaccaaaaccattccatcctaccaaacaattaacaatgtcatctactcaggcttttctcaaaattcagatgaagaagtttagttactcgcaacactaacatgaacaaaaagcagggagtaaaaaaaaacagccccactgatccaagatttgagactttccttgatatttttccatatactattaaaatataactcataccggactaaatacattgactatctcttacacagttatgtgtgctgcctacttgatccaactaggggataaaacaatcttgtctatggcaaacacaaagcagaaatttcagaattgaaagaaaaaaaaataatctggatacacaagtgttcagaagagttctacacttctaaagacagccccaccatgcccatatcatcacactccgcacttgactaacacaaacgcatcatatgatgtcaagggaaacaaataaggccaaaccaaaatgcatatgaatcatatcatttaaggtctcataacatttgtaacaaaattttccgacagcgtttgcattaactagtttgtcataaactcgtcgctgaacatgatctatagaaatgctattcacaatttataggaaaagcaattgcagcattagtttataatataacacaaacatttacttcacatcccaattcagaatgcgagtgggcaaatccatgatgcagaacttactacgtctaattctaagtattaattcgtgaactaattagatcctagatctagaggccaaagttttgattccaacagcaaggcatatagtaacgcaccgatctatctagattcaactatgtagcctacaaatcaaaccagctgctaatcagcgggacgcggatgaatctacgaccgatcacagaataaaaccattctcaatttctcatcaagcacaagaaatctaagatagaggtcaaccgaagcatcatcagatggggaggagggcacacgtacggacgaaggggaggacggcgagcacgagggcgagggtcggggaggaggagagcgtggcgttgagggtggggtggaggacggtgagcgcggagacggcggtggtgaggagcagctgcgcggcgaggatgccgtacaccttgcggacgaacccccaccggagggcgctctccccgcgcgagatccccgggtacagcgtctccccggtgccggcctccaggtccaccgcggaggcgtccaccttctccttcatctccggcgcccggcggtagcccgccggggccagcggctgcatctccgccgccgacgccatcgcttccgacgcgcttggtgggtgggtggggggaatcggggagagaggaggaaggaggtcaggaggggatttcggttgctggtggcctcgtgggaaggagacccgtatgtatcggggaggttgggatttgtgaatttgctaagcgtacacgtgggatctgaccgaacttttcttcccctggtcactgcgaggtggggccaaattgggcggatcggtgggcgcagcactcagtcagaagtcagaagaacgcgtgacacacacacactgacagttggacccacgtggataggctgttatgttaataaatctctatattttttttgcggggaaatctctataattacgtgtgcttaactcatctttactgcacctgcgtgaagaatttgttcgtagcaaaaaagaattactgttaacgattgcgctcgattgaattacttcatggtctggaatactagataatttacaccataaactattaatattggacaaataaactccttgagcattgttttgggtggtttttgctcgagcttacacacgtgacgccaaacgtgacaatccaattaacaaataaaaaaaatctctagacccacccgcccctaagccaatctatccctagtttcccctcttctctctctacacctatggctagagaaggagggcaaaggcggagaccgcttgggcaaggcggatcgaggaggcagcaacccgaggcagagtggaggcacatggatgtagagctcgaaaccaacttggggtcgagaatcccgtcctcactaggaactcgtccccggtggcgaccaccaccatacgtcgcaccgtcgcttgctgcgtccacgccacgtttggccactggtctccatgggagagggaggatacacgggggaggaagaggaggatgggaatatgacagtgatagcgagggagacaacgaagatgccgcacatccggataaaagcacaagtctcatatatggaccccgacggtcgcatcatctccaccaccactcacacggacgcagctgcacatctcgccaagctccgcaaccaaaatactcttcgaacatcttcgccaccacgtgcactgatgctcgccaccgcctgtggccttttccaccaaatcgagctctaggagataatgcctagagagctcgagctcagctgcccttcgcacaaagagctcgactccgccgccgcctgcggccttttccacccaatcgagctccaggagataatgcctagagagcttgagctcagctatccttcccacaaagagcttgactccgccgccaacacctccccaatgaagtttgagctccgttgcaggctctcctctaaccttgctgtcaagctagagcagtggagcacgcgaccataggtctggaggccactcgctctacgacgaggatggtgttgcccaaccaagctgaagccatgcggaggctcgcaagttcgccatcgccgtgagctttgcatcaatatcttccaccattgtccaccttctccaatctccagcatgagagagatagagagagagagagagcaggggactagggatgtgattggacataggaagagaaaattctttgttggttggattgccacactgatgtcatgtgtgcaagctcaatttaaaaccgactaaaacaatgctaagaggattatttgtctagtatgaatagttcatgttgtaaaatgtttggtattttagtttaaggagataatttggttgacctaaccacgatagttcgtggattaaagggactatttggattaaactaaatatttggtagagttttagcaccaacaaaattttagtatgctatagttgaaaatattgatttggattgaagtcaaactatgcttataagacacaagtttacaggcaaagctaaatctatctattatattattaaaacagctctgaaaggaggcaccatgttcactgtttgggctagaaatttccacattaatcggagaaaaagaaaaagaaaagaaaaggagagtcgaagtagaagtacaatttaaattagctaaaattcggaattaaaataagagatattgaaagaagtttccatgtatgaacccaatacgagattaatcaaaactcgaaataaaataaaatccaaaattagaaaagaaaaggagagtccaagtagaagtacaatttaaaaatagctgaaactaggaattaaaaataagcaatattgaaagaagtttccatataagaaccaaatacaagattaatcaaattttgaaataaaataaaataaaatccaaaattagaaaaggaaaggagagtccaagtaggaatacaatttaaaaatagctgaaattcggaattaaaaataagaaatattaaaagaagagtccatataagaacccaatataagattaattaaaaatcagaataaaaataaaaataaatccgaaattagcaaaagaaaataaagaagagttcaaagtaggaatacaatttaaaaatagctaaaattcataattaaaaataagcaatattgaaacaagaatctatataagaacccaatacgagattaattaaaattttgaataaaaaatataataatatccaaaattagaaaaattaaaagagagttcaagtaggaatacaattttgaaacaactgaagttgaaaataaaaaaataaaaacattaaaagaacacaatacggtattaactaattttttttaaaaaaaataaattctgaaattagaaaaaaaagatttcaattaggaataaaatttataaataactaattttttgataaaaataaagactattgaaagaaaagaccatctaaaacacgtgacgagataaattaagtaacatgcctataaaggagtagagttggtggcggttgatacgtcatataaaaattgttaataaaacaccaaatagaatcctaatgacgattaaaaggagggacgtcgggcatgccgtgaagcaaacaagtaaggcggttgccgggacttctagaaagtaaaaaaaaaacacattgataatcatattcaaattttaaaatctcaatgacaataaaaaggagaagcagcgggcagggtgtataagagtatagttgcaaagccgccgatggttgacgggacttctagaaaataaaaaatgaattacaacaatagttatgtttgatttttagaatcacaatgataataaagaataggcggcggacggtctgtagaggggcatagtggcatcgtttgctaggacttctaaaaattataaaaaatgaaactacaagtctaatttttgaaggttcgaaaattctaaaaagtaaaaaaaaaaccaatgataatcatgtccgattttaaagtctcaatgacaataaagaagggaggcagcgagcgagccgtagaggagtacaatggcaaaaccgctgacagtttggcgggacttctagaaagtaaaaatgaacccaaacgataattatgtttgacttattaaaatctcaatgacaataaagagaagagatagtggatgggcatagaggagcataatggcaatgtttgacgggacatctagaaattataaaaacgaaacccaatgtgataataaactctaaaaactagaaaatccaatttttaaatgttccaagaagaatgaatagaaatagtgatagatcgagcaagcaaataaaaaaggagatgacataagggatagcaaatttttaaaaactatataattagaaacatgaggatgataaggtttggtttttcaaaatcttaacaatgagatagctatttaattaattctaagtaaaatcatacttaaaaaatatatgatttttttgctagccgcgcaattgcgcgggccacccagctagttcatgttaaagttgtgttctactccctccgtttcgaaatgtttgacgccgtgactttttaacacatgtttgaccgttcgtcttattaaaaaaaatttaagtaattattaattctttttctatcatttgattcattgttaaatatatttttatgtaggcatataattttacatatttcacaaaagtttttgaataagacgaatggtcaaatatgtacttaaaaagttaacggtgtcaaacatttcaaaacggagggagtaatagagatgtttggttggttaggcaaattttgataagggcaatcccaggcccaaagatttcgccgaacatacacgtcgtcaaatcgaacttttttcgtttttagattttttttaatatttacagaaataatctatggaccaaaaaaattgcagaaatagcccctgtcgccctaatggtgggcggcaatctgacgtggtagacggtgggtcgaccgcgccgtctgccgccgtcggccaaaattgcgattaggcccttgccgcccgtacagagggcggcaaggggctaattgcaattttggccgcccataaagagcttgcggccgtactttttt

SEQ ID NO: 59562 - DNA, 9803 bp, Oryza sativa
aaaaagtacggccaaaagatttttctatgttatgttaataataaataaagaagtatttattggtaaaacttgttaatattgttataaaaatgtattgaagttggttgttgcgcaatttcatatgttaagtgaggtattattttgtaccttattcgacgtattagtactcggataatttatataggcctatcgcagtctgggtcgtagaaacattatatggacttaaacaaggagaattatgtaacatgaagaaatagtagtacaatttgaacatgatacaactatttacattgcggttacatagatgatattagattcgaactaggagggaggtagtgcaatagttgaacacaacgacgatgtagtaatgggacaaggaagcatgacagtagaaatttcaatatgccaagttgtccgataatagctaacccctacgtgaggatccctctcctctctcaaaccgcgctttagtaaccctgtattgctctggtagttcaagctgcacaacacggctaggtggagttaggacccttctggtgtctatccattctctgtattgacatctccttggtggttcatgggaggaaagaataggtgtaaagcaagcaaagtaagtaaatgttgtgagaaaataaggattcatgtaatcaaaatattcttaccatgaaatcgtcgtcaagaatatttggacaaacaaagaaccttcgacccaatgttgtaggatttatggaacgaagaacctgacaacgatcaccacacctgcatcttggacgggcttcccatggagggagtgccgtagttagcacccgccagtcgctctgttgttcacgacattgtcgttcataagccgcttttctctgtaagtattgctcagtactttcggatgcgaaataccaacgaccttcttgtaaacaagtggttaggtcgagaacgggattttctgtatcgacccactcgatgtatgcgcaagccgtagtgcgggtctgccgaatagagtagtgttacgaagaataaagcgattgcccatacggaatgaataagcatatgcagataataaaatacctcacggtcatagttagggcacctaaaaaagcgccttcctcgaatatcaggattcctcgaagccattagttggcatcgatcaccgcataggcagagaggacgctggcaccaaggtggtagtaggtatacacaaggatcgctacgccagtttggatcctcaacacctcggcgtctagccattgacgaaagccggtcggatttgtaatgaagcaagtggggaagagagtactgaatgtgactgagttctgaaagattgtgaggcctcactcgttaaggcgacttatataggcgcaaaaaatcgagtgatacccctgacatgtgaacgtggtgggtgtcacgcccagaaattctcgaaccagaatttctaagctgaatgtgcattaaatccctgtccaggaccagccagggtacacaaacgacaattgttgacatacagatccacgtcttacaaaaatagaaaagattacaaatgcagcggaaaagataaaagcgagctaaaccgggaagcttgacttcagcagcgggcgactccactccacaggcaatccttgacggcagcgacgaaaccaactttgacaaaacagctccaactaggaagatcttcagctctggtgtggggaaaaagagagcaagactgagtactacccactgtactcagcaagtcataccggaagaggaggtatgatgcaggatataaccaaaggaggctagaggttcttttgcataaagctagcatttaaaaacagtagttgaaggcagtaaaacagttgtagtaattaatcaatattaaccaaacactgtccaacgctaccccacgttgcaacaggcccaaccaaccacctgaactacaccagttcattaagctaaactagggatgagactaatcacggtgaatctggttgatcgcccataaccgcgggcacggctattcgaatagttttactctggccagaggtgtacaactgtacccacaagacacgattccacacatgtcgccatgccccgaagtatcaccatgatactgcaaagggggaaatcgtgacaagaccctccacataaccctcccctaaccatccacaccacgctaaggtttcacccccacccctcaaaaggcagtgggcggtcccctcttgcgccgcggtgaatccggcagctggacaaccggacaccccggccgacccaactccatcacgcccaccctcgccaccggtgcctaggaaagggtcgagctatacttcagatcaagcagttacccactcccgcttgtggtaagcacggtaagtctcccagggtttcccgtgaaccggtccttaactgccatgggtgcgaccagcaaaaccatgcacccacagcccaccattcagtgtattttaattaactaacaccattgcggtggcaccaatctaaagctatgccaatagacaaagtctatgtaataaggtgatccccatttgtgtgctagttgaactaagcatggctaagcatttcctaaaccaacatctagtcattttgatacccaagttatcaacggcatatggtaaacaatatgtggctgaggaataggacccatcccacattacattgtaaaagaatgcaacatttaatagaaatgcgggatacttgtaaattgggtacaatatgatcaaacgtattgcatgacttgccttgctctcgaactgatgggacctcagcaacgtcttcgagaaacttcggatcgacgaaacggccgaaacctacgcgacaaacaaagcacacaagcaaaacatgctataagactactgaaacaggaaacaaaaccatttttaatggattctttgcatttttcttgatttactgagacttgaatggacttaaacggagctcggatgaattacttatgaattttagaagataaactgtgtttttactaataaagaaaagtccttaatcaatttattgcgcaataagtcccagggctgacgtcagcgaggggagggggcggcgccgacaggcggggcccacgggtcagcggctcaaagcggccggtctaccgtggaccaggaccacgcgggtggtccaccgccggtccacgggaccgatggtccggatcggccgaggggccgatcggacggcacggcggcggctaggcacggctcggctcggcttcaaaaccggccggccggccatggcaaccggcggcgacgcgcacggtcgccggcgacggcaatcggcggcgtgggaagcgacggaggacggggcgaaaagcgacggcagcggctgaaggcgacggcgcacgcgcgaaggacggcggcgcacacgggagagagggaaaaaaaaaagggagcggaggggagcctcaccggcgagcacggcgaccaaagcggaggatgaaaggcggcggtgacccggcgatgctgaggtgcggacgggcggcggcggcacgctaggagaaaacagagagggggttaggggtagggagagcgaccacggcggctagagcggccggccggagttaggtggaaatggagagctcaccggcgtgcgagagaaacggcgctccggcgacgattggcggcaaccgaatggtggccgaggtgcaagcgggctcggtgagcgtgacggtggcgactacgcggcgcggcggtggctctagcggcggcggcgcgcggccggagatgggcggcgggcggcggagctcgggtgcgcggcgcgagggcggtagacggcacgggagagtgcggtgaaaagaggaaaaaacgagagaaggacgcggggaacgatttataggcggagggggaggcggacgtggccgggaacccaccctattgcgccggcgacgtggaaaggtggggggagagagagagaggggtgggattcgaaatcgaatcccgccctctcgagcgcgcgcacgggctgggagatgtggggaaggtgggcggcgacgcgggcgcggagtggggcgcgaagaggggcggagaaggcgggcggcgtggggaggtggggcgccggcggttggggctcggctccaaccggctagaggaggaagacgaccgacaggtgggccccacctgtcggcgcccgaaggagagagggagggagggaggacttcggggaggggagaaggaacgggccggccccaggaaaggggcgccgagcgcggggagagagatgggccgacggcccatctagagaaaaaggaaggaaaagaaaagaaaaagaggggaaggattttcctgggattaaaattgcactttggtgatttttaattggttaaaattatttccaaggctctgaaaattccactaaaaatcttgttaatgcattggagcatggggaactcaagaaaaattccaccacgccgaattcaattattaattgcatttattaattagggaattagctctaggttaaataagataatttcttcggacgatttatttagccaatttttaaagcaaggagagggggaaacttcagggtgtgacagtggggtatggtgggtacgcctgattggcgccgaaagatacatgcatgatcggcgccgaaagttacattggtcgtatgcgccaaatggcgggcaaatactcgtatcacacgcgaataaaggaggctgcatcggtgcggcagaaagtagtcgtgcatgcgccgaaaggtatcgtgcacatataacaacaatgtagtcattacacaagcatacagtactggaaagtgaagcaagtaaacaaagagaagactgctctactggccctgccccgcgccgcgaccatgcttggtcctccgggcctgtgctcgcacgtggtcctgggagtaggtgaaacgatccggtggcacagcacgggtagcacgagtgtcccgcggaggagtggcctgcgcctagtcttgcgtctgcaccggcggtgcgcctcccagctgtgaggggccgatgacgtcctctgtcgagcctgaagtgaagtcgaagtcagtgatgtcgaagaggaaggtggaaggcaacaagtggtccgacgaggtcccagcatggtccagtggtggaccctgactcgacgtgccggctgcctgtgacgaagtcccggtgtactgccagaactgcgctgagtgcgaggtcgacacagctgcctgagacgctgaccctgcagcctgggagaagtgggcggcttgcgtcatagcgaactgggcgaaacctacacatcgacaacgggacccttgtaagctaagacataaaatgtatgtaaattgattgtcgaagtaatgttgtttttttaagtacctgtggggggcacaacagaaggcctagccgaggaaggcggggtgctgaacggtgcacgaaaccctgaagcaatcggcaagtgaaacggctcacttatatatgcgaggcatgtacagaaatagtaataaaaatacttacctccgtgcggagggggagtcggcctaggaacgtgcgcagctggacggggaccagtcggtacgggtggccgctgtacagctgcgtctgcccgagcaacgtcgtctgcacgacaggtgagcactcggagaatcgagcgcatcgactccaccatccgcgtgtacgtcgtcaggtgctcctctacgggtaccggaatccccgcgcctaaacgttggatcgtcgttgaaccgtcaacgacgacccggttgatgtcgtcgacctgcatggttaatttgttcgtaaatattcgtaaaatttgacgaagagaaagacatgaaaacataaaggaatggtgcgatgcagggtactcacagcacgagcgaagtcctggtcgcggtgcctggcatagaggtctctagtgctcgcaacgtggggctgctgctccaagggagcgaaggtgaccctagtacgggtgcgtggttggtaccagcgtaggtaggcctggtacgactcctcagtgtgtggctctccctcgtggtccacgacctcctcggttgcgagcaaccagtcctcaacaaaagtcgccaacttggcgggccagtcgccagctgactgctgacccttgcgcgagtacctgcgaattaatgtgtaatattagtgtgaaacgacagatgttacaaattattgtgaacaggcagattttaatgcaacaacggaaagcgtagtgcaagatcttaccggtgaacagcagctgggacggtggtcggaaacggtactggaaagggctgacggaagccgaactgccgcatcacgcggaaaggggcgtgaggctcaacgcagatgtcgaagaccatcggaaccgtagtcatccagtacgcctggtccctggtgcagagtgtggacagacccaacggcgcacgagcctgggtagccgtggcactgtagggctcccacacgacgtcagtcggcagaaggcggtcgaactccataacaaactcaggatacgaccgcctaacctggacgtgagcccatcggcgctgcaatacgagacgatcgatgtgatgtacaatgaacttagcaattaacttaacaatacgataagatcgatgcaacgtacctgacgacggcaccacaaagtacccatcgtagggtagtcgacctctggtcgctcctcgtacagtgactcctcgtacgcgtgctggtccacctcagggcggccgatcgcaatcctctcagctgcccagatagaaagaaagagagggcacccaccaaaggtcgcgctgggatccgtcttcgtgcaagactcacaaagtgcacggtacagagccgccaacaacgcggaaccccagctccactgagacacctcgcctaccgcgacgtcagcgatgctcctggcgtagtgcacaagtcccttgtcgaccgcgtgcccgtgaccgccacagaacatcacccagccaaaaagccagagcaagtccgcctccaaacatcggctgtaggagtactcgtcggcctccgcctgtagctgctcaacctgcaagccgtcgataaaatgttaggcaccttaactgcggactaaatatgtaatacgattgtcatttcggtacaaaaacactcacggtgaactgaagcagccaccttttcgtaggtccggtgttgcggtggtgtgccaacggctcgaatgggaggtgcggtgcgcgctgtactagtgcgaaacgtgccgtcagatcatcctgccagtccacagccgtggtcactggcccaacagcgtctcccgcgagcggtagccccaataagtacgatacgtcctgtatggtaggggctacctcaccgcacggcaagtgaaaagtgtgcgtctctggcctccatcgatcgaccaaagctgctaggagggacctgtccacagtccatcgtctggccgggtccgcgtcaccggccgcagcctccaccagccgacacatcggtaggaggccggcctcacgtagcctgcaataacaaattaatatgtcattataaaaaatattatagtgcaactaacttatagtaaaacactattcgtacctctcgacaaaggagtcgtgaaccgtgagtagctcaccgcacgtccgtgcccggaacgtcccaagctgagccccctgcaccgcagtaaggtgagaccggtgtcggtgatctatcgccgggtccaacaactgaggtgtatcctgacgtgccatctctgaaaaatatagtgtttcgtgttagaacaattcaaaaaatagtactgtaaaacaaaagataacttgcaaaattatgaaatagtaataaaatcatgagattaattatgtacaacaagagtacaggctatttaaatatagcaaacgttactaatggtacataacgatgacatgcaatttaacatatatgtagagttcaataatataacataacattacgtgtcgaagtccgacatacatcagcatacctaaagacgttaggcgccttagtccgacgttacatcacgagacctaaagacatgacatgccgaagtctgacattacacgacgaaacataaacacatcgataagttcgaaacgaattacaagcaaatccacatgccgacatagaacataaaaactacaccacgtagccagacgtggcacgacgacgcctaggacgtggtcgagtggaggtagtgccttcacccgtagggcgagctccatctgctgctgatcctaatagtcctgcctccgccgcacttggtttctccttgtctttaggacaatgcttgtaggtgtgcccatgttcatcgcatttgctgcaacgcttcaccctgccagcctccgactcgtccatatcgttgcggatgcgacgagtcctcctccttccagccttgcctcggagcttcgatgggtcaggaatattgagtacttcattgttagtctctgtgaactccccagctatgccgaacccataaatctcgccgctccatgtatgatatattacttgcttactgaagtactgtgacacatatactgcatctggtatgccacactccgctgcggcagcaatgacatgggtgcatggcctgtggagcagcttcggctttgcacaagagcaatgacatgtgccgtcggctttgagaacacactcctgcttcactctcttgcggtagatacccctgcctgccttatcttgacatagtatctcaaacctgtgctgttgggtaccttgcactagagctcgatgtttcatggcctttttacgcaactcctctagctttttctgcatgaaagctccaaacaaaatgctgttgttcggcatagagggaagaacttcctggaaccgatccctaaaatacctgcatgttccatgtaaaatgaactccactatgccaactagtggcagtccacggacaccgcgcatcacccagttgtaaacttctgccaaatttgttgtcattattccatatctagcaccacctgtgtcatacgccttggcccatttctcttttggttcatgcagaatccactgagaaaatttccgaatctccaatccagttcttctaaccaatgttggactatccgttgggagaggtccaagagcttgaggagggtcagcaacggcggtcgatggagccgctgcacgctgatcactgcatttggctgtcaactcatctaatctcttccaaagctcattgaattttttctcctggttctgattgcacagcctcttgaacatgttcatgagctccttgttcttgaattgcttgaagaaattagctcccatatgacgcatgcaccacctactctatacatcttcccaaataccggggtatcctcattccatactcccaaactgcaactctcctatcgctcacagaatgccagcgtgcctatcatgtatcaggcatacatttggcctcataccaacaacttttgttttaaccaatttcaggaaccagtaccagctgtcggtattctcactctcaacaaaagcaaatgccaagggcaatacctgattgttcccatctacccctattgctgttagtatctggccccgatactttcctgtcaagaatgtcccatcaatgcagagaacaggacaacagttcacgaatgccatcttgcatgcatgtagagctaagaacgccctttgcagcacactcttgtcaggatgttcaattgaggggaatttcttcacttcgtaagagctcccagggtttctttcctcgataacaccaagcaggcgtggcaaattgtcatacgaggcttcgtaagttccaaatctcatctctattattttctgtttggccctccaggccttggcatagctaatagtatacttgtatgtctcttcaatgtgtcggattattgaccttggttcatatgtgagattatcgatgacatgc

SEQ ID NO: 59563 - DNA, 4968 bp, Oryza sativa
  unsure (1)..(4968): unsure at all n locations
attaatatccgtctcatcatctgacgaatcaccttcctctacacgctcgttgtcagaatcgtccctctccatttcatccacaatggcaccgacagtctccccctcgtcggccactccacttggttgaatgcccactggagctactacgcccccgtcctctcgtgcgttgacctcctccacagaagtctcgtttacttcagcacttggtccctcgccatcatccatgttcgtctgcacacctggatcctttgggtgaacaaacggaaccaaagctagaggccacccgcgttgcaatgcattttccaaataccatctccacactcgagagttttgaactggcattagttcccaataaaaaccctcagttgcccgacttactataacattgattgttatgtcacttgtctgtggatcaactctgaagcccctcattaaccatccttttatagaaggtacactcctctcagccggtctatcaattcccctttctgatacaataaaatctgacagatctaccccagttggcccgtaacgaacgtttcctggtccatggtaaacttggaatatttgtttgttcgacatatctgtcaacgaaataactagatcatattactctttcatgcaataaacatctacaacgtaatatcttcttgtgtaagccaatgcaacggtaatgtattaattccaaactagcagatctacgtagttaccgatatctacaatacacacttctagattagtacaactaaaaccctaaaaatataatgcatttattcaaacaaatttttaaagaatacacactatttaactcaatagtcacatataggatctatgaatattacctgaaatcggtgtctgaatccggcagggcttcgccccttcttctcttctcctcccctctcttctttttttttcactggaattgaggagagaagaatgacggctgggggatgggcagcaggccttttataggcaacgaggcctgccgcccggccagagggcggcaaggggccgcctgcaaaatagccggccccgactggctttttttgcattcgggccccttgccgcggggttttcctaaaaaaaaaccctccctctgtcaccgcccgttcctcccccgtttgccacgtcagcttgtcgccctagaggtgggcggtaggggctatttctgcaattttttggtcgatatattatttctgtaaatattaaaaaaaataatctaaaaccgaaaaaaattctcgtcaaatctatctcggcccaaaattgcgggcacctcacctaccaggacaggaccccggcccacgccacaggtggcggccgccgccgcgcgccgcagccgcctcctcggcttcccacggatcggacgggtcgcagactcgcggcgcacactggcacccgatttgttggtttcttacccctcctacaaggcggccggacgcccacagatcggatcggtcatcaactcatcatcgccccccttcaaaaggccacccccctccccctcccttctcgcctcattccccacagccgccgcctccttcctctcctcgatctccctattcgtcgtagcctcctccctcgttcgctccgcccgcaaccatgtcggcctactgcggcaagtacaagggtatggatccatccatccatcagcattcttctccatgtcgttctcctctctccatctgttcgtgctttcagttgcgtgctgtttagatctagttcttgtgttgggttttcggggtgagtttgttagtagatctgttcgggaacagtaaatcgatggagtggcgtttatttatgtgatcgtaatcgtgaaatcttttgttgtgtctataggttaaagattggttactagttgacttactgtatgccatattggcttagtttatacataagggttctttagtgataagtggagcagatcttgttcttgtgtgttaaaagattgattataaaacatattttctgccatattgatttagtttatgcatagtgtttctttagttataacttataagtcgtgtagtatctgtgacagaaataagttggttgatctagatgacgtgcatgttctgttagcagaaattttctatctatattgatctgttcaagtgatttaaattatgcatagtgtttctttagttataagtcgtgtattatttgggacagaaataagttgggttgatctagacatgcatgttctgttagcagaaattttatatctaatattgatctgttcaagtgacagcctttcggtggtctagttgagcattggacatagtttatgcctggcaatttggatagatctattatttaggccatacagagatgctgctttttttttgttaataatatagtgtttgccatcttgcagacgagctcatcaagaacgctgcctacattggcactcctgcaagggtatccttgctgcggatgagtccactggcaccattggcaagcgcttcgccagcatcaacgtcgagaacgttgaggagaaccgccgctccctccgcgagctcctcttctgcacccctggcgccctccagtacctcagcggcgtgatcctcttcgaggagaccctgtaccagaagaccaaggatggcaagcccttcgtcgatgtcctcaaggagggtggtgtcctcccgggcatcaaggtggacaagggcacaatcgaggttgccggcaccgagaaggagaccaccacccagggccatgatgaccttggcaagagatgcgccaagtactacgaggctggtgcccgcttcgccaagtggcgcgccgtcctcaagatcggccccaacgagccgtcgcagctcgccattgatctgaatgcgcagggcctcgctcgctacgccatcatctgccaggagaacgggctggtgccgatcgtcgagcccgagatccttgttgatggccctcacgacatcgaccgctgcgcctacgtctcggaggtggtcctcgctgcgtgctacaaggccctcaacgagcaccatgtcctcctcgagggtaccctcctcaagcccaacatggtcaccccaggctctgacgccaagaaggtgtctcccgaggtcatcgctgagtacaccgtccgcaccctccagaggaccgtccccgctgccgtgcccgccatcgtcttcctgtccggtgggcagagcgaggaggaggcgaccctgaacctcaacgccatgaacaagctcagcaccaagaagccgtggtcgctgtccttctccttcggccgtgccctccagcagagcacgctcaaggcctggtccggcaaggcggagaacattgagaaggccagggcggccttccttaccaggtgcaaggccaactccgaggctaccctcggtacatacaagggtgacgctgtcctcggcgagggcgcctccgagagccttcacgtcaaggactacaagtactgatttgccttgggaggtgctggctaccattggaacattctgcggctgttgcttaatgtggttttgatatctagagggcaatctatggttatctaaaatgtcttgtcgtaataattctggaacctttttgtgtaacacattaccaaatatcaattgcctggattgaaatatcgtttttatcagttctctgtgtgatggatgattttgctggatggaattaggctctgtttagtttccaaaacaaaaattttcaccctatcccatcgaatatttgacacattacgtgtaaattgtgagacaaaacatgatggattaattagacttaataaatttatctcgtagttgtaatctgatataaatgtatatctatatatccgatgtgacatcttaaattttttttttttttgccaactaaacaaggcgacaccccaaaacaatttttttcccaactaaataaggccttaaaccgctactcggcagatttagtgtaaatagcaatttggtctagtagacgttaccccaattttgcgatcaccttggaaatcgctggaccttatcagctcaatcgaagctatgcttcaaggcagattcaccaccctacctaagtccaccaaaacaaaatgccacaggcgtggaaaatccataaatcgataaaatgtaaagtaaattcggataacttctgccgtgagagaactgctgtagcaattcagcttcattgtacaaccatcaatgctataacattagcataagatatggaaaattttaaaatcttcatccaacatgtaagcagaatggatattgaccatgtatctcctagtaatggggcctacagtccgacaaaattctcctaaactacgggctggtttggtttgaggcctaaattaggcttaccaatattttgcaatttcaatagtatttagtatctatttggtttgaagccaaattttggcatatctaagaaaatagaccatttcaatagtgaacttaggttattttggcttcaatccaaacacaactttgccttaccaaaattagtcatgccaaaacttatcaaaatttggcactgacaaaatttggtaaggcctatttagattgaaactatgccagtggagcaaaaaattgaagtgaaggaaaaaaaaacaagatcctattcgtgttttttctcccgatttgcaattgcctgtttctgacgcttctcccatgctggcatcttgcctgggaacgcccatcgcaaaatccgctcccatccatagcagccacaaaacataaggatagcccaaagcatcagtttgcccctcattccttcaggcaggggttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 59564 - DNA, 10069 bp, Oryza sativa
cagtgtttgctatgattaaagatcttaaagtagtgttcggaaaggggcctggaagccagcctatagagagcgaagatagtcacgcggcgatgtggaaaaagaactctatattttgggagttaccatatcgggaattcttggacgtacgccacgcaatcgacgtgatgcacctcactaagaacctttgcgtaaaccttcttggcttcctaggtgtatacggaaagtcaaaagatacactggaagcacgtaatgatctgaagcatatggaacaacgcggcgaccttcacccggaaccaaaggagaaaggaagccattacttgagtccagccagctacactctaagcaaggcagagaaggaaagtatatttgaatacttggagagcataaaggtaccgtctggatactccacgaatatcaagcgaataataagcatgaaggagaagaagttcacaaacctaaaatctcatgactgtcacgtgttgatgacacaactgctaccagttgtaataaggggtatccttccagaaaatgtccgggcaacaataacaaagctatgtgcattcatgaacgcaatttcgcagaaggtcatcgatccggatagattagaagcccttcagaatgaagtggtgcaatgtctcggcaagtttgagttgatatttctaccttcatttttcaatataatgacgcatctgctttgtcaccttgtgaaagagatccgtattctcaggcctgtgtacctacacaacatgtttcctttcgagaggtacatgggcgttctgaaaagtatgttcgtaaccgtgctcgtccagaggcaagcatcgccaagggttatggaacagaggaggtcatcgaattttgcgcagaatttatcgaagaccttcgcccaatcggggtacctgaatcacgccatgaagggagactacggggaaagggaactctcggaaggaaaagcaataatgacggtagacaacaatttattccgtaaagcccatttcactgttctgcaacactcttcattggtagctccttacatcgaggagcacttggctctagttcgcgccaggaacatcggtaagtccgatgcatggattacatggcatcacattgatactttccccacgtggctacgacaacatctcatgggtaacgagtcaatcaaccaacaacttgccttcctggcgaggggaccgtctgggtcgatcgcgacattccagggatatgagatcaatgggtacacattctacacgagagcccaagacatgaagagcacgaaccaaaacagcgctgttcgtgtcgatgccatgggacacgatgcaacaactgccacgtattacggtgccatcgaggatatatgggaacttgactatggtcctctcaaggttcctttgttctggtgccaacgggttaggttgactggtggaggcataatgattgatgacagtggtatgacaactgttgaccttaacaaggttggatactcggacgaaccttttgtccttgccaatgatgtaacgcaagtctttttcgtgaaggacatgtctagcaaaggaaagaagggcagagggcctaatgagcctaagcgtcaagtggttctcccaggcaaaagaaaaatcgtcggagctgaggacaagactgacgaggattacgatcagttggataggcaaccccctttcacggtgacgattgaccctagcatcctcctatcaaatgaagacaccccttactcacgcagcgatcacaaggagggaacaatagtaaggagaaagtacgtgcggtcaatcgtcactgccgatgtaatgccgtaattattgtgtacacgatgtaaactattttggatgtattgattatccatataaatcaattgatgtatggcataatttactatcattcatatgctacatttaattgaatatcattcatatgctaattataattgactagaaaatttttaaaagtattaaatcattcatgtggcatttacagatgttaattagagtttttcacaatttaatttactatctttcatatgctacttatatatgactattcgaatttttaaaagttttaaatcatgcatgtggcatttacatatgttaattagagtttttaacatttaatttaatataattcctacgctaagtatatatgatgattacaatttttattaattttaaatcatgtagtatgtacatataaatcttaattagagtttttaccaatttaataatatcattcatatgctaagtatatatgattattagaatttttattaattttaagtcatatatttgcttattacgatttatccacttaatttattacagacaaaaataatttttcaaagtaattgtcattaatctttgtactttaaataatgttaatgcattaacttctattttagaaacacatatgtaagcaaaaataatatgcagtgctataatctttagtccaggttcttaaccctaaccgggtttaaaaagaatttggaaatagcgggaaaatatatttagtcccagttgatgagaacaacgatctttagtcccggttattctcaacaaccgggagtaaagatatctttacttccggttgttctcatcaaccgggactaaagatcgagggctatatatattcccgaagcgcgccctcgtcttctccaccaacacttaacgttttcggtcgatcgatctctctcggcctctctccttcgccgccactgcctagggcaaatccccgcgccgacgccaccgtatctcaccgtcgtctcgagctcgtcgtcctcgccgccacctccgcctcctccgccgccgccgcatctctggggtgagagccgccgccgcctctcccttcatcgatctccgatctcgatctctctctccgtcgtgccgcccgccacgagacgccgtgccacaacgacaccgcgccacgccgacgccgcgccacgccgccgccttcgccgccgcgcgcgcaaccccgccgcctccacgccacgccgccgcgcaacgccgccgccgcatgcaacgccacgccgccgccgtcgtcgccacgccgacgccgccgccaccgccgccacgccgccgcgccaagcgccggaccgatgccgccacaccgccgttaacgaacacgtgaacgagaacgaacacgtcaatatacgttgccgcgagaacgtgaacgagaacgagaacgatcgaacgaaggagagcgagaacgagaacgatcgaacgaattaacgtgaacgagaacgacaacgaacgtgtacgagaacgaacgtgaatgagaacgagcgaatgaatgtgaacgtgaaatgcaatatatatatatgttacttcgcatttatcctaatacatattttttgtatcttgcagaaaagacgtgttgtcggagtcgtccctcaagccggagtggaagagctagccctagaaggaattcgtgcaggcaagtgacgtaataatataaatgattgttatatttgtaatgcaattaagaatattagacttgtaattagacttagcatataagattgtgtagtgttctaatattatttgagttttaatataagattattttattgcaaattagacttagtatgtaattattgactacggaattggtgcgactcctagcaattgactattgtagtcttaattagacttagcatatacgcacgaaacacttagcatacatgactattttagtcttagcatgtaatattatttgatttttaatataagattattttatttgtaattagacttagtatataattactgactacggaattggtgcgactcctagcaattgacaatttttgtcttaattagacttagcatatacgccagttacacttagcatacatgactctttcagtcttagcatgtaatattatttgagttttaatataatattattttatttgtaattagacttagtatataattatttactagctagggttgtataatatacgtcacctagacttagcttatatcacgatttgtaattagacttagcacgtaaggttgtgtagggttctaatgtacgacatttacacttagcatacatgacttagattgttaaaacataaatgtctcgtgacttagcagatgtttcttgtatcaacagatggctgaccgcgatgaggaacagatattgtacgatacaatcgcggagggaagcagccagtactggaatgaagaagaggggaacgaggatccaaatcagtacttgaacgagaaagggaacgtggagagggatgcggaggggaaccagcaggggcacgtggaaagggatgtggaggggaaccaggaggaggaggctagtggtagtcaaccctccgttggacagaagagggcacgcgggcaacgaggtgcagcgaagaagcttgagggtcggcacatcataatggaagtggaagaagatggacgtcctagtgccccggccgtagccgccaagaactatgtacgtcacagcggttgggttgtgcgggataacgtgcctgtcagtacggtgtactggcgaagaacaaggacacgcggagatcatgagagctttgtcctagattcggagaaagagatgctgtggaccataatgctcgagacattcacccttcccgcgggtacagaggacaaagtgaaaaggtggactctgaagaaaatggcagaacagtttcagagcttcaagggagagctgtacaagaaatatatcctgaaggggcagacaccgaacttcgacacattcccaaagctaagggatcactgggacgagttcgttgcatataagacaggtgaacaagggcaggcgatgatggaaagaaacaaagaaaatgccgccaagaagaagtaccatcactacttggggtcaggaggctatagcgtcacgatgccgaagtgggaggagatggaggctatcttgattgagaggggtatcgaaccggcaaccgccaattggccggaacgatcgaagttctggtactatgctcatggtggaacgctcaacccagctgatggctcactggtcttcggcgatcagatacgagaggctgcgcgacgactaacagatgcagtggaagcctcctctcagggcacgttccgatcggacagatatagggacgagctgacactcgccctgtagactccagagcatccaggacgaacacgagggaaaggggtgattccttagaagattggtttcaaggaggacatccacacgtacaggagtcggatgaggagtaagagagataccgaggcgaagattgcagatctagagttccgggtatcgagctacgaactcagcatgcaagaggaggtgacaaggaaggttgatgaacgcatagccgcacatcggtcccatgatccccagccgaccattcctcctgcaatgatgagcccgtcaggaaaccgtagcagctgtgccttaacggggcaggtaggattacagagcatggacgccattcaaacacaggacgaatcgacctgtcccgttgatgacatcactcagcagacaccatctgagctgcatattccttacaagaacttatcaataaaggtaagctcgtagtttatatattttagatttagccattccgctagttgctgcttatatatgttgattactaataaaaaatatctcacaacatgaaggtggcgtcgggcatggccatcccaacggacccttcaggtacttaccactgcaggccgattccagcaggatactcgaaggtcgaagttgagttggtcgaaggcgcatacgaggacctcgagctggattaccctggaggagacggtgagacgcatctacgagacacaagccatgccattattctatggcgcaggcggtacatcatcctccctgggcgacaagcggcgtctcgtgcaccatctcctcctcaggatcttgcaccgtctcctcctcatgatccgccagcaccgtctccaccttaggctccagcaccgactcctcctcaggatcctgcaccgactcctcctcgggctcctacacctactcctccgcaagctcctcttccggcaccttcaaagtcaagggcccccccccagctccaccgcctgcccacacaagggcaacgaagaaggcgaaagttgacgccgccaagaacaaggacccggggtacgattgcacgcaagaggagcttgacgcttacgttgcatcagaagtcaagagacaattcaagcctcgaagtccagaaaagaagattcctatagaccctagtgtcaggaacttcttcaggggtatgtctgcatctgtcaaggaggccatcaagctatcggactatgagcgaacgctgaagaaagcatcttctggaaagtccaaaccagtccctcagcttggagagcgaccaaaccaggagatcgagccgttggtgaccggtaaagaaatgatgatagaacaatttattactgacaccggtctaactacggatcaattgctaggagtcgcaccaatcgaaaagacggaagtgaaatacatgtacgaactcggtaaaccgcttgtcaagcctgagctgctgcagtccctacccacacaaatgtacaagttccatcagctgtacatggagatgagcgccaccggtagagagatgatcggagcgaggatcagggacacggacttcttgcaaggagatgacattctctggatcaatttcaggggaatcaacgaactataccagctggacgccctcgacatctctattatgagttgctaaattttgtaagtatatcgttcagttaatttcttactatacgtctcctttaattaattatgtccttgtatataagtagactatagaaaataatatactcccttttatcgttgtagaatggagattcaaagggcccgacggcggagggttttcgatactggattcatcgaccctcggaaagtaaacgtcgcaatgctcgaccaatatccacaagaaacagaggacaatctcgtccctctcctgaaggcgcagcattacaagacgttcatactgttgccatacaacacagagttagtttaattttactgtcttcctacataccaaatttcattcccgtacgaacttgctaagtgtttcatatgtaatgcatcccacgcacattgcagattccactgggtgcttttactcttcgacctggaggcctgcaccgtcaacgtatatgactcaatggataaaaaagagtctacgtttgacaaggttttcgaacttatagacaggtaccgtcataagttcctttgttaattaagaaaatcttgttatgttaattgctactacgaatcatagctttaaactccatgtagggcttggtatcggttccgtcatttggtccgcggcaaatggagagaaagacttaggcggaagttcaaatttcctgtgagtacacatgctctacatttatatttctccgattcaaatacatacaagtgtatattaattagatctctcgttgtttgtcatttatttgtagtgcgcaaagcaaaagcagggaactaacttgtgcggctattacgtgtgcgagtattgccactgccttgcagaccaaatcatcaccacaagagagctcgatgtacgtacaaataaattcaaaatttcattacgtagcgatttcttgtttaattactaatcaatttcatacattcatatagtttattcgcatgagggataacctgaccacacacaaggaatttatcgcggcggttcaagaacaactcatgggattcatcaacgaagaaatccttgatcccaagggtgaattctactacgacggaaacacaattcaccggtccttagcttctgagctagcagcgagtactactacgtcgaaatcgtagctagctaggacatataatggattgtaattaatacatgactacatatgtttctatatgcatgtgtacacattttctataatgtaaatatattttggtcatatatatatatatatatatacacacacacacacacacacacacacacacacacacacacacacacacacacacacacacacacacatatatatatatagatatatacacatatgcatgagcataagatatatatgtagaaatatatatgtattaggcatgaacatatgtactgaaccaggtatacatagaatatatatatatatatatatatatatatatatatatatatatatatatatatatatatatatatatatatattattagaatagttctatcttacactcttcctttgggattaaataaatacgatacctttataatactttcgggcgaaatgctacaatggtatatccgtgcgcttgtggatcctttctgtaaaccatatatataccaggaccatttctagcgtcattgctagacattcatatttctagtaatattgttaagaaataccaacaggtgttaacagcgaaatttggcaagatagactcggatttcgagttggaattgaaggggaatcaaagaagattggatctttccaaatatggattacgcatcggttgggcattgcatcggttggaaatagagttggagtctgatttagccgatttgacaagtagccgactagcctgacttgggctcggtttgggcctcgattgagatgaccgtcattgtcgtttagagatagagctcatttaaggcaattgtatctattaattaggatatttatatcggtttgagttagagatatggtaagagtccatggtatggacttgtttgtattttatctttaggaaagcttgagtcgtgtccataatggacaagttttgtactcggggtaaaaatataaaccccagaccattgtaataggggagacaatccaatcaatacaactttcagcgtatcgccacccttttcttttacttttcgacgagttcttatttcaagttggggcatcggctacgatctctcgacaacaaaatagttataacacaacaaatttaataaagcgaatgtaataatttaagtcaaaatacatttcgcaaattatgtttcaatatgctcaaggagagcgtgactgaccttagtcaacgaacagttttctgctgccacaaacgatggacctaaattgcgagatgggaacctctaaaatgatagcaactacaccaataacaaaacaagactaaaactctaagaaagaaatgatcacattacataaaaataacatttttgggccctttaagttataaaaaattaagcaatttaaacgggtcaatttggacctcgtatggccaagatacgaccatccaaaatttagctataatttaaatggagacttccaaattatttaatcattattgtactattaaattatgtgtaatacatcagcgctcgaggagagaaaggaccgagcaactgattgtcgagacccatgggtaaaacaggtagttcaccaaggactgggttccccgagatggtccatggtaaaagcagagataagaacattcttcgagtcggtgagggcgacgcaacttcatcgaacgacgtgctcaaaggaggggatggtgttcctgaggtcttgataaaccctgagctgcactcaatacactcacggctatgattggcctgatctttcggggagttgatgataactctaatttgggagaacttactacaaccgtacgagacgctattgtgttgtgccttagcgatcgatacaccactccgtgggttgttgatcttgctggtgcaaatcaaccttatgactgcaagcaaatcaaataaacaagtaagaacaagataaaaaaaaaggtaatctgaattgctcataggaattgaatacacacaataacttgatatggaggcatgctcaaggaagagatcgacgaggcgtaattgacggcgacgacgatgcagcgggacaatgcttcggtgagtcgggaaaggttgccggaggaggaaggcgatggcatcaccactggtcactggcgagaacggttttctagcttgttttgggctcgacgaaggggagcctggggaacaggaggtggctgcaacaccaagggtggcagcgccggggtgctgcgtttcctccggtcgaaggggaggggttgccggagctcgtgtcatggtggagagagag

SEQ ID NO: 59565 - DNA, 13265 bp, Oryza sativa
tttaggtggagctgaaattgtttggttgagctccaattccaggagatgtggaggtggtgttgtgccaaaatactccccccgtcccacaaagactttatttttgggtttctgtatccaacgtttgaccgtatgtcttattaaaaaaatttatgaaaagaatttaaaattagtcacttataaagtattattcatgttttattactaaataataataataataatcattgaaaatttttaaataagacgaaaaatcaaactttatataaaagttgaaaaatggagtctttgtgggacatagagaatagtagataagctataaggttatatatgttttccttcttctttctatctctcacatatgcatttaatgtatttagcttgaagcatgtgaacagataaattttgcatgagagttaaccctttttatttttcaaattctctcactacttatcctactattaaacttaaactggctcttaaaatgaacaacttctggacgtatctcggcaaaaaatttatccatagaagttaatttcttttgggacggagggtacagtgctaaaaatttttaattaggatgtgcaatgtaatactcttttcatgttcgtaatacttatcgatcgttttgaacaagtctaatgtgaaattttaaaatctttaattataaattatttctaaaatatccatatgtatagtttaatttttaaaattactctaataaaatagtatatttattaatatttttatatgtattataatagaaaatagtggtcaaacattactttttattatgttcttgttaaaacgacaagtaccatcaaaatgaagacacaactatcctggaaaaatcacggtggaccatacaaataggtttaggtcgttgcaattgcaggggcatcacactccaaattcctcaagtcgaacctctgaagtgatgacagtataatcgatagtagcttggatttttcctaaagcagctattggcacgttctaattaaggaagggagttgggaaccggcggaactcctcacgatacattgggcagtggaaaaaataaaaaatagtttaggggtaaaacttttatatttatgtttattagaggtttataaaacaatgctgaaaaatgaagtatgataaaagaaactcaatcaacttaaaaattaagttttaaaatctaatttataattatggaagctaaacgatgagaagataagaaaaggatcatgtttaaatactaaatggcaagagctgattaactatatactagtatagactatgtgtttctgatgttacaaacagttttcttttagggggtgggaggggggggggatgttacctcaaattctgtgtcacaactcacaaggttgcaagagtgcacgaccaaatgtcactgcattcatcagcgaaaaacctctctcgcaagttgtactatcaactagtactatcaagtggatgacaggaatggacaaattaaatttgctgagctgagaattttttcagttttacgttatagtagttgcataaacactaataaataaatacacaacgaggatatggatgatatattactgttaaacgcatgttaaacgtacaccttaaaatgtatgtgctcgttggtatgtaaatataaggtaatgttcgtttctacttaagataaaaataaagaagttagaacaccaaaaataagaaaaccattaacgtataattagttgagttttaattgttataaacttaacgaatagttttattcaatattttacagtaacttctacatatataaaaaaattttccgcgaaatatattatttagctgtttaaaaagcgtgagttgatcaaaccgaggtagcatgaagaagatgcctatatggtcgcaggttttcgtgtatgtctttcgtgatcgataaaaaaaggcgagattttaacgctacaacaaattatctggcggtatcttctcttcctgccagccgtgcgcttccctacgtaactcgcttgtcctgtgactcctgtccgatcgtccgtatggcatctcgaactgatcctccgttcccttcaagcaactgctacatgccgctttcctgcagcgctcactcgcgtccgtggcgcggaaaaaaacggcttcctgtgcgtgcgctcccgcgccgtgtcagcttccagctgcctctgttctctccgtgacgccgatggcgagagctatagcgcaggagaatttatggcgctcacgccgtgtcagctagagctcgaaccctcgaacgctcgagcggaaaaaaaacgcttgggcgagcctcgcgccacggcatccgggggtcgacggcgatggatctccgatagcgacccgagccgagccgcgcctctcgatcgcgatcttgggtgagtaaagcacggaagcttcgcgcttaattgggagaccgcgaatctgatgtaagcgctgcagtaagactgggatgggacaggttaattcgatccgcggcaactatcaccggtttcttgtttccatgcatggctgcatcaagtaagtttatgcagttgtaaaaacggatttgaacattgatgttatatatgtaaaacagttctgtcaagttgggcatttgtcaatgtcaaaggacctttcggtattagtaccgcaagttacttacaccaatcaattcaccgatgagaagcttaaatttgctatacaattggaattacctgtggctgtagtccgtcaaaacacacaggtgcgtaatacactcaaccggcttcttgtcgtttggacgttcatgtcagatatgtaactagccccaactgagctaaactaaactcgacaagtccatcttgtgttgcactaactagcaagttgcctagttggcagctaaatcaatgcatgtaaacctatcctacaataggaaaagagagcagattccctttacagagctagaaaactcttgagtcagtataacctctctgtctctgtgcattgtatttgtagtctgctcaaaatgaggtgtttgagtgctacatctcagtcgaggcaggggcatccaaagtttcacacataaaaacatgtgacaccataaagctcatccatatgacctctcgatagaaaggaaaagcatcatcctgatttggtggtgtcggtgttaacttatggcgaaatcacatattaattcgatccggtgcgcaccgagccacgtacaactgcactaagtaaagggggacacaacatggccaatcagcaaaggttcttctctgatggttaggttacaccggtgtagcaacctcctctttatctaatggcagattgtttgttttccctgttaagagtaagagagctcttgaattcaaagaaagtagccttaagtggagatgaagtcactagccaattaacaaagccatgcatatggcattggtagaatggttcacttgacagcttcagaatatgtatacaattgagctggctagtatgccattggttttcagttggaacctctcctgtagactgtagtttaattacatctatcctctgctgctctatttgcacctgcatatatacttgcataatacttggtggtcaacgcacgtaaaagaagatgccaaatgaaaaatgcccttctgatttgtacctgaaaacgaacgctggccatacgtatactacttgaaagcgagagcgccgctgcatccactgacgactgaaacataccattcagctttcagccggatgccccgggttgcactttgcaagaacagtttcggcaaggatcgcggtttctttctggaagagtgggtaaaaaatttcagacagaacgatacgacggttgtatcttctgttgttccctctgctacccttctctctgcaagcatgcctagttgatgtaactgatcttttgtcgtcgaccttttttatccctttttatcctcacccgttttaaaaaaaaatgttgcaaagtcaaaaggaggccacatgagcagcagagcaggtccatttactggcaaaaagcgtgagcacgcatacagttcagttctaatctaggaggatcagtcccaatttggatagtgacacctcccaacatgttctagaaaacagggtaaccgtcaacacaggtcacttatttaaaatcacataaagtattacctggtattataaaacgcacatgaaaaaaaaaaaaagggagcagtcctgtaatggataattatataggtataacttgcaggagtcgggacttagagggtgtttgggacttatgtttctgagagcctctctctctctcccaaacacccccttagtcataagtaagatccccgcataaacataaagaacttaccaccataattattgtccgatcatttctcgagatttggtgagatcatgattggccatgtatgggacagtccctcccattcccatcttaccatatatgtacatgatctacgagtatatgtgagaggacacatttgccatcgctttgcttgcctgctcgatatggaatgtcagcacgaacagggcactgcacatagcaagccagtgcactgcaacgacaaggttacgtgcagtgaatggctatacaagttgctgcctatcctgagagccggggaccaacgggccgcgcggcactttcgcggcttttggttgatgtgcgtgacgataattggctagtgcgccgggcagcctcgtcgcagtatgcgtgttgtatcacagtatcagccatgggtatgtggaggatttgcatgatatagaacggtagtgagctagctgcgagatcttggtgaggtgacagctgcatgcgggagctagtggcacaccgttggggtcgggtccgtactatgatgtagccttatctcgtagtgcaatggcgcagggcacatccttttcgggttcagcgatgtccacgggcaacctgtcgttagagagatcatgtactggcactatggcgttattgcctagccggtccctcaccgcggaatggtgtactaagctctgatggtgagtattagagttctagcatgggcctggaatcggcagaaagagggatattacgtcccctgtgtaggagggggcttcaagtgctgctagctagtcgagctttagagacctgattttatggtaacgaccacattaagcaatctaacttccatagcctttggctatttcactatttggccataatcctagaaacgttaacaccttgatgaggatgtgtcgtcagtacgaatatcctctttctgtagccggccggaaaccctttctcttgtaccagatcttaaagcagatcacatcagacagtcctgtcccgggggtagatggcgcgttacgggtttaccggttcaacgtgtggctacgtgacgaagaaatactcctataaaacaaaacaaaaaagacgttactaagcgaaaggcccaaacgatctgccgcgccgcgccgccaacgatcccgacgtaacagagctagctactagctagatagtttggtccagccgtttcaccggtggggtgtgcgaaaactgtacacggttacgacggtatacctaaccatacacctcgcgcagccgcgcgtgctgcacccgtcggtccacgcccccccccccccccccgcgcgcgcgtggtagcttggcttgggcgcgcccactcgatcgaacgccgccaaacgtgacggcgacgccggtgcgctcgcgctcgcgcggcgttgggatattctttcgccgggacggcgagaccgcgagatcccccccaccccacccatactactccccaccgcgcggggttcggccgcctcaacgagcggtgatttggctcgcggggtcggtggtttgctcggcgtcggggtcgggctgtctcttggtcggtcgcgcggacgccgagagcgcacggcacggtggcgtcgaagggggcgcattacggcgtagcctcatttgccgaggcaacgcgcgcgagatcgatagattgggctaggggcattatcattggtcagataacggaaccgggggcactactgtcccctgtggaatcgaacgggcatgtcatggctgtcagtgcggataataactaatcaaatccgtaaatgggctcctgcgtgtttgatccggtagcagagtagtagtcccgttcagtcgccagacgtgctgatcgagccaatattgcaagcccctacataactttatgctgcggacgccaacataatccgaccgctacgttccgcagtgaacagtagtcatgggaggaaaaacccaaggcagaaaaacactggacgacccaatgtccggtggtacctaacgaatcaatccacatttcatcgagacaacatgagtcccaaacctacccgattgtttggcttccgtattaatgctgccatcatgtgacatggatgccacataaaaacccgtacgatcatgccgattcagatatgtttccccgctcgagaggccacgcttgctcccctggtcaccggcccctggtctgggtcccaattaacctcagatcattgatcgaattcccccaatacaaatccttcagccacaatctcatatatgctccgaccgtgacgtgctcctatacgcaatcacacaaattcattcatttaatttattcctctcccatgcaatcagtcaactggatggcctaacgactaacgtcagtataccactgtaatttcattaggggaaattaaacatccatatatatgatctgaaaagtgaaaaccgaggcggaatggatcgcagctggtagctagcatggtagtctggtattacggtatagtggtacaagagacgaaagcaaagacgaacacgtacgtaggcgcaccgcacggcggtgtgaacgcggcgcctccatccgcatctacctcggaatcttcgtccgggggcgctcgtccgctacctgagctttgatgccgatacggcgatatgatgcctctcccgtgctgccactagctctctctctctccctctcccgcctatcagcaaccgctccgagcagaaacacacgctacgcttcactgaaatctcttcgctcgcggctagtgtcgcgcgcgtgcatgtcgtcacgttcgtgcgttgggcaccggggcgccgcgcggcgcgcggccgagaccaagcgtagcgtgtgtttctgctcggatcgacaaggacggcgagctaaccggtgtcggtattagcgactcccgagtcatcgatcgccgtctcaggtgcgtgcagtgctagctcgtgtcgcgcgaccgtgcagaggctccgtggcgggcgctggaattctggggcccgtacagccgtttgtacgaacggggaggggtgtctcttcacaggataggatatgtggctacagaagctcgtggctaatgtggtggtattaaaaaaaaacaacggtagagtactggctggaggtgtaggcgcacccgtgtctggcgtccaaagtgagtattttactcgcacgttaggtggaaggctgatactttacatacatttgttgagatgggacaaggtgtggtactcgaggactacggcttttgtggtttcgttagctccaaagatcttcggggaaaatataaaagaattcaagagtacactaggggttattcttttttatttttttatagggagaagccataaaatttaattgataagcatcctaataccaaaaatgctatcgacaagagcaactttccaaaaataccattgcacaaatctctttctctcaaaaataccatcatagtcaaactgttgttaacaactctccgttaaattgtatgaaaagaaattttacccctagacaaccatttgctcacccacatcatcattttgcaatgtttgctcaccggcgcctgcgggccactcctctacgccgtcgtgttgccgcctgttgcggccgacgcaccgccgcctgtggcctcctcgccgcgccccgcgccacgctgctgtggaccgtgacgccgccgccgtggaccgcggcctcgccgccgccaccaccgaccaggagagctgtgccgcagtcgggagagccgtctggatcgggattgaggggtatagggtaaaaaatttcaccatttcatctcttttttcttttaccataaaaactgggtatattttggcccgagggcaatttggtcattataaaaaaatggttgttgcagtgcggaattgatggttatgttgggagaaagaagcttgtgcaatggtatttttgggatgttgctcttgtcgatggcatttctaggattagggtgcttattgatggcatttcatggattttctcttttttatattgagatgcccaaccaagtaattttacaaggattttattttcttgaatgtacattaaacgtgccaaaaagaaaaaaaaacttcatgtcataaaacgtcgtaggagatacgagcagacaagcacaatcataacattaaccaacttcaactcgcgtagaagtatatgagtagacattgaccactatcttcaatcctttaacaattttgcaagctggcatcaccgagcaagttggtgaatcgcaccccaaaggcactcccgttgattggatccttgtcaacgcgacatataagtctttctaaatcttcattgaaaattccacggatatagtagttgtcacataggtagaatagcaaataattctatgacatttctaacttcatagacatcactatagtgataagagacatgtttccttcccttttgccatcagcgaggatgccgaatcaaaggaggggcaccgagaggaaggcttggaccgcgtaggccctatcgtgatttgccacctgagacgaagtccgagagccctatcaacctaggcttgtcaatattttagaaggattttcattgtttaatatgtactactagaagggttttccatcatctaaataatattaatattgaaagctttaatgtacttatcttgaaaatgtgctacatacctagagagaaaataattaagcttgaacgtgaggagagagagaaaaggcatggactagctagctgattgcatgacaaacattcttaggtgcttgcaacgatgacaatgtagcggtgaccaaaatgaccatacgattgacaaacaaagcggggaagataataacaaccattggcgtctaaaatctggtgacttagacatggaaaattgcaggtatgcatctattcaagcttgatggttgtcggtacatagtgctgtagtgttataatgacatctaatacttgtatgtaagggagaatatatatgactagggcgggttggatgcttgtgcaaggtggtgcgtggcgacgtggtatgttggggagtggtatctggtaagcttgaattgttcattgatgctggatgctctacctccttagtccttccaaaggtttcattgggttttacttttttttaatcaattgtcaactttcaggccaaaggattctaaatatcgaactaaaagtcatgcttttatgccccatttgaaacagagaaattttgtagattcaaatcctataggatattttcttcctatttgaccctttgaaacagaggattaaagctttcaaaatcatatgaaattcctaataatggctcaatgcgtatattttaaagaaaagttatcaagagttccaaccttttaattttttcttctttgatcatatctctcatctgattcatatattttctcggtgatctattcaaaagatcatttatgtggcttttctgtattttataataatttgttttacacttttattcttttgaaaatcttatgtttttttattactctgttttcacgatcatgagattcgaaggaacccttaatatgaaatttgaagttctcacatacaaattaaattcactctcgtggctagcaaaacgcgtcaagtggcatggattcattgattggtttttgtgttcgggcacattgaagtctcttttgaaatggagggattttagtggaatttcagaagaattaaattatttctgtaaaatttatataaaatttcgaatgtttcagaatttgaaagaagtgtgaagaggatgaacagaaattgaccctcgatgcttgcgtctagtgtgtgtgccctagaagtcatggctcggaagttaaaaatagaaatagtttgaggtcattgcttaggggaagttacaatatcatcaaaatataatttacaatagcaatatgttaattttaaagtttaagtgaagatatgaaatacaaactcgaaattcagctgccatagttggccctacggcttataagccactcttaaaatttaacagttcaatatttttttcatcgaagtttattttccattgttagcttttataaaagttttgctttcaaatataatttctgtggctgtaaggtcgtccagtttataattagaggtgaaagtttcaagcctttgtaccgaatttaatttgttcgttatatttctcatttgggttgtacttaagaaataatatttggtattttttttctattgtataaagataagcatatgcgtgcggggcaccacatgtacattcatgaccttttgtattagatttttctcgttattcgcgtgcacgctttctaaactattaaatgttgtgtttttttaaaaaaatctataagaaaattgcttttaaaaataaaattaatctatttttaaaatttaaaataattaatagtcaattaatcatacactaatagctcatttcgttttgtatatcttcccaatcttttctttccccttctcctcaaacagttaaactcagttttgacacaaacacacataactgcatatagcttagctcaaatcagagatctaattttcgcgaccgcataaaaagatttcacgtcaatatattagaagaaagagttttacttacacaacgcaatcagccagaccggcttatgctaggaaaagagagaaaaaacaaaataaaaaagttgaagctcagatatctaatgaaggcagcgtatgaaatttccatgattcagcactatcaataaactctttcccttttttgtcataaaaaatagctgaaacctgcataatttcatttccactccattgattcgttccaccgttgagtgtgcccgaaaaatttcttagttccataggacgtgcaggtgcattctgcaggatcaggcagcaaatattattggcgtgagccggtttagcctttcgaggccgggaaagataggccgtgatgagatccttgcctacggccaattctgacctctataactgtagctggcgatagtatcttcctcctgcttctccaaaggtcaactgctactagaggaatcagtctctccttaaaatatctaaaagtgctctcaaaatatgcaacagtcaccttagtaatattacgaagaaagatactactttaggaacatgtacagtacaaaacacatccacatacacactgcctttgtgagtacaaccgaatgactggaccagcatatcttgagatcgatgacgccatcatggataactcgttgtcgaggtacgtcgtctacttttgaaaaaacaaatatcatgagattgacgaagtcacaacggatgcctcattgtcaacgagtactaacccctataaacacacacatcctatctctgtgagcacctacgaagtactgggttaacatatcttgagattgatgaagtcatcatggatgcctcactatagacattcgtcacctaccactgaaaaaataaatatcttaagattgacaaagtcatcacaggcgtctcgttgttgacgagtacgtcgcctaccactgaaagaataattacacctctgaagtactaggtcagcatatcttgagattgatgaagtcatcatggatgcctcactatcgacgtacgtcacctaccactgataaaataaatatcttgagattaaagaagtcatcacgggtgtctcgttgtcgacgagtgcgttgcctaccactgaaagaataattagccgtaaatgcgagcgcctgtgtcgaatttaggatttgaacccatgttaattagccgtaaatacgagaacatgtgttaaatctagaatttgaacccgggtggattggttccatcacaagtaacctaacaaattgagttacgctcacttcaaccacacaaattaagaaaataggttaaattaaatgggaaatattgtgattgattaaaaaaagaaataaggtggaaaaattaaaaaaaatggttataattggttgagatataaaagtatatagagaagttgttatactataaaataaattttaaattgtagaagttgatatacgtggggatggaggaaacaatacctatattgtcttttacaacttaaataattttagaatactaaagttcaattatgagtgtgaatgaatttacatccgcatctcacattctgcggcgaaaggtgccccctgacgacatttttgccacgtaggacccgcatgtcaaccgtaaatgctaaatatcgttctcggtttagtttacatcatctatgcatattatataaaagaatctaaaagtataaaatttgtcaaagggggacagagagagatgggagaaggtatcagctcaacacgtggaccatttaaaagctccttataatatcaccaaacagtgtttgataactagcattatgggttcatcaggacgctaaagtaagatatctcacacctcctgtcattgagttgagtttcgaatgagaagacaaacttgtgcatttagatcgactataatatagccaattatgctcgagttcagattaaataaattatagccaattatgtagcccccggcccggtcactagacgaaggctttgaataatgcaatttggacagtgtcacacagagaggatcgctgacaacatcacgtcatggaagttgctcttgttgagttgttgtcacggccaacaaaacagtaacattaaacacagcacatacgtcaacagttcagtggtctttgcgccttacgttgcccttctgcatcgtgacagttgatttgttttttctagtattactgtcccgttcaagcaaaaatcaaagcagacaaaattctgtggttcttgtttgatattttcccctctgtgattagtgaatgtacggaaatttgcaatagtaaaatcaacaagaggtcttttaagttctcctgccgaaagtctagatctcaaagcttgtcaagttgcacatggcattttcatactgattctgtaacagttaaaccgttctatttggggagggtcataccatatacggtcaactcgtccggcacaggggaaagaaaaatgtgcgcccgtgcctgatgacctattgatgtcgcaagctaagcaggcttcttgattacttccg

SEQ ID NO: 59566 - DNA, 14791 bp, Oryza sativa
  unsure (1)..(14791): unsure at all n locations
gggaactaaactggcccttagtgtataaaagttgtactaatagacttatgttttaaagtggaatcatagtagtagttcgttttaagagcaggctataaacatatttttgaagagataaaggaagagagggaagagcagcaggctacagatttgtaggccagctacagcacggacttcaagacgtaatgtgtgtatgacaggtatgaccaggtattaattgtatagtaagcaactattgtatgaattgggtattagattggctatagatgatttggagctagtagttgactatactattaaacttgctttaatagcatctgggataccatcgatgagaatattttttttttgaaaggatggtaaaagctttgcctggtatatatttatagagaaatagatcgatgagaaattcatgaagaaactttaatgttgaagacttctccaattggaagtatgtccgatatatagaaatcaacacgtacaagtacatggtatattagatatcttaaaggtgctagttaactctaaacacggtgtgcatcaagtagcagcgatgacaggcggagcaagaggctcaaccgcattgcgtctccatgctggtgatgcacagttcctatgaaattaatgttggagctggtaccatgttgtctcttctcaacgaatgatattaattgtattctcttcttcagaatttcctatgtaatttaatatgaatctagattttgaaaataaaattatatctaatactcttgcttaaattttataatcaactacattacatatacaaccatatcgatcaatatacagaccatcgatatcgtatagtgtcaacccatcgtgacaaaatagtgcatattttttggaattaacgtgataatttctacacctctcatcaaatgttgtgttttcttaattttcctcccttgtcatatttttcgcgaacgctcccttgtcatatttggttttaaaagaaacaactttcaaactgtgctgtgataattaagttatgatcaatcgactctcaaatgcgtgccatttcaataacattaatgacgcaaccagctggggtttcgatgaaaatcgttgatcacatgccatataattgagttggtgtgtgtttccccgcagcaaaagcttcctaaaaaggaactccagaacagactcagcgcatgcaccaaccacccagatgtacaagcccttatttaaaccgaaccaaatcagtgccaaattaaaaagtgccattaaactaatggagtagacacagcttgattgtgataaataattgcctcgggttaaaataggtcatggtctctcactctctctgcagaaccaaaaaggatcttaagaaccgtttcacaatcttacaatgtccttcatgttcaaggtccaaatcccaagacgtgtcaattaagaaatcaggaatgaacatggagatcaaacaagatgcatatgtttgaaacttttgattcgggtcatatgtaccagcagattagacttaattgggatccccatgctctagatgaaaaagatttgaatttaatggcactaccaagactaggaggagaaaacttaccaacctagaaagtacattaagacaaagtaagggacagggttgtcatgatgttgaaataatccagcaagttcatcatatcagatggaacatctatccaaggactagtagtgactgtgcacttccatgtaggcaaggtaacttgttgagcatgggatttttcactatcaattcttaattactcaaactttatgtaattgtaattaatctatagaagaaactgaggtactgatgtcacatcaagctaaaaagtcataaaacatacacagaaataaactttcatagattaaaataacacgataaatcggagaaaaaaaacatttactctatatagtcaaatcttcgtgagtataaattatatcgacaatgattgatcgatatgtttgtacaggtttggcaacgcttttcaactatagttgtatttatggaaacgtaaataacaattgtatatccaattcaattcgatccgtgagttaaggtgtactttgtatgtagacataggggtgagtatgtgctatttatattattgccggtacgtgtgtatgtgtttcaaaaataaattacgcgcgaaaattcaccaaattctcatttctttttcttataatggaataaaacattccagcctttactcatcagagctacagccaattcttacaaaagtaacacccaaacactgagtgtagttcaaatgaattaaacacacccaacaaaataaaagatcaaactaagataaggagagcacatttattcaagtctatttgtgaatctgcatcatagtttgcaaggagttgcatgaccgttgtctcaagccaacgacctgcaaccttcataagctctcgatcatcttcacacatttgcagctgtgctctaaatcggagccaatatgttgcactgaaaattacctgcatatatgagatagatggtgatttgtcaaaacgatatcatttctagtcaaccacagagcccaacatatggcagaagctcctacaagtatgagtttactcttcttcttgtctacccccaagagctaaccatcaaacataaaacatattagatacggtagtaggaaggcataaaccaagagagaactgtactgctctctaaacaaattttgcataatggcactctataaaaagatgttgaatagtttcatttttcataaaaaaacaacatcttaaactgccattccaatttcgtcttgccaaattatccttggttaacacaacccctttaagcaagtaccacataaaaatcttaatcttaagtggcatcttaagcttccaaataatcttgtttatctcaatataaccattattaattaaagctagatacatcgacctaacagaaaatattccattctgatgataattccatctaaagctatcagaggattgattcaattgaatatgtccaatagaagcacacaattcataccaatatgcaagattctgaccaactaatgatctcctaaaggaaacattgagtggaacagatctcataacattagtaatagtagaacttttccttcggacaatagagtataaagatggatatttgtctttaaagccaggtttcctagccatttatcttcccagaaccttatttgtttcctattatttacaatccaagaactcatatctaagaaggtatctttgatcttcatgagacctgaccaaaaatgagaatcatcccgttttttattaacttgggttatattatagactgattgtagagatactttcataaaaccggttcaccgagctgatcctatgtttccctatggtggctcacacgaacgagacctaaaaatgccaagaatctgacactgaaacggacggccgagatgacgcgtggcccgccgaactgggcgtccacgcaaggccatgaccccatagatgacctccccatagaccaggccgcacctccgtgtcgccgtgcatccatcccaaggccacggtgatgacgtgcccgtgcgccgtatcccgcacccgcagcccccgtcctgagccgcgcgcgcgcggtccacacgcgcctcccctcgtaggacgggtcggtcgcagccgccgcccccgccccgcagcgatccgctaagcgaagctgaccggacttcgttaaccgccacctcctccttgtcggatcatcggatcggcgcccgcgcgcccgctaagatgcagccccctcgcgccacgtcacctcccttcccctgggcgccgcgcggtgccggatcaccacagacggatccttcttcctcctgttctttatatgagcgacactaaagaaagcgctacacacacgcgaccccataatctttcctacagatacaccacccacgccagttagaggttagaaacaaggcgtcgaacaccttaacgccattaccgaaaggcttcgagaattcggtggtgggtgtgcgagggagagagagagagggggagagagggtgtgtgcagtgaggaggggccctggcgatcgccggagggatgactacgggcgcggcggcgggggctgctgcggctgcgggggcggcaccggcgtcgccggtggccgccgcggccgcggccgcgcccgaggtggcggcgagggacgccgtgatcgggtggttccgcggcgagttcgcggcggcgaacgcggtgatcgacgcgctgtgcggccacctcgcgcagatcggcggggacgccgagtacgaggccgtgttcgccgcgctccaccgccgccgcatcaactggttccccgtcctccacatgcagaagttctactccgtcgccgacgttgccgccgagctccgccgcgtcgcggacgcccgcgcctccgccgcctactccgaggaggaggcggcgtccacggtgatccacgagcccatggacgagctcgtcgccatggccgccgagccggagccggagcaggagcaggagcccgaccacgaccatgtacctcaggatccggcaccggagccggagcctgacggcgccgtcaacaaccccgtctcccccaccgccgccgaggtgctggaccacgaggcggacggggaagattcctccggagattcgtcggagcgcaaggcaccctccacggaagatgacgccgtcgctgacggacgtaagtacaatcaccccccccccccgctaattaatcctcctacgcgcatattaattacatgtgcctcataggccatagcttttccaaccatcgttgcttcctattttcggcatcggcattttttttcttgctaaatccgtcatcgtttccgttagttcatccgtagaatggatctccagttttggcccgcttcagttggatctggtcgtttgctgtggatttctctgcaagttttgtcctctaatctcctattttttggggttaaaagaaaaaagtgattaatttagactttcaaacgatgcctttctacggtaaataccattgcaaaagctgcatctgcatggttagtactactagacctggcgcgcgggtccatcacgcttggtggttaggagaaaaaatggaggtcgagagggccaaattattcagcgccgcaccaaatgcggagccatgattcttcctgggacggggagatcgtacggcggggcagtgctcctccctgtcaatcgacgccgtccgtgccggcggcggcggcccgtgacctcgctaaaaccctaccgctttattgccttctctcctctccatccacgccgttggattcctcctctcttttcctccgcctccttttgtttggttttctccgtctcgtcgcctccacgcgcgcgcccgcgcctcggccaccccttttggcttggtccccctggaaagtaccaccgctggtacggccgcttctgccagtgcgattagcaaaaacgtgccacgctgtggttgcccttttgacgcctccggcggcctctcgccgtgggtcggcggttggcttcagagcggcggcggcggtggccttgaattgaatggaaaacatcgtgtgcgttggattctagcggctctcatcaacctgggccctgggggagtggggggctccatatggtgtgaggtagccgacgctgattggctcggcgtaaaatattgccgtgcatgcgttttgcatgtgtggacggccggagatcaccagattcgggttgctggttaacccgccgggcaaaaagactgtgtgcctcctcctcacttggaggagatggagatggagatggaggccgtgatgcgtggcagtgtggcatcaactttgaacaggcgtttttctcttcaaagaaataaatgctcttgaaaaaaaactgtcatgaaactgttgacttttttttatttgggagaaatacagagtaagttggtgtgctttaagttttgttttgtgttgttgcatgctagtatttcggttgtgtgtgtagaattgtcatcatcattttgtcctggtttggggggtgtcaaaaacgtaattagggacggtcgttgtcctcttgctcgagtgacctctagtcgtctccttctgccttaggcaagcacaagtgtagtgatcaaacatgagaaatcatacacactcatttaaaagaacaaaacaaaaaataggaaagtgtgaatatgtcatcctcgccttggggctagaagcctagaatgacgaaggatggttttttgccattgttttgcaacaaaagcaaacaaatagaacgtgattctttttgaaagtaaagaaagtggattagtacattaagaatacagagctgatagattagatgaaaataaaaatagtactcctactaagtggcagtatcgagcgtggtacacacgagagggaacttcctcccatcctccgtgctactagtactgcaacgtggatctcatgagatggtgtcaggccatgtcaggtccgcgcggtggagccagccggtgcgccgcgacggcacggcccgtctgatcgcaatcaaacggagccagacgctgggcagagttaaatggacccgcacgagactcgccgggcggcgggtcaccgtggaaaaatcaattcgttcgtgcccaaccctgcacgtgtcgatgaccggctggacccagatcgggttcgagaagccagaattcccggggtccgaagggctggatctggtgccgtgccgatcggatcggtcgggacggagtctgagctgtgttacacgtggttggccgacatccactggctggtggggtccggggccaatcacgcaggtggtagctcgggcccactggcagcgccttctcgagagaactctttgtctccgcatggtggccactggccagtgacaggtctttgtgctctttggctgctctcgtgttaagtctttactctttagccgccttgaggctgcaagcctgctaccatcagcccaagtgtgtgggtaggtgtggcgaccggcgacggcgtacacaacttttgaacttccacatgattagatcaactgtaggtgatttggaattgataattcaggttagggcagcgtagccagtgcgacgctatgtttgtttctgcgttgtatattggtgatgtgatcgtgttccgcgatttggcgacttgctagttgctgctactagtcagccacctttgcaaccagtccggatttcagaagattttctgcaatctcttccaaattgactactgacggactacacacgagtaactctttttttcttctaaaagataggaggaaaaacaatttcttgagtttcttgtgctaaaaggaggaaaaaggttttgctgtgcgtgctgcatagggtggtctgatgcaaatcgtctttatacattgtcttcgcccaattattgaacacgtattggtccctgcttggtgctcgcccccacacttatgccatatgtactaatgaccatctacgcttcactcaacttgcgggaagaatctcccgttgtgctcgctcttctctttattgcgttatcacgaaaggttcctctttttttctcctcatgctgtccatcgaaaatgacatgaaaaggactacagcgtaggagtcctcgacactaggttatttcttcctgggctatgatggaaattttggaagatcaaggggaactacagcgtgtctcaaaatgtgatggcaaaacggtaggtgacaacaattttgtgtgaatgcaattgggcgatagacttggagaccttggtgccgcgtgactgtgcccactaacgaactctcactgaggatctaattatgccaggccagaaaagcgggtagaaagtacattttatattttattttattaggaggtttacgattttattaggttctttagacagcctcaacccataatatctgtcggtgattgtttagtaccctagctagcttagcttggtttctcatttcctgaacaacatgataagagttatcagcttttagatgtgtatcctttgtgcttgcaagctaaaagatgaacagttaaactgaattctcagaatgcactttcttttataaaaataaggcctacggcatgggtgcagttttttttatagcgtcaccagtcatatatactcatatccgtgattggaagttttcatgctttctgctgtttatcataagttgattgctctttgaaatagatgttttccttgaaacatggtaccgcagttaaaagaactttatatctttattgtttgaaaacagagttcaaatctaattgctaagaacatatccactgtttggatgcatctgagatctatattacttagcagatgatcatactgaccaaggatctcaaggggaacacagcctaccagagagttaccctatctgctctgatcacgaggagtgcattgtccgccccgagaggatcaagattcagaaaggttttatggccaaggagtccgtgaaggggcacatggcgagttccttctttacatcactcggcaaactttctgtattgaagaactaggagatgctgtaggacttagcagcacttccattcatctaatacgttcattcttctaattgctgtttttgactggtgtttatgacttctgtatgatcaggttaacgttgtgaaaggcctgaagatttatgaagatgtgttcacaacttcagagctcatgaaggnnnnnnnnnnnnnnnnnnnnnnnnnnnnnttcgtcaggctggcagaaatggagagctttcaggtaagttggtgtttttgttgcttaaaaacatttttgttcgtcaaatgtagttttaaagatccctgatatggagtatgtttgcattattaacgttaggtgctatttattttcatactttttacttttgtccatatctctttggtgctctccaattgattcttctaagataccaaaaatattcttgcgtccatagcatctaaaggtggtcctagttcaggcattgctacctttatctattggtggtgatgattttatttgatattattttgtggtaactgactccgatatctggatatccagttcataacaactgtcgtccatatatttcacataatatcgtgctagaagcaatagaaaatgaagctaagacattgaagtttatacacttcttgcatagatagattttttttagacggaaggccagtggcccggcttttaattgaaagccaaaacggcagagttcagctggggttgccagcgtactgcatagatagatgccacctccagtcatcctaatcaagtaaaagtataatttgcatttgacaagatcacaagatagtcacaaaccttgtgcctacgatacctaatggactcgagcatgtgtatttgctttaacttaatctaactagccatgagttctcaagttatcttaaatgacaatagaagacgttgagcaagagtatagtttaattatgacaacatgttagatcgcttctatcttatcggaatgggttctgcaccacaaaacattgatccaagtaagatctcaactttgtagccttatttggttcttgagtagagaaattttatggtccttgaaaaggtatctcgatgtacctaaattttacactaaaaattttagcatctcgaggaacctagtagcatttccctattggttctgttgattgttcatgtttggctatgttgattgttcctgcctaccttgtaccttgaaatgcgaccctcctattacctttgcctttgctgctatcaattttgtcagtttggagctaactctctagttcaaaatttaggtgaaaccttcatattcttcaacaagcagattaaagggaacaagagggagatcattcagcttggcgtcccactatttcagcccaccacagaggaatctaattgtatgatcgaaaaactagacaactctactgtgatttgttctacttacttacagttgcaagaatattctttgaagtgtggcatatcatatttgcatgaacatgtcttatccacacaacgtaatggcctactgaatggtggtttacaactgttcattccttcctctgcgtacaggtcacatagaagcaatcccccttgtcctccaggctgtcattgatcatcttgttctttggcgtttaataccagaaagcaggaaacctaacagtgtcatcatcaacttcttcgatgaggtaggtactggttcccttataaaatagtatgacagtacactcgacgaacccaaatgccccttttcttctatacttcgttgaaacttgtcgtataatattgaatagaattggaagtatggttagcctagtggtcctagggaaaaaaaggaaatggataaagaatgtgattttaagaaaggaacatcattataatataataaaatcactcttcatgtaaatgccagaacagttgtattgttcacttcttgttctacaagtggaaggctgaagataagtgtaaaaaatatgagaacgaagaaagttcgaaatttctgacatatctacttcttccatatactttgtttatgacttcctaaccattttactcgtttggatacaccccaaacccaacatctgcttgtgtagaactataatccagacccatacctacggatgggcctggatttgttttagactagtgatgggcctggatttatccaatggcaagcgtaggtgatgaaaaatcagttggaatttaggttgaatcttttatgaagatcttgagcttgcttgatttccaatgatctgctttgactacacaaagtcaacttgagtactaggacatcagtaatttccatataggacatgcatgcaccaagaactcaactgcatagaatagacgaacaaatatccttgctcaaaagtcttgtccaggttgtgctctctgacaatctgacgctatggtggatttgtttgacaggatgagcactcgcagccctacttcaagcctcctcacctggacaacccaatctccactctcctgctgtccgagactacgatggcatttggaaggtcacttgtcactgacagcaatggcaactacaagggaccccttacgctctcactgaagcaagggtaaaacatcgaatcgcactgacatcatctgcttgtttttagagctaagctagtatagttgtacatgggctcatggcgtctctgcgtcgaatttgcaggtcactcctggtgatgcgcgggaacagcgcggacatggctcgccacgtcgtgtgcccatcgtccaaccgccgcgtgagcatcacgttcgtgcgcgtgaggccgtcgacgccggtggacctcagcccgctcccgtcgcccaccaaggccatgacgctgtggcaggcgccgccgccgcagcagcagcagacgatcccggcgcccggcatgcagcagaagccgcagcacggcggcgccatcatcggctacggcccggcgccgcaggccgtgctggcgcctgcgtggggcatggccgtgcgcgcggcgcccgtcatgatggtcgccgcgcccgcgccggcgaggccgatggtgatggcccccgccggcggcaacaagcggatgagccgcagcggcaccggcgtcttcctgccgtggacggtcgggcccaagaggtacaacaagcacctcccgccgcgcatccagaagcgccggttctcggcgatgatgtcgccgatcgaggcccagggctgacatcaacaacgtcacctcaccggacctcgccacgcctcgccggcgtcgtcgtggtcaccattaggccgcattttcttcttctttgaggcaaacaaaaaaaaagaaaaggaaaaaaaaagtcgaaaacgcgcgggaagttcagtcttaatcggtgtgtcctccctgtgaattttgtcgtcgaagtggtgactggttgtttttgtttggtctgcctgtaatttagcccgggtgtgagtagcagagatggaagcggtagaatatatgggtaggcatagttgagctcaggatcaatcaggaacagtgttttctttttccctttttggttgcgagaaagaactactggatggatgttcatgtcctgctgagtttgcagtaagctctaaatagtagaggtagatgatgcgtctggtgttgctcactttgtttggtttgtaccagcagatgtacctagttatgcttatgcatcgattttaattgtttgtatataggatttgccagcaccaatcgttgagttattctcctaccagtaaatgtgatgaatggatactccaactgaagagataggagatgaccaagtgaaagttgccattttgtttgagatacatggttgccatttccattgtatagagaatgattatagataattgtaatgccgtttatcctaacatttctccggttggaaaatttgtttacaattgaatttgcagtctcttaaccagttaacttccactgactcggtccaagaaggtttcatcccctcctttttggatttttaaaaataacaatagcttttattcaacttaaccaattacatagcctatagaaaaaccaattacatcgagaagacacatctatatgagaagtgagaacaccctcagcttttacatagcaaggacacatagttacacacacacaccctcaagtttataaaataaaaaatacatgaagttttatggccaatcaacgtctagatggccatccacatcatagggtaataaacaccttgaccactttctctagatgcagacataacgcaatcaccaaatcttgcatactcctaaagtataacctatgggagccaatggattagtgaataataaaacatgaaaagctgaagagataatgtttttctaataaaaataaccatatcattcacgtacaatcaaagcgaccagcaaatgacatccgcctttaacaagacatgaggtttcatattattttggattccccaaagccatctccaaacccgtgagaaacacttcaaggtggagggagatctcacaccacttgaataatagaccaaatcgagtgagcacaattacaatattagaacatgtgtttaacaggaacaatgcttttgactaccttactagttgtggttagttatgttgccttagctccacattgcaataccaaacaaatcttgaccttaagtggcagctttagtttctagagatgtttggtaagtacataagaaggctgctaagcattaaattaatcaagggtcaattccttaagtacccttgaaacttcacgcggtcctttctacgcccacgagatttgcttgatcccttgtatacatcggagtatttttgtccttgacatgcctattctgttagtttactattagtttttttttaaaaaaggaaatgatcttattgtttctttaaaaaaaaagatcttattgacctcggcatattactaaaagttagaaatattctatatagaaattgtttgggctgtgaaaaaatggtaagcagtaaattaccgaatatgtggttttgaatttaacttttttgaaaagacaattcattgaaatttacataacattttgaagctttgcgtcgaatttgaaaattattatttgaatgaatatgcagtttgaaaaatgtggaattttttcataaccgtgtattcacctttcgccagtattgacactatttttatttagttcaaaattttaatatttttgcgagtatgtattcaaccaccgtatattttttataactacaaaatttttattagcgaggacacttaccattttgtaatacacaaaatagggacaatatggtcattttagggaaaacataatggtcaactaatggaaataggcatgtaggagatcaatatagaaactcaagggtatgaaaaggattggttgaatcttaggggtatggaagggattagttagacatttaggggtatacaaagaaattagtgcgacccaacctttcttggatgaaagttttcctttccaactacagagtatgttcttagttttggggtttatgaccttctctctctccatggagatctagctaaccctcacactggatctgccactggggacagcagggaggaggggagtggtaatgtgcatggcctaaggcataggaggattccaccaaggaaccacatagggtttggccaaaggcagaggaaacatgatgcccattgcttcatccttgtctgcctaggtcgccatgatcattctgggagcatatggtataagacgacgtcaggccctatactggcttaatagccagatttaagaccgccaagccatagcaaatgaccctaccattgacgcacattgcactagtctccatggtaacaacccccttccccctcccccacagccctagaaatacattaagccagagttgtggaacgattatctattaatgttcatttccctagggtgtagtgtatgatcaagatttgtagtatgtatgtgcgcagttacatgtgaatataagtcccatcttgtagctcttaaagatatagtgtaatatctgtcaccttaatctccaaatgtaattcgccatcgatatgaattttcatacaagaatttaggatacgtgagttaatatctgtcaccttaatctccaaatgcaattcaccattgatatgaattttcatatagaatttaggatatgtgagtcaaatcgttgttgttggataaagattataggcgatcatgcaaataacaaaccaaatatgcatgacacatgcaactctacatgcaacacgctgttaacgaccaaatttggtaatccaaggatcggatgtgaagaaggaatcgagacggagttcgagatagagatcgtccggaaacagagtgaggatcggctgaagtccgaatcggctgtgactaggatcggcagagttcgagtcgaaca

SEQ ID NO: 59567 - DNA, 22198 bp, Oryza sativa
  unsure (1)..(22198): unsure at all n locations
tcgccacccttttactttcgttttgtttcgacgagttcttgctttcgggttgagctgcatcggtttcgatcttcaacaagaggtaaaacttgttatggggcttgcattctcaggatagtgcttacatctttatgatactctaatctcgtttatgtaattcgtcgagttatcatatatcttatataatctctggcaatatcgctatctgaccttcaatcggctaacttctgttgctagaaggcagccgattaggttaagtaccgatgttgacttagattatataggatatctaccaccctatgaagcattcaacgacttgattgtttagatattgtctttcttttcatacttatagctgcatcagttgagtttgatcttacgaatcgtgattagaatctcaacctctagcctgtctttggttgacgattagggtagtatcggggtttcagccaatcttatctgatttaactacatttatcttatatgctttattgacatgttaaatttgccctttatgttaagatcttattgccttcaaatatattaggatttctgtttagtatattcttcttgctttaatatcttaatatagagtggtatcgaagtattagccgatacatgctagatctatctgatcggctatgctatgaacatatataatcttgttgtcaatatatatttcgatctaagtgatttatactgtctcggcatggtgaccgatctatcccaatcacttgatttaagtatatatcgacataaagattatataccattgatatctacagccgatcgagtagatttagttctttcttatttcttaatgactgccgatcgatgcatatatgacatcggctcaaagataaatgatatgtcatcgccaattagccgatcgggctatcatttatggatttaaccacggtttctttgtctttgtttgtgttgacgaaaaaatcgaacacaccggcctgggagatatgcttagctccagtgcaggtccaaatatgatgagatgcgggcgtgccagtcaatttgatcctgcaactgacaagatatgtaaacagcagataaaacagccgattggctgacaagccgatgtagtgattccagtcgatagcgataatagccaatgccgataccagccgatagcgatagggtttaagcaatcggctatatgtccaatgtagatgatgatataaaggcaatcggctgatgatgatgtaataaaataacaatataatatagtataaaccaatcggcaaataatgatataataaataagcatcgatccgaaggttaaagcacacatcggctggaggtccaatgtcatgaaatccacaagattagattaaacagtgaaacctttgttgtcatcggctaaatccaacttatatgtatatgcaatccttatgggccgatgcaacgtctagataactcatcggctgaaaccccgatgaaacccttattggcaatcaagaagcaggctagagattatggttctaagcacgacttagtagatcaaacttaactgatgcagcactgagtatgaaaagaaacataatatctagacaatcaagccgttgactgagttttcagggtggtagatgtctaagctaatctaatctagcaacgtgatttagccgataccggcagaaaccgtaaaacgagaagtagccgatagagctaaattgatatgctaggactagattaacatagacatatgataaacatgtaggcaaatatatcatccaaaccagagcaatccaagaggtcgaatgtactgatgcagccttgaacgacgccgacgtagacgatacaattgcctggaccggcggaacattggacttaccccttagccggagatcgaacaccgatgcaaccctgcgtcgggtgccaagttccgccggaacgtaaaacaaaagtagaagtaaaaagggtggcgatgcgccgaattgtattgatcgtggagatagattacatagaccccaggtgtacatatttatacccatgggttgatacaagtccttgtcggacaagaaagaaacttttctaaagataaaaggaaaagataaagtccttataggacactaaacacactttcctaaagataaaaggaaactaacaaactattcctaattaatagataacttgccacgccgcattctctttgaacttggtctcttctggataagattcctttagtagatcattttccttaaccgaatatagcaagaatccgacaactgacgacttgacaactctcatcggctaatctcaggacttcgaagccgatgctgactctaagccgatgactactccgggcttaccaaatttcactgttaacagtttcttgttgattgcaggatcaaatcaactggcacgctcacacacccaaaggcatgttttggacctgcactggagttaagcagatctcccaggcctcgtgtttttacatcaacacacgcatataatttttctacatacttcacatccatggggaattgatttcgacttaccattaatgaatttctttgttgctactatgatgaactagaagttagataatcatacacctatggtcaaaaatatttgagatgcataattaactcatgccaagctatggctagaaatttaagatagataagtcagtcgctagtttgggcttgtgctcttgtgagtttggcctggggcgagtcatgtgtgagaaggagctcgggctcccgagaggagaggtaactaatgaacaagcaagaattatataggttcgggctaacacccaactccagttgtgttagtgatatctctcctggttgtgaagcatcttacaagtttatcatagactcaaagtagttcctcttcctttctcctctggattttctaagaatttgataagtatgcagataagtgttctacccactaggtatcgacctcctcccccttgctcctagatctcctttctagttctctagggaagaccacatgaccaaagttcgaggaaggagctaactttacaaggatttggtgtggaatgtcttgtcagcaacttttcttctcacccgatctgtcggcctcaggaaggcccaaataggatccacagggaacaaggtgcggtgaaagctcgtgacgcacccctgcttgatgcacgcaaacatgtgggaataggattcaccacaccctcccggtggtgggacctacgtgacaatgtctggtaaaggatgttaaaaacagtgggcctagtgggaatgcggtggtcaaccgcgccacttggtttcccacatccctatcaaggtaggcaaggggtgaagtgatgggtggtaggtgtggcagttgttgccctatctctcatgcgcctcgccccgaggtaaacatcttgtcaccctcaaatggggagacatcaagggcccaagcagaaatggctcatccatccagcttcaattaggaatgttagctcaggttctgccccgaaggcccttcggtgagctccgtccaagatttaaggagttatcccctagcaaggccgctgtgccccaaggctcggggctcctccttagctccgtggggcttcgcttgccatcctattggagagccacgtgttgacctgagattggtctatgtcttgttcaatggcttaggggtgaggtaacggggcatccaaccggtctgcgccattggttgtaggaaccatgttcccttgtcacaaagagaaagtgtttgtctatgatggtgggggaaacttgagtcgtcccactaaatagtttggctatgattatgttgtctttctttgatgtcccaaggagaatcctggagaagctggattattcctgatattgatttttctggcaaagtgacttactgaatggaatactctatgtagacaaaaaaaaagggtcttggaatcctaaatctggatatccagaataaatgtttgcctggcaagtggttattcaagcttattagtgaagctagcagaacttgcttagaagaaaatacctatcaaaagtaccgttattaaggtgcgaaaacagatgggttattctcatttttggacaatacttgaggttaaaacataggctttttttttcctgtggctcttttaaaattggcacaatggatcccggttaagattggacgactgctgattgggtgatcatccccttaacactttatacccctacgttgtataatctgattagaaacaaaaaattctttcgtgagtgaagtgttctccagggttccacttgatattttttttaaagggctttagtgggtaacaatttgttagcatggcatattttttttaaagattgtggcagtgcgtttgtctggaaggttcaaaggatgggaattttttcagtgacttctatgtacagattgctcatagtgaccgtgatagttttcaattctattgccaagttgcaagattcatttggaacacgcattttattatttttggaattcgaccatcaactagcaagtctaatcttcctgtaattggctaaatggtattcaacctacactaaaggatcattttttttaggaatcacaactttatgttgtaatgtttggttaagtaataataatgtggtttttaatggagccaagactaactcctttttcaaatcattttcagagacgagttaaatttggttggaactttagaaactgaattttagtctccctcgtgtgtcttggtctaaacctgtgttaaaggatgcctttgttgtgtgttgtttgttgggtctaagtactcttgtattatcctttggctgcgtacacccatttgggtgtagaggacatgttttatctatctattatctaaaaaaacacgaccaaaaaataagatgatatgattcatctatgcagctgcggcctgaaattctgaataaatgcttggtattctgctttgcatcataaaacagacaaagatacagcagccgatcgcaacttcacgccatcatcgtcccactttgtctctggagcagtggcaccggcaatatatgtctgtccacacaacaccacatgtcaattcaaattaaatactgtgaccgaaataggatgccaaagtccagcaattaaaaagaaaatgaatcgataatgtcattaaatctctaagataaagctacagattacaagctttcggcacatctgtatatttggtccattgttgttcccagaacagaaacaaacatgaagacaggaaaacattttcccagaacagaactgcccacaaaaacataaaggaaatgagtgaatacctttccactattcacagtagccattacagcaacatgttctttgtccacaccaaactcataaaagtaatatgtcctgcagaaccaatctctcatgaccaaaatcaaaatacaagaacaattctgtccaaattgggacacttattgatgagggataagattttttttttgcctcaaaataaatagaaaaggtcatatagtaccttatatcatcttcatccttaactttaattgttcgagctgagtataattttgcgccacctatgaaatgagacaaaagaatttacaaacaaattggaagagctaagtcagatatttccaaatgagtacattatgctagcactacatgctaacagaatatttttgcttcatgtttcctcatataattttttgaagtgatggaaacaaaaaatggatacaagtttatatttctttgaatattttaaccaagcatcaatattgatcatacaaagttttacgaagacaacagtagataacgacaaagttgtacaatgtgaaagaaacagttcaaaatagaatgtagtaagcatgtgagtacattgtgcaactcattaagaaagcagttaatagtgcacttccttgctggacatttattttaaaaatgatgcaaaattaaccaacatcataagaacattgttaagataagatgccccttcaatttgtaaacatgatgttttagatgttaggtcattcaggtgaaacatcatatatacagcagcgcccacacaagaagctagatcaagagttagcaatttcctttgataagtgaaaactgtgaatatgccgtgtccttattcatcttagaaacttattttaaaagcaaagtacatctctgaagtctaagataacagtaatcaccaggtacaaatatctttgatgcctcctttaaagtgcccaggtctgttatatctttggcctacaaaccaatgtttgtgtcagaacataaattttttggctgattgtgtgcaacataaaataattcaaaataaaaaacatgtctttgggccttgattacagagaattgttgatataaagaaacattatgaacactcctgcacctactagtgcagtaccagtttctactagtcagttggagcaaaaaaagtaatgtttgtcgcctctctgtgaatcaatgctactattgttcattataaatataattaattgggacttgacatgtgttatcaatactatatttatttctatataattcttattattgtttaggggtgtttatcaaaggatggtaaattatcaacatataaagcaccatcaaacttgtcatcatttcgttttcgttaatgaaaacaggaggatcctgcctctctttatcaaaaaaataaaataaaataaagtgccatcaatcatactaccttgcataacacagtgagacaactgcacaatattgtaaatcaatttatagtaactactaactagtgtgcaaagctaagccgctttaatgattaggaaatgggtcgttggtcattccaaagagttgagaacatcagattatacaaatcatcacattatcttgcatcacgaccaactaaaaaaaaaacgaaccggtgctctaccattatttttcttttagacaaaataaatgctgcacatacagaaaaattcgggagggagaacacaaaacaatcaaactatagtaacagaaaaataactagttgctgtgcaaacctctaggaatgtgattttgagctgattcgatggcttaattaccacgcttacaagttcagacctgcattacagaaaaataacagggtaatcatcttagctcgttgaatgtatttagtgatacaaattctacccaatttcttcctagagctattttcgtaggcgaatttgagattaatagtattgtaaaatttataatcattacgcatatctcgaaatgctagagagctcgataagtcaaacgggaccttacttacctacctgtccggagacgcgaagcgagcagcgtatgtcctgggcttcgccttgtcgccgtagtaggtcatcccgacgttgaactcctgatttgtcgataaaattccgaggttaaaaccaaaatgttgagctcgcggcctcgcgcgactacaatgcctgaggaaaccgaacgcgcaaggggacattgggaggagaccagagacctcgggctccaagatgtcgtcgaaggaagggggaacgcggatggagaagccgctgccgtagtactgcgaccaccacttggtgttcgcgatgccgcccagcagaggggagcccttcttattttgggaaggctcccccggtggccgcctcctcttcngcggcggcggcggtggccggacaacggagaaccgcacccccgcggaggccgaggcgatggcggtgtggatggcgaagtcccggcgcgaggcgccgcatgccgaggcggggctccgccgccggggcggcgggttctggggatacgaaggcgagggggcgaggcggaggagcacggcgggggccattgcgcggcgaggcggcggcgccactgccgagcggacggcgcggaagccgcggcgggagaggctggaagttcgccgtggtgagaggaacgcgcacgcacacggggtgaaccgattttttggtggataagcacggcacggtggtgggccctcctttccgcgtgcacggcccacggcccacggaccacggaccacctcccctgcagaatcaaagcccactattcactagttcacctttctgtagctgaagagtccgatccattcacttgttatctactcacccttggttcttcctctctctcttccaaatctccgaatccagtgctccacccgtccatcgagcccggctgagggacggagacgtcttcgccgccgacgaggcgggtcccggccttgtcaggttagggcattcccaagcttcgctgctgtcgaggcacctagtcccgtcgcagaattttttatttttctccatatgattgcatcagtttttctcagtaataactagtatattttttgttgcaaattatcttccattgttttgcttaccggggtatttgtggcccaacaaaaggttgattttctcttgcagtcaagatgtctgtgtcctgtgttgcatcgaggacaatatctgtatttttctttctttttgctggaaacatgtattgatcatacaagtctgttacttttgaaactcttttacttgggtattgaagctagtaaatagaagttgtatgatggaagtgttatctgacatcttttatgtggccaagataattatagaagttctaaaaaattagtggcatagataattgtatcgcgtgtcactccacagacatgtaggtcaaatttgtttttttggatggaagagtaataacaaatccaaatgcaaatgcttttgcaccttgttaagtctggtttgtttttctattttctggtgcgtggattgaatttaacttttgtttgtgtagtgttgtattcgtcataaatgtatttattagccatctcatgtttctttttggtcatcagttgaccaaacagaaagatgttggttcgtttctgtcaagaacgttttgttgtcatcattgcaattgaaactctttgtttttcttgttgcaacaggccgctcaaatttccgtaaaaaaatgacattcacaaatgtagcatgttgagtgtctaatgggattaatccatcagatattcaacccatagtcgcatcctgttttatgccattaacagtgataaatggttgtcgagcacattgtgtgaagggtgatccaagcatctaagttgcatcttttttcttcttttttttttttactttatgcatatgccatatgctatccattagcctatctgtgacaatttggaatctgaccgatccgtgccccgaatttgtatgtaggtaaaccatattcgtgaaaaacagtattaaacagcaaattggcagtggacaccctcagcaactgcacaactcttgtggccgaacgtggagttcttggttacgaggtccgtcaaaaagcccaagaaaaaaagtgaggcagatcaaataacaagcttgagtgcttctctattcgatagaaggttcagagagtggaaaaaaaaaacaaaaagctcgaagaaggtcaggaacataagctgagggagccatgatgtccactctctcattatcttccccactcttcctggcagctcctcccaaaggtaaccatctcccaatccaagaacagctctttctcgcactaccatgggctcctgccatttatggtagataacccttgctgccagtagacgatagtgacaacttagttaccacactctttctcttgagtggtgagctttgttagggtggtgagtagtggctactgactcgtttgtgccatgtttattggagcaagaggaattcaggaccttccatgtgaaactgcactagatcttgagatgagaagctagcactaataggcttcagttgtgcttaagccatgtacttgctgatatgtaaagcgagataagggaactgtccttcattggaatagtttgcggtggtggtgactggttgattacctgcctcctccatataccagaaattattaacagagactgtgaaaggtcacagctttgttgcagctagggtcatgtctcacatgtatttgctatttttgtgatcagtcctgaattaaaaagttgccgttgtttactacgatatgatatactgcattgctgttatcataatgttgtacatgtgaggtgatttgttttttgttctacttctgcagttcaaggtgtgatttcgtgtcgagcggctttagctagtgcatcatggaactctgttatggtacatggtgggaggcaacggcgtgcaacaatagtaaacgtggttagactttgtatagtttacccttcctttttagcacctcttgatgtggttcaatttaagttgtctttttcatgattgaagaggcttaaaatttatttcacgaaataatggcattgatgcaccaattaaatcatccaaggggagcggatataatgaaccagcatagtttataaacatttcatgcacaattgcattaaaaatcctggcttgcccaacacccaagaatttaatttaccagtgaaatggaatttgagtttgttttcattctacagatttttcatgtgcacaagataacttagttcacatttttttttatgatctggtaacctgtgtccttcttttcagcttggaagaaagtcgaagaccagagagactatcgtccctgaccctgactatcgattgccaattgttatacttggtgagccccgtgattattgagtagaatatttctagatttgtacttatacgtgaagtctaaagatgcattagttgttagcattgcgattcctcaattcaactaattaactagtattatccaaatacagggatagctggtgcatttgcatatgcagacaatcttcttgctgctgcacctgtaggcctactggggtgtcttcttttgttccaggtcagcgcaagcctgattaagctctggttttataatatctgcttaagatgttgtgatactatcttttctccgtaggatataatctttaagaccatattgagtaatctgaaatcaaacttcatggaccatactgcatgaatgcagtgttgcaagagctcctcttgctaattaattcaaattaaaactagttgttcataagcacttccatcatcaactagcacccatggcttattttttcgtctctttttgaagagcacctttttttttgcctttttgtactttgattgaattttattggtcatttttgagcaatcgtttgcttcattttcatgctaacacggatctcaatgttttgcagactactagagtacgatttgtcttcgatgatgaggccctggtttgtgttctctatcttctcaagtaaaatacttatgttgctaagtaaatgcattactgctaagatctgtaaatctgtaatgatttacctttttttataaaaaatctgttatgactctctgtcacatgaatgatgttattcttttcacatcatagcttatgtggattaaggtgtatttctgggtcttcatatctataatttcatgagtgtccttgattctatatttgtgttattgcaggaagtgaaagtgggcgatcagttagaggagtcaggtgaaaatgtatttgtcggtggcaagaatcgttggaggtaagtaggcatgtatatcttttacaccatatgtggtccagaacagaatacttttggcaagtcagtcgaaatgatttcgtaagggaaagatatgtcaaaaactaagcattagttgcttgttctatgtccataaaactaaaacatgtcgatcacgcgccaaaggtcgggctatcttgctcgataaatcgctttgatcatggtaacagtagtaatgcctgataattgaatgcacccacaggtactcaacatttgtgaattgggaactgtggtggccacaatttcctatcttggtttatttcaaggagacccaaacaaaacccgaagggcaaattcatttcttccctgtgatttttgtaagtccactaattttactaactttgttgttgtatcatatggaatttgatttggtgttggcgtgttgcaacacagaacggccgacagctttatgatgctatggtggagcgtgctggaccttcggaaactagcggtcctaaatagtgagtgcttccctcagggaggccatgagttgggctccatggatcctgtagatttagttgatacattttagagggacaagacctactactatgatgtacaatattagaacatgcaattaaccttttaagaatgatgtacacagtatatatactctgtacttctgtatgactatgtataaaaaaggctgatttaatgcaacaccaacacggcatattccaatctaagtcaatacgcaggagtttaccttcttatatacttcctccgtttaacactgtaagtcattctagcatttaccacattcatattgatgttaatgaatctatatagatatatatgtctagatttattaaaatcaatatgaatgtggaaaatgttagaatgacttacattgtgaaacgaagggagtagttgcatttattattaactagaaaaaaatatctgtacgttgcaacgggtgaagattattttaatcttattattattattttacggtttagttaaggtaaaattcactgtagtattcgtttagatatatatttttctagaaaatcatgagctataattatgagtccgatcatctcaagttagcatgtgagtttttttaaagaaagttcttatacatctccttctgtattttcaaaaccgaacgaatttaaaacccgactcaaatacagatttgtatttctaaaagcgaacgaacttaaaagttgactcatacatggatgacgtaacaaagtatcggtaaaaacatatttaatttttataatagtagagatagagatagagaagagatatgccagatgttatagtccatcaaatttgtatcggtggaattgtatgcggtaatggatttgggtattgaaccaatgttttgccatacagctgatccgaaaaaaggtttatagcaaatccggaaaaataaacataactactactaaaaacacggcaaagaggtttatttttttatcctatgccatgggtaatttactagcaatataaaaggacaaatatacgtctggttagagaagagtaagagggagcagagcgaccgtcctggaggcagaaacccttgtgcagttctgcccttgtagtatggcgaccagacatggctgtccacgctggcccctcgccttatccggctccagaatcccatccacccaatcacaatccaacccacgccattgcaaccaaatttccaatacacaaaacagcagaaactctagtgatcacaagctcagctcagctcagctccctccttctccccggagaagcagcggccggcacggcagcaatggagaccctcctctccccctccacattgctctcccctctccgcggctccaagaagaagccggcgagccccgccgcgtcggcgtcgtcgtcgtcgtcgtctcccgccaggtccgtcgtctcctgcgcgctcaggaggcagcagccgccgccgcaggcggtcgccgcttggcgcggagacggcggccgcggtggcggcgtcgggagctgggcgacgttcttgcagcacggcctggccgnnnnnnnnnnnnnnnnnnnnnncagcatggcgccggcgcccgcgccggccgtggcgtcggagttcgacgtgctgaacggcgggccgccggaggacacgtacgtggtggacgacgccggcgtgctcagccgcgtgaccaagtccgacgtgaagcggctcgtccgcgacctcgagtcccgcaagaacatcaggatcaacttcatcaccgtgcgcaagctcacggtacgtacgccatcacatcgcatcacatcacgccgccgccaagccaccgcgcgtctctgaccacctcgccgccggcgcgcggctcgtccgtgacgttaattccttgcagagcaaagctgacgcgttcgagtacgcggaccaagtgctggagaagtggtacccgacggtggaggagggcaacaacaagggcatcgtcgtgctcgtcaccagccagaaggagggcgccatcaccggcggcccggccttcgtgcaggccgtcggcgacgagatcctcgactccaccgtctccgagaacctcccaggttagccttcgccccagacgccggcgtgctctgccgttcacgacgcagaacaaaaccaacaggtctgatcgtgcatgcactgcagtgctggcgacggacgagaagtacaacgaggcaatctacacgacggcgaagcggctggcggcggcgatcgacgggctgccggaccccggcgggccgacgttcaaggacaacaagagggagtccaacttcaagacgaaggaggagacggaggagaagcgcggccagttcacgctcgtcgtcggcggcctgctcgtcatcgccttcgtcgtgcccatggcgcagtactacgcctacatctccaagaagtgaacagcagcggctacctgttctttccaacaaaaaaagagagaaaaaatgagcagcatatggtgctgctctgtacagtaaatttgctcaggagatggctaaatctcccggttttctgtcggaattttagaggcgaaacagagaattatgatgaacacaggtgcaccaccgtgccggttaatttttattgtagtagcataactgaggcactgagcaattaggtgcaaatcagcacttccttaccccgattcctcttcttctataaccattttttttgttgttagtttttgctctgttttatccttccagcaatgctgcaacagttcttgcaaaatgtgcaaactctccagcaaaaatttcatgctacaacaatgcaactaaacctgtcttttagtttttttttattattttttttagagaagggtattttctacccggcctccatatccaaccggatatatacggccattgagataagaaacttagccccgcaaacaactcaatctgaaattcgctccataggagatttgaactcaggacctttgggtactactcaggtcactgtaacccctacatgtcttttagttaatcaccgctgaggctttgtagcagtagtagtcgaagtatatatgaacaactgaaaagagctatatatgtgattattatctattgacaagtaacaaatacaacgttttttttttatcaaatacaacacctcgtagtttataaaagcgaaaaaaagatctgctcattagaacttcggttttatgagaaatggcatcttgtcagcaaatggagggtcagagtatctccctgtaaggatctgcgacgcgatgtggaaattcgcagcttctgtgtaatggattccatcccaattgacaaattctgtactgtccttgcaccctttggctgttacaagattaccattcagagacgctgtctgcccacaaggtactctactgtcatagttcaagggtggccctccatatccacagcatgcttggatgggattctcgaaccctgtaataatgcaaaggcagaaattaagagtgttgtttgaagggattattgttttgaaagcctactgcttaatattcttatgagctagctacaatagtcatcactgatccagcatgtgtccaaatgcatagtagaagaaagccaaagaaagaaaatgttgttgtgtagtgtcttgtacaattccattgtctttaaaaaaaagtgtagcagtgcaagggaatgagcaaatagcgaaaaaaaaagggtaaaaagcatctttatttccctcaagcgaggttcataattagaagcctagttcaggactgatggtggcaattcatcataagtcttctagttgaagcatgttaatgttaaaaaaaagctcccagcattgtaatatactgactatagaaatgataaatcatgtatttgatttcaagataaccaaacaatgaggaaattagatagtttggttgcataccatagcgcgaataattagcgatcaggctgtacttgatggtgtagatgtcaacataagtgatactagccccagcgaattcacctcttaactttgtgcaaagtgcatgcagctgtaagttgaaaagctttgcaacacgattatgctttgctacacaacgaagttcatccagctgggatcggtctttgccgaaaaaagctacgttttgaggtaagcagccaagaggacctgtgttgtgaatccagaatttcctggcaccttgctcatataatttctgaaaaagaaggaaaacgtttagagtaggtcctttcccaatcaaacagtacatagttggaccagtatggaaaaatggcaaactgattattttttggccaaggcaaacagattattttttgaagactgaaaaccatattctacaaactactgaagaccattgaagaaaaaaaaaaaggttccatgcactgcaaaagcttaagaatgaaaatactgtgtatacaaaccttcagcccagtttcgaattccaacaaaatagtcggaatggatgcagcaacttggtcctctgttttccagtagaattcaccagcaaggtcattttgacctatgtcaaacgtgtaaagtccccgcgaaaagtaatccgactgaggaatatatctcctgtacgtatctcctgcaaagtaaataaataagattccatcactaataaagttacatagcctatattagaacatggaaaatcaaagacaccaggtggttaggttaacagaggagaatatcattctaattcttgtactgatatatacttcctccgtcccaaaatgaagccatttttgaggttggcacgggtattaagaaagtaagtgagaatgattggaggaagtgtgtgattggttgaaaagagaaagtaggtgaagaagaatggttgtgattggttgagaggaggaggtaggtgaagaaatagcttcattttgggacaagacactgtgctagaaatagctacattttgggacggagggagtattgattaaaaaaacataatggaactacgaaaaaaacttgctaagtgttaaaatctagtcactgcaaggattccaaaaaaacttgttatcattgcgaatgaacaatgataaataatggaaacttctacaattttccagaaacacaatattggcctaaaatgttctgaaaattttcattcactgaaactcactcaacgtctcaactttatgtcctctttaatttattttaagtttgatttgttaatcatcttggagtattttctaggtgcagttctttattttcccctattaatcctatgtaacacaaaattgccaccttcagtcaaaattcattcggtctgcgtgacttttatgggtacatactgcagaagacattttccattttgctttgtatccacaacatctaaagatgtgacgtatggaaaaccttgccatacctttagatagaagcttagtaactttgtccttgaatgcaaagaattgcttaatctgaagaccaaatgaaaatgggctgacagatgttgccgttgctggagtaattgaacagccagcttgagcaaaattaacacccgcacgtaagttaggtgcaccaacagaatccaaatatgcattgaggaacggcatatccattgcatccactgcaggaggaagtttaaaatcatgtcagatagtggcccacataagtttctcatgtgcaaaagtgtgaaaatagaatttcctagtcatagtagcgaaatgctttttttgaaatttatagtagcgaaatgctattgctattcctatcaaaatgtaatgcattaacccactaaagcaacaatatttagaatctaaggttccaggtttatagtgattatatgaaaactatatcactagacctattgttcagaggaatgttttcagaatactaatcttctacatggaccataattgtagattgcacaaaccaattgcaggtcacatctcaaaaactgtgaaagttagtaatgtgaaataacgaagagaaggaggtggggggagggggtgatcaatagcaacttgtgatagtgttttctacaactaaaattgtgctggccatttagatttccttcatagttacgcctccaactcccatggtttcttagtgacaccaccacaccaactccaataataaactgaaaagcagtagcctagttaaactaaataaatggaaacacattacacacggtagttggtgggtcactcttaagtacacccaagaaattaggcactaggcaagtaggcagctggatggagacagagcaaagctcaccgcgagtcaaagcataaaacaacagtgacctaatttccccaaatgcgatgaaaccggatcaagaaacagcacatcctttcctccagatctaacgaatatcccaccaaaatgctgcaagtaacagcggtacaaatggcacgaattggaccacccacatccagcacaattcctccggtgttagaacagagtacactgctatcattgaccatcggcaattgatgccccaatccccatcctaaatcttctaaccaccatcacggccgttctggtgatctggtatgttctgcaaaggacagtcctaactaattcgcccttttccccaaccaccgtgcggaccaaatggcctcactgccgtcaagatcgacgacgaacagtatcaccagcacgccgattctttgtttcttgcaacactagattgggtaccaagaaccaatcggcgacgagcaacgatttttctgatgcaattcagacagaagccacatcgccgatgcccccggttaccatgtgggaataagattgcaacaagcaatgtgaacgacgcactgccacccacatgaagaatctacaaggaaatgggtgagaacaagagaggtgagcttactgaggaagtcgatgatgaggcggccgtcgcagaaccggccggagggggagccgaagaaggtggagccgtagggaggcgcgatggactcgaacccggcggccacgcgccctcccgtgtcggagttggagtcgccgaagttgaacaccgccgggtagttgaactccggcgacgacgcctcgagctcctccgcgcggccgccgaggcagagggcggcggcggcgacgaggagcaccgccgcagcatgcggtggcccgcgcatggtggcttgcgctcgctagctaaactccactctgcttctgctctcctgctcttgcttctccaagcgaagaggaggagaaggttgctgatgcttgaagctcttaagcagtggagatttgatttgagttgattttgggttgtaaagggaagacctggccacccatgattagtgtactgccaagctttttacaattttactgctatttgtttttgcattttagcccttgtgcttttggggctttgcgttagatatggcagtatggagagatgggaggtaattacataaattttggaggggttttgtgaagctggtttctgaaattggaagcgaagagaggtgagctagaggccctagtagagcttgttccgaaattcaatcttgtgtaaagcattcagctcactgcattgcacggaaagattgccgttttatactaccttgctgctttcgtgagaatcggaacaaacataacgtagctgtgcttgtgcttgtgcttgtgctcttctctctctcacacacacatagaaagaggaaaactggagatggaaaaccaaaactttcttatgactaaaattccacgcaagttctagatgaaccatgtaggtttcatgacttcatctgagatttcctattactagaaagtagaaattaatcatgcattcttttcctccccgaaattatacactactcatacgttagaatgaaaatattagcacgggacgaaaacgaactgactggaagggtgcagaggtaaccccaaaaatcactattggtgtggtggaaatgaggggcataggtggggcaggagccaggagacggtgaacaacagtgagaggtggactagtaggcgacagagtaagagagcgagtgtttcgcatcgcattgcaccaatacatccaatatataacacgcaccggcggtgtctggccgactggccctaggcctcaccctcacgatgcggttgccgcgcagctttacccgagtgtcaccacttgcgtgcggaagtgcccatgcagccatgcgcaacgaggcaacgatcgggaccaggtgataattttttttaattttgctttcgtcaatgcctgcctattcgttgcattttcccgtacggattcggttgccttgtcgtgtcatgcgttctcaggctccatgatacagctataaaatatagcaccataaagagatttatttaaatttgtaatattataatgtatcatatttcatataaagtttatttattttgggaatgatggagtagagcctagccaactacatgcgttcgccgaaatgcctggccaaatcggggcatcctttgagagtttggattaaaaggttgaggtgaatctcagagtaaatagaagtaggaatgatagaactgccagggcgttcacaatgcagtgaggtggcattctttccccaaccatccacatcagatattccaccccctctcccaagatgcgtgtgtggcgttcctaaccgaagtccgcggagccaaactaagtcacatgttcttcgtcaaaacttgcaggtgcaggatgaggtacgggttgagcggcgcattgggagagaccgtggcctaatgcgacacccccacatccgtgtgaagcggcagcggtcgccggcgaggccaccgccccaatcagctgcatcgtccccaaagcggtgccgctcgccagatccgacgaacccgaggctagatttggcgagctcgatggggcagcaaaactacgggcataactaaagtgtgacatgaaaaaatgtcttacacttccatacttgaaaaatcaaaagtattgtaaccactacaagtcatcagcttgatacgccaatgccaaagattgagtatgagtagtgacgccgtgtttagttccaaaatatttcttcaaacttccaacttttccatcacatcaaaactttcctacacacataaactttcaacttttccgtcacatcgttccaatttaaaccgaacttccaattttagcgtgaactataaacacagcctgagctgtggagttgtggttttgcggatgtatacaggagatcacattgtgttccaccatcaaatgggctaactcggaacgtcaagaccatctttgcagtgccaaatacaaaataaatcaatgtagtgccaaactatttttgtatttttgcactttagaccttgtcttaaaggtattttctgtggaggttggatggcgcagcagcgtggtaagctaccgtaattaaggagattttggaggggtacgatggaattgatttctgaaattgtaagcaaagagaagtgagctagagcctagaacttgttccaaaattgtgtaaagtatattcagctcactgtattgcgcgaaaagattgccattgtacactttttgctgctttcgtgagaatcggggtaaacagaacaaagaaaaatgagacactgaaattacccataaatatttttttttgctgggatacccataaatattagatgaaaccaatatgatttcttctcaaatttcctagtacaagaaggtacaaatcctgcatcccaaaaccatgacgagtaatctttgtggaaacataagcacgaagccaaacgaacgaactagaagagctgacgaaaaaatttcactgcgaaaaggtagttgcctagttggcgataaggaacgctgaacaccaacagagtagaagcactagagttaatagcactgtagtccaaccggacagcgcgagtgtcatgccaccgtggcaccacatggcggcccatcgctgatgtggcaggaggatggcatcaacattactgccattgccccccctcccccccacggcgccaatagagaatgtcacgggggaatatcaccgaatcccaatccccccttcccccacccatttgccccccctatcttttgtcttagcctgagcgcatctcgtgcacgcgcgctctctctctctctctccactctcacaaatcctcaaatccacttgatttggagccatttttcataggatttttaaggaaaatcgatgagcaaggtatactcctccattccccttttttttcgttttaatcggtggaatttgttgattggagggtaaccctagaactattttttgcccaatttcgtgatcttgacagttgaaattggggatttgatgattgtagtgttacatgcatgcaatgtgctcgttggtgctatgttttttcagtacatatatgtggtatgatattttttagttaag

SEQ ID NO: 59568 - DNA, 12884 bp, Oryza sativa
atctcaactaaaaattatcattaccacatatatgtacttaaaaaaatcataacactaataagcgcactgtacacatgtaacactacaatcatcaaaccctcaatttcaacggtcaagatcactatattagacaaaaaaaaataggttatagggttatccttcgatctacaaattccactaattaaaacgaaaaaacaagagaggggaatgaagggtataccttgctcttctccaagaaatcgcgtgaaaaacaactccaaatcgaatggatttgaggaggaggattggggggaggggggaggtgagcagtgccgcgcacgacctaggtagcgaatggtgaagaaggggcaggggtagggcccacacggtttaagtgcgcccagccctggagggagagcgccagcagtgttggcatggggaggaggggcagtgctagcaagattgacacggtggcatcgtcctcttgccacgttagcacttggtggccatgtggcatcatgatggcatggggccacagcagtggtctaaaagaaaccattaaaagaaaccatttatagaacaagttgtttaagagtttatttataaaataagtttttaaaaagagttaaattgtaaaaaaaattcaggcaccgatgtctgggcaggctgcaggcccctccacctccaggctccttttttgtctattgcacagctttttccagtgtcgccactcgcgttgtcgcgcgccacgcccgccaaggtaccaacccctacaattccacatggcccggcgcaagacatttgccatttcgccgtgaatgctgatgctgccccaacgatcacgaccaggataagatattttatctttattttaggtctatttatatccccataaaaattttatagcccgtcacaacgaatgtttggacatatacatgtagtattaaatataaacaaaaaaaaactaattacacagattacgtgtaaattgcgagacaatttttttaagcctaattgcgccatgatttgacaatgtggcggtacattaaacatttacaaataatggattaattaggcttaataaatttatctcgcggtttacagcagattttgtaatttgttttgttgttaaactataatttaatactttaaatgtgtgtccgtatatccgatgtgacacgctaaaactttacacatactccctccgtccaaaaaaaagataaaccctgatttccgtgttcaacgtttgaccgtccgtcttatttaaaaaaattatgaaaaaaattaaaaagataagtcacgcataaaatattaattatattttatcatctaacaacaataaaaatactaattataaaaatatttcatataagacggacagtcaaacgtgagagcggaaactcagggtttgcctttttttttttttttgacggcgggagtatgtatctagctttgctttcattactgctgtctgcgtcaggccgtgccggtgccgtgccgtgccgtgccggtgcggtgcgttctactgcaatctacagcctccattgttcgtttagttacgagcctatccaaaaagccgactagcggagtcgctaaacagctaaactatagccttgtttagtttcaaaataattatttaaactttcaacttttccatcacatcaaaactttcttacacacataaaacttttaacttttccgtcacatcgttccaattttaaccaaattttcaattttagtgtgaactaaacacacatcgttttaattttaaccaaactttcaattttaatgtgaactaaacacagccatgtactactccgtagtatgaccaaatcagaccatcgttggcaaaatttgtcttaggctgtgtttaatttttgcaaaaaagttgaaagtttagtgaaagttaaaagtttacgtgtttagaaaagttttgaatgtgatgtaatggaaaattgaaagttaagagtaattgggggtgaactaaacacggccttaagcaaacttcggcacccacgaatatactatggcagccaaaggcaaaactgacggcgcaagaaatctccagttctgcaccacatcggtgtcagcgccaacggcgcgcaacaaatgcaggtccttgtaaacgttgcacagagaatacaccgtactatgccagcggcagtgtgcagtggcatacctgcacctgaaggcgggtgcgggatacacactgaaaatgggattccttgtgaaaatactagtacaatcacaagaccaacaatatgcattaatagttccaaacaaatcagctcttgcattatgaactgctgagaagttgcaaatggtgctttgagatgttttacttaatccattactgagcagtactccacagccaaacgtcgccaatagacccacaggccacatggccacattggcatgcttggcacacataggagtactgcagtagggatttcacatgacctgcaggaaattggggaaatgaccacattttaagtggggcataaatccctcggcccacttccaaagaaaacacactgtaaccactgcagcttggtacgccaaatgttgagtatgattaatgagctgtggactagtggaggcccccattatgtttcaccatcagacgggctaactcagtagatgtgcttacatatcatgttaacagtgttttaatctcaaaaacatatagtgcagtcgcttgataaacagctcggccagtcctcaatgtaaagcctagttccagatccgaacaaaatcgaacccttcagcttgaacttataccacagaagacccatcgaattattcgcagtacaacacttgagaaaatgcattagcattacttctagaccctggaggtctgtgcataacaatcgagctgatggaacaggttaagcattatacctctgatatatcatggttggctaaccatattttgttccttgtgccaaagaacgacgtccttgtagggcaaatctcctccgaatatatcaagggcactcccaaccgtaacatcaactcgactgttgcctgctctttttatcctctctaggtcatccattgtagacacacccccagcataagttacaggtatctacagagccaaagatactattatgagttcataaacaatagaactaggaacattcaaatacggttaaagcaaggttttattggtttgcaaactgggagcctgcctgcatgcatgatcactgtcacaacctattgacctgcctaaaccgtatctgaacagcccgagtaaatgtccatctcccaaaagttgtatcagcatgcccatatttatatctaaatggctaccagtgctttgttcgacaattgttttgttcaaaagaaacaaggatggtaaaatgcctagctgcagcttgatttagcatcttgagtttaagaattatgaaggccatggtcatcttgttatatggagtagcttttgaaataacattgcctgtgtagcatttttcttcgctttcaaaaatctagatgctcaactacaatgcagtcaattcagccatttaaatacttggtttattgacagctttttcaattatagataaagcaagaatctaaatttcacaagaaagactaaacttgcagatacagaacaaacattaaggatggaattaagaaacaagaaaaagctggaagaatttaaattaatgaatcaagaatacaattgcacgtacaggtgaataacgtcccaatagttcgacaagttcttcatcaattcctaacctgcaattgccaaactagcttaaatcagaaaagataatggtacaaaaagaaagctgttcactactaagtgaatacacaagtgaactggatatacaaattaacaacctatccaagatatgagcagttgcactactgaagaacacaaataagcttttgaacattagaactcattccaatcaagacaaagaaaaaactaaaaagtgaaaaaaaaaacctgcttctattgggacgatcatgttaacttcatttgctcaatgatgtgtcattaaatttaaatacctaactgaaagcacaaaaaattggatctttaccgagtaattggttatgaaactaagggtgaacagtagcatatagaaagttttggcagacagacatttaaagtcttattacaatatttcatgctgccattaccaatccaattctatcaagaaagcatgaaacagagaaaaggtataaaacacaccttttcccctccacatcaacaccatgaaccaaaaattcatctgcataggcagcaagatgttttaatgttggctcatccacaaagacatcactgaatttctgccatctgtcagtcacgatggcatatcttccatcctatcaagaaatattattgtaagaacgtaattaagtatcaaagtacctgtcaataataagataatgacaaacacattagggtaatcctaattgttctttcttgtatttacagaagagaatgtagctagcttgtgtttctctaacttcgatataaactattaaaaggactaacttgtttaggttaaattttatcttgtttcaggggtaaaatgctcatatctgatggtatgactaattatctttatcagtaaaaatcattctgaatatgaaaaggaatacatggagtaattacacctaaaatagtgatatacacttattgttgttggttcatgctcttggatgtcagtttatcacagaaaccagttagttggaattcaactatactttggtatattgtatactgctctctatataactatcagggcatacatagtgcaaattatatttcacaatcattaaaccattttaggttaaacttgagcagatcaaattgaaaaattcaagaaagggaccctcatgaactgttgtaagcgaaattccaaaaagatgtaatcaaccatgccactgttctaacactttttgcggtatgaaatgccatgcatgccatgcgtttggaattgtcagtataacgacatgcagcataggcatcacactagaagagcgtgaactgcaggtacaaaaggtgtaacatttgtaagaatgtaacgagaacagctcacgtgaagtatttgaagtgctaactttctcattgcacacgcagtaatgaattaattaaatttgaaaagaagatgtccgaagtacttggtaccttttttctacaactaaggtccaaaacaagcctatgtttcccaaccagatcgacaagttgcttcagccgttcaatgttcattttgccttcactaaacacatactgcataaaaagactcagatgcatgattcacaatattcaactactgataagcccaagtacagtaaaaacaaaatgcaggtaaattacacaaaaaaaaatcctatcaagcatttgtaaaatggggtcagctatgtgcaagtgcaatattttgccaacaaaggcaaaatttgcctggctgctagttaggggagaagccagagggggcgagaagaggcctggcctcccccaatgcaaatttttatatcattgatattgatatattatctattgggagccttgaattcacatatatttctacactattttcttcaattgtagggctcatttggtttggtgccccaccaaatcatcggtaagtgccaaatcatgggcaagatttggtactactaatgttttggtagagttggttcataggagttgtattaactttgtcaaattttggcatcaatccaaacatctataaggtactattcaaagtgccaactatttggtagggcaaattttggcagcaaaccaaaacagcccgtaatcacttacaaaattggcccccctcatacataaatcttggcttcgccactgctgttagtaattatcggctatgaatgtattttgttgaactaaaagtaaaattaacattttataccatggaagcgacctctataacagaaaacatgtaagtaatttgtgatgaaccttaatcaagacattgcaatatgctttgacatctattactagatttgatagtactcacagagaatgatgagtaaagaaaatagaaactaaacaaccaaaatactcaaactaagctctatggttcatgtttatggtatgatgggttcatcaaagataacagacatgaccaggtggacatgagaagcttcaaatttatctcctgaagtcaccatgatgaaaaatccacttcatatcaatttactaatatacagtgaaatagctacatctatttatgtaagtaggtgcatcaatgagggatgagcgatagtcatatgatcaaatagatcaaatgtctcgtcatgtcaactggtgttgaccatgtttcagttgaaaatcacaagcaattgaagttctaaaagacttgactcgttacatgtatgcaaatgaagcatgacagcaatgaggaacaatattaaatacactttttataatatgcaatctaatgctgcagccagcactcacaaatagcaccgacctattagtagctgttggcgatcagcctggaaccccgaaggtgttcaacgaaatgcaaatcatgaactggaatgaactcgaacttgaacgtaagagaacctttgtgctggtaaacttggcaatgttttctgatacattgatcaactaaaatagaaaagatgtgatgaaagtctgtcaatctccctacaggaatgtgccatcccacattcggaggcttgccacgccatgtgtcctacaacaaatggttcggaggcttgccacaccaccacgtgggatggcgtggctaagtagggaagcatgcagcgcatggtgcagcaagccccccaacgtggatcgcacattcctgtaaggagattaacggacctgcattgcatctttgctatttaagttgatcaatgcattagaaaatgctgccaagtttagcaacacaaaagttctcttgtgatcgcatttgagtttgttccagttctaaattgtcatttcatcaaacaccttcggggtttgtggctgatcgccaacagtagccagtaggtacaaggctcctaagccccacaacaaagactcccttagattttacagtgatcacccaaagagaacaggagattccttagaccttgtggcttttggaacacttttccgtcaagaagaaaaaaggaggcaaccagcaagcaaattacaccaggaaggagaaaccaccggaatgttattgactgactggacaggactataggcaatgccattgcctgtagatcaatgactagtggtagggtttttgataggttgctcttatatcatgctaggctttggggtaacgttacagtgaaccaacaaattgtatttaacaagaaatggatatgaaatggaaatgcaatggggccaggcttaattttgttccggttaactgatgcacgtattaacatacacaactatatgtggtttcaaagaatgaaagagaaacagaacttatatacacggatcaaggcatgaacacgtacagaagtaacaatcacgtgactggcaccttcattaaggtaagatatcgcattctccaaatttattccacctccaacttgcaaaccacctagtattataatagcccacgtttattacaaatacttcaaattgattttgcttcatggccatagtagaaacaaaccatactagcagaagcaccattagcaggtgaaaaaaaaactctccaaaggctccaatgaccagaaccataataacctaaattagcatctcttgggcttaattttatggcaatgaacatgaaacatggctgtcagcatgaaccatacataattcaaaccccgcaatagtggaatctgacaggtataccactggaaaatatcatgaaacaacaacggaaaaggaagaagtgttattaagttttttcccctagagttgcattttggcaaagtatttttcattgctctcaaatagctacatgatattttgtatcagctagttttttttagaaaataaaaacaaacactgcacttattaaattatatacactgtaagcacccatatattcaatagtcacaaatgtggctttatatcataattattattgataacagtaaagaacaaacaactacagacagctgctcacaaaagaactagtccaaataacaacataattatgctaacaggtaacagctagataacattctcaccaggatatgcatgtagtgcttccatggcagcagcttgactagcaggatctgcaccaagcatgattacatgtccaccaataagttcatcctctttatatatatttgcaaattctgctggaggtttgtctgattcaaaatttgtaacaagtgccgtgccatcgtttgatgaatcccgaagagtagagccaacaatctgtttaactttcccctgaaaatttatattaagaaacagcccatcagataaatgacactgttaatgccagaagtaactgaactcacatggttgcaaaatgacagtagaaatcaatgcataagcctttagttttaatatcacggtgttccaggtgaatcgcatcgcaggaaaatttggagcatacaagctgaaaaaacttctgaaagtactttgcttacaaagttggggtatcaatttacgatcatgttaatgttcagaacacccatgaaacataagaggaagcaagtgttccactcgtacggaccttatgaatatcgatacacggcctgaagataacggcgcacaccacagcacgtcctcctgccaaaacaaacgagcaatcccagtttttcccccaattcgcgacaagcagtaacaaatcgagccatacagagaatcgaatcgaaagggacatcatactcgccacgccggatctcgccggccggacggagaccatcgggacagcccaaccggaccgcgccgccgcgcacggtggagacggaaccctcgatgccatccaatccagtcgctgccacaaccaacaaacaaacacccgcgaagcaaattcagaagcaagcaagcatgcgggagccccccccccccccaacccaggacacgattcggagagaagaagaagaaaccagcgcgtacgtgccgcaccttcgcagccgccgccggcggggaggggagggctccgcggaggcggcgcaagggcggcggcgagtcggagtcggggtcggagtcggagtcggtgcgaggcccaagccgaactaggtaaagagatttattggacggccaggatatgcacaggggcgttgatccgacggctcgaacgcctcgtcagggctaataatattgcctctcgcgagagagaagccaagccagttgagtcgaactgttgaggaatcgctcgctcgctcgctcgctcgccggcggcgcggacgaggagggggcgagatgttcttccacatcgtgctggagcggaacatgcagctgcacccgcggcacttcggcccgcacctccgcgacaagctcgtctccaagctcatcaaggacgtcgagggcacctgcaggtagggctcgggattggttgggcaaaccctagtagggcggggaggggatgtggggttcgacgggattcattcttgttcgtccttttgcagcgggcggcatgggttcgtggtggcgatcacgggggtggaggatgtcggcaaggggctcatcagggagggcacgggctacgtcaccttcccggtcaagtaccagtgcgtcgtcttccgccccttcaagggcgagatcctggaggccgtcgtcaccatggtcaacaaggtgggcgatgtgcctccgtccctcgccggattggtatttggtgttgggtggattagggcttgtttgtggttagtggctccaattcgttttcgtgttggttctgcagatggggttcttcgcggaggctgggcctgtgcagatcttcgtgtccaaccatgtgagtgcctgcattgcttggagctgcttttttctaatgctccaaatttgtggagtaaaagaatcagaatttatgctagaatgatcgatagacgataatggttcagtaccattttcatacacccagtttagctgtaccatcaactcgaaggatggtttttgtcatagaaatttctgatactaatttatcaaacatgttggtttgaacaatcttaaagtgactggaaggcaacataaggttctagttgaatttgtgctttctaaccaactaatgttttgttcttgcattttcccgtttctatttttgttgtgcagttgattcctgatgatatggagttccaatctggggatgtgccaaattatactacttctgatggatcggtatgcttcttttctacagttacttcttatgtcttgtcctctataaacattgacaactgttgacaggttatgattttttttcctgtttatttatgcttattggtgatatgtctgacttaaaaagaaatgctggggaatgtaatgtaatgtccattgtatccaattttggtatcagcatgtcataactatgcttgaaatgcatacacatatatgttcattgtttttcctagaaacgaatagatgtgaatactgtactactgttgaaggctaattgctttggccatcttcttttgcttactaggatttacttgtttgtccgatgcaggtgaaaattcagaaagatagtgaggttcggttgaagattattgggacacgtgttgatgcaacagaaattgtaagtttgttgacatctagtttcgtgcaaaaaaacaaacgaaaaaccaggtgttccctgtcttttagatttttgtagcattgctctcagagtaaccaccatatgcaattattggtgatgtaacccacttttccataccagtagtttgcatgatgtttttctttcctaatgtgtgaaaaagaacagatgtggttttatcagcaaagatcaaccttgatgtgtgtcaagtaaattagttgaaaagtatatcaaaatgaaaatttgacatgtaatcttgtagcaacaaattgcaagtaattaccatgaatgctcataagctagccactagtatggtatcataatagataattgttgaatgcatgtggctatattcttccctgaggcatttctgaatccatgttcttgctgtcataactcataaccccgtttaagctggtgatgtgcaatgctctaacagtttgaatatgtttgttgcagttttgcattggcacaataaaagatgacttcctgggcgttatcagtgatcctggtgcggcagtgtaaattatccggtgacaagattacgcctcttcatgctcttgaacgggaatattccgatgaattgtagtgttaaaatatggaagccccactggaaggggctgtaagtgggttggaacctgtattttcatcactataaatggcgctttaccaagttggcactgttgcttgagtgtgttgtgggattcaactttcaagcagtcatttaactaatcaaactctgacctttttacggactgtacaattttgcactgtatccttgcaattaaacattcaatgcttcgaactgcatccttgcaaaataaaactaaagagaaagaaagggctaagtaaaaaagataggtttacactgtcagttgttcatgttaggatcaagctaagggcagatacaataagttagcaagaacacagcggtcaccccacttaagttcttgacggcacttcctaatgaagacaggaagtatactttgattgtgcagttatactcaatattctcacgtggtccttcaatgaaggatctgcatacggcactgctcctgcggtattaacagaaatcagatgacaggagataaaacattggtaaagagcaaaaattatttggatatataagtctcaactcacctgcaaggctgcaaagaagttagagccagaggttaacctttcagtcttccttccaaaggggcttgcggtgcatacacttgatcaaaatgatcttccaaaatgatcttcctgacgattcaatcgttaccatcgtttccacgattccactacacagaaggggctcctaagatgccccaaaaactgattttgcaactcagcatttttaagcaattaaggggatgaagttgtcgtgatagtctttagttcctgattcctgaaacaatcaagaagatactctcatatgtaataagttcaacactaccatgacatcaaactggtgaatagatcacaggtgccttatcataccatcaaaccaatttgtccgaaatggaagccagggccactagagcaaataggcaaagtaatgaaaagacatccacaatgccaaaagaagattctgtaagaaagtagatcttgtggttgttagggtcaccacgaaatccgcgagcaatcatggcctacaaaaatcagacagacattcagagtatgaagtgcagtcatgtgcaaagtaatttcggctatagtgaaccatgtatgtacaatataagtgcttgaaaatgttgggcagcagcaatgatgtaatttaagttttatcctccttacaagccccgcagtactagtacaagatctttttatcaaaactgtatgttacttttaggtcataaccagtaaaattcttgataagttctcacaatcagctaaccagacaacctgcagtatgattgccttcagcctaaactttggcaagtttaaatagtgtgataagactaaaagctcataattcttaacccagtttggttcaatacattcagaccataataaattttcctcttacacattcatattcaacttaacagacgtgcaacaccactttcacaagaaaggaatgaaggattagacatggacttatactattagtattatcatggacgtcctgtatagcaaaagcccatttaactgtcaggctagccagtacattcatggccatgtatgcaccagcagttagattttgtaataggacccccagctattaggaatagcatatgggtcataagcctatgcttatatatagcc

SEQ ID NO: 59569 - DNA, 11159 bp, Oryza sativa
aagttaacaaaagttctgtattacaacctaaatgcataaaattatcctacattaggtgtttcaatataaacagaacaattgaaaagccatctgctgaaattagccaaattcaccaagtccaacctttgcaagagttatttaacctcacgaactcaagtaaggtttggacttgcaaaagtatatactgcttccatgatccatcccaaaatataagaagttttatagttgggcacgagtattaaggagaaaggtcaaatacaattatggttggttgtgattggttgataagaggaagtaagtggaaatgttaaatgggagatggttgtgattggttaacaggtgaaaaggtggctatatttttgggacaaattttgaatgctaaaggagatatgttttgggacatagggagtagcagacataaaactgctaagtgggtaaatgaattggaataagaaatattggaataaatgaacttgtcggtatcaacaggactacaggaccagttgatataatccattatttacctctgacaggagaccaattctctatagctagacagcacaagccacaagctacctcaaatgaactagactaagaaacagaactcatatattaaagtctttgaatttgaactgagcagaagcacttgaagttggaccaacttcaactaactgtaatcgccttcatttcagtagcgcaaatcatgaaaaacacttagttaaatcttgctgacaaaataaatcaaggtacataacaactagtaaattcagtagagattagttttctgctgcaattcccccaccaaaatcagccagcaactggttcctgactaagtttgtcagctagttcactcccgggcattggttacagaagtaggaagtactcactgtcaatagtttccatagttgccagcttttcccaatttatccgacgtgctacaatcgccagtgctgaattgcgaacctaatgaaaagtatttaaaataatgttacaatcacaatgcatgttctagttagaaagacaaatatagccgatgtttacttgagcaccctatacttgcctcatcaaatacaagattaatgaacctcaaagatagtaagagtgtgagtattatctcaggtactggtacgccgatatgcttcagtggaatcataaaccaccataaagcagaagcaagctgctcaggagtagttgttgtcaagcagagacttgcactttgaaatatctgcatcaaaagaaagtatgggagattatacctaaatggtttattaaaaaaagtgtattgtcaactcaggacatgcttgtcttatgtgccaattgctagatgatgaaagtattggttcaaacaaatcctctgggctttgggttgctggccatattcttttttatttctttggcaagtcctttcatgctaaatctttctctaatgggcttgtttgaattttttcagactcttttctttcttcttaatataatgatgcacagctctcatttgcattagagaaaaaaaacaatttgtatggaaaatattacccataaaaggaaaggacataccgcaaatgagaggcatgctgacgtactcgctactgataggcctttccttgtaaattgcagtggacccagtttcatgattgtgtaagaatagccatttgtggatgtaggtatgtttggcaaacctataacagatgggggaggagttcttgtctggactaatgaaggagcaccatcagaaccaaatcccagcattatgaatatgatgcctgaaagcagagcgacccttccaagttggtcctatagagaatgtaatttgtataaagctaaacagcaggttcacttaaggggtaatattttaacaaagaagatagcataacggcagagactatgtatcgaaggagtgaaaaatagccaaatcgacaggaaaatctataagtaaaacatggacagctttcattggtatacttaaaagtcacataaaattgtgtgtgtgtgtgtttttttttttgggggggggggcgatgaaacgaagccaagcatgatagtttgtcagtacaaaacccatataacttgtccagtacttcacagtcaccctttcaacagtaggaaatcataagccacactcatgtttttttaaaaaaaatgaattgcattcaacatcataagggaatctccatatatatataaagtagtagacaatttaaaccacaactggcaacccaacaggccagcactatttgtgcataaaatggtgaatgcccattttaacagtagatcagagagcgtaccttccaaatatggtttgggagaacccacatagagaggagagtaaggtatgctactaaaccaaaccgcaagtaaatatttgatctggctggtaggacaacaagagccaagagccacacctgagaacaaaagtgattggtcaggttgcagcatgaaattggacgatcatttagttaatcatcaacttaatcattatttttgtgcacaaaagacaattaaatatatactacgaaatttgttaaaacaactaccgtgacaaaatcaaaattccacaaactcgggggaagggaaaaatccgtcggacactatttcttaacttacataaatattctaaataatcatcagacaaagtgtccaatataacttatagatatactgacgcaggttcaatggttaaggtcagtttctaaaatagcagaaaacaaaacgtcaaaacctaatgatttcacagtttgtggctccaatgagaatcagccaatcattgaaaaaacatactagtatgttgtcatgaaagttcacgacagcattatgtatgctcaaccaacaatccaagttaacccgagaataggcacagttggtcagttgcacacgctcacgttggtggtacaaatggctcttagcatataaaattgagcaagatttttggcgatgtatttgcatcagcaattcagcatttcattcatcccttcatagcccaggggcgaacattttcacaagcacttactgtgcatccttatcccctgccgtttactggcgattcgatccaaaaacacggagcagataagcgtgaggtgaggcaaggtgtcttgtctccggggaaatcttagttaccagcttaacccggggatcgatggcgtggaggaaggtgcggggcgagtcgacgaactggcagatgggcgtggccgcggcgccggagatgagcctgaggacctgctccgggccggcccctcccaccgcagcccgcgggatccacgccgcccacctggcgacggcatcccccgcctcgcccttccccgcggccttgctggggtcggaggcggcgcagaccagcaagcttctcctcctccctgcgcctggcttcgccgagagcgggagccagccgggattgggcgtggcggccttggctgcgaggagagggagagggagagacagcgagtggatagggcggaggtggacggcggcggccatcggattctccgctccgggcagcctgcgccgcgccgtgcgcggccggggtaaggataactcggggtgccgaaacgtgatcgcggtggcctatgtgcggcccgtttcagttgggccggaccatctcatgggcctccgtcgatggcgttcttgctagatgtgcccaaattgagggttggtgaaatgaaaatttttggtgttacatcgaacgtttaacccggatgttggaagggattttcggacatgaataaaaaaactaatttcataactcagcctgaaaaccgcgagacgaatcttttgagcctaatcaatccgtcattagcacatgtgggttacgtaacacttatggctaatcatggactaattaggcttaaaagattcgtctcgtgatttacatgcaaaccgttcaattaattttttttatctacatttaatgtttcatacatgtttctaaagattcgatgtgatgtttttagaaactaaacagcccctgccgtacgttccaagtctattttcaggggaggagcgcagttagttggtttgcagtggtttgaaccagccagcacgaattcgactcccacatagcgaattttcacgtggccttacccattaggaaacagggtacatatatgtgcgtgttcagtgaaactgcacgtttccgtaatgtgtgttcgtctgtgttttgagttgtaccataaaagaaatttggggatgtgtggttgtacccttaaaagaagtccattttacaatacagtaattcgtaatcacaagctttagatcaaacttaattaaaagaattaaccgccggagacaatttacaaatgaacaaattcgccacgaccacacggatatacatccacacacaacacactagcataaatcaacacaacgttcctcctcacgcgcgtacacgtacgtacgcacgtacgtacaccacaaaccaaaccgtcgcccaagattgatacggttttgcacagaatcctcctcctcgacccggtcgacgacgccctcacactctgctaaccatcggattctgtatgatggctacgtgtgctccggcgtgcagcgacccggcgcacagcagctgcgtcccggccaagatgatggtgaacgtctccagcgctcgctgcacagagaggcaataacacacacaagaacaattaatctcagattagccacgaaaacgattaaacgacgcgaggaaaatggcgtaattggttcagttttttttttgttgatgaatttaccaggctcggtggcctccagccgatgctgatctccttgcacgccagcctgcaattaacgagcgaatcgacggtttgattaatcagtgataaacctgcgtgcagatgaatggcgaattggttggtggttttgacggttgctttgcttaccccatggcgaggagggtgagggtccaggtgacgatggaggcggcggcggcggacatcatgctggcggggtacccctggctgacgtcgtggaggccggtgagcgaggtggagacgccgacgacgccggcgagcagcgcgaagatgacgaagaaccccgtcgccaggttgccgatcgggaagtagatcgggaacagccgcaccggcggcgacaccccctgcactgcacccacaagcaaggcaacacacacatcaaccaaacactcgagacagctcacataggaattggatggaatctaaaacgagatttggagggagaaatatccctccaaacagatgatttgtgagcgtgttgaagatttaacatgggatctcaaggttaaaactttaaaccatactccccttgccactatacataggaattcggaccattcgaggcgtcgaagttgaaaccacacgtcccttgccactgcacatggaaattggatggaatctgacacttacgtgagttgaagctctcgtcgatgctgtagttgatggcccagccggcgatgacggcgacgacgacgtacaggacgaggttgaggaagaggaggccagcggacatggaactgggacccccggtcgccattgctgatcttccctcttgctctgctctccgaggcaggagaagatcacaacggcgtcgcgagaaaacacactctgctgctgctgctgctgtgttgacgcttcgatcggtcgggagccaatatatacgctaaaaagtgcagtttttctaactgaaaagatcgcagcaaatatttctccttggttgctttgcaagtaagccagccaagtattcctttgatcctttctgccacctggagagattgctctgcttttgctctccacaagggaggaatatccaattctccatctctcatccacggtccatccatatatggtggtcaagaatagaatctgttcttgtctttgatcacaagtgcatatccatccgtgcagataacttagtttacatgcatcgatcattgctggcctgctgcatctgttcttttcctttgtgttcgacaatgtacggctgctgtgatgctgtcctcttagatgatccgttggtagaagcggttcagtgttttagctgagaaggcttatgatcaacattcaataacaagtggtttgcgccaaaaatgtggaattgccaaaatttttggaagaacaaatttgacctcaaacaccaaccgaaatttggcaacaagccaaaaactatatttacttttttttttactattgccaatcttttggtaatgtttggattgaaatgatccaaacaaacggtttgagtatgatttgtgaactataaaattattaatggttagtagcacgattgccacgcttcaagaaatttgaaacacttaagagcatgaaaaaaatcggggatcaaaaatccatataggattttgtgataatatgaaggagagaggggaagagaaaatatgcgagtgactaattagttgcctggctgcactgggcggcccaagattgtggagtctacccatggtgatggtggctcagacaactgtgctagccgctgttgtctcctgcatccgtcgggtcgtcgtcctcgttgtgactgtcgttgtcgcctgcgcctgtcggaccattgttctcgttcaccatggctgcgcgtggggagtctaccatgccctctcccatctgcagcccattgtcctcaccgggcactcgagctggcatcatttgcgagagagagtcatcgagaaggtaaagaaaagaaggaagaagattagaatgaagggtgggatgaagaaagagaagagatagaagaagatggtggatccataaagataatagaatatctgtgttataggaaacataatattttatagacatttggttacaatgtttactatatgaattcgaatgatgtgaccactcattacaagtagtagctactctagctctctttttttttattacacggcagaccatagttattagaaccggaccagaccgatgatccgactggaaaaaaaaggaaccagggcgccggctggtccggtccagctaaaagatcggtgtgcaatcaaaccggtagaaccgggcggtttaccaaaaaaccggataaaaaccggagctggttggaccgctggaacggcgtcacatggaggaaacagaagtgcgcaggttgcagccttacaggtgcatcacgcggagttagaaaatagggaaaaatgctatagaacttgtgaatcgaacccaaaacttccatctttccgcatagagtcttaaccaccaggctgtgaaacttgtgataatattataacacatatctatttgaactgcaataaaccggtggttggaccggtccaaccaataaaccagtgaaccgagtgtcttaccggtttgatcaccggtccggtcttaataactatgtggcagacgcatatgcacacatcactacacgcgtaacacttacacctcgcaaatgcacaccggcaatacatccctgatctctttaaatttctattgaaagcctatctgtatgtgcgtaatattcacgagcaccagaatttaaaccttggtaggtaaagtcaatcatcaatgacttcatcacttcacagcaggtgttttccaagctttgctctagttaggacgcaattgaacatgagaacctgaaccttggcttggtcgcaaactccattcaatttgccacttgtttgggtattctcccaatttcaccaatcttgtggttttatagctaaagcctgaagaagaaaaatactccctccgtttctgaatataaaaacactgttgaatttttaaataatcattcgtcttattcaaaaatttttatgaaatatgtaaaactatatgtatacataaaagtatatttaaccatgaatcaaatgataggaaaagaattaataattacttaaattttttaaacaaaacgaacagtcaaacatgtttataaaaataacggcgtcaaatatttagaaacggaggggtacaaaataggatgtacaattgcacaactcgaaaaaaaaaaaaactgttccttaatttccataccacgacccagcgccagcggcacgaatctcaaaagatggatcggaccgcttggcgcgcccgcctaacgtggggagtcgacgcctctagaaagcgagaggacgccacacgccgagccatctctcgctttgcccccaacgaatccctcccccataccaaactccgccgccgccgccgccgcccgccgccgccgagaccgacccgaccacgatgggcctatgggacgcgctctaccgcgtggtgatgcgccgcaacgcggtctacgtcaccttcgtcgtcgccggagccttcgccggcgagcgggtacgcccaccctctaccccccccttttttttttcttttccctcagatctgtccgggcggcctcgtcgccgtttgacccgatctcatgttgttgcgctctcttggtctcgtcgcaggcggtggactacggggtgcacaaggtctgggagatgaacaacatcggggtaatttttttccccttcactctctatgaatgctttcctatttctaggtttgtttgtcgcgtgtttttggatcgtggcgttctagatcttgcatttgcgatctgggtagggctatatcgacgctgtccttgaaattctgttctccttcatgatgggaatgatccgttgcggaggtgcggataatcttttggtgatggttgtacgtgtgcaaaatgaggaggaagagccatgcgaagagaaggcttggttgcatctagtgctatacttactttatttttctagatttaccgtttctaaattggtagctagcaatgtcttttgttctgatattaaaattcctgaatgaggatctgttttgctttggctgttacttgattcaatgtcatgttaatgcaatgtgttttaccatgccagcgaatttagagagaatagcataaaacaactgagagtgaattgttctatttttgttgtgcatgctcgatttcacttttaaaaaatctgccaccatctgttgtttgttgtgagtatgctaaacaacatgttgtgaagttaaagtctagaatcagggctgtagatatcgttcataagaaaacttcacttgtgctatggtattttgatcagcccagcttgtctgtctactctgcatggtttcttgcggcttcagttgttaattttgctttctgaaatctttgatcaaaatactaaaatctttgatcaaggaatacgcttgcgttatggccatggctctcagatgcaaagccaatggcatgcatatggagataataggaggtttagattgtgatctcagaagggtatatgcactggatgggaattatggtatcagcatcataagaatattttagctcttaaacattaagtgctgctgaaacacgttcatagtttcaagtcagcatagtacttatcaatcaaacatgttcaaagtttacaacagtaattattccggttatatatgaaaaagccctcataggtgatttgatctttgcatatactgccctctactgcttgtgatagtttaaaagggttctatctttcttttactcctaatctcatgtttagatttaatttcttaattttatgattcattagactaaattaaaactgatagctctcatggaacaaactccatgctgtgagacaactcaagataactttgccacatccaacaggactacaggggtatagtacacccacctgtagctggtaattttcttaccatgagatctgattttggtctgcggcttccttcccatctgtcaactaaaaatataataatctgatgaaatgcagctgtagttaattatcatattacctccggactagcacaaaacaaatcaattcttctatcacaaaaatatgtggtgaagtactgaaaacaagagcagatcatgtttaatcctttttttggaaggtattttgatactcactattacgtgacaacgatgagggtggcaatcatcatattgtagaggaaaatacaagaaattatcaaaaagccaatcgcttgtatatataaattaaattaaatttgaacttgtcacttgtataaaaccaatttcttggtgctggtagtaccttttttattgctatgttctcgatttccagaacagcaaggagctgctgttgcataggaatatagttaaggtggagctgagtgtccaaattattagaatgttctcatgtcatagcttatttctgcagtatatgtgctttgttatcttacgaatgatatcttggtaaaccgtggttgaattgtttagtaattttagtttctgttgcagcacatgggcagtccgctagtatattattatttagatttgagcctgaactacctagcaatcttttttgctggatgtgtgtaagtgtatgtaccaaagtatatggaatctttgtctagcctgaagcggagccaggcattatgtctgtggggattcacattcaagtatacaaaatatacctattgatttttctatgggcaactttatggttgcagatgctgatttactacattttggtgtcacatactccctccgtcccataaaaaaacaaatctagtacgggatgtgacacatcttagtactacgaatctggacagactgtcacatcccgttctaggtttgttttttatgggacggagggagtagtatttgcacgatgtttgtttgtttgtatctgcatagcttttgtattgtatgcaactacattatgacgtgtttccccctatctttaattgtccactttcattgcccataccccttaagtcattaggtgaaatgaggactaggttaaattattttttttgttttgaactgattgccatgttcttctcatttaactcattatggatgtacatcattacccattaatttctgaatttggaccagcttagcacaaaaagctgaatgccctattctccagaaaaaaaaaactcatccattttagctgcagattgcctcattgtttcccctatttctgtgcaatattgtttggatgaagttgttctctagaaatctaaatagtctgctgatagttgtttgtttgttggaaatgcagaaaaggtacgaagatatatcagtgctggggcaaaggccggccgagtagaacaatgaaagcccagcactcatcatcttgcttgctttacgtgaaagtagacactcttttaagctctaatgtcttgtcattttcttcggcacaataagcaatgtaaaacccctatctccgtttctgagagtta

SEQ ID NO: 59570 - DNA, 31948 bp, Oryza sativa
tggccaaaacctttcctgtagccatgtgatggtgcgctctggaatcagttgaaaactatacaaactcctcggaatgaaagttattttgaggttttgtttctgtaatcacccattgctgctatggaacgcttggtttttgttgtggtagtggcactgcgtctcttcgtattgcagtcaagcaagtcagtatttttaaatttaggccgagtttagttccaaactttttcttcaaacttccaatttttctattacatcaaaatttttctaacatacaagcttttaacttctccgtcacatcgttccaatttcaatcaaacttttaattttagcttctccgtcacatcgtttcaatttcaatcaaacttttaattttagcgtgaattaaacacacccttaaccctgttagctttcttgtttgttttgttctgttggagcacaatttactggtcacaacacaacgctatacgtgtcgatcggtgatgcacggttttatgacaacgctggatgttgattgttggtacaatgctatacgtgtcgatcggtgatgcacggttttatgacaacgctggatgttgattgttggtacaatgctatacgtctcgattggtgaagcgcggggtttatgaggtacacaaattgtacaccaaagaaagatatgcattacaacatccgttgtagtctagctggttaggatactcggctctcacccgagagacccgggttcgagtcccggcaacggaattttggtttattcataaatttaatatttgtaaatcagtttagtgtttaattttttccatacacttatttttttattcgttgctctctatgagagtttttcaagaaacataaatttaatactccttccttctcgtctcacaaagacttcattttttttctctattcaacgtttcctacacttagtttttctaatttattcataaatttaatatttgtaaatcagttttgtgtttaattttttccctacacttatttttttattcattgctcttatcagagtttttcaagaaacataaatttaatactccttccttcccacgaagatttcattttttttctctattcaacgttctaccgtctgtcttatttgaaaaaaatatatttttttaaaaatagtcacacataatgtattattcatgttttatcatctaacaacaacaaaaatactaattataaaaaaaatttaaataagacaaagagtcaaaagtatatcaaaaactgaaaaatagagtcttcgtcgcacagaggcactaagtgatttgtacctttgtacatcggtctagtgttttattactcctttcatctaaaccatattagctttttacatggtctccagaatcatactttaatcattactttctctcataatttgtacgagcatctataaaattaacgtcatatgaaaatattttcaaatatgaattacactaaatacatatattattggcaaaattggttacatagcattgaaagttcacgtttttggttttataacaccgaaagataccggtttattttaatacacccaaagttcaccctgctccatttcttaagcacttttcgtcaattctcaatcgttttccgtccacattaatcgtaattgactcagccacgtacacgatataaaatttctaccctcattgccttgcattctacttatacttgtgaggggtagaaacgttatatcgcgtgtgtctgggtcaataacgaccaaggcggacgaaaaagatcgagaattgacggaagtgttaaaaatgggaacgggtgaactttaggtgctattaaagtgaactggtatctttctgtactacaaaaccaaaaacgtgttattaattaaaaaattacaaatgttgactttagggaacaaggagaccttatattttagaacgggggagtaaattaattaatagtaaattttaactaacatgaactcttcttttccaaagtaattaatatgtttaacatactattaaaattttaatatttatagtatcgctaataatatcataatacacatcctgtcatgacgcggctgatgaaataaattcaataattactgcaactgaaactctccgtgctgcttcagatactcgtcgaaccactggaccatgtcagcacgagcttcttctgcagttttgacggcgaacggatcgctggcgttgtatctgcaagcgaaggcatggggcgccttggggaaggtcttcacgaagtgatcaacctgcagtcagcagagatggatgtgcttcaaatgaaacgagcgttcacgctgagctaaatcagttgagtatcatctgagtgatgcaaagctacaactgcagtctcagcgatgatttaaactgaaaaggcaaatggaatcagttggaacttaccctgttgttctgatctaaggcatgctcaaactggtgcacaacaagtggtggcgtgatggtatcacgctcacctccaagaatctcaattggacgtttgacctctgagcattacaaaatataaaagtaaaaaaaaaacgaagttggagaaatgatcattgaacaatttaaggttaagtgaaggaaaaagacatatcgacaaaagtatatactctatctattctaaaatataagaatttctaaaattttcttttagcaaaactaaggttaggtttaaaaaaatcttttcaatcacttcagttgttgttttttgaattttaaattgctcagattccttttttatatggttggcttggaatcattgaagtggtggaaattatagaaatcagtataaaaatgcttatattatgattcaatatttgaatcctacatatttttgtattttgaaatagaggtagtattgtactcctatatttgtacctgtcatgtcatgtacggtcactagcgaaggatgtgaaatgactaccgcttgggtttcttcggtctttgatagttccacggccacctttcctgttgagaatgaaataagaaggatgaaagatttacttaattagaattagagaatgaacccatcctggcacaaaaaagagaacaaagaatgaagattcattcacttttacgaaattaagaattgtttgtggttgattgcttagtgctcatgttgtttaactgaataactcaccaccccagcaataacctccaaccccaacagaggacatcccttccttcttcagaaccgcaatgagcggtttagtcttttcagctgcttcctcctgcaatgaaatggcaacaaacattcagatctaagtgattcagttaacattcagatgacaaaaaatggcgtctaactagcaatcattttttcacaatactgaatgttccgtataaaattgcattggaacagtgacaggtttttcttttcatcatgtactttttcttttacggagtgaaaagtaatcaataggtcaaacaaacgaaaagcaccgtgatcaaagaaagaaacacacaccggagagtgagccatgatccacacccaaaatggccttgctggatcatccgtgtaagggtcaccgtacaacaaatcaggaaccacaacgtagtatccggagtatgcaactttgtccgctatttgtcttttaactcaagcaagttgggaataaacaaaaagatcaaatgaaaaattgagttgagaacgaactcagctgcacacgacaaatttgcgtgatgaagacttgaagtttttgtattaatagctttaataaatcgttttgatcgacgatcaaagcatgagacaaatttgtgtaacgcgtattttcagattttgcaaacgtgcgtacctcagctttggtgctcggaaacctgcaaaagttgaagtgccgatattatcagacaaaaaacagaagaggatttatgagatactctcttcatcaccccgccccccccccccccccaaaaaaaaaaacaactctttcaaaggaaaatcaaacttgataacttttaactaacaattatgctaaccatatatatgccaagtattatgcatgttgtaccgttagattcatattttaaattgctttcatgtgatgctaatttcatattcattgaaaatataacatgaaataaattaatagtcaaagtatgttattaaagaccgtgtaaaaaaaatacaggccttataatttgggacagagggagcatatacgagtggctactgtctctcaaggcagtgtttgcaatttttggaaatccaccccctccccctcacctacacacgaaactatttcgcttgaaatttcaattattttcacgagttagcaaaagttattcaggtttgttcaaaatttaaattattctggatatttcgaatttatcatgtctgttttcttttggcgttttttccccaaaattgttaactactccttccgtttcaagttataaattgttttgactttggtctaaatcaatctgttttaagtttgcccaagtttttagaaaaaaatgttagcattttcaaccaaagacaaatttattatgaaagtatattcaattattgatttgatgaactaatttagtattgtaaatattaacatatttccttacaaagttaaacttaaagtagtttgactttaaccaaagtcaaaacgactttttttttaaaatgttaagtcaaaacgacttataatatgaagcggagagagcacgctatgctcctaacatgtatgcgtgcactgaccgtaatagtcagagacgaggatgatggcgcggccggagcggcgggagccggtgacgtagcactccaggccgccgtagtcgtggacgacctcgccggcctccccacccgtcttctccgtcatgttcggcgagttgtccaggcacgggtgcttccctgtcgacggcgccggcgacggggacacttgccgtcccgcgccgccggtgttctcctcggccaaggagagcccagcggaggccacgacgacggcgaggacgacgaggaggcagcgaagcagcgccatggcgagatttcagttgatcggtgtgtgtttcaggttcaggcgttcaaaaccaacccgtttattaatttggtgatccatcaagagctccagcctcagataggcgcgcgtacgtgccgcgcatctctgtgcagaggcttcaggacttcacgcacgttgctcgatcacaaaatcacatgaacgatcgagtcgcagcgatgataattaattgggggaggtatatataattaagattttagtaggttgagtgatgatgcgtatcatgcgaacggatatcgtagttgtgctgcattttgatcagttatctgaatatttctaatctgatcaacgccacgcgaagattaattatatatgagcaaatcaacggacgcgatgacatattccagccaactcagtgtatatcttggtgtttgttagagcctgtggctccgttgtatatgtggtgaagcagacccaatgttatctgggtggtccacggatggtgggtcgggctgcgttccctaataatgttttctaagttgtgagctctagcccgctaacacagcaggtcaacagtaactactccctccatctcaatatgttccaacttatgatgggtctctaaatctggacgtacgcatatctagattcgtagtaagcttgctacatattgggatggaaggagtagctcatatgctttctggtgccattagttctcaacggtctatgcattttccaacaacttattatggtgttgttacttcatacttctaaaacatggcatatgtattcgatataagaaattttacagtttattgagaaagtaactagattttatactaatttgtttagtagtactatgttttatactatagtccttctgatactttcttaagaatgataaagttatccattggataatagttctacatatgtaccggacacgctctagtgatacttcccatatggatatcattatatatttgaagctaataaaaagtctaaatcaaggttatcaattaattactcccacatcctaaatatatataaaatgtgcatgtattcagataaattaatatgtgtaacttttaactaataattatgttatcaatatatttgtttaatgacatacaagtaacactattaattttttattttaaaatacctccaagtgatattaatttcatagttgtaatggtatatactgaaaaaaggtaatggttaaagtacaacatttaagatcgtgaaaaaaactatacactttgtatttttggagtggagagaaatatgtgttattgtcctatcgatcaaattgaatagtcaactcttttatatttaaaaccttaacattttatttcttcatattatattatcattaaatttcatttactattatacatataaccatatccatgtatccatatttctggaaatgcgatctatcatgtatccatatcaaattatcaatgtgacatactacagttagccatcaccaatgcaaccgcctagagtaattaactatttgccactcttacaaatggtgatatagaatttgccactggatccacatgtcatggacacatgacggcccacatgttatagactacgagtgacaaattcttaattgccgcatcttaaaaatggcaaaaagttaaatgtcctgcagcctagggcttaacaaattagctattttagctactccctcgtttctaaatgtttgataccgttgactttttagcacatgtttgaccgttcgtcttattaaaaaaattgtgaaatatgtaaaactatatgtatacatgaaagtatattttacaataaatcaaatgataggaaaaaattaataattacttaattttttaataagacgaatggttaaacatatttaaaaaagtaaatggcgtcaaatatttagaacggatggagtatgtggttaggttagtaattctattaatcaactagaaactaccaggttgacttactttgtaaacatcttagataacttgcttctgtggccgaaagaattaagcgttattagccaaatttttatatcgaattaactaaatcgataattcttgcaaaatatagagtttatagtcttaaacaaaactgatctagacttttatgtttatctttaatgataaaataagcggaaacaaactaaatgatagagtaagatgaatgatcaaacaccgatctacagtgccatacatttaaaaacagagataacaaatattgttcatatttttatcagttagattgcttgtttgtttgttttttatcctcttccgcagcgcaattagccggtcgcaacatgtttaagctcaaaagacactccaccttttatgttcattttgatacaacagtgtcactttgtaagttggcaaactgacgctctaaggtgaatttataggtacaaatgtgacttataccagcatccgtgatctagctttttttttttaacgaatcgatgaacgcaaatttcagtgaataaagtaagtgctctagctatttaggatatactccgttctcaccgaagagacccggttcgagtcctcttttttttcccaacctatatagcttttctttgctttattgcttttcatcatatgcttcaggcaggaaaattttgatgaaactgtaagccaaataattggtttgtaatttactggatacatgaggcgcctagtggttcattttcttcttatttagtagtattggatatccaagtccaaggaaccgtgcaactgaatctttcaccgcttcatgatctccagatacttgtcaaaccatttgaccatgtcagcacgagcttcttctgcagttttgacggcgaacgggtcggtagcgttgtatctgcaggcgaagccatggggcgcatccgggaagatcttcaccaagtgatgaacctgcatacatgcaaccaacaagatgaatgagttcaacacacatcacatgatcgtttcaggccgagctaatttggttgagttaaatcatctgatcagggtcgccaatctgcaactgcaattacagagcaaatgaaaataaaaatgaaatcagttggaacttgcccttttgttctgatctaaggcatcctccaactggtgtattagctgtggtggagagatggtatcaagctcacccccaaggatttcaatgggacatttgacctctgaacatcacaagaactcagaaaatttgagagataataactgaacaatataaggctaagtgagtgaaaatgccagaacaagatcgattatctgtacctttcatgtcatctacaaccactagcgcgggatgcgaaatgacaaccgctttggtttcttcagtctttgatagctccacggccacctttcctgtcaagaatgaaagaggaaggtttgatacataaaagcatatttagaaactcagaattcaaagaatgaacacattcctgcaggcacaaaatgaaaaaaaaaagatccattctactttgattcaataagaactgttcatgtcaggagtggaggcaagcctaaggcagctagagcttgtgccctatgcttctccaaaatcatgtacaaattctcttaaatcaccatgaaaattttaaaggaaacaaacaattcattagttgaaccgttagttccagtctttagcaatttctggctcggttactggttcatgtcatgtctgaatgttttatgctcatggatttaactgaataactcaccaccccagcagtaacctccaactccaacagtagacgtcccatccttcttcagagccgcaataagcggtttagtcttttcagctgcttcaacctgaaatggagagcaacattacggaacaaattaatatccttcattagaaaaaaaaagtgattcagttcaaattcagatgaaaaaaagatggcgtttttagtacgaatcatcttctgcgatacagaatctttgcgtaaattgtactggagctagcaattacagggtttttttttcatatattttttctagaggtgacaaaaggaatcagagaggcaaaacaaaaagattggaaaggcacggggatcaaagaaaagaaacaaaccggagagtgtgtcttgatccactcctcaaatggcctcgctggatcatcggtgtaagggtccccgaacaacaaatcaggaaccacaacgtagcatccaagctggtatgcaactttgtccgctattttccttcagcccaaccaaatgggaaaacgaaaacaaaaaacaaatgcacaaatgagttgtgaacgaactcagcttcacgacagcctgttgcttgtgtgatgaagacatgaagtagtttttgcgatttgatcgatgatcgtaggggtggatccagcacgggggcggcgtgatcttgagcccccactactagcgtgaagactatgagattaccatatatagatgaaagggggactgtaattctatctagtttgctcagactctaatgctatttctttttgaatccgtcacttcatagcgcataagttcatattctgtgcaaacgtgagtacctcagttttggtgctcggaaacctgcagaagatgaagcgccaattaatgttagccacaataattagacgaagaggattaattttaattatccgattcgtgtggacaatgtaaatgtcgtcgctaagctagcctaacatagctctagtggctagtgtctccgggaaggcatgcaggcatgcacatgctgctgcaccgaccgtagtagtcggagacgaggatgacggcgcggccgccggagcggcgggagccggtggcgtagcactccaggccgccgtagccgtggacgacgtcgccggcctccccgcccgtgttctccgtcatgttcggcgggttctccaggcacgggtgcttctgcggcgacggcgccggcgagtacacttgccatctcccacggccgccgttattctccttggccaaggcgaggcgcccagcggcggcggccacgacggcggcgagggcgacgacgaggaggcagcggactagcatcctcgtgaatccggcggcggcgcgtcgcccgtggcgaattcagacgtgttcggtgatcggtgtgtgtgtgtgttaacgcttgagcccgttgattaatttgctgatgtgatccaggcactcgagatggagatatatataggtagcgggacggagggagctagcgagcggtgctgtgtgcacggaactccagaaccatagagcctgtttgatgtcattttcaaccataatatatttgtttcgcaaagttaaaaaacaatatctacgtttagtttattaccaaatttagtcaatacataagaaatcttgccattgccaaaattttagcattgacaaaacttgttaatgtttattttagttacaatctaaacatgcccatacatatatatttaacttttttttctattatgaagtcgcatcatttcggctatttttagcttttaatgattcatcaagaattcaaattgtctatcttctcaaaaagcaacactgtacatcacaatcatttataatcgttggataattgatcagggtaacatatatagactatagagaacatatgaaagaaaattatatagtaagaaaattaaattttacaactcatcaatactattttgttatacagttttctcgtagcaacgtgcagaattcccattagtatacatgtgtgctgtgtgcaaaattgtcagatgtacgcgcgtccacggcgcagggaacgtacgtacttaccgggattcaggaaggtccaggaacggggacaaacctaggacaacgatttttatttttttccgaatgatcagcatccgcgataggacaacaattatgactttatattgcacctacggagagagtatatattgcactacggagagagtactttataaaccatgtatagtctaaagtggcacaagtgaacaatactaacatgatatacacttaaacttgtgaaataaattaaacaaccagaataaaacaaaatcctaaccaatttttttagactaaatagatataaaattgagaagatcacggtaccttaccgtaaaacctagtcacgatgtgatgaagtgtaaccacttgggagttggacattagagcggacaattaatgacgtcctgctagctatattggttagtgatggacccctgaccggcctaggctctaggcgatcgcactagtggtctaggcccatggcccttcttgagatactcggacgctcatttgttcagatcccgcacaagtggtctaggcccatgatctcacccttcttgagatacttggacgtccatttgtttagatgcctgtctatgtatcttatgatagtttctaggtttgcatttcatatggagtttgcactatattttcccatgatcgatgcagccgcccagcagtgctgcaattaaggacatacttcacaacttttttaggagtatattgcctgatcgtaaatcaaatacttgattcgaagtttggaacctttgtagagacgaatattgtttggatgtcccctctttatgcagacactgccctttatttttataggcgggttaaaagaagacctgttttttttttaaaaaaaatgcggagggagtctctggtcaagacctacatatttgtgaaattcgattttcagaaacgaacgcttaagccacttgcgacaacattttcacagacgggcgatttaagtcactcacatttggaaataaaatttgaaaaacacgtatctatacttagtttttcatataaagtttgatgaaggacaactttataataaaattgtagattttgataagatctgcaactttgtagctaggtgacaacctttcattatagagattgtttagagacccaaatattcgttacaagatctcaaatttattattataaaatctcaaatctatattgaaacgatctccaaggctccaatgaagacatactctacactatacgacccccccctactactgagtaatctaagagggattacataattctagtaaaagtgaatacatgagatatgtggagggggaattaaatttgaaaatatactgttgatttgttttttttctcaaaaatattcaggatgtaaattgtttagcagaaatatactatcagtctcgcacatccattgcgcgagagtgacgtaggcgtgtgtcacgccccgaactagccccgagtggaactagcccgtgacgctccgaattaacctgttaatcgataccagtcccaggaaacagtgctggtatcacaggaagacagaatatcacagcaacagaggtctctttattatagagtaggagtacagtcatgttgggctgcggacagatcccgagctcacaactgcattacaaaagggaaacggaagccaagacttagaccaaacatcacaggcgtgacttgggaactaggccgaaaccctaaaactcatcgtagccgacttgctcctggaagaactcctcgtcagcgggatccgcttcatcttcttcagcaactggggggagattatttatatagagcaagggtgagtacgggagtactcagcaagccatggggaattaagtgtttaatgcaggcttcaaggaaaggctgttgtttttgcaataggttttatttaaactcctttctgaaacaactaagtgagtgcttctcaaacgacacggatgagacagtgcgtctcgtccggttggagtatgtgcaatgtatcagtcttttgaattgatcaagattggcacccggccaacagctttcaaacggccacccgggcctggctgatcccatcagccgcagattttccaaacatcgaacccaaaccacatcagcaaatttcacaagcagtaggcaaacaaaactacgctaggaatcacctcacatccgcccatgaccgtgggcacggctgttcgaacagtttaataacctctgcagagggggtacactttacccacacgacattactaacccgaatcacccagcccgtgcagaacggccacgtctggtgacataaaggttttcatgacaaggcatttcgagagcagacacagggttgccatatgccgacgagaggggtcccagaccaacaacaggttaggtcccagaccatactgtgccaggaagcccgggggttctctccgacaccaccccgttgaatccacatgtctgtcagcatcaaggctcccccgcttagcaatttactcagccaggggtgtcccattccacccatgtggtcgcacttgtcttatgatcggatgaaattccaaggaaacggtccttaagtgcaagagcgggaaaccgtacacccggtacgttccccggtccgcgattttggaaattcatttagttcgcaagcaccgacccaggtgtcgggttttccaagtcttttgtaaaacccaagttttacccaagatgtttctcagattttaagtttgaaggcgaccgtcgatactcgtgcagagtgcacgattaccgaggcacaactaggtggttacaagggaacatgatataacaattagcaatagaaggatcagatgcaacaagttaggtaggcccaccggtctgccttgcagacgggcaaacagattaagtgcaatcctatcaatgcatgatattttgcaagcaatataattaagttcaaatataggctcaatatgttcaaaggtggcttgccttgctcgagatcttgagcttgatcctcgaattcctcgcactacgggtcttcgggctccgaaactacacgcgaaacgggacaactcaacaaacagtgaaaattaagccctattaatgacctctaagcgtgccattagatagatctcgaaatttgaggaattttggaagttgaatggagtcaaacggccttacggttgggaagatattgaatttctaagattattggatttttggtctaaaggaaaaaggatttatttaaattatttttgaaaagaaaagaaaagaaaagaaaagaaggagggaggggaattagacttcccacgggcggctagggcgcggcccgagagaaaggagcggctcggcagaccttaatgggccggccggcccaagaaggcggcccaaggcacgcgcacgggcggggggaagagaggaagccgatgggccgggtccaccttgcgtggtcccgggtgggacccgcttgtcggtgactcggctcaccgtgagcgaggagcacgcggggcgtgctagggtttggggaggggaggcgcggcgcatgcgcgcggttcgcggaggacgcggatgcggcgggcccacgcgcagcctcatggctcaccgcggaccatgcgcatgggggaggggggaaacggagggagcggctggccgggtcagccgatccggtcgtgccgaggtggctccgacgtggcgcctacgtggctgccacgcgggccggctggaggaagacgaaggcgccggcctcgaatggacggcgggcggcgacggtttctccgggacgccgtgcgacgacgaggggcgacggggcgtacaccgggatgacgagggagaacgagagggagcgagccaacggcttggattcgccggagggagtccgtcggcggcggattgcggcggcggcaaccggcggagagaaaagggggaaacggcgacgaggtcatgagggaccgattcccggcggtgagagcatctacgcggctacgggaacccaccccttgcgccggattaggaggaaacgcatcgagggaggccggcgacgagagacgcttccgagctcgggcggcgatggcggcgagcacacggcgagcgacggcagcagtcggggcgacgccagctagctactggggtactacacacgctactaaccgagtctaaggggaggagatggatcgaggagggagaatgggggaatgcactaccgagatgaggcggggcgctgtgacgagaggctgacggcatgggagcgatctctccggcctcgtgccggggaagaggaagaagagagcgcgcccggagtccccttccgtgtcctcgctcgtgccggctcctccgacacgcgcgacggcgaatggcgaacagagcatgggaggcggcgacaatggagtggaggcgatgggacaaaacgagaggagaagggagagagggcgcctgggctttataggatggcaacgtcggtttgggaaccgacctagggctgtcaagggagggagctagcgctcggcggtcgcggccaaagcggcgacaggggggaaatgacgccgacgggagagaaaagggaaaaaggaggagggaaaaggggcttgcccccttgccactttggggaagaagagagggcgacgcagcagagggggggagctctgcctctgtcccttggaagctagcgcgcggagtggcggggctgggttgtgacgacggcgatgacggcgggggtggtgtggagcggagcggcgacacggacggcaggcgcggacaggcacggcagaggctgacggcggcggcgaccaggcggtcggccaccacggcgcgcgcgcgcgcgggaagcaacgggcggcgcgacgatttgggcggcgtcggcgggaagcggcagcgagagtggagggcgctcggctcggcgcggctcacgcgcacgcgtgcgcagcgcacgggcagagcgggggagagggagagagagagagagagatggggagggagggggagatgggccgagaggaattcggcccatcgaacctaagggaggcgaaatagacttttgcggagggatttgatttgggaaggattttgattcgggattgaacttgacgatcgatcggggatttgagatccggaatggcacggacactagacaataagcaaggaaacagatttcgaaattagggtttttagaaattacattttcccgctaggcgccacgacggaacgggcgctacagcgtgacgacacggacagtctcgcacgaggatgacgcgagaccgcgcgatacggcgagagtgacgtgggcgtgacgacacatgtaagtctcgcacgaggatgacgtgagaccgtgcggtatcgtggcgagactgtgcggtctcgggcgagcaaacagtgagagcgaacggcttctctgctgagcttccgcttaattaatgactaatcacctcattagcgattaattaataataattaatgagtaataccttgattagcgtttaattgatagttaattaatcactaatcaaggtaattaaacaaaattgaatcagccgcacggtctcgctcgctgctaatgcgagaccgaccggtctcgctatttcgtcccgcgacacctcgcgacactcgtgcggtctcccggtatatatcgtcccacgagaccgcccgtgtcgtcacatccatatcattttcgcataatgtttgtgtcagaccgacggttcccggtatcgtcgcacgagaccgttcgtgtcgtcacgtccacatcattttcgcacaatgtttgtgtgagacggacggtataattctgcaaaaaaaatttatccctaatatttttgagaaaaaaccaaatcaacagtatattttcaaatttaattccgtgaaggggcacctttctcatttgtcctttcatcctcagcgtagaatagtgagtctcctcttatatatatagctatatttcatatatggaatgctaggtttgggacaataaatatatatgtgcaagatcatcatgggcccaaacccatagttttttaatactctatgtcggggcagcatcgatctactgagagtcgcagggagtgtggccaccggaggccctgttcattttctttttcagtggattgggtctaaccacgggaattttttatggggattcctaatgggtgagtctgtgccagcacgctcccccacgcaggttgctcgactaacggcgctcttagcactgtcaggattatggataccacatacctaatagtagttgactaaatctcggcaggacccaccacataccatgtcctatacggaagcaaccttgggatataagaggagttccggataaggaaagacaaccagagttctacatggaaacgacgaggactacttggattgtattcatattgggttccctagttcaacttggacaaggagatacctacgggtataaatacaagcccccctaggaggagaggggacacgagacaatcaacacccaacacaatcagcatagaagcctacatacgccaagacacgccgccggatatcgacttcagggataagcacggctagtaccctacggtgtctccggatactgtcaggagaaacgaaagcgccatctctgatctcgccgggcacggattcgaggagaaaggctaccctattgtcgactacgagtcagatcgtcagaccgccatgttgacaacagttagataggctaccccaaatagtgtattggtgtgattatcatgaataagagcaatatcggctccggccaacaggatgtagggttattacctgacaattcaggggtccgaacttgtataaaaatcctcgtctccgtctcttttacctcagtctcgcgtatatcctagtaccaacgatccctatactgtccaaataccatagtcgtgacatcaaacgtcgacagtggcgcgccaggtagggggactttggtgcttcaggatttcgacgagatgggttcaagagatggattctccaacaataagctactcgacgacttcggctgtgaggagatctaacccaactgaagtacattttccgaccagatcgaaaccatcgtcgtcatcgataactcggtctatcgagatcatccaagcctcaagatacacggcgtaccaaaagatgtcagatcatatgatgtcgaacgagtacgcaataaggtaattggtagattggtttttcaaattgatctactaatttcgtagatacgtccggcatgtatctacaaaggtacgcaatattttatttgcaatttatcgtacctattcagatcatacaacattgtcagatctataatttattatgtttacctagagcatgttttttatacaatatctattgcgcgagtgtccccgatgttaaatcgactacggtttaatgctgagggcttgctctattttcttccgtataaatcatgcttgcttacggtttacataatgcctgatatttacatctgctcgttatatcctgataatactagaagatctatgcagtttttgagtacatactcgatattctctgctatatgtcttgccttctagaaaatatttttcaggaacatttgagcactcgagtaggttgtgatcgagtacaccccactatcgagaacattctcgacaaatgcggagtcgtcgcacccaacttaccaacgaagaccgacgacctatctcatagcaccggccatggctggactactcgagaaaagattgttaacggataattcctcgcaaatgccgtcggtttgatcacccgacatgattgcgagcggacatccggatatgctataagttgggtatgtgagtcatgctggccacatgatatgcacatgtaataaaccaactttagcgcccctataggtgattaagagactcctacttctggttctcgaaccagtaaaacgtagcgatgtagcgtttctcccactgtttccacttcaagtggtcgagttacgactactgcctggtcctcgaccagcgatgtagtgtttctcccactacttccactttaagtggttgagttacgactactgtctggtcctcgaccagcgatgtagcgtttctcctactacttccactttaagtggtcgagttacgactactgcctggtcctcgaccagcgatgtagcgtttctcccactgtttccacttcaagtgatcgagttacgactactgcctggtcctcgaccagcgatgcagcgtttctcccattgtttccacttcaagtggtcgagttacgactacttcctggtcctcgaccagcgatgcagcgtttctcccattgtttccacttcaagtggtcgagttacgactacttcctggtcctcaaccagcggtgtagtgtttctcccaagtggtcgagttacgactactgcttggtcctcgaccagaggtgtagcgattctcccattacccctgcttcaacaaagttgatatcaggagcacaagatcaccaagtgttttacccagagatcccttacccagatgacacctagcgttgaaacctatcctaatgtccctttacgccgtcttgacaaggcctccgaggaacctaagggaacttcggctagggacgcccagagccgataaggccttgtcggatcctttagagacgaaagaccatgtaagatctggtcgtgtaatagttctcgccgtgcgtattaaccaagctgtgtaatcggaaatggaatttccaacttcacggcttggggctaggatcagtgcttgttcaaccaaggcaggtcaaaggtccaagagccttatcatccgagaacaattctccgacgacaaggctgggggctagggagagtgtatgactccacaaactgactgatcggagtcggtaagagagaagacgctcatatacaaaacactggtctgtacattcaattcactagtatgttatattataacatgttaccctttgagcgttcgctcgggggctatttctatctaatattcttttcttagtattgatttcaagaaaattctattcgacaatgacgaaggctccatgtctctatggttgtacaccaagatcgactaaggcgagtacgacaaatgtcgacaaggctccgtcgcagactctacgccttctcgatcgctcgagaacagttgctggatcttgacaaggaatacggaatgaagaaatggtgtacccgccgagataaaatttcttgacttcaatccaaattctcgattacagcaagacgggagacttagtcgtacgctctgtactttctcggtcgacatcagagattgacttagacaaaccctttcggtgcccgcacgaggctgataaaggaagtctaatgttatctctaaactcaccgagaacggttacgtgagctcgataacagttcctccaaagtgtgtggttgagaatatgaactcgttcatttgcatcgaagtcgggggctactgtcagggttatggataccacatacctaatagtagttgactaaatctcggcaggacccacctcataccatgtcctatatggaagcaaccttcggatataggaggagttccggataaggaaagacaaccatagttctacatggaaacgacaaggactactcggattgtatccatattgggtttcctagttctacttggacaagggaacacctatgggtataaatacaaacccccctaggaggagaggggacacgagacaatcaacaccaaacacaatcagcatagaagcctacatacgccaagacaagccgccggatatcgacttcagggataagcacggctagtaccctacggtgactccggataccctcaggagagacgaaagcgctatctctgatctcgccgggcacggattcaaggagaaaggctaccctgttctcgactacgagtcagatcatcagaccgccatgtcgacaatagttagataggctaccccaaatagtgtattggtgtgattatcatgaataagagcaatatcggctccgaccaacaggatgtagggttattacctgacaattcaggggcccgaacctgtataaaaatcctcgtctccgtctcttttacctcagtctcgcgtatatcctagtaccaacgatccctatactgtccaaataccgtagtcgtaacatcaaacgtcgacaagcactagtcacgcttagcgttaatgatgagtctaaaaattttctcataataaaataataaataaccaattgagatggaaatttcaaattttaagttttctgattaaagtttaagttgaaagtcaaatttaaataaaaaacttttaagtcaaaattttaaactttcaacttaaatttaaaaactactaactcttgattaaaaattggtttaaaaaactttcaactcaaaatttcaaacattcaactcaaattatgaaaaatttcaagtcgaatttgaatctttcaagttaaaatttaaaaaactttcaactcaaattttgaaatgaaaaatatttcagtttcaactaaaatttaagaagtttgtactaatgttatcattttttattataacaaattgtacatgtttaagttttaaaagaaatgcacaatcaaatcacttgattagaaaaaaaagatgtatacaagagttgtgggccaagaaagaccacgtggcttcattggaacaggtagcggaaaaagtacaccgaaggtccctcaacttgtcatcgggatacaaaatcgtcctcaaaccacaaaaccaaatatacagggtcctttaactatacaaaaccggtcactcaagatcctttggcggttttggccccggttttggtctacgtggtggctgagtcagcgtgggacccatgtgggccccacatgtcaggatgccacctcatctcctctctcttattcccccctcttctccatttctctctctttcacttttctcaggccagcgacgggcggtgctgtggggaggaggctgctagggggaggggagaggaggaggtccggcggccggccgcccgaaacaacgtcggctcaaacggcccgaaacgatgggcatcgtgtgaatctcccgcgttgaatcttgccaatggtggagcggcaacaaaggcgtcggcggctggacgacagggctgagtggtggtggcggcggtgccgtgctcgcgctcgtcctttcccttgtcctcctcatcgtcgcggcgtggtaggagtacgacgtcacctcgccgccgccgcggggccctgcgacgcctacctcgtgttccgctcctccctaccgctctacgcctccgccgtctcgatctccaacctcctcaacgtcaccgccaccaccggcggcgaggtcgtccgcgaaggagatggaggagcaccagagctagaaaaagaacgcgccggtgctctacgacctcgtcatctcccagccgctcaagtggccgtagctcaccgtctagtggctcccctcccactcccggtcaccggactccaccctttcccaccgcctcatcctcggaacccacacctccgacgagacgcccaaacacctcctgctcgccgacgctgccctcccgctttcgccccacctagcggcgggggccacggcggcgggcggtgccgtcccagcctcgtccgtgtccatctcccgctcggtgccgcacaagggcgaggtcaaccgtgcccgctgcatgccgcaaaggcggtacatggtggctaccaagacctgtgtggatgaggtgcatgtgtaccatcttggcgacgacggcgagaagtgcggcgccgatgtggtgctcagggggcatgaagcggaggggtatgggctggcaccagctcagagtacggcgccgttccaggtgagcatcttcaccagccggtccaccaccgccgccgacgtgccgacccgccggagcgcggcctcgccaagccgtgggttcgccgcgacgttgacgaagatgatgaaggaagggagggagagagagagagagagacagacagagatagatgaggaagggagagaagaggggaaagagggaaagaaggctgacgtggacacttgacatgtggggcccacgtgggtcccacactaactcagccgccacgtagaccaaaaccggggtcaaaaccaccgaaggacctcgggtgaccgattttacatagttaagggacctcgcatatctggttttgttgttcgaggacgtttttttgtcccgatgacaagttgagggaccttcggtgtactttttccaacaggtagcatgcggagtcagcctcatgggcacttgcctgctcacacgacaataaaggacgagctgggcctgtgggccaaaccatgcggtagtaagaaagctagcgcgtatgcgctaattagcgtttccgctttgagtcacgccaggcatgcgagatctaaggcccttcataatgcagtgagttggagtgttacctagttctccagctaggccaaaatctaatgtggaggagaaaaagcagtgggccccgtgtctttgcaaggttttgtacatcctagctaggatctggtttccttacgcccaaaagagaaaccgtgcgtgcctgcgctctgcggtcccctccccaatcctcaccattcttccccaatccgatttccgtcgttggtcgtcagcatccacgcgattcgcacgggcttatagctcgccggccacactaccgagtccggcctccggtgaggaaggggagaagccagaggacggccggaagagaagtgcgacgacagtggtggggagatgtcgtcggtcgcggtctctaagcgaggacgaccacgccgggcgtggaaggagatcagagctggggtcgccgccgtgccgctgccgttgtcgacgccctccagatccgcgctgtcgtgccaccgtcgtcgacgtcctccagatccgcgctgccgtgccgccgtcgtcgagtcatcatcgtcgacgccctccaaatccgtgccgtcgctccggattcaggccgtcgcgtcggcctcctcaaccgccgttgctccggatccacgccgccgcctcggcatcctcgactgccggcgctctggatccacgccaccgcgtcgatctcctcgacatccggcggcgccggtgttcatcgtcgaggtgggggagaggggagaggccgccggctgcggagttcgtcaccgaggtggagagaggccggaggcggcagcgtcgcctgtgaagcttcggatgggttgtgtgggcggggaaagtggagaggggtagtgtgggtgcctggttagggttgagattttgtattattttctccattgtaaggtgttcaatgtaaaatttatacttatttgtaaattgatcaaaatatgagggctgaaatcaaaagtgataggggctgaaacggaaaatcaaagtcacccatgaggccatttgcactgtgggggaatcaaaacttggacacggtgctttttagcctacgtggcattttaggttcctcaagtgagtagcttgcattgctactggcctaaccgagcacgccatgtgtcagcgtgtgactactgcatgcaaagtctttttcactcttgtgtatgtttagttctctcttggttaattacatgatgagggtcaggtaaatcttagggataagtctacgggtcgggcgtctgatcggtttggagaaaaatcgggcgctgacgtcagcgcccgatttacgtgcaaatctacgttaaactgatttttctcttaaattacttatccaaatcataatttgactgcaacattaatttcgttgcaattaaatcttcaaaacaagaccacacatggatatattccgacgaaatttttttagcttattattgaattatttttaaatgttgcacgatgttccactagatatatcggaattgtttcactaagttgatcgaaaatgtttcactcgtttaaatcggatgttgtttcaccttatataaaaagaatgtttcagcaaatagcgaaagaatgcaaaagaaaatttcacttcactgctacattagatctatacatagtgaaacattgtgagtacattaggtgaaacatttttggtggaaaaagaagtaaaccaaattcccttaatagagagttttcaaaatatgtgggtgatttgttgcaaaagaatattttaattcactgtaacattagatctatacatagtgaaacattgtgagtacactaggtgaaacattttctgtgaaaaaaaataaaaccaattcccttaataaagggtttagaaaatatataggtaatttgttgcaacgttatgtgtggtggggataagtgacagtgtggcaggaaagatgtgatgggggcgtccgatttttcctacccccgagcgcccaggaaggagcattatcaaaatcttggtcaaagaaaaaaaggttaggtaaatctaagctagtttatcaaggggtgtttaaaagagagggactaaaccaaaaaattactccgacttatatttttggagagctctcttccaaacaccccttgagtacgcacgttgttgaacgcaacgactccggggggtcagtcgtcgaccgcgtgtttaccgcatttattcacacgacttttcaacatctctgcagtatccccagttccccactaataaagaaattagggtaaggaaccaagatgtacgacgattatcccagctctgttttccggtatgaccattgatttgtatccatttgataggctgatagctgcgacctgcacgcggagattctcttaagcccgagtgacggaggtagtcatcaagtcatggtttctgcctataataccgagcgtacatccgagccgtagcgagtagctcgcaaatcgcaagctaacacagaacagtaatttgatattcacttgctcggagtcggagctctagcttggttcatcggttgcatacttgcatataccaccgtgccatgccttacctcgtccagctcctcctcctaactgtggccttgactctccctacctccgtccatccacagagcggcacaccacgagaagatgatgtgcgctgtctcgagggcctcaagacatccctcggcgacccggatggccgcctcgcctcctggaccttctcaaacacctccgccggtgccatttgcgagctctcgggagtttcgtgctggaaccccgacgagtctcgcatcattgctctctcgctctctggctttggcctcaccggtgctatcccctctgagctccagttctgctccgccatcacaaccctcgacctttcctccaaccggctggggggacaaattcctcccgcactgtgcgactggctccctttcgtcgtcaacctcgacctctccggcaaccagctctccggaccaattcccgcagagctggccaactgcaagttcatcaactcgctgaagctgtcggcgaattccctttcgggaaaaatccccgcctcccttgtgctcctaggtcaccttaagtcgctagacctgtctaacaacaacctggacggcgatatcccgcctaagctagcggcctctttctccgcggacgccttcgccgataaccccgatctcgtcgagccacactccggttttaacctcggtgtcctcttcggaaggccggaggctgcagccgccattgccttcgtcttcggttttgttggcacactcttcttcggtccttccatcattagacgggtcgctggtcgcagttgttagggttaatcttgttgttcatggtttaattaggatgagtacctacttaggagtcgttgtttatagaatatgtctcgttgctgcaatgctgcgttggtttgtaacgtataccggccaggtcgtgtacgtacgtaaacgtatacgaatcaaagcctgttaatcttggaagaggattctaattcctcgaggaacatcccctcgtgtaattaggggtgaaaacggtacggaaatttctgagaattctggctaccgtttccggtttgcaccgaccgtttcagtcagtatcggtaattgtcagtatcggaaatagaaacggtaatctctttcgaaaatggtagcggaaatgggatggggttttttccgaccgttttgtcggtaactgttttttatcggtaatttccgtcaaatttccgacaaaattccgaagaaggaagccggctgggcctcgctagcaggagcaagacaggagcagcccattaggcatttaggccgggaagaaaacccatagggcgtcagccggcgtgtcacttctccttctcatccactccctgtctcgtgactctcgcacagctctccgccgccgccgcaccgccgcttgctagttctagccgtcgtatccttgtgcctcgccgcgtcccttgccggagaagcaagatggcgcctgccggagaaaaacgccgcatccatctggatccatctgaaagcaacaacagagacgaggaacattgagtttgccactgttgccaggtttgccaggtccaccaggtataagtgtatagcttgaatgcttgagcatgatttttttacatgtacagatgaatgtggaacgcctgagccttgatgtgtttgagcacgattttctgttgatgtgcaagcatgattttagtagatgtacaacttttaagccttgagtatttttttagacataccacagttaaatatgggatgataccacagttcactgtttccgacatgaattttcgacttccgaacaatatcggtagattcccgttccgacggttccgtttccgatatactgacgttaccgatatcgttaccgtttccgagtataccgttccgattccattttcgagaaaataaaatgaaaatggaaatggtagagggtttttccgaccgtttccgaccgttttcatccctacgtgtaatatttttgtcaaattcaatgtaaaatggttgtaaaaatactttaaaaaaaacaacataagtacactaacatctatcaaaagacgaagtacaccgaggtcaaaagcggagtgcggctcgacgagaagagtgtccatcgtccattggctccgtcttctgtttaattgttgctacactcttcttcggctcttccataatattggacggccgctggcaagaacaagctgtaggagacaatgaaatatatatgcatgcgttcttgtgagattgcttttcgtcgactgatacctaaccgtgtgagtcatgatccataattccgtattcgagaagatcagtactactttattcatgccatgaccatgcatacatatgggctttcacagatccatgaagaattcctcgcccgaaaccgaaaaatacataaagcaaactcactcactctggctgcagagcgaccgtgcgaagtgcgtactcacacgcaattttattcgatcgatcggggccggcacggcggcgcacacgtctacttcgccgcagacgccgacatgatgtcgccgtcgaacggcgcctggccgaagcagtccaggttgggcccgtagccgacgccgagcacgtcgcagtagcgcttgtagaacgcgacccggtcggcgccgccgttgccgccggcgcactggagcccgccggtgaggatgttcgtggtgagcccgtagcctggcgcgcggccggccgcgctgtccgcgggagtcggagtccactgccccgtgacgacggcgtgcggcgacggctggctcggcgaccgcgcggtcatccacagccacagcgccgtcttgaacgccaccgtcgggtccgttgccaccagctccgggttgcccagcaggtccgcgccgatcgcctcgccggccgccccatagttgtagttgctgaaattgaattgaaaattagattccagtagtggtcatttgttcagtccaaatagtactagtctggaaattgaacgtttcacggatgaaatcccgttgcattttaagatttttctagtgttcgtccattttgtggattttttgtttgcaagttcatttatatggacgttttggtttgctcctttgcgttctcttactatgcgatttgcatgggtccgcgggcgtggtacgccttgccgggcgcgcacggccagcgcgcgttcggcacgcagaagtctgacgtcgcgcccttcacctccttgtagcagtagccccacgagtagggcccacctgcagggacacatgcgcactcgtgcataagacatgtgtacgtacacgtgagttccaacgtgacaagtaaacgttactacgttaccagaggtcgcgtgggaagtctgggccaggaacgcggcgacctcacgcttgcgggtgtcggcgtcgcccgtggcggcgaaggccgggaacgcgccggccgcggcgacgaaggcgcggtaggcgtagaacccgcgggcggggcacgccgcgtcgtcgcggtggggcagcatgcgctcgaactggtccgacgtcacgacggacgccacgccggcgcggccgccgcccggcgccgtgagcagcaccgcggcgacgtcgtcgtcgccgccgtcgcgggagacgcggcactggctctggcagccgcccttgcagtagtcgtcggtgaggccgcaccacccccacctgctgcagcagagcctgttggggcaccgggcgccgccggcctgcctgccgcactgctcggcgcgcgccgtcgccgcggcgtaggcgagggccagcacggccagcgccagggccttcatggccacctgcaggtttgcagcccttgctgcgatcatggcaagatgcttatttcttcaacaaaatcttgcttttcagtggtgtgttggttgagtgtacgtagctggtgagtgatgaagccacagactgcatggcctcttatatagaggagatcatggcctcatctagcttgtgtaaaatcggttatgcaaggtgatggcctcatcttgtgtgaaatgagtaggagtgaaaaccgatcggatagatccgatccactctgaatccgttcgaaacgaggatatggtatgggcttttggaaatccggcggatatgaatgcggatgaggatagtataatgcggatgcggatgaggatatggtatctctaaaatccggtggatgcagattatccgacatttctatcggattatccgattggccgtttgccggataattcgaatttatcaacacatgtaatcactctatctattgcatataacataagttggtctatcgaatgcactaatttatcaattagcatagatttcttagtctgaggctttcaccttctcatggcatacttgcgtagctgtatttttatattatggacatcatgtattcatattgtttaacacttaagcacataattagtatgatggatcgtttattgattattgtattattgtttcttgcattgctaacttaatattgtattgattgtatacacatgtaatatccgataaatttaatctttttcgaactgattccgcactatttccgacatccgaaataatccgctccgcatgcgcatccgtatcctatccgcacccactctgaatcctggtttaggatatggtatgaccattattcgtctgaatccgctctgttttcacccgtagaaatgagtcatgccagtgtggagagtacactgtctttcgggcagcacgagggtgcgttgctcgttttcatctcctgcatgcctgcgtctgctttgtttaactgagcccactgatacatggatgcacgatcgaatatacagggcattaattaaactagatgaagagatagaacagtagtaaaaacgatcgtctttgtttccggggattcgatgtcacacatgcatcagccagatcgagccgtgctctggtttgattcgttggaaagtttgcgttacaactacccaggatgagacaggatctatatgaagaaatgcaacctagatctctttgtatgatagatatgaattcacacacttgtctctctcatgtggttttttactttgtaggtagataaagaatttcatgtacctccctctttgacgtcgttatttacttgtgtagtactaacgaataacgattgaatttggcatggcttaagcctgctactaaacatttctccgatatatcaactttagcatccttgagcaagcagataggaacagcaacatgaagcaaatgcatattggccagaaaacagcatcaactaaaatctgatcccacgattactcaaactgacatgaactgttcttattaacgaaactaattaactaataaaatgattgtataaactctatctcttttctcctgaaatgaaattggcagagttcctgccctttgcccctcaaaaaaaaaaaaactaataaaaccgcgcgcaacaatgcaggcaaactgcaccagaagttcagaacaacgatgcgaccctgatcaaaccaaaggtcaattaacggataagcaaaacgagcataacctgcagctttcttacgcattttttaatcaaagaatttattactaccgaagagattcagaatttcccgaatagtggtatagggttagagttgcatggctgcacccatggagcattggagcctgaaggagtgaaggtgatgccaccttgtccctgaaaatgttcgatgtgcgttgtgcgaaatccctgaacaacgtcggtggacgtggacacactactctagtcactagccatcgcttgttacactgcatcggggcgcagttcagctcgtctggaccgcgcaggccgcgaatcacggtagccaagagattcgaagggattcggagttttattctccgaaccccaccaccgcatgactcaccggagcgcgccgcatcctgcattcctgccttggcctctcgtcaccggcgaccgcaggtacacgaacacccacgcgacggacgacacgctaccgtgcaggaagaacaccctggcatgcatggtgatcccctcggctagtgatatgaaattcaggctcacgccctgcgtacgcaaaattggtgaacttgtcggtacatgcaattatgcaaacgtacgggaaccggtaagctgattgcaatctgaatcctgttttagattctgagattaatggcacaatttgcccttcttttgtcctgaatgttcaggttcatatggatgcatcatgcatgccaaacccaaactcatgcagcgattatctgcatttacatctgcatttgtttgtctgttctgttggcaatttggaagacaagaagcaaatcctgtttccaaaacgaactaccagaaaattatgtgtttctaatacactttgtttgcactttgcttgcatcatggtcaaaattgcacacgcagttggaaaatcaaggggaaaaaaatacttcaggggaagcaacttccaactagcacgccctgaacccaatattaaggacgtgcactatagtcaaacaaatctcttagcctttgcgtgttggaacggattttgcgtcaatagccaccccgcctagactgttcgacttcaccgatcatccagttccaatcaat

SEQ ID NO: 59571 - DNA, 3720 bp, Oryza sativa
  unsure (1)..(3720): unsure at all n locations
tgtgaacaatcttacaaatcactttgtcaaataaagaaataaccaaaatagaagttatagatcttgatgagttatacaactttgttattgacgactttttcagttaaaatcatttagtatttgaaaatgttgtttgaagttgttataatttaaaattcatattcaaactgttcaaacaaagtcatatagaaaaatgaccaatacaaaagttgtagatcttaataagttatacaactttgtttttgacaacttttccatttgaaatcatttactacctgaaaaattatttgaatttcttatattttaaaatttaaattttatatagttcaatcaaactcgaatgaagaaatgactaaaagaaaattggtagatctcaacgagttctacaactttgtttttggcaacattttcatataagttcatttaatatcataaaatttgattcgaacttctcacatttttaaattaatttttaataactattttcgcatgcggtccacctaaggaggcgcatgtaaaaatctatttttgcatgtggctattttaagtggaccacatgtaaaaatatcttcacatcaatagttttttccctcctcaccacttcaaaaattttcatgtcttctcctctcctctctctgatatctcaccccctctatttttctttctcttcctctctctcactctctctcttcctctctctctctttctctcctcgatctacgcccggccgaggaggaggtggcaggagcgggcggcgggcggcgggggctgcgacgaggaggaggcggtgggagcgagcggtggcggcagatgggagcgggcggcgggcgacgcggccgagcagcgggcggcgtgggccgcgacgaggaggaggcggtgggagcgagcggcggctgcggatgggagccgccggcgccgggagagagcggcggcgggcgacggccgggcggcgcagatccggtgcatagggccctccctcgcgcggatctggcggcggtggcggatgggagcgagcagcggcagcgggagtgagcaaccggcgccgggagtgagcggcggcagcggatggcagcgagcgatggctgggcggcgcggatccgacgcagggggccctccctcgcgtggatctggcggcgtctccgactccggcgacgacgacgagtgggcgacgacgacgacgatgcgggtggtggcggcaggcctcgtcccacccagatccagaggcgggagcggccatcgtgatcgagggcggcaggagcgggagctggcggcggcggcgggagcgggggcaagtcgcggatttttgcatgcgggtgccctggccgcatggaaagatggtgatctttgcagaccatttcacgcatgcggctggcccaaccacatgcaaaaatcgtgtgttcctaaccggcaccagcgacgatttatgtagaagtgcttcttcgatataagagtttttctgcatgattaaaagagaattttgttgtccatttatttattctgaaatattggactgacactgtgccacatgcatatatatcggtttcagcccggttacaagtttatgacacaccatacttcgactcgatactagtacgttgtaagtacgtacttgtacgacgacacgtacagggagtgagtggcaaagcactcttattttaccgccagccagtcgccgccggcgaagctactagctgttcactgcgccgccgtcaacccgctgttgaacggcctctggtcgtagcagtcgaggttgctcccgtagccgatgccgagcacgtcgcagtagcgctggtagaagccgatccggttcgccacccggtcgtcggggccgaacccgcactccaacccgccgttgatgatgttggtgatcacgccgtaccccggcacccgcccggccgcgatgtcccccgagctcggcgtccactgccccgtgatcacgtcgtggcacgacggcttcggcgactgcggcgtcatccagaaccacagcgccgtcttgaacgacaccaccgggtcgacgccaccagctccgggttgttcaggaggtcctcgccgatggcctctcccgccggcccgtagttgtagttgctgagagatcgatcgatcaaaagttcaaaaccattcttatcgcgctgagaatttgataaaaaaaattgaacctagctttgatgtgcttactaggagagttggatggggccgcggccgaagtacttcttgtccggggcgcacggccactcggcgctggggacgcagtaggaggccgtggcgccgatctcctccttgaagcagtagccccacgagtaggggccgtcgggcgcggtcgcccacccgcccgtggtctcgtgggaggtctgcccgaggaacgcggcgacctcacgcttgcgcgcctcgtcgtcgcccgtcgcggcgaagtccgggaacgcggcggcggcggtgactaaggcgtcgtaggtgtagaaccctctggcggggcacgccgcgtcgttgcggtggagcagcagctgctcgaagagctccttcgacacgaccgcctccaccgcgccgccacccccacctccaccgccgcccccgccgccaccgccgccacctccgccgccgcagccgtcgcactggctctggcagccgtcgccgcagtagtcggaagtggagccgcaccagccgtaggagctgcagcagaggcagttcgggcacagcgccccaccggcctgcgagccacactgctcggcgactacctgcgccgccatggccgcggcggccacgaggagggccactgctgtcgtcgtggctttcatggctggacttgggagtcctcgtgcttgatttcgagatgggacgatagcgcgtaacgcctgccttttatagacggctggcgagtcggaatggacttcgctagcgagctcgagttttttcatcttcgtccacgtctgcacggaattggtggtgattgctagtttgattgtgaccgctcagctgtcagcctgggcagtacagtacgtagctagactcatcatcaatcatgaagggcaactatttggagttaatgttaagtctcattttagtttcacagatcgatcttcacatagtgagataaactgacaaccattcttgcttgaagaacactaattttgttgcctgattacttccaacctcatgcgagctattatagaacatcggtaactaaacacgaaaatacgtcataagtattcaccaagataattaaccacatcgagatatgatatttactaatgagattgtgctaaaatttatatctcgggacactgattacgggtgttccttagaaaccatgggtgtgccaatgaaacatgagctatagttgtaccccaattttttggaacttatgatttcatagctatattatgtgttttgtgatattatttgtgtaaaaacaagcattcttgagcccaaaatcatcctttctaagggtattcaaatttctccttatatactttacaaaaaaatctgtacaattgattgttattagcactaatgtcaaaattacttcttcatttcacttataggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 59572 - DNA, 929 bp, Oryza sativa
cgatggagtcagattcttttcagctttttccttttcttttattggacaaatttttttttcgcccatttttttttctcctgtttttttcggatcggactatttttttcttttttcgcccggtcgatttttttaccacgatatatataattcctttttctttggaataggacagttttctttttatttttttaaactctttttaccgcgtcgatgtagtcggattcgtttcgatttttttcctttttttgctttcttttttgtcggacagatttgttttttttccacccggtttttttccgcccaggtttttttatcggacttttcttttttttttctccacgatacatataattcatttttctttggaataggacagttttctttttatttttttaaactctttttaccgcatcgatgtagtcggattcgtttcggtattttttccttttttttccttttttttgtcggacatatttgttttttttccgcccggtttttttcgccaggttttttttatcagacttttctttttttttcgctcggtttttttctcccgttttttgacagacgacagaagcacatagagaagtgtttttttttcttttctccaatccaatacagatcggatctcttccagggaaatcagattttttttctccaggatcggactctttttttttcgctttttttattcattaaacggtttgtctctcggacttttttttccctttttaagggatcgggtgtttttttgccagggacgggtgtttttttcgcccggttttttttttcactttttttttggatcggacttttttttcgtccggttttttttatcggacaaacttggttttttctgcccggttttttttcacccggtttttttgacggacgatggaagcacctcttattttttaaaagtagtagta

SEQ ID NO: 59573 - DNA, 4575 bp, Oryza sativa
  unsure (1)..(4575): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggaaacatgccatggataatcttcatcggctcataaacattcgaacagggattaatattatttattaatcacgaagtactacttgacattgacgataaccctactacatactccctccgtcccaaaaaaaaaggcaaacccgcggtttgcgtgccaacgtttgactgtccgtcttatatgaaatttttttataattagtattttcattgttgttagatgataaaacatgatgaatactttatgcgtgacttatctttttaatttttttcataatttttttaaataagacggacggtcaaacattggacatggaaaccagggtttgtcttttttttttgggacagagggagtagtacaatattatacttatcgatcttgaactagtgaatgtgtacaaagaaagtggcacccaccctagctttgaaggggaagaagagaaggaaaaaagaagacgtttgccatgaatacccgtgcctagtcctctcgggccaagaggcaaccgttgctcgaaaagcctgtcagtggctggcactgcagtgcaccggtgcaaacaacaattcaaagctttggttgcttggttgatgccatctactgtactactcttctccacttaatctcatcaatggcagcagcacacgagaatggcaactattacagaacagtgttattgtagcagcaacagaaattcgtattgcgtagaaatagcaaaaggggttggttgtttctgcacattcaaggcacagattattctggtactgacacagctggggacagacaaaatagaagtactaccataacaatccagttccagcttagcaaatttctatgccatgatagatgtcaattttcaggcatggaaattggcaggaagcattttcatgctgcaatcttagattaccaatacagtaacagtgtaacacccctattaaccgcactctgttctgatgcccaacagtgttaaaagatggtcttaaactcttagtacatattagcaacagtaatgaggcacaagtttcacaactttgtggccttcagatgctctttcagtgagagcacatctctggccagtaatcaaccattttcattccatcattttccatcccaacacttccaaacaaaaatgatatcacggagacttaacataagaatcatgtgtgcatgtggcattcatttgatcacgcatcatctggaaaatatcacaactccaatttgaaggtgcaggagaaagaaaacgattaaatgacagaaaactagaatataaaagctcaagggcttggataaattgcattaaggttcaaccgtagcagtataatggattccaaggttgcagccacgtggtcgagcagcgatacaatttaagcaaaaagtaggataacttgatctgttcaactagccgcagtaaacctagcctagattaatttgttgctgttacttcacgaatccaagttcagtgtagcatctgctttagcctcaatgtcattcttgctcctgaccaggcatctcttctttgtttcctcatccaggtagcccaagtcttcggcgactgcaatatgcgcatatagcaactcctcgagttcatcaacaggagcatccttcttacctttgccacctttgatatgctggaactcttccttcccgtggcttttgacggtgaaatgctcgtggattctcatcgcctcctgaaatccagatatcgttggaagaaacttcactaggaacacgctctgattggctggtctgccatggctaatctttgccttgtcacatgcaaccccaatttctggatacagaagaaaatatcaacttaagggacactaagaataacgcatgagggcattttcaaaactcaacattatattttgtgccagaaactgcagatatacaacaccaagcattcctcttatccaaaagtactaacagattatatctagaagggaaaagcagttacatgatttcacactgtatcagctgatcttataaaaaattctaacagattatagccataaatgaagatgcatactagttcaaggaagcgtgcgaccaaaaaaatggtttgttcgagctagatagccacgatccttaggttgaatatctccagggacaaacaaataaaagggggactgatagaatgtaaattatattgggactaaatgaattactaacctgtcagcacaccttcaatttcttctttcgacacaatctttgcatcggtagcctttgccttggttgcaatggagctgttatgtattatgacaactggtggccacaacatgagatcatccttcatggcatttacttcctcatctggcatggaatgataggttttggtagtgtcaggagcaacatgccaattccatcccatcataacacagagtgccttgtgaaaccccaaatgttttgtcttcaaacccattttgcatgtatcataagcatgtgatatcaaggcatcgatgtccggaaacttccttgggacactgttatgcgaaagaagtgaacaaaaaagaaaacaaataaacaaagcagttcttcaggttagacatccaatgtaaatgttcaatgaaatcagaattctacgacacaagaaatatggtatccattatgcttttgagtgcagtataatgtatgacaaattgtaatgaattcagaagggtttatgcagaacatgctgtggcttctgtgcagcagacgaaaacatagtggaaaagaaaagagtatataagaaatagcaatgcaaatattccaaatatttagtatccctaaacaaaataaatggttaggaacagcaaaaacatcagccaaacaaattgttgcaactaagatggtaaaggtggaaaactatacagaattgaagatactttaccttcagctatctcaagaaatgaaatgcagtactgttgattcatgcacccagcaaaaacaaactgttgcttcatgcaataaattttaatagaagtctaaagcttaaaataaaccaaaaaaggatgacacataacaaactccaagaaagcaaagatcaacgatatctgatttgaacaagaaaaataaaccaagtgtttaaggtttgttgtatgcttagcaaccagaagagtaataaaacaaagttgaaacaaagctaaaagttaaaaaaaataaacattaagtcacttaactggcaaaaacttctgtagtaattggtacttcaataaaaagtaatattcaatatagagattccaatttaattaggactaggaagatgtcaaggcataaataatggcaatttctgatacctaccaaaggctacagatatgaaatgaaatcccaatccatatgaagcttatcagcgctatactaatgctcatattgtaaacagtaggaattgactaatgcaaatgcaaaagtgaattttcaagcataaattactcaccaggatggaaagagcaaaatagaagataacaaaatatgcagcatgtactgtgtacccgaaatacccaacatcaaatgcagcaattggttcaacctacagtctctactctctagccagaatataaaaaagtgacatgctgtaatactgcaagagccgatgctattggtttgtgtcttagttcgcaaactaacacatgttatccatcagccttaacgacttggcaagcgttgaatgcccttgaaaaaagacataacaattctgcctgattaaggaaacacaagtttttgtgccttccatgtgtttgattatggtaatccaaagaatcataacagcaatttggtttgtatgctcctgacctcaacaggatacaaacttggctgccccagacccagatactagcaaccaaaagcaacaatcagtcaacagaaccatatttcacttgtacactcttcatgtcatcttgtcctgataaatccttgcaatgcattagtccacagaatgtacatcactattggctgtggcattagggaagattgtcaaatggtcaactcatataacagaccattgctgcactgatcaaaatctttggcatctatctctcagtgcctgaagctgataaaaaatgccaacatgcggtagtttattgcctgactcttgattgaaccatgaacagacaatcttggcagtaactctacatgaaatttcctcaaaatcatcccgccacatactaccctatcgtccgatttcaccctaacagtaccatatacaagaaataacttgacctataattaaactagaaggttaacttctatgcgctgtgtggagggcacctaaagtttctcgtagaaccatgtggaagtcaagtaccataaaattcataatatgatttagctattgtaacctaaactacaagatcgaggg

SEQ ID NO: 59574 - DNA, 3743 bp, Oryza sativa
ttgaaacgtttatttgcctaacaaatccatctcccccttgtgtagatccaacatggaattgaggaagagcagatcttaatctcttttttgcactttttcctcttcctcttccatgcatgggaaatcccccaaattgtgagtggccagtgggtctggacagcctctgagatataggcttgttttgtgaatgcccataggttattgagttcgattgatgattgttttcctgatcttcatcagcccacccatcattgttgtcatctcgcaaagtaatccttgagaaaacattacgattgtttggtaaatcatatcttgcatcatatttgtcttggtcatcaaccatatcataaggctctgccattctctgaggtgataggtcatatgaatccacatcatcatcataatactcccgtcctagagggctatcatcagtttggtagtgttctgtcacatgatcacgatacatagccttccggggtcttcctctagaaaccacaggagaaacttcttggtcactaaactcatgggtatcatcaaatgaagaatacccatgttgaactgggtgtcttccaagtttaatacgctcagattcaggagaacgtgagtagcgcacatcagaattccttgtcctgcgatgacgtgttagtgcatctccacggtaagagtgctgcacatcacgctccatcccatcatgcatgccttggaaggtatcctcatcttctgccatcctaagtggcagcctcacttggtggtcaatcctttcatccttgcggccagtcaaagatgatgagccaaacatgcgcctgacactaggacttgaaacctgtgggccatttccatgtaagttctctggtggaagatatgcatttaccggatcccttcttacatattccatggacgcatctcttggagaatgattcgagtgtttctgtcttgtaatgtccaacaatatcttgccatcacgaccactgccatgctctaatggacttcctgagaatctgtgagcatggccacttacatgtcccagggtgtcatgagaaagcctgccaagttcctccatggcgtatccattggttggctcataactagttccatcatgcagtctgtaaggccgctccttggcaagcaaagatgaggaagaaccagcatatgcagatggcgcaaggtcagcaccaagtacacccttgctagggtaaagcctatccatttctccatccctttccagatgcaggcttctaccagcatagagcctgtcgatctctctttctctactcctctcaacatacgggtcatccaaacggtcacggtactgaaactcgccaccgccgtcaagcagcgacctgctacttcccgtgccaaagttctcgccggccttcatcgcggatccccctgtcaggaatccagtctctgcaggtggcactaaggtgtacagcggtggcgacgccactcgcactggtggaggtggcggccgtggtggcagcggcggcgacctcctgtccagatacagcgagctggtccttcccatctccgtcgaacaaacccggagtgtcatgccgggttccccgaagaactcaccgtccttcctcgcaggacgcagggatgacgggtggtcagggagcatgtagtctggcggcccgtcatacctcccgcgatcatcgccgcgatacggcggcggcgacctcccgcggggcgggtcgcggtcccggtcgtcgtcgcctcggcccctcgggcgtcccgccgcgtggcggtcacggtcacggtcgcggtgcggcgacggggtgcggcgcgggtggtagtccgggatgcggcggcggtcacgatacggcgacggggtgcggcgatgcggtggtcgcggcccggcgacggggtgcggcgggggcggtaatcacgggggcggcggtcgccgtgcctaaccctatcatcacgggggccgtccctgcccctgtcatcacgccgccgcgcgtcccggcgggggtggcctcccctacctccaggaccacctcctcctcctcctcctcctcctcctcctccgccgccgccgccgcctccccgccgcatgacggagacgcgcggcgacacagggatgggtgtggctgggtcagatctgggcccaccccgcgctgctccgacgcgggatggggatggcggtggtttcgattcgacggcgacggcggcggcgtcggcggcggcggcggcgaggggagtggggggagagggtgcatggggttcggcggcggcggttgggatggcaatttagggtgcagtggtgggccctcaagggctttgggctttggctgggcctactttgctgtttatgcacagactttttacgaattacagccctataataagaaagcaagggattattttatcctttttaacggccgttaaaaaacgcgaatataaaagaatggcctaatatcaaaaattagaagaggtgagtcttcgaactcagattttctagtccactaccttgtggagctagccggaagattcttgagtgtttctcatttgacaaccgttcaatttggttataaatattgatgtctacagtgatagtatttgataaaaaaaattgaaaactttaaaatcaataacttctcaagtagtactcagttgtatgttattttaaccatttcatactataatacgctttgactttataaaaaagttaacaacatttataacgtcagattagtttcactaaattcaacattgaaaatattttaatagtacgtttattttatgttgatagtgttactatgtttttaaattgaaaattttaaagcatcttatcatatgaaacagatgaataccaaatttccatgaagtttgatgttactatttgaatttcgagtaacaaaaatttgagttgacacgatgtgagcttaatttaaatggttagattctttatgcacacatgctcgtttttgtatcttgttagtattcattcagtggtaatactatcggcgttgtcatacgaatcatctgatcgttgcttttagttgtagtagtgctaacgggttaactcgtactccgtatgcagtaacttgtgtagcaacaattcccctgaatattgttccagatttctaataaccctacaacattcagaaacgaagccacgaccatttcaacatttgttccttattactgcaacaaatgcagagtggcatcatcacaagccatgcacccgcaaatcaaaaataaattaaggattcgtcatcacaagtcaatggatcagcttcagtatcatcaagaacaccacattttccccacatcgatcacatccattatcatcacacttctttcgctcaaaaatcatcagggagttgaaaagaagcatctgcagtgtgcatacatcgatcagcactgtaaactctcaaatcagttgatcagaatgtcatattactgccggcccagtctttcggaggtgctcataggggtagggtgtgcgtgtgtgcgttcataggggtgagtgtgcgcacgtttgtactatgtttctcaaaaaaaaaaaagaatgtcatattactgatgcacttaacctgatatttacagtgcatcagtaatcctgagtctcttctgatgcatttaacctgacgtactccctccgtcccaaaatataacaacgtttagcccttaggatttatcccaaaatataacaacttatcaaccaacattctcttctcaaccaattacaaccccccaccattcatttttctcacctacattcactactcatccaa

SEQ ID NO: 59575 - DNA, 12210 bp, Oryza sativa
gatcatcaaaccagaatacttcaagttaattaaaacatgcattccatactaccgaaaatgcctaccaataaggacaattaagctggaagttgaaacattatatggaaattcataaacttgacctagtatatatgtcctgaacagcattagacaaagtcacataagagaaagaagcaacccataccagattaaacaagacctaggatgtgtgctttcctgtcaccaatttagttcaatttgcagaacaaaaaaaacacagctgctcaagcaggtttgatttataatcaaaacaaaatatccacacatcacatattgccaatttgctactaatgtgtatacacagctttacttgcaatatagttcccaactgacaaacaaaaacctcataatacttctgcaaaacacaagtctaaagcacatttctaggtgaacttatatatatatatatatatatatatatatagacatccaaaaatgccaatctatcatccgcacactgtcactgacttcaatgatcacaccagtagcatctctgcattttcataaagtgtattccatgccatcctatgctcccacttgtctgtcctatctagtaaaggcatacacaatggtttgtcaatagtggtctcttagcgttgctaattaggaatacttgttgacatggaagaaatagaaagaggagagacaaaacatcgttgttatgcataacaacgactcttaatcactaaaatatagaaatatagttacataagggtaaaaaaatggaaagaatattaacaaaaggaatattttttgagttaatgattgagtctttgtcgtcccaactattgtaaagacacggtctctaaataatcttttattgtttaagagatcatactcgtctctaccattgaacatgccctaatggtgattgcgcttgcggaggaggcaccgactctctaggacgcaaccagagacaagcagcgacatcgtgaaggcgccctgaagtagctatacactagtacaaaatactaatacaaaatattcatatttggttatgtggcctgctcgtgcttcatttgagcagtcttgagctagatcctgctgaaatgtctatttttctttactcaaataatgcaaaacaagtccaagaaataacagcaagacttcttgacaaagagaaatggtatcacctatgctatatgggtaccagctagtacgtacattgttaatcttaaacacaggttgcaagatatttatatttcctataattaattggtatgttttactatacattctcgaaaattgtaccagagaggcatttttgcaaatgttctcctaacataatttacaattaatggaaattataaagtgcacaaatggatggatttatgtatccacaacaaatatatattcaagctgggatctcaaagaaacaaagcctagttaagattaataaaaactggaaattcatttttattaaaaatagatgtaaataatttttgtatacaatacgttagatctatagtaataagaattgagtagtgtattcttagatggtctcatgcatgtatagcactgtccataacaatataacattgctctatgcaagttcagagaattatcacatatatttggaatataacataagtgaccctttgataacctaaagaatcatgactgaagctatcgacaaatcctatataaatatgcaaaaaggataaatacacaataagtatattgtattgaaatgagtactcaaagcaccaaaacaagaggatttctcacatcatacatagaaatatctttggttcatgtaccaagttgtatggaataaaatctgaagaacttctaatataaaaattaggttggaaaatgcaatatgcactcaagttcataagtatagtaggtcactgacaaacacaagtaatagacagcagacttgacaatgtgtacctatgtgccaagcagccatatcaaaaagttgtgctaaatacaactggataaaattgtgttcaataatgtacacagacccaaatggtaaccaagctttttaaatatgtaagttccaaacatcttgatacattttatttggtttatttgcaaaggtttttgcattcataaacagaaacagtgaatattgtggtataaaaatcaatatcattaatagtgatagtaactgataatcactttgttagaaagtatggaaacggccagctactatacttgaaaaatggaagtagcaaaaatggaagcttctcttttcaaatgtgtactcgtataacactataaagagccaaaaagaatttgtctagtttttcatttacctctcactattgaacatggcacatacacctatctattcaactttccacttaaatgacaaaaaatgcccctatgtgggggcatgttttctttttcttgtttgaaagaacaatttatgagttctaactgcctttactaacaaagtttcatatgagtttcacatagggcaaaatgggaaatgcctcttggttaaccatgtcgtgatatattactaaattaaagaagccatcaaagtgatattggccttgaaatttcctttcataatattataacctatcagtttttttaatatttagcaaaataaattagcgtcgaaaatcgcatcttaaagccatatgatgtccaaaacacaatttattgtgaccaaagggagtatatacttaaatatgtacaacctcatctcacacatcagtatcatagaatattataatagacgcatttggtgcatgaggcggcctagcgacaaccaatccacaagcaacaatattatttgcaaaagaaaacaagaacttgcagacaacacatgcaagttaaaattagggcttgtctattttgttaccacttttaactatatcaaaatacgaaaaagacaaaaagctattcatatcattatcattgttatactaccaaaaattttggtaacattaaaatatgtcaaaatttggtagtgttgatagtgacaatgaaggggccccgacaatgaacaaagcatttaaatacagtgaatgatattatcctctcttaaaaactctatctcctaaacgtgtttaggtcgtccaaccaacttgccgctattatatatgtccaataaatccactagccatgtagtcaggtgagtgatttttgggatctgtcatgccaataggtagaatatggacgaatctgatctcacaacaatttatagactgctagtaccagacaaattagtcatatataactaattatccgcaacgaatgcatccacaaaacttccctttctaaagcgtagctttcgtgccgcccgatcgcagcaacagtattcaataccccaccaatcataagtggatctaaaagcgcacacacaccaaaaacaaaaaaaaaaaatctgccgtatccacctggggcctcgcggttctaattataccaaacttaactaacctaatcaccgcctcaaccgcattgatttcgtaccctaaccgcagtaatttcggcgcgtgtcgtccggatgcttgcccaactagcctgatctggtcccgtcccgacacaattgaccgcttgtactcttaactcctcgctcgcctcacgaagaatcaaatgccgttgaatgattggggaggaagaggttgaggaggaggaggaggaggaggggtggggtggggtagcgatcgcaccgcgaggggatccaccgccagtgccatcgctgtcctcctcgtcggtagcgagtggtagtagctagcacgaagacctcggtcgcgtcgcgtgccaagaggacacaagggcaccaggtgtcgactcgctgggatggttggggaagaaaggatgggggaatggcggcgcggcgctgtgggggtcggggttaggggtttggtagggttcgctttcgattttgatttttcactttctctcttttcttttcctctactttttcaccgcgtaagaggggctcttcacacacgttctttttataatggaataaacatcccggcctttactcaaaataactacagccaattattacatagtagcactcaagaacaaagtgtaaatttaaatgaatagaacacaccatagagaataacaaagaattcagcctaacataaagagatcacaattattgaagtctatttgtaaatctccaatcataattggcaaaaagttgcataaccgtagtctccaactttcgacatgaaactcttcatcttcatcacacctttgtagttgtgcccaaaatcgaagccaatgagttgccctaaaaatgacctgcatataggaaaatgatggtgatttatcaaaaaccatatcgttcctacttagccatattgcccaacaaatggcagaagctccaaagtatcagtttgctttttttcttatcaattcccaaaagccactcattaaaaatatgagatatagtaactggaagattaaaaccaaaagagaactgaactgctctctatatgaactttgcaaaatgacaatttataaagagatgttgaatagactcattcttcaaacaaaaagaacacctcaagctgccattcgagttacgccttgacaaattatccttagttaacacatcccctttaagcaagtatcacatgaaaattttaatcttaagtggctattcacacatgtaagtgtatattactccctccgtcccataataggtgatgtttttgactttttatttgcaacgtttgaccattcgttttatttgaaaaattagtgcaaatataaaaaaagataagtcatatgtaaagtacttttgataataaagcaaatgataaataaaataaataataattttaaaattttttgaataagacgaatgatcaaacattgacaaacaaaaactcaaaaagacaagtaatatgggacggaggtagtattaatcagcgagctagctgtatgtttcaacaataaacagtaatatttcatttattgtgctgccgttcaaccaagaacaaaatcaataagaccgggccgacaggatgtacactttgcgtcgcattaactgcgctaattcattactagaaatatgtacaatattttaattctagattctattaagaaaaaataaaacttagggcaccgtaaaaaactatattacctggttcattattgtgaggttggcaataaagcagatagtaggacatgtttgattagcaattaaatttgccatgtctatccttagataagccacaattttgataggcagtatttgattcttatcacaactctattttgtctaactagtcatttggcccacatgttatacacttttgttactgtctaagctttagtttgtcattttgttccacaaaagcgtgacaagactaaacttagccaccttagttaagaatgtgtggcaacattagttaccaaccaaatatgtcgtatggcctcgtcgtatggccagatgctttggctgaggcgcgtaatatcatctagccatagaccggatattaaaaactaaacaaatacttaaaatattaaaaactaaacaaatacttaaaaactctcttcccttaattctccattcctccgcggacgttcatcttccctccaatatctatctgtctttttttctattgtatcatggcccccatcttactacccgctacttgttacatcttgttacctactacttttgtaccaaaataaaccaatctaataaaagatgagacatattctaatattataaattttaccaaaaaaattctagaaaaatatgcatgtattttcagtagtattacactgctatgtaaagtcttaacctcaatgcattattttaaccataacaaaaagataaaaattttaacagttttaagagtataagtatgatagattttgtcttcttttcttcctattataatgaatttgaagatgatacgtatttttataattttcttgatgacatttattagttcatgggcatattacgtaaaaatgacttgtatacatatcttacggatgcacccgtatcaaggtcgcataagagcaagtagggatggcaatgggtcgggtcgggcacgagcagagtgaatccatgcctgacccaagacccacgtgcccacgcccgacccatgcccgcaaagccaatcgggcaaaaccccatgcccgtgcccgtgcccatgcccgccgacggatatccactgggtcatgcgcagtgacgaagactgggtcaggtgagcggcggcggttgacgaagattgtggtcatgcgcaatggagacgacgaagtcgctattgcctaccatggtgaccgccgctcccgtttgttcccttgttgttgccaccacctgcaggcgccgctgtcgccgcttgtccccctaccgccacactgcacgcgccgtcgccgccgcaccctcctgcacgcgcgcagccgccgcttgttccactgccgccgcccgcccacctgcacacgcaccgcggcctcttgttcccctgccgcagcccctgcctgcacgtgcgccgccgccgccgttcccctgccgccgccccgcctgcgcgccgccgctcccccacctgcacgcacagcaccgccgccgttcccttgccgccgccgctgcctgcacgcgccgccgctttggattatggagaggagagaggcatccgggaaagatggggtggggaaatgaggaattaggttaggtttcattgagtgagtatatatatgtctcagttaatgggctaaatgggctaagaagaaggccatgggaattaagagatgggccaaatatagctaatatgtatatgtatcgggtcgggcatgggttatccacgggtaaaaaataaaacccggctgctacccactatatgttcgggtatcgggcggacatgcccacggataaaatattacacccatacccatgcccatcgggtcgggtatctgcgggtacccgacccgtaggtaaaactgctatccctaagagcaagtataataagaggttgtaagtcggctaaatgctaaggtggaggagaggagagaagagagagaggagaagcgggctataaacttacagctggcttggacacaagaaccatgaaattatgtgagagagacactgtattaattgtaaatagctaactattatacgtgtgggctaagagaagtctgcagagaaccttatagccaacaaatcgtctgtattattagccttactctaagcgagacatacgtgagacatgaataggtgacaggacatccaactctttttattgaaaattgtgcacatgacccggtaggatgatgggggtacttaggacatgacaggacatccaagccttttatagaaggaaccattgcacatacggaaagctaactatcaatttaaccctaaattattaacttcgcttatttaaccctctttttaaagaatgaacatgttgtttggctatattctaactagtgttacaaatatattttaaaaaatacatttagaaaatgataaagacctaaatacccctggagagaaatacacgcaccatatcttatcctcgtccctctcgtcttggagccttggacccacatgccctagggattgcagactcggtcggcagaggcggaggcaaggacggtctgatgggagctaaggcccttcacagtgctccatgttggagcgtttcttcatcccaccacgtagactgtgtgatgccatggaggagagagggtgtggtccctcacacctccacaaagcttttcgttcctcaacgaagaggcgaggaaaaggcacagacaaagcgcacaaagccgtttgccatgcctagtctctcgccacatacaaccactgcacatgagctcgacaacggaggcctccatgaccatcggatgagctcgacgacggttgcagcggggagctcgtcgactcgatttgcgccgctgacatcaatctccgcccccgccgcctcaagccaggcgactgtggcctcccactccacactgccgccgaggagctcgccgacccaatttacaccgccaagatccacctctgcccacgtcgctcagcaccacaccagatccggcgacaccgtcaagcttcgcatccgtccactctagaagccttagaggagagaggcgtcgaggatggcgtcgatctggtcgctcgattcacacggtttgtcacggagctcgtggccgtggaaggggagagaggacgttgtcgccgtcgctgctccgctcaacgccgagctcgtagctgggtcagggaagatgggagaggtagaacggcgttcggaagtggagaggcgccaacggggagaggggagaggccgccggcagcgggagttcatcgtagaggtgggggagtggggggacaccggaggcgagttcgtcgccggtgaacttgccgaggtgggggtgtgtggggggataggaggggttgtgggggtggatccggtggtgggtttggggtgggatttatattcttctctcaattttaggggtggttagtgtaaaatttggacttctttgtaaatcaaaaaaaaatatgtggatgaaattgaaaggggcaagggctgaaatgaaaaattaaagttattcatgaggccctttgcactgcgggaatatcaaaattaggacccgtgtatttagcctatgtggtatcttgtggtttcttgtttgagtgacttgcactgtaagtgccctaagcgcaggcgtggaggaaacccagcacacagctcgccggcgcatggacgcgctcgtggatagggccaggagggcgcgtagcgcgggcagagggaggcgcgtgactcccccaacgaccacgccaggccatagggttttttgaaaaaaacccaagccataggccttactcagcgccgatgtgctagcggagggagcctgagccctgctggattctgtttttttttcgataacaaagtttattgatcattataagcacagtcaatgaactacactagatatacattctccataactggagatgattccaaagctaccttatgtttgatagcacaaatgagatattctttgactggctattggaacaacattagttgaagtattctctctagccttttttgcaagaaagtctgttgttttgtttatttgtcttcaaacccacttggcaggaatacaaggctgggttgctacactctcacggctttgatgctcatgtccacagaagagtacaacatgtaatcaatggaacacctagctatgtcatttatatcctttgtttcaaactacaacattctatattcgtgttgcttgtcatatgaactaccttatttgtagtcatggacattatattgtgaactctattgtttcagttttgtgtggacttcataatgctttgaaatgtgaggttgttgaattattatgctatgaaatgttgaattgcttcgaagtccataatatagaaaaggttatgccggatttttgtattttacactcaaaagttagatttgtaagtattctacatattcttccaattatacctaatttctacacacatttaaccatattttcaatcaattacttcctcaccttttctccccaagctacccatggattttgtaggtcactctggcaccctagaagccactactcccctccatcgtggcatccgagcctagctgaagcttgaaaccatggtacaacctaaggtcatgatgttggacatgcccttactagtatatactgctaagggtgatgatttccctatcggtaatagggacaaaatcttagagcatcctcagcagatgctccatctgaaaattagcatatgggggtgaaaaatcagccaacaactgatacaccatcggctacgccaaaaatagcgcgtgtgctaaataggagagaggaacgtcaaaattggcgttcttctctcctcacaccatacgcaaccgccacatttcgatcaaactcctgctcccatacagagttccggatcaacctcccacagcatctgcgccagcggcaaatagaggaggagagggaggatgagttgcagctctagttggattggctccggttgtcggagaagggaggtagagaggtggcaccaacaagatctagggagtttgaagaagaagtagtccccttccgatgctgactcggccttccaccgccgctcccgccacctccccacctggccacccacgcctttccaccatacctccctttcgcccgtgccttccttcgcacctccccctcccgcagcgctactcctccacccggcgaccgtgccgcaccagcacggctcgcaaccccgtcgccttcgaaccgtccgtcagcccttcttgtcctccccgtcctatatatgaagtagaagagaggaagagttagtgagaaattaatataaaatgtatggtagttgaaagatattagtaaaataaaggatgatataatatggacaatttagtatagatgatctgttgaagtgaaaggaaatatggagagggaatctttttggatgagcatccaaatgggaatatggaagataaaatttggatgtgctgttgtgatgctcttatggagccgggacggcgggatgattttcgtcacctatgagtcaagtggtcggagccccatattggcatattcaaacggggacgtaaggtcacaagcggccaaaaagtttccacccaagcacgagaaatataaaacattgtcaaataatatattggatgaatggaagatctacaagatattcaagtccaacaacttcaaatggacctagcgccttcatgtcaactccggtttggatgatcttgtacttgttggaaagcggtgcgtcgtcaccttttaaatgcttctggtctcatatcaaaattcatctcgagtcaacaggaatttcaaaacaagacagtttgaaactgaatttgggctttgggccttgtaatagattaggcccatctcggaagtgcctctctccacctccacgaaccagcactaatcctagctttattttcctttataaatagctttgtacgccctaaaaagaacaattgggttttgtttagttgaattttgccaagagtcattcaccttgtctctagttctcgttcgattagttgacgactatagattcagagcccccaactgttgatgtgttgatttgtcggatcgattagatctatcacttcaatcgcaactatatatttgtgcttaattacctattcgcaatatttagattgcatcttatcttgttcttgtagtgttctctgatttgcattgcagggaacgtcaaccacgcgtcatggttggtacgatatcgtttgtggcatagtgattgcacgatgtcatgaacttgttctggttggtagccatgtcgcaaacatcatattcaatcaaagtgagagttatcccattaccaaaaaatgggccacgggagagagtgagtgtcatcactactgtagcaaactgttaccatggcttaaaaaaaagtaaaattaaggggttgttcagttcattgccagaaaaaagaaaaccttaccatttgttggtaatccaaaatttagtaatgccaaatttttgggaagatcacaatgtggaggtggtgttttgtttgataccttaccaaattttggtatagttttgtgagtagaagtttctagaattataaagtttgtagggattgacaagattgtaacaataaagtctcatttagtttgttgttttggaaacaaagtaaaaaagccctgaattatactcataacattccaaatcggtaaggaataagttcaccgggggtccctcaacttaacagtgagattttttaaggtcccttaaccacaaaatcagaaatgtgtacccctaaactcacacaaaccgtgcactcacggtcctatggcaatatatatgggtggtttagttgacgtggcatcctagtcagcaaaaaaatttaaaaagtacgtggggcccacatgtcagctacacattctcttttcttctccttctcttctcttttctctcttctctcttctcttcttcagggagggaggcttgctgcgggtggcaagcgagcgcggtaggcgggtggatgcgggtgtggagacgcgcggggaagaagtgggagatagggagaggaggccggctctcattgcttgtcaccagcagacgggctaatgcgggcatggcgacgcgtggggaagaatggggagagggggagaggaggcgagcacgggcgcggcagtggctgcgggagagggggagagaggcggtcgggacggcgggagcaatggg

SEQ ID NO: 59576 - DNA, 8490 bp, Oryza sativa
agaagagagaaaagagaagagaaggagaagaaaagaggagataacggctgatatgtgggccccacgtacttttcttaatttttttactgactaggatgccacgtccgcaaaaccacccatatatactgccataggaccctgagtgcacggtttgtgtgagattaggggtacacatttatggttttgtggttaagggatttcaaaaaatctcgctgttaagttgaggacctccggtgaacttattccaatcggtaaccgcccccatggccaagtgggcttcatttgaggctcatttgtctccggcccggcccacttcccttcccatctcaccagtgacgtgcttcttcatcatccctatatttccccgacacttcccatcgagccgagcaaaagccctagctttcttatccggggaaagaaaaagaaaaaagaaaaaaccctagcgatcgatcttggcggcgaggcgagcgacaggggatggaggtggattcgggtcggaacgggaccggccacggccagatcgctggccccgacgaggagatccccgccggcggagacgcgaagaggtcgcgcgaggagggcggccgcaacaccaccaccacctgccaagaagacgaggacgaggacaacgactactacaacgacgactccaatttcctcgactcctaccgtaccacctgggccaccaactacggcaaaaacgacggatcctcctttgaggacgagagtgagtaacccccacttcttcttcttcattgcgcaccaatcacatctcatcatcttaatcttaaggacaattcattgcgcaccaatcacatctcatcatcttaatcttaaggacaatcttaaggacaagaagcccaaacaatttctttacaggcgtcatcttaatcttaaggacaagatttcgatatatggccatcaatttgctcatgtgcaaactagttttttttcccttcttttttgggcatactagtaagataaattttaaagtaaattgtactttggtccaccttttattacctaagtttcaatttggaccacccttaaacctatctttttaatttggaccgggtaaatttaccattgttgcggtttggactaccataaacaactttttctcatcatgtctaacttccctttcggcaaacatatgagctatacatagaggagttcggccgtgtactaaagctgatgtgtttaaggtcgctgattgtactgaaaaaaaaatcgttcatggtggtccaaatcgcaataatggcaaagtcatctggtccaaagtgaaaatatatgtttaagggtggttcaaagtgaaacttaggtaataaaatgtggcccaaagcgtaattcactctaaattttattaggcaaatggctccgttcgtttccacttaaaaaagtggattaagttttagatattcgtgacacgcttttcaaactgctaaacggtgcgtttcgtgcgaaaactttctatataaaagttgttctaaaatatcagattaatacatttttcaagtttgaaataattaaaactcaattaatcacacgttattaccacctcgttttgcgtgaaaaatttaatattcatcttcaggagattcaaacaccaccattgaccactctgctgtaagttaatctgagcgtacacaaacagtcctggtctgcactggatgtgtcaggaggaatgaggtcgcacgacagaatttcactatgaaattccacatggttcgagaaggtgctagacgcaaggtggtccatagggctaaactcttataacaaacctgtctagcgctttccaagcaattaacaagccttcttttttccaaaaagaaagtagaattatatcaatataaccagacaggacagctgcctagtgcacattcaaacacaaaatcacagtggacttttagaacactgaaattccattccatgtattcaataatgattcaactagtgctatatctatatgcctacagctgcaatccggcccatgcagcacactgatggacctgtgctgccgatatcctcgtggccaatggacgtgctacaaatattttcagtcaaggtgacagaggtcatggggaaccttgagtggccactgcgtgtctacggcatcgttgctgtccgtgactcgctggatcacaagaggaacgtcctcttccgccgcgacagggacgactgccagaccctcacctcgccacaggcaagcatcacattcaacgtatttatctttcccatgatttatactagtactagcttactcctctctttgatcataaatataagcacttttagaacaagccaaacctttttagttttgactgccaaattgttaaagagaacataatgatggatcacgtaagaaagatgttgctaggtttatcgttaaacaaattatcataagactctttttatttggaataatttatttttatagatacaggtcaaagtagcacattggaaaccgtgtctaagtccaaagtatttatatttgtaaacgcatggagtatttagttttatcagtctggcatcctttttaaaatggaggtaatagttagtatggttttatcggtctgaaattcggggtttgcatcctggatcacagttgttgcttatattttttgaactgaagatcaatgtgtaagatcagaatccagacatgatctgtatattgcttactgtgcatatatatttatgtgtgtttatgcatgtatatatacaggattcatctctgacgctcactggccctagccgtgccgtcgtgctgatcaaccctgtcatgttcgaggttgacctcaaggtgatcacccacaacaatagtggcttgccgttgtctgaatctgaagaggacgataaggtgctaagctacaacgccttcttctacgacggcgtagctcacatgaacaacactggcttcgcccggagatccgtcgagtcgacggagcactccacaatggagttcgtcttcgcacacctgatattcgccgtggaggccaccatcgcagttcgtgtcatcgaaggctcaaccgatttcagggcccgtctcaccgctcgcaccgctggcatcgatgaagacgtggtgctgctcgactccggtgacggcaaggtggcggtggtcaatgacgatgacgacagtggcccactcgtcgtgctgcagcggcgcgtcgtggtggtggaggagaagggaagcctgatccttggtgtggaggctgcagagattggcagcgaagagattgtgacgagacaggtggacatcaggcctaggcatgcgttgagaagcaggtgtggattcaatcttgggttctgcaggatgtcggtcatgatcgcctggtcagtgctaccttaattcatgtctcatgtgcattcaatgcttgactaatccatggctaactactacctttatgaggatgacacttagtactaattttaagcctctgtcaaattgcaagtactgctttgaactaattaagctagatgtgatgtgatgtgatggtgccgatggtttcttttgtacttgtgaagttgtgaccagccggttgatatacctttgttggcatttgtgtggcaatttcagttaatccatttgttgtttgcagtgcaatttttttcaggcgtacattaactatgaggtgttaagattttttttaggagctagatcagtgtgatcagtaacaaagtgtatgtagtttctcatttcctagtcgtattggcgattccgagaaccaattctactatatctgaatcccacaaatagagatgaatactctacattactagggatgaaactggttcggatagttccgtccgtccggaccttttttcggattcggatagtttcggtcggaactatccgaaaattctcggattcggaaacgaattcggattttttttctcggaaacgaaaacgaatacagtatgggtactatccgtcggaatcggaaaacggtcggaaactatctggaatttttttcggatatccgcagacattgagtaaattttagaaaaaacatgtatatatacataactttttcatacggaatcagatgaagacaaactttatatcaacattgtagagctcgatgagatctacaactttcatattgactattttattatttgaggttatttaagggtctaaatattcattataatataccatattaatttttacaaaatctcagatttacaattcaaacgatatctgatggagatgtgttccatatcaaagttgtagagctcaacgggatctaccactttgtagtttataacatttgtatttgaaagcatttaaagcataaaacaaatattgcaagtttcgaggatgtgaagtaaaataaataacatctccaatttatacaatggcaagtaagttatacatatagtaaaaggtcttgagaatagaaaatgataatcatatttgcatatggatctcttagaggaacaacaataaaaatcgatttttcacatacggttgtgagaccgtctacaaaattgatgatataattgttagcgatgtttaactaaaataataagtgatatctcttcctttatcaagaaactcaatttgaggggctttttatatatcggtaaatattcgctaccgtattcgttccgtctcgtattcgctccgtatctatattcgataatattcgatttcatttccgtatccgagttttcgattccgattccgattccgaaaaaaaatatgaaaacgaatatgataaagctagtttccatccgtttccgatccgttttcatccctatacattacttcgatagtgggtgattgctatttgagaaatgaaaccatgtttgtttctggtttgaatttttgagaactgattagacttaacaagttaaacaatctagcgcgtggttcagttcctcatctgaggagtggctattttaccggatgcagatgacagtgtcatctggcaaaaggatggtgatgtggtagaaagaagaaatatgaaaaattgttatatgtaaagtaattatctgggcttaaaataatttttcttgagttgatggtgtgtttgggttagttgggagtgcctgctgaattctccagggtgaaagtttgtgattcggaattctcaagtcggaaaaattgccaaaaggctagatttatcttattgaagtgatgtttctgttggaggaagaataacttcaattaattcattcatgcttgactagcattccaatgtaacacatgttaatgatccttttgcttataaatctttaattgactaagcttctggcttttctttgagagggtggtcaccctaaagaaaatatggcattttcagtgaaatgggaaaaggtgtttgcaaacccaagcattaagatggtccgcgtatcaaatcctttagactttcaaatatcaatttgctttgcaagtgttggtggaaattagaatgtgaacaaggattattatggccacaaattgttaagactaaatatttcgagggtgatttaactacttatatacctccacagctggatgattcctaaaggttagaaacaaatgttttgaaggcagaaaaatgcatcttggtagaattccagatcgttgtcaggtttgtggcatgggcaataccccgactatttatcatgttgatcattgcattactagaaaaaaaaatctctctgttggaagatggttaccagaagaacgttataaatgatgactttgaactttgcattcaactatcttcagaacgtttttttcccaacggatggctgcgtcgtaacaatcttgtactccctccggtcaaaattatttggagtttcagacaagaaaaattgcactaaatcactcactttttttttgttcctaaacgtcatataaaagctattggagggagagtacactcacaaaagagaaggcaatttattcaagaggaaatggaaggtggagaaatacagaaatgcctaatcttcatggacctctctcgattttatcttttttaggggaggttttattatcggttgatacgattctctgtctgaaaagaccatgactattcttcattccatgacctgaatagcaacagcaacccaagtgatgtactaacaattttgtgtagcaaataacttttttttgggcacccaaacaatcataatgcttgagtccagatatcaaatccagttagctgcctagctcgatacattgctttgttgagctcgtcgacgatttaagctgcactagatgtgcattcctgttaccagtaacatttcacatgtagtgcagtgcattttgtttcatgtcctcatctatattggagtaattaacaatgttatgatagagagctttcacaataaaattggtgacataaagatacccaactatagttatgttgcacatgagtttagttatttttgctttgcagcttcattggcgactcatatgtatccaggtacgtgatcaactgcagattcttcagaacaagcacagcagcaaatacccaaccgggaatacgatagtgtttttgacaggataactagacggagttgtaatactttctgccagatttgatgccaagtaacagtgttgctttgctgtcaatgtctgaataatgacttaatgagggcttagggacagggagactaagccagttcaactaagagcatttctgaatccatattacactgccagctacagctttgagcatttcagatgcacatgcataggcagccaatacattataacataatgactgactgcaggtgaacccaaatccgtatgtatgggattcattgttttctactggagaaaatccctaatagtgaaattgccatggatgtactgtactgttgcacaatgctccattgcttaatgtaaagggcgagatacaaaaggatcagactgaagatagccaaaatcaatctaggatgtcagataatcaggacatacttcattgcagaaacaaacattcgcgagaataaccacaacagcaaattaatgatcaacaaatgacgcatttaagaattcaaccataaacatctccactgaaaggtatgtgacattctatgatgataacagaaaacttttcataatcgaatagcaatttgctatgcattgaaggaactctacaaacgaaatcctctgttgactgaatctgctagtcatggataatagcattgtcaacctagttggaggaggtacggtatagcttgccgaaaacatggagaagggcaacgaccgcgaaaaacccgatgctcatgatcagaacagcattgggggacatcttgcacccagcagcctcttcagtgtagaactgaagcattgtgctggtgccacctctagcaccggcaccggcaccgccagtggttctgcgcctgcgcaagcttgcggcagctgctgcgctccctctggcagggccatcgccattagccggcatcttgttttagctctctgcaagggcaatacaggcttcaaagattagaatgacagcactagtggtatacacacaatgcaaagttcaataatcaaacatgttgcatcaataagttcaacaagaaattcagaagtacaggcacccatcatatgatggaagcacaaattgcagacgacagataggaaaggataacaatggcaaaaggctgaatataagaagtagaatctactcagtccccaaaggacatgagaccaataaacagttttctaatagactagctaaactgcatcttctaattgaatcgacactgtgagacttaggtggttttcgtttctattttacctcaatccccatcatcacgtctttcaaactactaaacaacacgtttcgtacgtacatataagttgctttgtaatatcaaacaaatccaacttttaagtttgtcataattaaaactcaacttcatcttcatcttcatcttcattagaaacgaacaccacttggatgacactatcaacaggcaacagagacatgaacaaatctacaaatgagccttatgcgatgcttcacttgtagttgtagcaccatatgcaagagatcacagagacaaagaagaagagctgaattatcgcggggatacgatacgcacgcagtaacgcggatcaggaattcaagtagtaacaacaagaacgaacagatcagagatccaaaccgttcatgaacgaggcggaaggaagatcaccgcccccataaatctcagaccaaaaaaaacaaaaaaaaaaggctcgggatctaacataacacgtcgctacgcaccacgcgtcagagatctaacatggcaagaacagatcgccctcggctcccaaccatccataaacatccatcagatcacacgtcctcccagaacgagcagagagaaggcggaagcgagcagatccgtaggaggagagcggaggagagggcacccagcatacaccgtaccttgcggcggcggcggcggcgacggcggcggaggaggattcgtggagggagtccggccgcagcagatgaaacggggaaggggagggaattggtgggggggggggggggg

SEQ ID NO: 59577 - DNA, 3642 bp, Oryza sativa
gcgatttagtgcaagaaataagtaaaccggtacatgaacttaacaatcacgtgcattttagtcaaaaaaaaaacactgatatatgtctttcattaatcctgatattataagcataactactagattgttggctcatggattcaatttcgtgtttcgccatgttcataacctgagacaattaatatgttgattagtcaaattgctcaaaaattatgttatttgcatgcacttacttttgataatcatatatcttttggtttcaaatcgatagattatttattattacaactaaccaattaaaagcaatacatataatacatgtagatctttatcaagatggcataaaaggtatggtgtggaatattttgatcttttaaccaaaatgcacgcactagccaagtttttacatctatatactcatttttaagtttttcactagattacacccacatactaagtttatataccgtagacgcagtttattactcaaaagagagtaaggagcaactatccacgttggaacatgtgacgtgcatatacccccggtccacgtcagcgtggaggacacgcgttacagatcttatccgctgtgggggtattgtcgtcgtgttaattgggtggtcgctttctggcactatttagtgatggctgattggtgctgattttcctttggtttagtacacccagatatatcaaacaaacggtgtgagctcaactgaatatagttttcaagctacctttttatttggtgccacaggatcgctgacgtgtacgtaatccgatactgacaccaacattatcaaattgtacatatgcctttgacaaaaagaaaattgtatatatgtgactcgtgctatggaaacatgatcaaattatcaagaattcttttttttttcgccagtccaaacagggcataaggttatttagtcgacttaggacctggttggagaaacttttggcagcggtagattttctcagaatcagaatcttccctgaacaatctaacttttcgttaagattctgaaaagttgtagttgtagaatccaatttttcaaaaatctaaataaggtagaaaacctagtttattcaaattttcagaagctgactaccaatcagctcttgtatcttaaactctctcaaaaggcatttaggcttgggccgagaagggtttttcaaattcgctccgattcgaattgtatctgggtactactttcattacccaacatatgaaatagacaaaatactttcattacacaacatatggggtgtttcaatctcacctcgtgactgacaagtagctgacctcaagacaaatgactgaaagaggccttccttggtgccatatatacagttcaaatgaagggggaaaatgaggatctggcatatgagatatgtgcatagtaaaaggacgggctcaacagaataagattgagacaggttgactcatttgctgaattcatggaggagctgaataatgtgaggaattgaatgagtagctgataagttgaatagctgatgctggccaatgtttacatgattgggaccatggtccaaaatccagcgtgtttactagctacaaggatatgaactcgaaagaaaatctctatttcagatttggtggtgtttggattcagggacttaactttaatctctgtatttagatactaatttagagtattaaatatagactacctacaaaactaattacataaatgaaagctaacttgcgagacaaattttttaagcctaattaatccataattagagaatgtttactgtagcatcacataggctaatcatagattaattaggcttatagattcgtctcgtgaattagtccaagattatggatgggttttattaatagtctacgcttaatatttataattagtgtccaaacatccgatgtgatagggacttaaaagttttagtcccatctaaacagggtcaatagacttattctatatggttacaagctacttatgccctagagattagggtgagttcgtttcagcattttggaccagttactttctcatttttcatgaaaaaaattttgtatagaagtttcttttaaaaaatcaaataaatctattttttaaatagtaataattaatagtcgattaattataggctaatggtttgcctcgtttcacgtgccggcgaaaattataagcactgaagcgaactcagcctaagaaaacgtagggaggctcttgattaagcaagatacgaggttgttacacattttctgctcttgttaaactctatttgctagaatttacattatatgaatatgtgattctctgaaccaaatcgctagtaatttaattatgtacatttttcagcatttatggagattattatgatatgtactcccttgattttaaaatagttttgttatcggtttgttttaacttaaatatatctatatttgaccatcaatttttataaatccgtatagtttagtatcgtaagatttataattttttacaaaatttttttttcgtaatatacactctttcctgtcgcctcctggaccagaatgaaggtctttgttaagttttcacacaaaaattttaaatcatgtcacatcgaacgtttgaatacctgtatgaagtattaaatataggctaaaaaaataaccaattgcacatattacgactaatttgcgagacgaatcttttaaacctaattgctccataatatttgacaatgtgttgctatagtaaatatttgctaatgacagattacttaagcttaataaattcttctcgctgtttactgacgaattctgtaattagcttttttattaatgcccaaacacaccatacgacaccctatataataactgatgtgatatgaaaaaaaaaactttacaccctcgtctaaacacccccgaaatatttggctgtagcagcaggatggaggcaatgcggcagtgatgatatattgataatttgatgtggatatgagttgcagaggttgcagcagtggcagtggtagtagctgctagccaatgggccacgcaggaaatccacctttgcatgcaatgcaatgcgtatttgcgtttgtttttgtgtgtgtgggtgtgggtctcccagaatcgaatcacttttcaatgataagaccactgcatccattcattcattctttgattttaatttccacacgcgcatttggacaggccaacaattttgactctccttgctgatctcttttaagtaattggttttctctttgcatagaggttggtaaaataataggtttttcttcccatgaattaataatttttagtagcctttaaaatcaaatgtttggatttagttgaagaaagtctggctctacaaagtagtccttagtagtcgctgtcgagtaggtttccttaccgttcgcggtttcaattatggtcctgttcttttctccaacaagatttgaatgaagattaaaattttcgtggcacgctttttaaactgttaaacagtacgtttcgtgtgaaaactttctatatgaaagttgctctaaaataccatattaatatatttttcaagtctgtaataattaaaattcaatcaatcatacgttaataccacctcattttgcgcaaaaaactaattttcatcttaaaaaaaaagcaccacc

SEQ ID NO: 59578 - DNA, 17092 bp, Oryza sativa
cgataaccccttgtcgcatgctaaggtaaacccaattgtctaccctagatactctctcgatatcatagagttgcatacttatatcatatcatagagttgcatacttatatccaaccgctagtcaattcattctaaagcaacttcctccgttctcaaataactcataccatcactatttaaatttaaactttggtccatgtttttttaagaaaaaaactataaaatatgctacgtatattattaaagtgtgtactatcacagatagacccatataccttccatccatcgtaatctaaacatttaaaagtaatttgtagaaaggaaagggtataaaatttttcactatactgaaagaagtcagcaaagacagtgcagcgttacaaaccagcttggacagtgtctgaaagagatctcaattatgggataagcaatcagctggttgctgtcatcgacggtgtagacgcaaaatactcatcctaaaaccatactaacaaaatgaaaaataaaaaaagtaattttctgtagcaaaaccaaacaaatatctgggccaacaaacaggctacgccattggatatgcctcgagatccacgcggcagcagtatagcacagtagcagcaacagagagagcagagcagcagcaaactgaaagctgacgcgacaggcaataattaaagggataaaccaacttgtgttaccacccattccagataacgacgccctttcctctgttaattaatccaatcacccgtgaaaacgccatctctctctctaatgaaatagtacagtacaccctccatctcttaataagtgtgattttgatattttgcttatattgttttgccattgtcttgttcaaaaaaattttagaattattatttgtgacttattatccaaagtactttaaacacaactttttatttttatatttatataaatttttaaataaaacgagtggtcaaacagcaagcaaaatatcaaaatcccttatattagaggagtgagggagtacattatactagtcctagtactataaataattttctgattttctcacccattttttaaaagctcttttgtctctgtaccattgcatcaccaccgaattatcttcactgacatgctttgctgatctcttcattaggtttgcttgcttttccaccctttttttattttgattaatttggtatcctttttagtaatatcttgtgtgtggggtttgccattcatgattcaagtagagatgtgatgaccaagccctgaaaaactttgggagtgtgtctacttgtgtgaaagagatccatcatctccaatgcatgaataggaatagcaaaatgaatcatttctatttggccaacccataaaagccctaaattagctcatctcattctactaacagaggtgctaggacaagggggacattatccacaatgttctctctttgttcatatctcggaatttatagtttttgtgaaattccggcgcaccaaacaaggtaatcaagtcttgtaaaacaccctttggtaatatttttaaaagcttattcactttattatccttttcagcatgcaaataaactaaatatgatcttagcaatgccatagttccggaacttttctctcataaaagtgctatcaaattttacaaaggcgtcaaactaaatacattcaacgctatcaaaatttgacaaggttgatttggctacaaagtgaacaaaccctaaaaaaatgttatagtagctgggataaaaatccaccaggtgaactacaattaaacaaagatattgagatagtagtacatgcaaatattgtttcagtaaccacagaaaagaatggaaattgctgataatgtttgctgccatacaagataggagtagtaatactaaacagtgacatcacaagacaaaggagtagtagatcccaaggtgataagcacaagatcattgccatgtagagcaacacggttgtgtttagttcagcgtaaagtttagtttagattttaattgaaattggagatgatatgactgaaaagttgtgtgtgtatgataggttgatgtgatgaaaaaggaccaaagtttggatccaaattttggatctaaacataaacacagccacaggcacactgaaaaaataaaattaagagagagagagagatatacactagtactagtagaacacacatggaaagaatgaaaaataaactagaattaattaacagtgcaacagcataaatcaagatgatcaactgtacaaatcctccccttctctctcaaactccttttttcttggccctcctaatttggacccactactaatcatcatcaaacacccgtctcaacaagacaaatggttcttgaatcttgatagatcaatccaaaaaaaaaaacaaacaatacaaaaataaaaacaatacccccaaaaaaatttaattaacaaggctaattgaactagcaagaagtgttgctcttgcattgcattgcattggcttctcttggctttgctcaacataagctttgtcttgctctgcttcttgcacaaattgacactagtgtagtgatccattttcttgattgattcctcctttgcccaatccaatggcagcaaaagaagttctaaaccctaaggtgatgcttgcttctaaaccactagcaccattaccaagatatgaatggacgatcatggcgaattcagaggtgatggtgatggtgcgagcttactgcgagctgttgttgttgttgttgtttgcgccgccgttgtcttcgtcgccgctgtcgtcgccgtcatcgtcgtcgtcgtcgttgcggccctgctggtccatctccggttgctgctgcggctgctggtctccggcgccgccgcggttgtacgcattgagcgcggcgagcatgccgaggttggtgtccgacatgccggcgccggcgctgccggggtagttgacacgcgtcgacatgaactggagcggcgcctgcaccgtggcggcgccgccgccgccgccggcgaaggaccacatgggctgctcggtggggcgcgcggcagcggccgagctggcggacaccggcagcatccagaacgcgccgccgggcgccgcggtgttcggcgcgacggcccacattgccgccgccgcggcggcggccgccgccgcctgcggcgtcgtcggctgctgctcgcgcgccttgggcgcgctgggatcttggcggtcgtcgtcttcttgaagaggtcctccctgtatcgcttcctcatgaacgcgcccgcgccgccgggatcctggggcgactcctgctgctgctgcggcggcgggaggaggtggtggtggtagccgagcatggcggacacgtcgtgctgctggtggtgcgggtgaagagccagcgccgggaagggggaggcgcggttggggttggaggcggaggaggcggaggcggcgccggagcggatggagatgttgagagaggagaagttggccgggatggtgcccgtgccggtcgccgcgatgatggccggctccgcctgctgcagcagccactcgatggtctcgccgtcggacttgtgccccagctcccgcgtcagctggaacacccgcgccgcgcacagcgccggcatccgtatcctcctccccctcccatccaccttcgtgtgccggtccttcgacggccgcttcgccagcgtcgtcgtcgccgccgcccccgccgccgccggggtcgtcggcgccaccaccttcttctccccaccaccagacgacccctgcggctgctcagcgaccaccggcgttatcgccagcgcgcccatgaacgtctgctgctgctgctgcgccgccgccgccgccgcggcggcggcagccggaccggagtagtagaacgggtggtgcgggtggttctccctgccaccaccaccaccaccgccgccgctccctccaccaatattactgctcgacggcgccgctcccccaccaccgccgccgccgccatggtccatcctcccaagaaaccaagaaaccgccgccacccaagcccgcaagtggaaaatacggcgagtccttccgccgcacgggtggtccgagtggtcgccggagttggaggcctccgggaacacgtggaggacacggtggtggtggccggagatggggctggggggggggggtggtggtggccgccggtggggttggagaggagaggagggaggagagagaaagagagagagacagggagaggtggggttgcctacttactcacctatggttattgttttatttatggagccatttcttttcttcatttttttacacactctctgtatatatgggcatgttttatttatagatctccagtaaaaattttcaccctatcacatcgaatgtttggtcatatacatagagtattaaatatagacgaaaaattaattacacagattatttgtaatttgtgattcaaatcttttaagcctaattactccacaatctgacaatgtggtgctatagtaaacatttgctaataacggattaattaggcttaataaattcgtctagcagataataggcagaatttgtaattttattttgttattagtttatgtttaatactttaaatgtgtatatgtatatccgatataacacgccgaaatttttcatcttggatctaaacacaacctatatatgcaaattccataaacgctagagaagatattgggcaccctgctagtgtagcgtcccctctccttttcactttccacttttgttgcctcacaaaaatttcaagttttccctttgattggggtgagcaaaactgctagaaagttctgatgttgaataaacattggtgaagatcatcatgcaaatggaattttgaaaaaaaatgcttgagcttatcgaaatgtcatctggtagattattggcgtatcgacgtagatgacgacgtattaacttgagggcggatcaatacgaccggagaagacatctacgcggaagcgatctgttccattgattttaatggtaagatgaaacatataattcagtaacaataattatcccaagctacaaatgtctcatgcgggacattaaattctatcacaaaatacgaaatggcatgtagtatagtggttataaaagcctaagtacattttaggtcgtgggttcgacttcctacaggagcaaatttatgatttaacctttcagtggtaggcgacgtattcgtcgacagcgaggcacatgtggtgacttcgtcaatcttaaggatttgccgatccagtcttcgaagatgctcatagggttgagtgtgcgtgtgttgtgagtgtctgcgttgtactttgtaatttaaaaaaaaatctatcacaaaattactcgttgttcttttgacatggcttgatgaaaagaactcgaagcgaagcactatatatgaatatgccatttcattacaagtatatgctttgtctccatgatcaatcatgtacagagtaaaacgatttcaatcgtttgcttttagaagctatcaacatgaatttgagatctcatccatcttgatctcgagttcgatgcataatgctccttgaataaattccttctaccatataaccagattggcagcaacaataacctactatatccacttgaattcaacatcacattcactccgatctcctgttggatccatcacaccccttataaacaagtttctcttaactcatatccagacagacaccaacaattacctactaaacactaaaaaggatataattaaaaaaaagatgggtgtcatagcataataccaagtgtcaacctaaatgttgccaaactgacagcatcttgtcttaaaaccaaaacatccacacgtgtaaatataatccatctcaaagaattttttttgaaattccaatgggtgtattgggtgtggtggcagtgtcactttttcgtccctctctttttcaacttttttttgaaggggtccttttctaattatttggagagaagagagcggcagagaagtaggccactcgtgggtcctcggaatgatggacgaacccaaagacgagagagcgcgaaaagcctctgcaaaagaaaccccacatgcgcccaacactgcacataccacccccatatttcattgaatttcaacacaaatttttcttttgagggaaatttcaacacaaaattgaacaggggtgcatggtgatttattttttgccttattttgtttgtgattggatgttgaaacaggttgtccttttttttatcataatgattggtcacaaatataggaatgtaataatgggaaatatggttgtgaagcatgtgttattatagccatcgagtaatagcgatggtctgtcatttttttgcacgaggcttattatcaatgattcattagttattatatgtgctactggattggttttttttttctttcttgctgcgaagtggtctataataatgatgagataattgggttttaagcttcgtataatggatttttcgtttttatgtgggctctctttttaccaatagcaagctatgacaatcatgtgggtgtgaccttgctgttttatatacagttcagtaacctaaaatatccagatcttacaatgcacacggcgttagagcctaagtattttaaaactactacaatgttgcactattagcattgtttgccttttgaattataattgaatcatgtaaagctaagagttgaaagcatggaccaataagtggcacttagatggagggggtggctttttgtaacttttgcatgattgagtgggggtgttttcttgtgtaggaatgaggggggaagtgaagccaagggagacactgcaggtggagggtgtcagagaggggagcatcccaacagcaccaaccatggcctctctctccctctccttttcccccctttctctctcctctcttcttggctcttgctgcctgtactcctctactctacagcctacagcatccatttatcacaataaataatcccatccaataatttatcatggacaaaatcaccaattatccctaaaaataaaggcctcaatttgcataaccactggttgtgcactgggaaaaaattaaaaataatactagtagccagagaaaggaacatctgtgaccagtgagtataacagggttatctcaagtatctatacactttatgcaatataatgataaagaaactgatcacacagaatgtcttttacctgcacataacatggcagaatataaaattgcagggaatatatattttaaaaatccacccatgaggcagataaaagaaatggaattccaattaaacaaagagctgggacaggtaggggaaaggtctcctgccagtcaactccaggctggcccaccagcctccttcaaattaaataataattccatgttggttccaaaaggagagatatttttttaaaaaaaaactgaaaaatatacttaactgatcagcagtttcatacacagagtgtcagcttggcgtcttcccaaattgccatgattagggtaacagtatggaattgggtatgcaatgtgagaggtgattatccaccccatgctacaccaaagtgggactgatcattcattcctagctgcaggcagtgtcttgcaccttcgtcggttatccatattttttaataagctaaaacaatatattagataagaaaaatttatttctaggcaaaactttaatatacgtgtttctagcaacttaaaaaccaatgctaaaaacaaattgcattgaaaatattttaaaatcaactttaaaattaagtttgaaaaattatcccaaaactataaatttaagctacgtatcttataactacagatttaataataaaactatcataaaactacagattttagggtttaaatcatgagcactaatgtttgagttatcaacattcaagttttgtgcttaatttggcactaaacacttagttttactataactttgttactaaacctatagttttacgatactccaatttaaatttgtatacatatgataaatttagtgttaagtctatagttttgtgatacttcatcttaaatttatagttttgcgatagtttgagtaatatatctgtagttttatgaaatttacttaaaattaattataaagtcacatctaaacaaacgctcgtaggcatactaaagagaaggtttagccaattactctatctattttcgaataatcagcacaatagactacaccgtttcactttaaatatagtttacttttaaatgattatattatgatgaataaagtgtatggtctatttattacactataaactacgataatataccacatttttaattattccaaacttcctttgaaaagataagatgtcaaagtttacaattgacactcagaacccgtttgagttcactgaagatggagattaaatacagacacgcaaaacggagatgttattagtttaagtttaaacttaaagttagatttatcttaatatttgaaagcaatttttatataaaaagttttcgcacggaatatattgtttagcgatttgaaagcatatcaatcaatataaactaagataatatatgcatcttattcagaaaagaaccccaatgtaattatttcaggacagatgggtaccttatttcccttttttaattactgcataaatgccagcacagctgagttgatgatccaagccaggctagccagtcaaagaggaggtcaacgtccacattgcactggtacatggtacacgtctcaccagacatagcagtgttggccaagcttcccagtatgaacgaacacactctcttgttgacccgggttgctaagggcatgtataatggtagccacaagtaattgtggtctcgagacgccacgtaggatagaatcacagaaaggtcacactacccacagtggaaaccactctaaaactttttttatgtcagcccttgtattatcaaacctattgaaactttatattttgaaccctatagtaaaaaaaagtatatgtacacccctaaataacttgggacccactgtcagcctcttcccatccattctcttttttattcccctctctctctcttcgatttcttctccaacgaggcaccaacagcgtcgctcggttctcttctcctctcccctccctcctcgtcggcttctcccctcccctcgctgctctcttctcctctcccctccctctgcctccggcggcagatcggcgccgatcgagctctggcggcgatggatctagcgaagacggggagcatcggtggcggcggcggcggatctggcggcggcaggaggcagtggtggcggcgggctcgccggatctggcggtggcggccacaacgcgactgtggttccttgacgccgccgtcctcctccccccacgacggtgcgaacgagctcgccgacggcgtggcgagcttggtggcggcgggctcgccgaatcgaggcgtgggctcgccggatctggcggcagggagcagcgacgacggggaagcggcggcggcggatccggcggcggcgagcagcgaagacggcgaagcggcgcggcggatctaggggcggtggctggggagcagcgacgacgaccacggcggctgcggcggtgtggacccccgtttttataacaggaatcaatcgtgtaaacagtaccatttccctggatcaagtagtttggtacacacgaattcatagctggaatatcaagtgcacatacacgagtgtctaatacgaattattacatcataggcccgcaggcatagtcttaaatcatcggaccgagaggtccggaatacatccaaaagcagaaatagataaggcagcggaattcaggctgcggcatgccattgccacaggcaacgaccgtactaagacctactggacgccatcgtcttcatctccctcctgatagtaggcatagggatcctccgaggcttcatctcccgcttctgataaattttatatttgcaaggatgagtaccaaccgtactcagcaagccaccacagcaacaatgcatatgaaagggggagttcaaaggatggccatagttcttttgcgcaaagcaagttttgtaattcttttcacaagcctaagacctagcattgactgatcaaattttagtaccagagtttgtatttaaacaacgacggttctgtccaccatccattgtgatcccaaggatagcttcccgccattgattcgtcatggttttctgaggacgtccaccttcctgcctctcaggaagtggctccaacagcataaaattgatcatgcaatatcccctcccacacaagttaagaatttagagtctagccaagtgtaatacatgtcccggtgctcaataaccgcgagcacggctattcgaatagatttggtttactcacactgcagtggatgtacactttacccgcactccgcgactgcccaacacatgagcctcgtcccaacacatgagacgcgtcacggcaaagcttttcgataacctcgcattggcagtacccgctccatgaacttttcatcctcatgcactctaggcgtacacggtttctagcagtgagaggagttctggcgcacccgggaagggaagactcacacatgcattaagttataattatgttttagattctcacatggcagtcctaccgatggcgacaccactgtagacacccgcctcgcggtcctaccaatggctgccccaccgtagagcccctgcctcacacatcaagaaaccactatgcatagatactgcctccgctcagctatctactccgctaggtctatacccatacgagaagtgcggttatacgggggtcatttcatgcttaacttcatggctcggtccttaattgaccagggacggcactagccttttccggacaccacccaagtcctccagccgccccagtcgaaaacagttgttttactttattttcctttcacaaatcatgtcatcaatatcatggcaatgtggcgctcatgtctccacatgccgcatctcaattaccttcccaaaggtaattgcccaagcatatagcatttgataaatatgagtatgcatgaatctaaaatagcatttctaagcaagtgtcatagttgactagggactcgtacgtatctatggttacaaagatttaaaggtgaacaataatcaaggcatggtataatcacaagtaggatgttcataattgcatgcaattttatttgtaaacaaaacaatttcgcaattgggatcaacatgttcaaagaatagtgatgacttgccttgctcgaggtcttgtgagtcttggccttcacttggatccgcggctccctcggtctctatagttacgtgcgtaagaacaatttgaattcgattagaattcaaacaaaatccaaataataaccgaattgaaaaacgagcgcgggagatgaattctatataggctacttaattcgcgaggtggaattatttttctccctaagatattttgtaatttatagtcatgtcctaagactcatcgaattattgagttcttaatcacatgtaaattattaccgcgaaattgatttcttagggagattactaaaaataatctataatctataggaattcatccaattatattttcattaatcctatatttaaatgctagtatttttggtatttaattagtaagaattcatctaactatattcattaatcctataattaaattctaatatttgcaaatattttaaatttcccccttaaattttccctttcttttctctctttctcttttcttttcttttcttttctctccctctattttcttttcttttctctcttttctctccctctctcttttcttttcttcttcctcctcccggctcccccccttcttcttcctctctcggctctggctctcccggcgacgacggcaatagacgcgaggagggggcggcttacctacggcggcggctgcgacagcggcggcgtcgacggcggcgacagcggcgcgagtcgcggcgcggcgtggcggctctaaggtggcggcgcggcggcacggcgacggcggcacatggggaaagggaaaggggaggggaagatgggggaagtgtgtgtggggaggcttggggatggagggagggcttatatagggcgcgggagaggggcggcggcctcatggcgttggcggggtggcgcggcgcggggctcgacgcggcgatgtgacgactacgcggcgcggcagggcgcggggcgcgaggcggcgacgcgacggcgtaccgcgcggcggggcagccgcacgagaggcgagcggcgagcggggcgcggggctcgaagcggcgacacgacggcgtaccgcgcggcggggtagcggcacgagaggcgagcggcgagcggggcgcggggctcgaagcggcgacgcgacggcgtaccgcgcggcggggtagcggcacgaggctcgaagcggcgcgcggggcgcgaggcgcaggcgcgcggcgcgaggcggcgacgcgacatctgcgcggcgcagcagcggcgacgcgacggcgatgggacggcggcgcggcgacgggacggcgcggcagcggtggtgcgcggcgcgaggcgcggggcgcgggcgcggcgacacgacggccaggcggcgatggcgatgggacggcgcgcggcggcttaatggcgatgcgacagcggcgcacggggctcgggacgacggcgacgcgcggacgacgacgcgacgggcggcggcggggcgcgtgggcgcgcggggcgacgagatggctgcgcggcgcggcagcggcgaagtgacggcgcgcggcggctcggggtgcgaggcgacgtgacggcgcgcggcgcggcagcggcgacgcgacgggcggcggcggcgcggggcgcaaggccggctagggcgccgggcgcgcggcgcgcgggcgcgacggcgacgggacagagggggcagagctaggggacgcactcgagcacctagcgggcaatgaatagtgacttttcctattgatcccgattttaatttatttcccatataaatttgattctataattcctaattttacatatatgcattttactcaatatgtgtattatcccaaccaatggatccacccctgattaattttacccatattttatttttatataattttcttgaatttaattagagttaattcttattcctacatttttaaattgaattgatacaaatatgatcgtgataatattttatttattactgtccacaccaaatcttattttaaattgcactttaattatttactttgtccatttattttttttttgggtttattcctaaccaattatccattattcgcgatttataaactccaaacccaactccaataaaataatcgaataaaatcggcatgatgcaatttatttaaaaagtttttgaaaatccgtatttttagagttttgatattttgtcggtcgaattttcagggtgttacaggcggatttggtgaggcgacgacgaccacgacatgaggagaccggacgaggaaatgcgcggggcgccgactcctccaacgcgaggcttcggcttgtggcttcgcggttcccgaacctaggcgtggcgcttgcaccggttcctctgcaagctcactgacagcctgcgagaccacccaaactcgtgccagctcggctcggctacgacgtggacctgcaagaccacaggccaggtcacgtgttgtacatggcctaaatgactaacatctggatcttctgaatgttggctgtgtacaccttaaaaggtgtagaggccaggttaatttataattctttatctaaaaatcttctgaattagaaaaacaatgctgatcagggacaaaaattgtaacagcaccaaaaagaaaatcagtgccacacatgatcgagaacatctatgaaaaaactgtatcttgtattaatttggtaacgtgagacggtaatttaacgttatactcaaataaaatagattgaaaaaacatactactactatgttaaaaaaagaagagatcctaactacaaacctagctagatactgacacaattggtgtctagtgggagccaccacctgacaaccctggacggcagcgcaactcatcgacgaacatgcagggtttacccgccccggcggttaccgcgcggtaaccgcggtaaccgtgaaaaaccgtacaaaaccatacaaaatttatcaaaaattcaaattattttttaaatttatttgtatttaaggaggttaccgcggtatttatattaccgtacccccgcggtaagcccggtaaccgcggtggcggtaagttaaaccctgcgaacatgtagggattaaaaataaaattttcatactatatactcaggtctcgttcaagtaagcgtaaggatgaatattatcatcagtatagaaaataagataagttattagtgaatgattaattaagtattaatgattaaaaatttgaaaaattgatttatttaaatttttataaaacttctatataaaatcattttacacgaaacacaaggagaagccaccagcagtccagcatcagcgaatttgaattcaaccttcatcgtggttagatttgttcaggctctagaaattattggtttcacagctgagcacattgcaaggacctgttggtaaagagaaatggcgcagcagtaaagagagagagagagaaaattacaaagcttttccagtaaattcagcatctatctcatgtcgcgtttcacctggtggctgggtgggaaattcagggatcgagctagcagtagcacctggtcctccctgcaattggcaagtgactgataaccatcactggctacacacgtgatcgatccatccaatcccaacccatatcatgcatcactactcaactagtatcagggtaacgacaatatatatagcaaaagtaatctatatagatgggactcacacatatagactataactatttttctcttcacaatgtatatagatattactattggttactcgttggattcatgctgctatactcattcatctatggccccgtttagttcgcgaaatgaaaatttttgggtgtcacatcggacgtttgactagatgtcggaagggtttttcggacataaatgaaaaaactaatttcataactcgcctggaaaccgcgagacgaatcttttgagcctaattaatccgtcattagcacatgtgggttactgtagtacttatggctaatcatggactaattaggcttaaaagattcgtctcgcaattttccccctaactgtgcaattagtttttgtttttatctatatttaattcttcatgcatgtgtcgaaaattcgatgtgatgtttttggaaaaaaaattttggaaactaaacatggcctatgttgagcagtatatacttacttttcgacaggtgaggtcgtcattaatatttgagatggtaagtatcacagaatctgttgtaaatacttgttgggggctagagtcatgatttttgtatttgattgctaaccaggaaaactacaaatgttaagtcgtgctattgatatgattgttttaatcttcagcatcaaccaatgccaaaatttaaattttaaaatttaaatttgaatttttttatcaaaagtttatttttcagcattagcgtttaaatcactaagaatatatataaaaaagttttacctataaaagtcaacaatattatatattttgaaaataacggagtactatacaaagtttacataccactctatgctgctacgagacgagtatttgtcgtcttagataatgtctttcgtcaaacacgaacttttgccgaccaaagattaagttttgaggctccctttgactcgcgggatagtaaaaggtataaatagaaaaatgtattaaataaaatgtgtgatttttaaatcccatagtaacaaaagatcacaagaaacaagatatgaacccttcaattgtgccataggaaaagccaagaaaatattgagacacaaattctaccttggttttcattaacatgctttttaaacgatcaaatggtgtatacgtacaaaaactttatatatatatatatatatatagttgttttaaaatatctgataaattgttattttttaaaaaataattaaaacttaatttatcatgtactaataactttcttgttttgcgtgttcatacttaatctttcatccaaagcacttttgaatgggcccgcaaaacgagctcatacctcttgttattttcctataaagtgtaaaagatataaatacaatcatatgaaaagtttccttcctttatatataaagggaactgggcctgtttggcacagctctagctccagctccacccctcctggagctggagctcagccaaacagtttcagctcctccaaaactgggagtagagttgggtggagctctctcacaaaatgtactagagttgtggagctgggtttacgcagctccacaactccactccagcctcaactcctgaagttatatttaggagttggagctataccaaacaggccctaaagagggaaaaaatccataggaggtttgactcctacgaaaaaaaatcattgcttatcatatgaatcaaagtaaccataaattttggcggttaaaattcaaattcaaattttttattagggcggtaactctaaccaaactggtacggaactcagctttgatgtccggtagtatgagcttgactatttgaggatgaacaattaaacacccaacccctctgttgacccgatctggttactaaccacctcctccattaattcggaccagtcaacgaccatctgctcggtcaatccggatcctctgtggccggaaacctggatccgtacatgtggtcaccacaaatcagctagcacacctgtacatgcttgaatttaccaagcacatttaatatttcttttacataatttttaaaagtgctatattttagaacgaagatatcaattacatagtaatcagtttcttaatatacgatgacgcagatttttgtatacactaaccattcgtgttctttaggtcatttattttgggaaaaagtacgaattaccccccgaactatcacggtcatctgaattaccctcccgaaccacaaaaccgagcattcttcaccctcaactataca

SEQ ID NO: 59579 - DNA, 10925 bp, Oryza sativa
atgacaggtgggccccacaattttttttaaaatagagtgctaactggactgccacgcgtacgccacgtggaccaaaaccaccgtggattaggtcgaggggggtaatttgtccggtttgtatagttgagggtgaagaatgcccggttttgtggttcggggagataattcagacgaccgcaatagttcggggggtaattcgtacttttcctttatttttattttgtgatggtttgttttatcaatgtattctaagtctgacttatactttttacatttacactaatacttttagataagacaatttgttagtggtatgtaaaaaatgaacgacgttaacagagggattaatttagctaatacactctaaaataaaaacagatgtggcatattctaatacaatgagtttaagcaagagtctgatcagcatcgttggattaggatctgtctaatccagtcttaggttatcatatttcaggaatgagagaatactactatgtattccgcacgtagtactgttgagatgaaaatgatgtcgtcgtcgtcttcgtttgctcgcaaattaacgaatgatagaggtaaatccgtagtacaatatcgtctactctcgctatcccaagatagatgtagtttaagattcaaagttcaaaaagaacttatcattttggagtataattcaatttaaaattttcttcattctacctccaaggctccaactacctttccacactaaaccatacatcatttaaagaagacactattgttattttttcataaaacttacttcatccgtttcacaatgtaagtcattctaacatttctcacattcatattgatttaatgaatctagatagatatatatgtctagattcattaacattaatatgaatgtggaaaatgttagaatgatttacattgtaaaacggagggagtattaatctttactgagtaacctaaaaagataactattttgaaacagaggtactactgtactagtaatgtactacttgtattttagtattttcttcttgttttagtatcaaaccaaaccagtagtacactctcttgttttctcaatacattaataagaaacatggtatagtataactttctgcttaatttgtctttgactaaggtcttatttagttccaaactttttctttaaactttcaatttttccatcacatcaaaacttttctacacacataaacttccaacttttccatcacatcgttgcaatttcaaccaaactttcaattttagcgtgaactaaacacaccctacataaaacataccctcctgggaatggaaatttgttgatactagcttactagaatggctattactgttaggccggctgtcctcggaccaccagagggcagcattgtatcaccggcggtggtgtcagtagttttaaaacagattgtcgtgtatgaattttggcaaaattaactcaatcaacaaccgcaattttccaggtttttttttgacagcctcgatcctccggtttatgggcaatggtcggcatgaaaatcatcacacaccaatacgatttacaacttgcccacctaaatatcacggcaggtaagactcccataaatatttaatgtttaagacatgattcgttcaaacttttaaaattctccaccatcaataacttccaaatatttagcttacacaaaaaatgtattcatatatttatcttgaaaaatacaatatcataaattcgctggatattatgaaattattttaatataaaccctatggtccaaatcttatcctaagcatagaatatttacgacgggagggagtaactactggttagctccattaattttaccagtatctaagtatattcatgattgaattattttttgtggaattcataattgaattctacttgaattatattaaacttgaacaacaggacaaaattatcaatacttcatcactcattaagagtaaaaaaaacatgactactacatagtagtccctccgtaagaaaaacaaatccactattgagtgtgacttaatctaattttagatttatttttttataggatggagggagtatacttttaggttagttaaaatattgttcccatttccaggccatactatgcatcagtccatcctcgatcttgtactgggccaagtttttagatcccctaattccattcatttggacgcatacgtaattccataagtacgcaaaaactatgaatatttctcgtctaaattaaattagtccaaataattcctaaatccttatggttttgtttttatctctttaactgtacgtaaaaggacatgaaaatttgttgggaatgcatgcatgcatatgttcccacagatcgagggtgtatatgtacgtaagtacagtacaggcgtatgtacgtataatatacagcacaggagtatactacggcctagcctggtttagttactaacttttttttatttgaacttccaactttttaatcacatccaaacttttctacatactacgtgaacttctaacttttttttcttcaaactagtaaaattctattctagttttagcgtggtactaaaacacaccctgcgttcatttggtgtttacgtgaaggcgttgcgttgcgttgcgtgccgtcccggccagccgccggtcgacgtgatcgcccggggtcacctcaactcctctccatcgatcatctgaattttactccgtcagataggagtactctgctggtgtacaagatttgacgggacagactacaggtgctccttctattaaaaaaacctactacctccgtctcgtctcaaaataagtgcagccatgagtttccccgtctaactttgatcatctattttatttaaaaattttttataattaacattttttgttgctatgagatgataaaacatgaatagtacttttactcgtgacttatgttttcaatttttttttgaaaaattttaaataagacgaacggtcaaagttgggcgcggaaaaccatggctacacttattttgcgacggagatagtaccttcctccaatctcataatataacggattattttattttgagaaagattaaggatgaagacaaaataccacagtacccctattaaatgtatttttggttatggtgagtgggtagttggaggttaaaataggtagagattcaaattagagttgatggatgtgtatattgtatgacttgtagaagggataaaatatcttactccatattattgaacagagggagtaggttatttaggccgagtttagttctaattttttttaaactttcaactttttcatcacatcaaaattttcctatacacaatcttccaacttccgtcacatcttttcaatccaaacaaactttcaattttggcgtgaactaaacacaccttttagcataaattaatgtttgaaaagtaaaactacattaccccttatttgattggaagcaagagaatagtagtgaggatagaataggtagaaattgaatcggaggtaactgatgtgataagtagtactccatccattctataaaaacgaatttagaatcggatatgacccatcctagtactataaatctggatagatatatatctaaatttgtagtacaaggatatgtcacatctgttactaggttggttttttatggacaaagggagtactctcaagcaagggtggagacaggagtagggcagctagggctgcagccctactctggatcctaaaaattcattgaaattccgtttctaaatttcaaaaactagaagataaaggcaaaatcatataaattcaactaattgagctctaggtttagaaaatttctagctcctccactgctctcaagtaacaagtattgtggaacaaaatttgaagtccagatagacaactattttgggacggagagagtaatctaggtggagatttaacaccatagaggacaacaaatttggacaagaattgtctatattcattgttccagatggtgtctaattctcacttaggtttttttgttttgacgaaaagagcacttcactttatttgtagtttacttctttataaagggtttggtgattcggagataattctttattctccaccaatctattttttataatttgtttatccatctattcattttcattttgtatcagtttaatcctcatgtatcataatcgtattttttagataatggaaatggattacatctccggcttctatcataagacacacagtcataaatttaatagtaataaaaaggtaagataaaagtaaatcaaaataagaaataaggtgatgggacaaatccccaactcccctttattattgactagtgttaaaccacataaaatttttttagctagcaattctaatgtatcataatcgtataagttctgaagggcgagtagggaatttgggttagtagtagagagacatggctagacagcccaggataccacatcttccaaaatactccctctattcaaaataactaatatggacataaacatgtctaaattcattgtcataagcttatgtctatatttgttgtactaggttatattttattcttgcttaggttggtttattttttagtatggaggaagtaaaaccgggtaggattgccaccggtcatggtttagttagagctttgttaagagattgcttatactatgtagctacttaaatacttttctgaaacatttttttataatttattttgaaaacaaaccttcattatcctcataatagggataagaaaatgttatcacatcattcactatggtgtggtcaaaatatctatatattttgtagtacttaaaatattagtagtggtggtgtccgttctgtcagaacacccgtccatctttccaaatttcaaaatcaccaacttgtttaataaggaaaatcatataagtattatttggactaaatatatgcttaattgacttttctagaaactcaatttgttttccgttgcaacgcatggatttttggctaggataaatctaaattttcgttgaaagggttggaaaattaactccttttttcatgcagtttttgcgatgcttgtattatatgcgttcaactcactttgtccgaatctaaggcacacgctcgtgttctgcattagcaatcgctgttgagaatataaaggcacagatgctcattatgcttcaactaaataaactaatttttactttttacaagtctaagaataagatttagttcatttatccgaagtaaaatggatccactattacccacggatccacgtacgtctaatttattctacatagtactatataaaactacgctactctcgcccaagtcctgaaaaaagataagtcattaacgtatgattaattaagtattaattattttaaatttgaaaatgaatcaatatgatttttttaaatttttttaaaaaacactggtttaggaagcttatatgcagagaacgaaaagaaatgtcactctttatgcatggctcaaacgcagaatactagtactagaactcatatactccactctctctgctgcttttgcttggtcccttatccagtcgtgtcagcatatatagtgacatggcagtgcgtgtcagcatcacgtttttcacgctagccgggtgtagtgtcatcgcaagatctggtcccttcaattccatcaccgccacgtggcgatctaggatcgagtcgatgatcagtggattagagcaagttttttagtatagcccactgctaactttaaatcatctatagtcaatgtaatagccaattcatacaatagttgcttactatactattaatacctggtcccacatatcatacacacattacgtcttgaagtccgtgctgcagctggctatagatctgtagcccgctgctcttctctcattttctttatctctttaaaatatgcttatagctatcttataggctgctattgtacctactcttagcaagcaagagagggtacagattgaaggacagtcggcacggagcaacggtatttaggctatactcctatgtaaaaaaaaactaatccttagaatgaatctggatatactgttttcctctattttattttaaatgaaatagcatattctcgtgctaattctcttaaaaaaagtttggatatgctataagtttggactcatctttagaattgaattttctttggatggagaaagtatgtgtaaacccttttggttttttagtttttgattgatcatacttagaatatactctacttttatacgcatagttttacgtttttatattatgaaaagtagaatacatttcaaggtaacaactaatcacttctccaatgttcttttccacctataattagctaatagattattgcggacacgcttcataaaccactaaaaaatacaacttttttataaaaagaaaacctttctacataaaagtcactaaaaaattcaaacaaatccatttttaatatttttaatagttaatatttaattaatcatgccttaatcagatttcttctcttgcaagccaatcgttcctattccatccgtctcaaaatataagcatttttagcatagtatcaagttaaacatttttaactctggctattaatagcaaaaaatttaaaaatatcgatcatgtaaaattgacattactagattcatcattaagcaaactatcataatatataacttttttttatttaaaacatcttatttttatagatattattggttaaaataacatcttgaaaaccgtgtccaagtaaaaaatgtttatattttaggactgagtgagtaatgagtacctctaagagcaggtacaatagtaggctataagccaactgcaaacatattttaagaagataaatgaggagagagaagagtagcaggctacatatttgtagccagctgtggcatggactccaagacgcagtgtgtttatgacatgtgggactaggtattaatagtgtagtatgtaactattgtatgaataagctattaaattgactatagataaattaaagctagtagttgactatactattaaacttgctctaataccataccctgtcctgacaaagtgaatgccattggaccaattggactacctctaatagaatctaatattctatgatctctatttggttgattgttgtaataataaaattactgttgtttctgaaagtattatactacaagtagaactaatctgaaccgtttattcttaagggtacaatagtaaagtactaagacagattaggggtaaatttgacatcacggcaacgtcggttacgtcgttgtgttcgatcgtcggtggcggcggcggtggagatcatcttgagggcggagccgccggtggtgaaggccttcttgcggacggccttgtaccccggccacgtgacggcgcggtaggcggcgctccggccgggcgacacggcgtccgtcaacggcgccaccttgacgtccggcaggcgggccgaggaagtatccgagcgatatcctgtcacggtcgcggttgacgacggcgcggtggtatacgctgtggaagcggccgttggtgagtatgcatgtggaagagaggtcgccgacgttgaggacgaagttgcccggaacgatcgccggcaccgccacccaccggtctagtcctcgccggaatagctacagccctgacacaatgctctggagcataagccggagtcggtgtgtgcgatgagtcccagagctcgccgcaggtccgggcacctctggtaccagtgcatcgtcgccgtcatcgtcttggcgatcctcctctccgcctcaacgccagtgagacctagcgcccaccctgaggaacaactccagcagctcgtcggctagccgccgcatctccttgtggaactcctccatgacgtcaccgcgtatattatacgtgcatcagtacacttatacgtgtacacgtagtagtagacgagcagctcgagagagggtgtgtgcatggcggcgacgggtgtacgtgagaataccagaagaggagccgaggaggtagtcgtcgccggacttgggccagagacggcggagcttttgcttatccaattgcaaatgcgtgccggatcagaacgagagacgagtgagtgtagctaggtttagaaagtgaaaaggacaaatacctctccacaaataatttttctgggacaaaaatatccctccacaattctactaccattaaatgtggtgggagtagaaatagatctgagccgttcaatcatatacaattaacggttcaaattattttctactcctagtagaaagcaccggagtgggactcatgattgtttgggaccgatggctgttacgcgaggtacaaaatcattaaaactgatgttaattcgcgggtgcagacatgctccctctcttggtctcaattggtcagccacacagtctcacctgtctcatacctgttcgatttttttttccttttaattcctcatccaacccgtgccaaaattcactactgaattattatacaatattgaagagaaatgatcggtagaaaatgagtaatgttctgagtaaatttcaagagctaagtttagctatgtgatgaagaggcaaactgaaagtctgaaagcaattacatttctgaatcctgaaggtacgaagaactgacggagtgatgcaattgccagaaatgcatgtcgcgatgagcacctctctctctgtctctctgtctctgtctctgcagcatgtgagctctgaatatgcaaatcagagctgcaatttttgggaccatggcgtgcctgattgcttgcctgcttgccgtgttggattcatctcccagccaagaatttcaccaggacaagataacatgactcatcagctagccttgaagaattcacacgtctgctgctctagaattcacagtgtaggtagctgctgcactgtcgactgttcttcggtcatcacacacagcgtcataaaagtataaaacagagattttatgagagtttagcttctttttctttgttttttgtcttagcacatcttcattcttcctgcactgatgcagcttcctcttcatcaggttcagaggcagtgatttggtctgatcgtttgaacagggctatgtttttctatcaatatattcagctgcttcacagctcttttgttcccaacatgtactcaaattcagcaccattagttgatccattcagactgattcagcaccattaggagcagaacgctagggtcttcgactctgacctctcttctgtctcagtggttctggattccatccattcggagggccgtctgtggtcgttagctggcgttgccgcttttggggacctgttgggagtatagcgcggctcagccccttcccgctgttttagagtttttgtttagcctccgtagttttctttttctaagcctcagttttttttattttgctttttctcctttcccctggcataggccggtctggccgattgcgtggtgtaataactcttttcttctaatatattgacgtgcaatccttttgcgcgttcgcgaaaaaagactgattcagtgatgaaagttcattcagatatcacccatcagtcattcgacagtgagatggagcatggactacaaacttgttgatcatcgtgtttctcatgtaatctggattaaggatgtttctccctttgtgcatatgtttgcattaatgtctgctcattgagctaatgcatcatacagttgttctttccttttcttttccttcaaatcctgaatctacttcatgtgttaccttgaaactttggttgtctggcactagtaagcagtagtataatagttttggagcataatagggaatattgtccccaagatcacaggatatgaagttggaatatatgcttgaattagaaaggacaatctaaaatagatgaacaagaaaaaaaaattgcagtgataaaccatagtgttcagtgcagcatagaggatcaacatcatctatttgcctgcactgcaaccgcatagtgctagtcagaattcatgtttttctggagcatgtttgagtatcagagacttcagtcgtaagaaaaaatgtactcctagctcgaacttcagcccaaaaagaagtagcagaaaaatgcaaaaatactatgcatacgatgtttggttacgatatttgtagttcttgcagaaaatgtcctgaaaaaggtcctgtttgattgaaccagcaacgatgcaatctacaataagaaggtggtagatgttaaactcgaaacacaacatcaaaagtagaatccaaaataatcacgacatggtttcagatatatatatatatactagcaaatatgcccgtgcgttgcaacgggtgaaaaaacgtaatgataatatacgtttttcatgcataaccatgtcgataacaatcagaaaattagaactacgaaactttattttctagcgcgttttcttttgtgcttttttctgacatttttccctcacgtgtttttttaaaccgtttttattttctcgcgcattttttccttttttaatatactgtagaaacttctctttttatagttagattagattagattagagataaagaagatatataaatggactaaaaaacgacgaatataaatttgacttttttcctccgcgcttttttccgtccttttaattttttttctcgtgcatttcttttacgaagggtttttttcaccactttcacatagtgtcaaacctttctagatataataggattcgattttttttaccgcatcacgtataattcctttttctttagaaacagacaattttttcgcccttttttatcgcgtcaacggagtcggaatcgttttgattttttccctttttttggatcggacagatttttttttgcccggtttatttcgcccgatcgatttttttaccgcgtcacatataattcc

SEQ ID NO: 59580 - DNA, 5828 bp, Oryza sativa
gcgcttccctacggctgcatccacaactccctcatgccgtcccccccgctactgcttgctatcgaagaggtgatgatgtcgctgctcgccgacgatggcctcgtcctctgcctcggtgccgtaagccatcgccggcggcggcggcggcatggcggacgtcgaggccggtgcccgacgacgaacaccatatggtgcttgtgtagaattcgatatgcacgagagaggtaagcaactcagattgagtgttaattctattgatgaatttgtgtttgaggaatcaaaagaatcgatttctgagccgtaattggaattcaatccttggttgcagttgtggatttcgatttctgagccgtaattggaatacagtcattggttgtagttgtgggttttttatctctaccctgccaatggtttatggttcacattttcatgtgaggaccgacttttttcaagattaggagaagctgatttctgaatatttcagaccagcacccagcagcatcaagttcagatcagaacgcagcaacagcagcacgagcaccatttcagaccagcaacaacagcaatgctgtgggttcctgctcttgtgtggcggcgacggcgtggggagacgacatgcaagacaaaatcgagacgacgagctggaggcctcgtgcggcatcaaggcggcgaggcagacggccgcctcgtcgccgagccggcggagacagcagtatgtacgagacatgaacaaataagggcaaaatcgtaacttcattgcttccttaatcctgtcgaactggtcggaaacgtcaaataaaacaggaaggagggagtatatttttgcaactgaagtcctgaattcagaagaaaaactggcaagatggactctctaatacagaagtatatactgaatttattaagattctgatgccgcaacatattcttgaatgtctgcagagtaaagttgatgtgtccaacagtccaagctgtgttttgagtataaaactacgtttggatgccatgtctttggctctgaaataaacaaaagagcaagagagacaacattctttcaaaagttcagattggtcttagctgatactacggatgatggctgggttcagaatgggccatgttctgttttttcgatgggccggccaaggaatgctgagaaacgtcagggcaacaattaaggcccttttcagaagagctaattgagtttagctactcctcgttttctatttgtatgttttttaaaaccactaagactgtatatttcatatgaaaactttctatatagatgatttaaaaaataaaataaattcatttttaaatttttaataattaatattaatcatatgctaatcatgtttctcgttttgcgtgcaaatcatatgtcgaaaataacgtatcctaagtatttatttttttttcagaatatttatccgattattgaaacggattatttgctccacacttcacaaaagacatttctttcagaaaactttcttctattctgttacttggaccaattgttttaagctattcttttagtttatttatcaaaatatttaatttatccttatagtcaagtagattatccacaacaacaatccataaaaaaatttgtttcaaacttggccttaagtttgttgaagcaccatcctcaggctgtgtctgttcccttgtgttgggaactaatttccttcacacagaaaacgagataccttattagcgcatgattaactaagcattagcttgaaaaacttgaaaaatgaattgatatgatttttaaaacaactttaatatagaaacttttaaaaaaatcctaggcaacaacggaaaatcattgagagcgtcaaagggttgcttggtaatacaggatatctccagaatctgtggggtttcagtgatggggatatatggaatttgcatcactgaagaggaagagcacacgctatggttgtaatttattcaggtttgaaggcaatggtgagttttctctttgggcttgttcagattgatgtcatttcaaatcataccttttttttggtaaagttgccaaatatgtgcatccatttagtttcttaccaaactctagtaaaaaaaagaaatcctgccaaaacttggcaatattgctaaattgataaaaatttggcaataccaaaaattggtaaggtttattttggctacaatctgaacaaacccaaagtatcataggatcagtctatggcaccgtgtacgtgaaaaaatgaggaagtgaagttagaaatgttatccaaagaacacagcctaataaaccagtctacactatgacgcacaaggaaaaacacccaagggatgatctgagcatttcgttcctttcaaagtagccgtatttggcaattgacacatttgcagctgaagaagaagagatgaatggcagattccttgtttgagatagattatcgattggattatcaacttcattatagggataagttaaatgatttaaaaaataaaattaagtctaaacaatgcaacaaaagaatgttcttttatgagaactatctgtagagacgtagagtaaataatctgtgacaaacaatacacattcagaaaagtatagtacaatggacatggccaaagaagaatatcttgtagctaggccgctgaagttgaacatagcccatccaccaaagatgaccagcagatttcaccaggacccctcaattgcagttgtaccccggacgattttattgccatgttcagaggattcttggtccgctcatctacatcaaagatatgatagaatatttttcaaccatttaataaattcttaaaaattaactcggccaactttccacgtatagcagtattgagtgtatatgtattgactattggtcactaccttcgtgtttactatttggagttctgcctataatatattcatgtttaggcgggagtcatgaatatagttgtaatgtaaataaatacatcgtttttatattaaccgataacccaaatgtaatatatcctacaataatagattacaatatataagcttctttaaaatctagggaacattaaaaaaaacacttaggaacattcatgcattataaaatcatgtacttccttcatttcatattataagatttcttatatatatatctagattcattaacatatatataaatgtgagcaatgctaggaagtcttataatatgaaatagaggaagtagatttcaaaacgctagagtactatagttgatatgtctatatggttcaaagcaaataaatataaacaattctctactctaattgcgattatggatttggtttattacttatattttctcggatgagtgtgacattgcctttgactatttttctagctatggtatgccatgttcaatatctataattgcatatattgcataaatggaaaacccacgggtactcaaacggcatgtgcatgtgttctatttacagttgataagtgtattgtgtataggccaaacaagtaattttaggtctcaaattaagcatattcttgctccgcagaggttgatccaattcatcgccaacatcagatatggttcaaatcatagctaccaacacccaacagataccccatttccatattaagtgcatcaatattacttatagccattggatagttatcataaggtagcaactgtttaagttagatttattatttatttaagttattttcactttggaacactttcaatcccgttttggacaactctttaattaatattttcattctagaccaaacaattttacatgatgacactttgaccaccctcaacacttttatctatctatatgttcttttaatacatcaaagaaatattctagatatagttatgggagtttagagacgaataactgacgtaatcaaaatcatttatatgcttgataagagcattggtgtggttaaaagaaaagcaagattagccggctaaaaacttaagttagaccaaaataaaattacgagttgtcagtgctgtgcctatatgtgcacgcgtgctattatcttaaaaagaaatgtgcacgcgtgtgggagccattttaatcattttaataaggaaaaaaaaaggagagaagaaagtaacaatcccgctattattacgtcatatttccgcccaaccatgagcccatttcattttcctcctcctcgcctcggtctcctctcctctcctctcccaaatcgaagccgcctcctcctccgcctccgccgccctcctcgccgccgcgtggatccatctcatcccctcgccgccgaaaccctagacccgcgcttccatggtggtatgaccggttggcctcgcgattggggggtgggaagccggtgcggtggtggtggtggttagggtagcagaggcattcggcgggcgatcgccgtgaagcgggtgtgtgtgggggccagcggtggcgccgggcatggcggcagcggcgaattcctcggcctccgcggcgggggccggcggcggctccgcggcggcggccgggctcaagacctacttcaagacccccgaggggaggtacaagctgcagtacgagaagacgcactccgccgccgtgcttcactacaaccacggcgggaagaccgtctcgcaggtgagctcgctcgtctccgggaggggatctagattggggtggcgtcggactcgcgtcgagggtttccgcggtttttgcagtgtgttagtgggatctcgattggcttcgaggcgggttctagaggaacatttttttaggtagtccaagtttttaggtcgctggtgcagattttagatggcgctaatttatttcatgaacaacttacgtcgctgctagccttatagagatcttattcgttagattttagcgattcgttgagttgataaggttgcaagttcaatcggtagatctctctcgatcatgtggtagtagtgtctcagcttgtgtaatgcttagttgtgctgtgtggcctatatgtgttattcctgaaaatagtttttgtggcgttgtaagtgctgttgttgatggttctagttattgcagttgacggtagcgtatctcaaggagaagcctgccggacagggctccacgccttccacgccaagctccagcagcgggatgcgttctgcagcagcgaggcttcttggctctgggaatggtaaccggacgcttagctttgttgggggaaatggtgtaagccgggctgtgtctgggagcagccgcattgggggtggccttggtacatccggaggcattggtagttcacaagctgtggcaaattacgatggcaagggtacatacatcattttcaacaccgctgatacactattcatcagtgacctcaattctcaagacaaggtctgtaccttttataatggtttagtgtgaaatgtagtttctagtgtttattgtctgctgataagcctgataactgcaccaggatccaataaagtccatccatttcagcaactcgaacccactatgccatgcattcgacccagaggccaaggagggacatgacctgatcattggtatggggtcaggggatggttagtatcgttattagcttgaatcactccattttttgaagtgtattttgtataatcacgagttttatatttgcccattctgcagtctattcaatgtcactgaggcaacaattgcaagattctggaaggaagcctgttgcggcccaacattacaacaagggtgataaagatggaacaagcactggcaggcatgtttaaatttttcacttttcatttaggtgtcagatatgattgcttgactttgtttgcacttactccctccatcccaaaatataagaacctaggaccagatgg

SEQ ID NO: 59581 - DNA, 4057 bp, Oryza sativa
ccatccggtcctaggttcttatattttgggatggagggagtagatttgtatcaccattgcctgttaaatattttggctgcatgtttccctcccttcctgcagtgaaaaccaagtggcatctttgaatatacatggtcaaactttaactttggtcatcaaaattgtcatgaacattaagataagatgtggaaataacattgggaggtcttcctggaagaccaaaatatttgtacatcctgtagtatatgcgctatgataaaaactggtagtgttgtgtttggggaactgtgttgatgtccaaaacgtaacttatctttaattgttgaggttttgacagtttagcacataagacttttttttgggggtcaagttggcataaatgcaagtacaacacataaatactcatgctcatgtgatatagacgtacattgctttgaagtatcagatggacagcaaaatttgaaaggtagcaaatttatttgcggtcagaaggactcccaaatcattctaaagaagtaccatagagttcttatttgggacattggaataaatcattgcgatgctttgaatctaatgctgagctgattctttcagttgatcaatctatggtagtaacgagcttttgttatttaaatctgctctctgttagttcgtgtgctatcaattctgagctctctctcctgtacgaagccaacatattatggagaaagaaggataaccttatttcattttgttattgccatctgctgttgcatggcacctgtttacatgctatcaattcatagaagcgataaataaaggaaagtaaatcttgcattgctgatgaacttttcttctcttagtctaagaacaatatcattatattttaagtcattaatcgataggatggaactgctacatattaatgattttgtaatacagctacatggatcattgtatgggcagttgtcatcaagatgcctaacttcttcttgttatttaattaacctctagacactattgttcaaaacagaatgctgtttacatagtcatccttgcagatgcttatctttctcttattagtgaattgaattctctaattagggaattgaattctctaattaacttgtgggtactacctttttttggcagccgatgcacttctgttgcatgggtaccggagcgtgaaggaatctttgttgttagccattctgatggaaatctgtatgtgtacgataaagtgagcagatgttggttatcggatttggtattttaaaatctggtttctgtttggtggatgattgaactgatgtatattgatgtactatttatattcagtgcaaagatggaaacactgagtgtacattcccagctataaaggatccggctcagttaatgatttcacatgcaaagtccagcaaggtatgttaagcacttcaagaattattttagttaagtatgctttagtatagaggtatattcccccctttgttaacatggatgtctacagggtagtctagtattctgaaccttgaacatatttcttaaatcaatgaacatacttatttatcgcgccatgtagagcatggaaatagcattgcaaacagtgataactaccaagttctgcacctatattcatgcttaagtgcacttatagaaatgtttaatagtcctttaaaaatgatggtttttgctcatgctcgcttttgatagtttgattatgcagtaattaaatttttaatagaaaaggctatcatggcagttggttccaacaattatgcacttgttctggcctccagttatgtacaatgctaagtttcgtgactggtattttacaacaagaactttactggcaaatgccaaccacccgatagtatattccaaatagcgtacatcatataaagtgaatgttggcaagtaactccattatcctatattttctactatcttagaaatatgtttttttgttgcaaaacatgtggttagaggagttcgtatgaaggtgccataattaactttggattcatctcaaaatcatttcagagcaacccaattgctagatggcatgtttgccaaggttcaatcaacgccatctccttttcaccagatggagcatatttagcaactgttgggcgagatggtacttcctttgtcccaatagtagatggttctttattccttatagaacccactgattctgtattgcttattaaaataacactataaaaccttatttaggttatttgagagtgtttgacttttcgaaggagcaactaatatttggtgggaaaagttattatggtgcactattgtgttgcacatggaggtaattggaatctccacttttacatttgccctatctttgctagttagttctatgatttatctattcccactgtttggctgtcctgtcccaaaatatagcattttttagaggatgacacatgtattaaggataggggtagaaagacttgtttgccttctcaggatgggtgaggtataggcctggtcgcctggactacaatagagacaaggatagtaggggtagtatgggtagtttagtggcaaaagttaccttttacatgtcctaggttgctacatttgggacaaaatgaactcaaaaacttgctacattttgagaccgaagagctttatgaggcaatcctgaaacgtgtttctgttagttttagttttttaactctacacccagcttgggatgaacagcatgccaaacttaataattctgctgatttatgagccattccggaaaaaaatgtttctgtttgtaagtttaggttgaatagcatgccaaccttaactaattttgccggttgcctgcctttctgccaggctgcttgttacatgtgaggaacttttttggtttgcataacattacggtgtactatgcctattcccctgtatttggggtaacaaattaacaacacagtttttggcgccactagtttctagcacggcacacgttgaggcacatctctggcctggtctctaccatgtcatcaggtttctgctccgtggcattttatctgctaattgtttatcactagtttatgcgactttgaattatcagcaactatttgtgtttaccactggattatcttccacaaattagttcctcttaccttattttatcatggtctgtttttacagctcggatggcaaatatctgttgactggtggtgaagatgatcttgtgcaggtatggagcatggatgacagaaagatagtcgcgtggggcgaagggcataattcctgggtacaacttaacttgcctaaaaaattgtcaatgccacgatgtttcctgtcaatagttgtaattgaggacaaggtcaattttatgttgacaggtcagtggagtttcttttgattcgtattggtctcctccgaattctgatggaacaggagaaaataccgtgtatcgttttggttctgttggtcaggtatcacaaatttatatagctggagatatagtatgcagtctgtgcttttatgacatgtccttaatgtttaactcatgtagtatcaaagtttctttttgagaagtgtagtaatcaatgttaataagcaatcataagatgcttatttctccgtccactcttatgctgttgtttggctttaaactgatcaaactatgtatgtagcaggatgtgctaacttcttatcatactcgtgctattttctcgctgtacaatctatgacaatgttttctgtttatgttaatcaacttggttagttattaatatcgattcttgctcatatggttagttatagtgatgagattcatttgggcaagttatttggcaattctttttacatgttctatcgctggcataacttttcactgtttcatgctcctaggacacacaactgcttctgtgggacctggcattggatgagattgctgtcccactacgacatccttccagtggctcaccaacttttagtagcggcagcccttctgcacattgggacaatgcatgtctcccaacaggtgttcttcaaccttctccaagaatgcgagatgtgccaaagctctcaccccctgttgccccccgaggac

SEQ ID NO: 59582 - DNA, 986 bp, Oryza sativa
aggataatggatgccacttacctggtggtgttttcttgtgttttattagtatctaaaaagtctgtaaattatttattcatattattgttacagagcccttctaattatcgcctggtgtgaactgtgaactgctctctctctctctctctttgatctgttaacaatgtagtatcttcaaataaagcaagcggttcaagcaatcatcatctgttccttggagcaaaatattttggcaataggtacctggctttcgctcgtcattttttatttttcttgcactgagacttatgtggcggaatatgaatgggaagttgctgttgttggaatcgctcatttgtatgctgatatgttcggaaggcgctctcctctgctgctactccggagaaagcggccgggcaagcagacatctcagttctctcctttcgttagttctgggaagatgattatgcggtcttgctctgggctcatctcttatttctccttccttggttgttcttggttggtttgtgcgcttcgtttcttgattggaaagtgggagagagaagaaagatcgcacctttgtgtcactttttgattgtgcaaagaaaaattctctttttggctggtcatgtgacatgttgggcttgtggcaattggaaaggcagaagaatgtcgtgtgcttgcgagttgtatctctccgagtacaatcaaatgaatgtttctgacggaggattatatttgggaatgacgtccctttttcacacatttctgtcagtcagtcctgttcagatgaaactgggtggtactgtagtagatgtgcacattcgggaatgataggatctgaatttgggaaactatttataaatttgaacactgttcgacaatttaaaaatcgtagttgcccactttaagagtcaaatttagacgcatttccagactatgtatcgttttgggcctgggttttcaggttgggtaagtaaaattacctgatctcccccgccccccca

SEQ ID NO: 59583 - DNA, 6435 bp, Oryza sativa
atgagaacaaaactaactattactcataataacatgaatcactataataaatcatatcgaacaattcatcaatatttaatcaatcatgtattaaagcttttaagtaaaggcatccccttttgaaaaaaaaaaataaagagcgcccttcacgttcccaatctactgaaatgtggcttgcaaatcttaggctaattaaagttaccagcttctggtcaactgatgaaaatacatttgaattttctctgttcttttagttgttatggcagcacaaacaacatttttctaaaagtatgtaagttcttttttctccagaacttttttcaagtttcttgaacattagttttctcatgtactacaattttctaaatgagatgactgtcccgaagatttccttacttttttaacaagttttcttcaagcactaggtcaactgatgaaaacacatttgaattttctcttttcttttaattgttatggcagcagtatagtaacaaagttcctgggtcgatgggatcgagaaacggggtcgaggaacgtgatacgctacttgagagagttttttacaaggtggggacgaaaatgaccccatgttttcgggacggggacggcgttcccgggtcgaggatcgctgccaccgaccccgtttcctgtgactattaaaagaaactggataatttgaatctggataaatctaatcttggacctaaaagtgaatactttgaatctgaatttatttcaagtcctaggtatgcagcattacctgcactttacatttcaaagattgcttgaccatataaaaaatgcttaccaaaaggcataatttactttgcaaaacatcaaaattaatggtgctacttcattctaagtacaaaaggctgaaaacttgttttggagaagtatatacattaaagctgccatatcttcaagatgtagccttaatcattttatatgcctaggaagataaaaaattggatcatgtataattttattgattacatatatatactatattggcatcatgtgtaacatcgaaggaaaaaatatacaaacaaattttagaactcatctcaagagggtgaatacctaaataggtaacgaaaatacatcttaagcttgaaacagagtaggggaacatttaccttgtgaagaggtgttgtgctaattttttcacaatttttttctattttcactttatgcaactgtacaataagaaatgccatatcccaatttttttagcacattctaggcccaacagacagtgcatgtacatggatatgttattgttagtgaaatatagggaaaaggtatgataacccctcttagaaaaatgcgataacatcaaatgacaaacctctagccagatgcgaaaattttaagtatagctgaagcaaataagggaatatctgcaacctatccttcattatcctgaagcatcccagatatcttatgcaaatagctacattttgatggaatctagctgaggaaaaggaaatagtcatattgataactatatatctttatttttctgttcaaaagtggcatccctgtgtgaaactgaaataagatgttctatctatatgacttctattaatggttagattagattcttagcctatgcaaagaatctatcaagtacaaatctactatctactactactacttaaaaatacttaaaaagtataagatgtttccttcgtccgttaataaaaaaaagcgataaaaaaagttcgattgtaattaagaaagtccggccccaaaaaagaaggcgcagaaaaaaaaaactgaccgattcctatccgtgctaaaaaagcggacaaaaaaaggcagaaaaaaaacgattgtaaaaaaatgcccggcacggcaagaaaaaatatagaaaaggacaaaaattaatttttatccgtttccttttttcgttttattttcttgtcgctatttttttcaccgtttttcccggttttttcgtccgtaaaacgattgtaaaaaaaaagcccggcacggcaagaaaaaatatagaaaaggacaaattaatttttatccgtttcctttttttcgttttattttcttgtcgctattttttcaccgtttttcctggtttttttgtccgttttattttatttttccgttttattttctttacgttgtttttttcttttttttctttcaccgtttttccagttttaacaaaatccaacacgctattttttcggtggtttttttttgtcgggccgaaccctagcgccgccactatatcgatttgcctctccatgcgtttcctcatccctttagtttgtcattttttattccgagttttgcggattgcttcgactttgattaaaaaaatcgaaaaaggagatcgagtgaatcaaaatctctaacaattttggagatcgagaaagattcggccgcttttgacagaggatcgactccgtcatcgtacgtgcacgtaggggtgaaaacggtacggaaacggatggaaacaatctttatcgttttcgttttcatttttttttttggaatcggaatcggaaaccccgaaaacgaaaacggaaacgaatattattgaaaccgaaaacggagcgaaaatgaaccggcgcggatacggtaacgaaaatttatcggaatacaaaaacccctcaaactgagcttaaaacttttgccaagtccaattctcaagtctcaacagtcaacaattcatcataaaacacaattatatgaaatcgtctcaacagcaaaatatattcttctataacttcatataatttgcataacaaatattctaaaaaaaatacagcaaaagaccatggtataaggtatacagtatacactattattcagtgctatactgctaatctgctatgagctatcactccatcatcagtacatagttcatcaatcattagtcatcacaaaacagcaacacacatcagtccattagtacagtacttagttcaatcacaaaatagctacttgcatttgatgattccatcataaatctgcagcacaaaagaaatcaaatcaatggtttaggctcgtcggctcgtcgctgggctgctggctgctgccgctgggctgttggctgctgccgctgggctgctggctgctgtcgagtcgcagaggcgaggcgtcgtcggctcgtcggtgtggctgtggcgtcgtcgtcagtggtggtagcggcggcgaaacggcgggacggcgctgccgccgcgagacggcgccgcgaaacggctggacagcgccgcgagatggcggcggtacgagacagcgaagatggtgggggcgaggtcgcgaggagccgaggacggcggaccaggggtggcgcggggcgctggcggtgggtggagcgtgatgctctgccaccgctcgcggtctcgcgatgccgtgtgtctgtctctctcctctatagggttagccactatttgggtagatgccgcgatttgggttgggctggaaacttggggacgaattatagactattgatttcatgggcctttttaacttcggaaattccgacaaattttccggaatttttccgaccgattccgagttccgacggaaactgctattatcatattcgattccgtttccgagaaaatatttccgttttcgattccgttttcgagaaattccgaaaaaaatttcgatcggctgattccgtttccaaaaacaggcctggaatccggaaagtttccgtaccgttttcacccctacggtacgggcacgagactgttcgagatgggcctacagctacacttacgggctgagccgaagagaggtaggccaagcacaggactgttcgagctgggcctacagctccacttgcgggctgagccaaagagaggtagggcaggcacaggactgttcgagctggtcaattaccggatttggtgggaggatcggctccgtcatgcgggcacgagactgttcgagatgttacaggctgagccgaagagaaggccaggcacaggactgttcgagctgggcctacagctccacttgcgggctgagccaaagagaggtaggccaggcacaggactgttcgagctgggcctacagcttcacttgtgggctgagccgaagggagataggccaagcaaaggactgttcgagctgggcctacagctccacttgtgggctgagccgaagagagaggccaagcagatagaagcagcggactgctctaggactaaatctgaaaatgagggaaagaatgaacgttcggtccaaaaacaagaaagcattcggtctaaaaacaagggagtataatgtatagtataaaaaacgtttttacccgttgcaacgcacggggattttttctagtaaattaataataacagaaagttgagcccaaaaccagttagaatatgtgttgttgcacccagattaaagcactgcaagaaacagggcacatttgttcaatggtagctctaagttcctcaataatttgaggccagaaaacttttagtaaagtgatatatacaggctcataagaaacatacctggcttttctgtcttctgtgatgtataaccggaaaatatatagtgcatgctaccaacacggtggaattcgattgccatcatgctatgatcaccacctgtgaaagaaatgtaatgtaaaccactcagcgaaacagttcataggagaacttaacaacacattcaacagaagtgcatgtgcatgtgaaagtgaaacatctaacgcatgaatataaatttcggacattacacagtatagtattttaagcacaataaatattttaaacaatatgtgactttccctgttgtatcaatagtaacagcatcggaaataaaacacctaagagcataatgagcaggagatgcttccaggttcaagcactcccatcctttcctaaaccacatattagatccttccagagcctggtaatcatagaagaacgtagaatcaaaattccatactcacaacgattcatcaactcaaaaatctccgttataatatgcacttagaaggtgagtgttatggcaatccacaatatctgcacttgaaccataatatgaaaaaaaatattttaagtgcagtgttatcctgtgtgaacaaaatggaccaacttgatgtaccataagatgtccccccccccccttatgtttcaaataggcctggtcaatgaaattggggacttcacagaatgcctaaactccaaccatctaaattgtgtcaattctgcatatattattgcgcagcactccagttaaatgttttcattcaccttgattcaggttatacacctgactcaaatgtggcttaattaatatgggctagaatggactattgttttctagttaataaaggtagctaacctagacagtatagcaattcataagatcagatcactaaagttatgccttaggtcaagaaaaaaaaatattcataaaaatatggtgctctggacaaattctaattttaattaaaatgctattagttcacatatatcttgatctataataagctccacaagtataccaaataaccaatgcagattaccttgtttgtttggtggatcatgtacaaaattcaaaaaaccaccacagttttttgtacacagtgaacattaatggtgtgcccattcagctataatttttaagccaaccataaattcctgcacgtctggaaaagaaaagggattgcgtaattactttaaaagactattaacaattgagcacttaattttttgtgttgaatcgaaccgaggcactaaatgaaacagaacatgagataggtcagaatgcatggaagcaacaccgaagccatatcacacagtcaattcatcatatggatcaaccaccagggtaacaatgaaggccagcttgcaaaaaataaaataaaatggtaccagggagagaagcagatggagaccagcacccacttcatgcttcatgtagcaggagccttcagtaatctcagaggccgatagggatgaaatgggaggcgcttatgagaagataagcatggcgtagacgtcgagcaactgcatattcagttgatggcgttaaggaagaggaaatagtctgatgaccgtggacgcaagcggccaccgatattagggaatgcacataattccttctcacaggcatgaaaaagagctaatctaacaaactgaaactttccactcaaataagttttaactaaatttgggaattcctaatcaaattgttttgcaggttaatctgaatttcgaacctctttatgcatggagcaaatcagtatcaaatgtcgcactaaccaatcacaaaaccataatcacacactgcaattcaaatctttattatgtgaggatttaggaagagaggacatcaccttaacctgtagtttctgctctgttgctctatgatcagcacagtggccacagctcactcatcacagcgtcgcatagtgccctaacccaccagatactatgt

SEQ ID NO: 59584 - DNA, 16031 bp, Oryza sativa
taaatctaaattactttccactggaaacataataacaaatccaaggaaggaggtttctgcatatagacccactaaaacgataattcacagaaacgtactcggattttagtagtacctcaagacatttcatcgagcagttcatgagcaccaaagaactctaatgctttcctcctcttccttgttccctctgtattcttctattctctggccatagcagtagtacatggcagcacatacatcagcaggatgtcagcgcagagcagaagtaaatccacagcaaatcgtcaagagcaaggcggcagcagcaacataccagaaacaacaatattgtttcaaaataatatcttcctaacattattgttacaggcaaagtcaggcacttaggactggtaaatcttagtggtggctgttttttatgcttttacaatcaaaatccacgatcttcctccagttctcaaaaatcaccaacttcccgtaacataataagaaacgggtgtaagcaatagaaaaattggcatattatagacacagagaaggcacgcgaattacacatcactatactattgaatttgtttatgttgccagtgttatgttgtccaatgcagtgacccataaggatacttatgggaaaaagggagatctgaatttgagtttataataagagagattaagtgtctcttgttcaggaacagagaggttgtactgacgaaaatcaatcgtaatcagaacagcgtcagtcgtgctctagctagcagaggtcgtcgagaatccttaacggcctttggccagatgattcttgtaattttatttcgcacttggtttgtaatgactatagctgagtaatgcatctatgttccccgcaaaaaaaaaaaagcttactttatagagtagggattgctagcaatgttattaggagctttctgttaccctaaggaagaagatggcacggtaaaaaaaagaaacaaagaggaaaaattaatttgtttacaggatgtgtattactaccagtcaattatattaccaagagaatccagctcccaaagaaatatataaaccacagttttacaggtaacgcaaagatccatggaccacacaaaatagcacttggcttgattaaaagaattaagaactacatgccttataaatatagaactatctattccatgatagttttgtgtctttctgcagaataatgtaattacactgaaatagatgatggtctgagttctgaaatgcagtccaaaatatttttaccaagcaaaggaaagcatcttgattctactataattcccatgctatgtttaaaagaggacaatattatctagcatcccagcaacttctgcttatgacgtgttaaagcaccttattgtaacggtcatgtactgttcgttcatgagctatgggttattattttgggagtagctatatttatggcgccatatttttcaccgaaaaatagtcggcgtgtatttacattgtaagtccctaaattacatatgtaattttagtgtatttataatgtaattcctaaaattacatatgtaaatcctaaaattacatactaattacatatgtaagtggtatataagtgaggtgtaactactatagttacataggaattacacgtgtaactatagtacaattacactctaattatatatataactgcagtgtaattaaaaacaaacattgacggtgagctccctatcttccctggcttctcctttttggttcccatcgtttggcatattcatatgctaatcagcctaagtttgaattttcaacgttaaatttgaagctgattttggggttttttcattaaagtttattttcagcctttgcttttagatcgctaagaacacatatgtaaaagttttatttacaaattaattttcgtttgcaaatatgccgtttggcttattccaccaatatgccgaatgatgaggcccttcttgtccttttgcctgccatctgtgcatggaatcttggtttttactccgtaacaattagagatttgagattagtatcagcaatagtagttacgatggcattagagtctcgaacatgcacgaatctctgaactaattgcacagtgaaaaatcgactgtaaactggaaagaaatatggcgccatatttctagcaattccgattatttttgcatggtatgtgcagaacaaaatttagatcatcagagttgcatggatactcatagttttgcatatgattagttgatttttttttggccagccatgcactgcctacacaatataaaagggaaattaacttcttaagttaaaaattgacatgttgaagcaaaacggtgtaatatgcgacaggttgataatccatctcctaagaaggaaacgaaagctggagccacacatcatgttaacatcaaataactaaccggcacttcattaggttgatatataatcgagagatatgatagtagaaagaggcaatggcattcatagggctttcaagtaaagcatgaagtcacaaaaaaaaaaaagaggacaattgttatgcatgtcttccaaatgatttcctagggaaaaaaaatagcgttttactcaaaattccatgatggcagtaaccttagacctacctcatgcaagaatccgaaattttagctgaactatgtcaaaaaataaaacctgcaacacacagaaaaattacaacctatcaatttcaatggggtttatagggttttcaagtaaagcaggaaaccagaaaataaaagaacacacgcaatcactgtgctgtaaataatctcgcaggggaaaatttactgccttagtacaaacaatccctgtgtttctgtatattttcggaaacttccgaaaaaaaattcggaacttccgaaaatatccagaagcgtgctcagtggttctgtaaatccgaaaattttcggaaacttccgaaaattctcgggggtataaaactctcctccaacccatggactcttcttctctctctttgctatccttttccccacgggttcctctcccccatccactcctccccggcgaccacctcctctccgccgactctccgacgctctcctccacttcatcctcgtgggagcacgtttggggaccttgtgggcacttacatcgttgatcttcaccgcgttcttcactcgttcttcgcgttcttgaggtatttcttcaaatcaaatctagtgattcctcgagttaaatcttgcgattcccttcggtggagatgttcctctagtgccctaggacttgcagattcagtttcacaagttttggttggtggatttgtacaggatctgagttttagggttcggccaggaattttcggaagtttccgaaaattttcggaattattttcaaaagttctgaaaatccctgcctgagccctccaaccttggtttcgcctaattcttgcatccatttgcttgtacatcatatctttggcttcctcttacttgtgtccattccctttcttgtttataggatgccacctcgcaagtccatctcgcgcaggggcaagcgcctccaggatcgttcccccactccttccccatcctcctcggagggctcggacagtgaatggtctggggaagggtacgcggggaccggtccccaagtgacgcaagtacctcggggttccaccctccctcctcggcggtctactcaagccggtgagggctccacccggcaacctcgtgcgatcctcgccgagttccccgtgactcgcaccaaaagtctgaggttgtggcacctcagaggaatgaggatcctcgacctcttcgttgctctgctaccgataacaggttctggactcttttcagcaagatttctatgaaaccgttatctttcccataaccgatcccattgttcctatgcaatggatcaattgggaggacttgtaggcacatgatgaccccaccctcaactctatgattgccatgtgtgaggagatgtgtgtccacaattttatgaccctccatcaaccttggtgcaaggaggttattgcccaattttatgccaccgttttctttgacagccggcggggcatacattggatgactcagggggagtggtactccattacctatgaggctcttgccactctttggggttttgatgaaaactggatgaggtactttgctaacctccatgactattccattcctatgcatcatgagcggcatcccctgtatcttgatggcggcaagttgggcacaactgagggtttcaagcctttccatgtctacctcaaccgtatcctgagaaggaccctcactcccaaagatggtaatgctagcaacatcaaccatcactctcgtaatgtgctcctcgggtttaatcctactggcaatccctttcatgcttacaactttgtgttggaggagatccgcatggcctcgattcagtacaggagggcgcttccttttgcccctcacctgatgcggatgatcgagcatgtcactcaaacccagtttatttgtgaggagtcccattcctatctcactctgcgagtgcccaaggcttgctctgcggctcctgacatacccacctcatcctcttggccgcctactcgggacatcccgtcttcctccactcagcctcctcctgagcgtgcgcaaccctctcctgtggctcatcgctagccttcggctttgtttcgcatcttgcgaagtttgttcggtctttgctctgcagaggccaaacagaatcgcagggcgcgaaacaaaatcaagaaggcatcccggcgagcaaagcaaacacaggcgcacctctactctcggtttcagttgggtgctccaccgtccccaccaggctatgaggctgagcccgatgggcctgaggatgacatcgaggatccctttgttgatcttcctccggagtacgacttctttggtgggtttggccatggctaccctcctcctccacctcccgaggatccacctcaggccccgttcgtgtgagccatcttcgcttcatcctctctttttggtgcttcgatgccaaagggggagaatatctatctctttttcattttagcttgtggtcgaacattgttggtgtttcagtgtatgagactatgtgtgattttaagtcatttgtgtaatagctattactattgtgagactttaatgctttattatggatgattgggatgtaatgacttatatgctttatattatgatcttgcaatgttcttattccctttataattgtgcttgtcatgaatgagatatgaaatgtgatgaatgtactatgaattgattcatatctttttgagcttcaatgtggatgcaaagatttagggggagctctccacttgccttaatgcacacttttagggggagctttcactaaacctttgcaccaaatcaatctattatattcattctctcttgtgatctaattgtattgtcaccaattactaaaaagggggagattgaaagtgcatctaggcccctaattgttttgatgattgattacaatacgattagagatgactaacaattttcatgaaagcaaatgtgaaggatgttacgtcctcgatgtgttgtaatgcgatgcatacccctttgaatgtgacatcacgatgaatttatggcatgagcaaatggtatattgtatatcttactttctttacgtcttaggaatgtcgtactattaagggggatgatgcatagacatagacatataaggagtgatgtgtgtgctcacaatcaatttttggaagcattttctccttggccgtgtgttctggaaattttcggaaatttcgaaaaggattttcggaagttccaaaaattcacataactaaaatttcacttctggatatttttggaagtttccgaaaataattttcgaaagttccgaaaatttgcaaaaggttgttttgggttctggatatttttcggaaatatctgaaaatatttttcggaagttccaaaaaggtgcgttgacttcgagttttcagatctggaaatttttggaagttccgaaaatgattttcagaagttctgaaaatcgcaattattatgcaccaacgggcagatatgaggctgtggctataaatagcccccatcccccctcttgtaagtgttgctggtgacattgcaattatttgagcccttggcttgcttctctctctactcatttgagccttgctttctcgattcctctctccacccgggtttgattcggatttggcgtgtgtgtgagtgtggattcgagtttgtgtgaatgcttcttgtggttttcgtgaagatttgtgagcacttgcatcatctccaagagttcttcgcatcatcttttactcttggagattgaggactcctagacagctaggtgtcactcccgagccaccgatctacttgtggttggccgtgggaagtttgtgaaggccggatctcgcctccgcaaggaaagagataccccttagtggaaagaggagtgctttgtgcaacctcttgaggaaagagttagctaagacccggctctttttgagctcctcaacggagagtagaatccctcaaggatttgaactccggtaaaaacttcgtgagcttcattttgggtgatattcctccttcccatcctctagatttatttgcttgagccgctataggtctagttgttgtatgttccttgatttacttgtggtagccctctagatctagacttttactgcattgttcaactgttctgcctattttcgaaagtttcgaaaattcctgcttccgcatttgtttagtttgttaaattagcctattcaccccccctctaggcctaattgaccctttcaatggtgaaatatatttttccaagaatgtgtcccattcctctgctaataaaattctcatgtcaagagttactttgaaaccaaagaaactactaatcaaaaacaagatagatatttccagttcactcatgcacctctttaacattttagcagattgctcccgacatttgacatcaacttcccagtcaattgagctattgtcttccccgcaaaaaaaaaaaaaattgagctattgtcctttccctcaacagctcctccctttgctatatacgccttcattatatatgtctgataaaataacaccaaacagaagggaaaaatttatgaacgtccatgctagttggttattttacaatcttgaaaagcaatattttgctatcagtccaactaatttgagaaaaaaaattctgaatgagatacatgaagagcagttgtgaggctgaattgttcagggatatatgaaaagcatgcttaggattgacgcaacaaatatgtatatatgtaagattgctggagtatggattctgagcgatagcagtagacaattcaatcaatattttatcacctaaagatcattcataatagttcgacgaaacaacgatagtcggcagatacacaccttcatgatgcattgcaggtgaggagacggacgggacatttcgctgagcaccccgtgttcgtcgtactgtgcggaagagcgcttcgggcatggtggcagcggtcgtactggaggatggggtgatgcagactaaacctttctccacagaatttaaaaggaaaaaaactaaaggtagtgagatgagtttaattatggggaattgctaagcaagaaccacaacgcttgccagcattggattgttgaagagaaagttacctgagcattttggtagctcctgctttggattttagaatcaccatcagctccaaccacgaaacaaacaacatcaatcaaagttatcacctaaacaaaaacagatctagaaaactttgaaacaaaacacaatgtcgtacttagaaccgagctaccaccatcgccaccggagttgtgcagccgcacccagtcatcccctatttccttccatttccttcagagggaacacaactaaatcactacttgatgcacaagacatagtcatgtcagaaaagtttgcttgtttatcacttgacgagcagcttcacagcgacgaggaggaggaagaggaggaggaggaggaggaagaagttgaggaagaggaggatattgaggaggaagaggttgtggaggaggaagaagaggagattgaggaggaagaggttaaggaggaggaagaggaacttagagaacaagttcaggaggccggggaggaggtcaacgaggagcagcaaggagccgatggagtagttcagtccatgctgatgccaaccgatatcaatagtgttttgagctatcggttatatatccaatatagataatgatataaagacaatcgactgatgatgataaataacaatataatccagtagaaatcaatcaactaataataatatgatagaataaacaatgatccgaaggttaaagcatacatcggctggaggaccgatgtcatgaaatccaaacgattagataaacaatgaaatctttgtcacaatcggctaaatccatcttgtatataatccttataagccgatgcaacgtccagataactcatcggctgaaaccccgatgaaacccttattgaaaatcaaaaagcatgctagagattatggttctaagcacgactaaggctgatgcagtgcaaagtatgaaaagaaacatattatgtagacaatcaagcctttaactggtttttagggtggtggataccttatttaatctaatctagcaagataatttagccgataccagcataaaccctaaaacgaatctcatccgatatgatcaaattaagatgctaaactagataaactaagatatatgataaataggtgcatacattgacaagatcaaagtgtcaaagccctagctctgccgatgtaaacaaccatagcaagttttactcatcgtcggagatcaaagccaatgccctaacttgaagcaggaacttgtcgaaaaagtagaaaagtaaaaagggtggagatgcgccgaattttattgatctatagagatagtttacaataactccgggtgtacatatttatacccatgggtaaacactagtccttcttggacaagaaaaactttcctaaagtacccatgggtagacactagtccttcttggacaagaaaaactttcctaaagttaaaaagaaaacataaagtttttatcggatactaaacacacttttctaaagatagaaggaaactaacagactcttcctaattaatagataaactgtcatgccgcatcctccttgaacttggtctcttctagataaattttcttaactggatatatcaagaatccgactgctggcgacttgacaaatcccatcggccgattccataactctgaagccgatactgactctgggccgatgatgacttcggggcttaccaaattttggcattaacaggactctgaaccgtaagggatagtcttgcattgtaatgctagctcttcagactatctaaagaagggttagatgcctcttggggcataatcacacataagatcatcagatcgataacacaatcggcggaatatttccccagacatgagtagggtattatttcttatcgagaatgcctgaacctgtaaaaatttccttgtatcataacccatccacttttctgcttgttcgctacccactttagattagccaaaatctagttttgacatttatcgtttaaattggtgggagtttttatcaattataaaagttgtcttcatctgttacaacgcgcaatagtatatctataactaatataaatatttgtatttttccaatcatcacagtatttttgggtccgtcaatccgacctagcgcagttaggtcagtacaatggccaaagaaaaaaaaaacaagagtttgatacaaaatcatctacaaattaaaccaacagactcagaatcgaactcaataaaatcagctgggatgatcaacgggatagaaagtttgaaatcaatggaatcaagcaaattaatcacaaagcaacctcgatttatcgttttgacgatggcgacaagctcgtcatccgacgagaggatgggcggtggtggcgaaggaagatggggaggagaggcgagcgccagcgcctcgagacgcgccgtcgtcgaggccgctccgccgacccgcaggacaccgctgccaccggatctacccatcggaggacgccgccgcggccgctcgcggtggagaaggccgtcgtcgccgtcgctagcggtgggagagggcaccgccgtggccgcacacgatgggggagggcgtcgccatcgccaccgctgctcgtgatgaggaaggtagccgctgccccgcgtcagtcgcgagatcaccggccgccgctgaggaagatggggatcgcggtagggaggtagccatcgctatcgctgccgtcgccgccgttgctcgcggtagggcaagtagccgccgccccgcctccgccgcgagatcgccggtcgccgccgccgccgctagcaatggaggagggcaccatcctggccgctcacgacgggggaggacgccgccgtcgctgccgctgctcgcggtagggaggtagctgccgtagctcgtggttgggaggtagccactgccgtcgccgccaccatcgtcgtcgctgctcgtggtagggcaggtagccgccgcctcgccttggacgcgtcgccaccgccgccgcgccactcgcggttggagagggaggataatgagtttagggttagggtttcaacatggaatgttatatatatatatatatatatatatatatatatatatatatatatatatatatatcgagcgatcctaaccgttcgattgaatccgacggctctcagcgtatttaagccgacttgggccacatgggttatgtgcacttaacaggccaagttgtggaagacattcggcccatccttatgggcctaattgagttttatctattctgagttgatttaaactatttctccattaacaaacttaatataagcattattttgagccattaaaaattgatgagatttgatatagtttttatttcttcatgttaaattatttatatctaaatggagtcaacaaaaaatgtaattgtatatttttcatgatatagaatttaaatttggactaaaataaataatattaattattttttatgtggactatagcctctattggagaatattactctcttccaatattatttattttataattcatatttttttattccaaaatacaaaaagaaaaccaaaatacacaaaaaaaagttttgcagtacaggagttcagttagcttttctttcccttttcgtccaggagtgtgggtctgccccgcttttctttctgctatttttagcgctcccactaatatgattttacagatttctgttgcacactatatttaacctaaaacaaaattcagctctcacaagtacaatgcatagaaaatcgagtatattctcacaattacattatatggattacaagaaaatataatttccgcatgacttatattcagatgtgtcctttggtcaattccattcatttttcattaggattatgtactttaaaaatattgatttttctatagatcgctcaaattttcatcaatcactttctatgcaaaaacaatcactttaattgttcatcatttgttcctcccttgctataatcgttaggcccatgcgtcagaagcgtcatccacatcacgcaaatataaattagattaattgtgaaaaacaaacatggtttgtttatcactctacatatagccgatgtttataatcatactatgatattttggtaaatcattaatatctaacttcagtcacgcacaggtattttgctagtctactactacttaaaaaataagaggtgcttctatcgtccgtaaaaaaaaccgggtgaaaaaaaaccgggcagaaaaaaccaagtttgtccgatcaaaaaaccggacgaaaaaaaaagtccgatccaaaaaaaaagtgaaaaaaaaaacgggcgaaaaaaacacccgtccctggcaaaaaaaacacccgatcccttaaaaagggaaaaaaagtcccagagacaaaccgtttaatgaataaaaaaagcgaaaaaaaagagtccgattccctggagaaaaaaaatctgatttccctagaagagatccgatctgtattggattggagaaaagaaaaaaaaacacttctctaggtgcttaacacttctctaggtgcttctatcgtccgtcaaaaaacgggagaaaaaaaccgagcgaaaaaaaaagaaaagtccgataaaaaaacctggcgaaaaaaaaccgggcggaaaaaaaacaaatatgtccgacaaaaaaaaaggaaaaaaaaggaaaaaataccgaaacgaatccgactacatcgacgcggtaaaaagagtttaaaaaaataaaaagaaaacggtcctattccaaagaaaaatgaattatatgtatcgtggagcaaaaaaaaaaaagaaaagtccgataaaaaaacctgggcggaaaaaaaccgggtggaaaaaaaacaaatctgtccgacaaaaaagaaagcaaaaaaaggaaaaaaatcgaaacgaatccgactacatcgacgcggtaaaaagagtttaaaaaaataaaaagaaaactgtcctattccaaagaaaaaggaattatatatatcgtggtaaaaaaatcgaccgggcgaaaaaagaaaaaaatagtccgatccgaaaaaaacaggagaaaaaaaaatgggcgaaaaaaaaatttgtccgataaaagaaaaggaaaaagctgaaaagaatctgactccatcgatgcggtaaaaaaaggcgaaaaaaaactttccgataaagaaaaaggaattatatgtgacacggtaaaaaaaataaaaaaaccaggcgaaaaaaaagataaaagtccgataaaaaaacggggcgaaaaaaaaacaaatcggtcctatccaaaaaaagccaaaaaggggaaaaatcaaaacgaatccgactccgtcgacgtggtgaaaacagggcgaaaaaattccaaagtaaagggagaaaaaaaatcaaaacgaatccgactccgtcgacgcggtaaaaaaagggcgaaaaaaatccaaagtaaaaggaattatatgtgacgcggtaaaaaaaatcgatcgggtgaaataaaccgggcaaaaaaaaatctgtccgatccaataaaagggaaaaaatcaaaacgattccgactccgttgacgcgataaaaaagggcgaaaaaattgtctgtttctaaagaaaaaggaattatacgtgatgcggtaaaaaaaatcgaatcctattatatctagaaaggtttgacactatgtgaaagtggtgaaaaaaacccttcgtaaaagaaatgtacgagaaaaaaaattaaaaagacggaaaaaagcgcggaggaaaaaagtcaaatttatattcgtcgttttttagtccatttatatatcttctttatctctaatctaatctaatctaactataaaatgtcacgagaaaataaaaacggtttaaaaaaacacgtgagggaaaaatgtcagaaaaaagcacaaaagaaaacgcgctagaaaataaagtttcgttgttctaattttctgattgttatcgacatggttatgcatgaaaaacgtatattatcattacgttttttcacccgttgcaacgcacgggcatatttgctagtatagttaaaaagatgtaaatagaattcgagtcatagttgggggaccaaggtggacttattcataacttgtccatcttacgtgtgtgacggaagagcccaattgcatatggcttcgtataaaagcggtacctatcaactcctaaccctggcaacatatcctatacacacaggccctcacgtgtacacacgtgcacaccaactaaaaaatatcactaaaaaatctaaaaaaaactatacacatactttcaattgtattatacctagtgttaaaatcttaacgtcaaattcattatattttagctgtaacaaaaaaacaaaaaatctaacagttttaaggttgcaattttgtcagaattttatcttttttgttattctctatgtagaatgaatttgaagatgcgactttgcacgtagatgtaatactattgaaagtatatgtataaattttcctagaattttttatgataatttttagttggtgtacacgcgagagcatgtgtgcataggatacgctccccctgaccctaaatctctctctttattcctgaatcgctcggccgcacccgcacgcctctcgccaagtcctctcggccgattcgtcttcttcagtacgcgccggccgccggctctctctcctcggtaaggcatctcacctgcaaatcccctgattcgtactcacagcgagcgattccccttggtgccataatttccaatctagtgtgttaaaggtcgccatgtgcgccgcccggtcgttccccaactgggtgatgctagagcgcttcatcttccgcgtggacgacgacaaggagttccccgacgacgtcatcagggcgtcaggcctcacctctcaggagaatcccttccacgtcgccttccgcctctccaatcccccaggcatctctcgcatctacgtgcagttgccaggctttccaaattcaaggaatgtcttgccgttctccgtcgtggcgacccaccgtcacctcgtcctgttttccctcatctccaccgtcaaagatcaaattgacgtgcaggacttagtcatctatgacgcctctgccaccttgcagacgctccctccttgtaccgagctggacaatgtcctcctgagaatgatcgccgcatggtgatgctccgatccacgggcctcttgtacctaggcaaccaagatcagttcgaggtggtagagctgaatctttacctatccaggccccaggtggtcctagctcaactctgtttgctgcggtcgcacatatcaaaggtagcgagcagcggttggcgcaccatccgtctgccgatccacgtccatggcaaccccgatgatgtgcatcagctctactctggaagaccgacactgtgatccccttcgacaaccagctgtgctggattgactacatgcgaggcatcctcttttatgaccctgccgcgattgtcgtctctttccttccgttccctgtggatcatgagactcctcgtcgcaacaaggaatgcttctggttgtaccgtggtgtgtctgtccttgatgccagcggtgtgctcaaattcatcgacgtcgcccgcgatgatggacttggctttgagtctctcaggcgtgatgctggttttactgtcacctgctacagcctcgtgttgggagaacataagaagaagaagaagaaacacaggagaaccatggagtggagggaggactacaagatcacctccaatgagctctggtctatcaacagccttgactgcctcccacgcaccttactcatgttccctcaagtggacattgacaggccacatatagtgcacttccttgcccctgaattacggtatgtcatcaagaagatgtgggtcgtcgccattgacatgaacaccaagatcgtggagtcatcttctctgtatatcaatgggaaggaggaccttcaaactgaggacgctggcctgacccgtgcaaagtcgcgctttccgcagtccttcctcccatctgacttctccaagttcatcactttctcaaggtatatatattgctagtttttatgtatccatatcctacttatatgcatgttgattgctgcgtacctgcaattgttagcctcctgtcagtagcctcttcctccaaacatttaaacataaatatttaaatatactccctccgtacctaaatatttgacgccattgactttttaaaacatgtttgagtgttcgtcttattcaaaaaatttaagtaattattaattttttcctatcatttgatttattgttaaatatacttttatttgtacatattagttttacatatttcacaaaagttttttgaataagatttatggttaaatatgtgctaaaaagtcaacggggtcaaatatttagggacggatggagtatattgttggaaacttttagcatttgtaagtgaagtatgcttatttcttaagtag

SEQ ID NO: 59585 - DNA, 910 bp, Oryza sativa
attaattggcttgctgctgctaaaaatttaggagtatatgccaatgcgctgctgctgctcagaatgccagcaacagataattaatcaaatcttaattgcattatatatggagctcgcagtaaacagagacttaaacacccggaccttaaaatcactagacgatggggtgcgtcgccgtctccttttgtacaatttgttttatctatctttttaccaggatttatacatgtatcagtgattgtataagactaatgtaaactagaagtggacgcgcggcacgtacggagttactagtattgtgtataaaatacatgattttacagaacttgtaaacgttgagaatcgctcaagtcatttgtggaaaagattcaataagcgagaagaacaataaattcttacatgtgagtcctatcaattcatggttcgcccaactgctttcttaacaaaatgtgtctgggtttaaatgtacaaaaaaattaataacactgatattttatttttatttttattttgcggggaacactgatatggtattagaacgccaactattgatatcggaggataatttgactgctgccatatgcagttgagattatattgtacaggttgggaaaccttgcaagcttgtttgttacaccatagcaaattctcttgtagcgatcacatcatgcgcattctcctcttgcaattgcctagctaaagcttcatcagatgccaaccgggcctcaatcctgtgggtttctgaggagatatggactgaataggtatctggagtggccactgatgaacctgcaactatttgctaattaacaccgacaataaatcaagtaaaccaaacattacagaacctgtctaaaaaaccatcttaatttagaagaactcagattagtagtgttcatgcttccaccag

SEQ ID NO: 59586 - DNA, 15725 bp, Oryza sativa
  unsure (1)..(15725): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatgactgtcagtatggacttcatagagggactgcctaagtcaggcaaatatgacacaatcatggtagtcgtggacaaattttccaagtttgctaaatttatccctcttgcacacccttttactgcttatacagttgcttaggcatttatccagcaggtgtatgatgtctttgggatgcctcaggttatcatttctgtcagagacaggatttttactagtgctttctagcaggagctgttcaaactagcggatgtcaaacttaacatgagctcttcttaccatccacaaaccgatggacaaactgagcgcttaaccagtgtttggaaggtttcctcagatgcacagttcactttgctccatctaaatggtccagttggctgtcccaggctcaacactggtataacacctcctaccacaatgtgctgaataaatctccatatgaggtcttgtttgccagaaagcctacacattttggccttgtggatgtgggtgcaagtacagtgccggatgtgcagctttggctccaagagagagctcatatgaatgaacttttacatcaacaattactaagggctcaacagaggatgaaaagtcaggctgataagaagcgttctgagaggcaatttgctgttggagatcgagtttatctgaaattgcaaccatttgtacagatgtctgttgcccgaagatcttgtcagaaactgagctttcggtattttggaccgtatacagtgttggaaagggttggcgctgttgcttaccgcttggatttacctgctactagtcagatacatccggtggtgcatgtttccttactcaaggcggcaatcaaaccaggcacccaggtcagttctgatctccctctcaactattctgacgaacaatctaccattcagcctgaagcggttcttcgtcgaagtctgattaaacgtggcaagagtgttgttccctgtgggctgatcaagtggattggcatgcctgaggagctggctacttgggagaacctgcgccaactccggacacgttttcctgatgctactgcttggggtcaagcaggttcttaaggggaagggaattgttagactccaggagtcttttattgcttggcttcactattctatttgggatttgggcctgatggccttgtaaggtggctggtgcgtgagtgaaggcctagttgtgagctgtgtactagctggaacctttatatactttgccgaagcgctggtcgtaggcaacgaataagaaaatacaatatcaccaacctcctctccaagtcaattctccactctgttcttactcagttcctcttttcttcctcccgaattgctcgatccgtgcccagtttggcgtttcgccaagggagatctcactgattcgtgacatgctggcgccgaagaccttgtggactatggtgaacttgtggggttcgtcggccgggaagaagggcgcaaagatgcaatccttggtgcaccgccgccgcagcagcttgcacgacgcgcacggcgacccactgcacatcgtcccaatcctctctatctaatgttcacacacgtataaaacgcttatacgaatgacagtggcggtcagtgacgggccacgtggcggcggcggcggcaacgacaacgtgggagaaggagacgcgcctctgctgtggggatcggctccgacggcggattgctacctctccgcccgctgccgcgctgctccgcccctttggcttcgagcgccgtcgctccacccgccgccacccaatccgcccctttggcttcgcgcgtcgttgctccgccctgctggctttcgccagcctgcgccgtcgccccgccggctttgggcgcatcgccattccgcccgccgtcgccccacttcgccttcctacgccatcaccccactccacccgccgccaccctgccacccccgcttgcttcgcgtgcgtcgccgctccgcccgccgtcgccccgcttcgcctgcctgcgcgccatcagcccgctccgtcgttgctcgcctgctccgccgttcccctcatcgcccaacgctgcggggccgcttcgccgccggtggtgacacaacaccattcgtgaccggccgccgccctcgccttctctcgcgtcgcagccgccgcctcctcctttctcgcctcgccccggcggcctcctccccagcagcgccgctggcttgccagagaagagaagagaagagtgagagagagaggaggaggaagggagaggagaatgaagagggagggtgctgatgtggcatcttgacaatgtggggctgttaacaaccaaatttggtaacatctatgtcaggaaagaagattggatcaaagcaaagttggaggcggagatcgagttcggaaacagagcaggaatcggctgaagtccaaatcggctacgattaggatcagctgggtctgagtcgggttgagtaagccgatacagccgattccgacaatacgaatcgtacgcgacatcgggttcaagttaatgtatttcaagatgattgccacgcacgaatagagtcctgggaaggcaattgtatctattaattagaatattttatgtaaattccttatagataaatgtcggtgacatggggccgggggtatcgtgactagaggcttgggtagccgcggtcacccacatggcctgaccccctcggggggggggggtcgggcccgagggtgacgtggccacccctccctctgtctccccgaggggtcgggccgctcccgtttcggccccgagggctagggcgcccccgtttcggccccgagggctggggcgccccgaccccctgtggttttggcgccacgtgtgtgggttaggtgagcacagcggggctcacctaaccgcatttatagcgggttggacgagcgcgccacgccgcatttaatgcggcgcagcgcacgcttatccggtccgtgaccggtcgcggtgtgtgaccggtcacagaccggtcagatcgcgggttaggtggcaacaggcggcctgtcacacgcctcgccccgtcccgtcgaaatgatgagagcttcctggctctcgtccctagccggagccggcgtgctaactcttggagttggtatgtcagtcccggtcagatccattccaggcttcagcgcaagcatggcaaggaagtcgctggccattgaatgaaggttgaaatgggcgtccaccgggaaagctggcgagcggggcaggaggcgtgtgctctgcttgtcagaggtcacttccggctgtagactagccctcattgtaaaaagcatgtttcctttcttaggcagctggaggcccatgtggtgacccctgaccagataaaaaggaggcccaggcctaggagagggagaggagggagaaaaaaacaggagaaaaagaggaagaggggttgggactctggcgaatgggggctagagcctgaactctctctcgctctccggctctctgtattccttcacgcacagatccaccagaacacaggagtagggtgttacgcttctcagcggcccaaacctgtctacgtcgcccgtgtcttgtgcacttcctctctcgctgacgttcctcagatcgagggcgaagaacctcacttagcgcccccggccgaaccggcaaaggggggcctgcgcggtctcccggtgaggagccccacgctccgtcaataaatataggcaaaagtctgccgcaaagacttgtggtatcttagagtttgatagagataatagtcgtgtccggtatgggcatatcttgtaattctcaggtataaatagaccccgagccttatgtaattaacaacacacgttcaatacaatcttggcgcatcgccacccttttgctttagttttgtttcgacgagttcttgctttcgggttgagctgcattggtttcgatcttcaacaagaggtaaaactcgttatgacggattatgtttttacgattagtgcttccatctttatgatactctaatcttatttatataattcgtcgagttatcatatatcttatataatctctagcaatatcgccacctaatctactatcggctaacatctgtacgcagagggcagctgattgggttagatcttgatgttgatctagattataagagatatctaccattctatgaaacttctagcggcttgattgtctagatatcgttattcttttcatacttaatgttgtatcagttgagtttgacctattgagtcgtgcttagaataccgatctatagcctgccttctagttgccgattagaatagcgtcagagtttcagccgatcttatctgatttacttatatttgttctatatgcttcattgacatgttaaatctgccctctatatcaagatattgttgtgtctaagtatattaggctcttgttcagtatattattcttactttaatatcctgatatagagtagtatcggagtattagccgatacatgctagatctatctgatcggctatgctataaacatatatagtcctgttattgatatatatttcgatctaagtgatttatactgtctcggcatgatgaccgatctatcccaatcacttgatttaagtatacatcgatataaggagtatatatcgtgaatatctacagccgatcgagtagatttagttcttctttacttattcatgactgtcgatcgatgcacagatgacatcggcttaaagataaatgatatgtcatcggcatctagccgatcggctatcatttatagatttaaccacggttcctttgcttatatttcttgttgattacaggatcaaatcaactggcacgctaacacatctgaaggcgagctttggatctgcactggagttaagcagatctcctaggccacgtgttttctgtcaacagaggcccacgtgggtctcacgttgactcagccgccacgtgggacaaaaccggggtcaaaaccactgaaggacccaaagtgaatggtttttataaagggggctactatataacggaatcccgttttcgaacgggatgatcccgagtaggtatcaggtgtaatacctatcaggtatcagacgattctacacatgtttcaggtgatacttgcaaagtatcatgtgatacttatcaagtatcatacgatttctaccatgtatcgcgtgatactcgcaaggtatcatgtgatacctatcaggtatcagacgatttctaccacgtattgtgtaatactcgcgaggtatcatgtgatacctgtaagatatcagacgatttctaccacgtatcgcgtgatactcacgaggtatcatgtcagatatcgatgatttctactatgtatcacgcgatacttactaggtatcggatgatacctaccaggtattaggtgattcctactagatataactggacatctcgttggggagaggagcatctcgacgcgcggccggccacctgcagtcgtcccttgtagacggcgacgacggcggcggcagcgatggacgggcgcagcggcgacggcggcagcgggcgcggcggcgacgacggcggcggtgagggacgggcgcggcggcggcggcggcgagggacggcgacggcagcggtgggggcgggcgcggcggcgatggcggcggcgatgggggacgtggacggcggcggcgggggacgggcgcgcgttgatgccttcagccgcgtcgcatggatgagaatcgcatctgtggaggaggagtatcctgctaggggacgggataaccctagcattcccgtttataaattgagggatgccatatatctggttttgtggttggggaacgttttgtaactcgatgacaggttgagggaccttcggtgtactttttccacaactcgcagggcgacagggtctagcagatcaagcgaggccgaggcccaatcgagtttgacgagccggggacgcagaatccaactcctcccggtggaagtcaggttgggctaggctggctagccaagagggcttttataggctcctgggacgcatcgccctgcttcggcagtacggcgtcaacttctccgcggatttgttcgtctctcatctcttccgcacgccgctgctcctctgcctgttcgtccatctccgaattctcttctcctttcgactctctttgattctctctctgataaaaaggtcgttttttctcggtttgttttctcatctacgtggatgttgccgatcacaatcgctcgcggaacaccgctgtgtctagcttcatgcccctgcggtgttcgtcgaattgcccggctgggcatcgatgtgtgaccagcggttcaaatgatcaaattccagtgtcgttttcaggtattgcgctttcactctagaatcacgcgtttatctcagcaatttcttccgttggactgcataaaatctggatgtgatgctcggcagtatcgcgctgttcaggttggtggcatgtcgcgacattgacttgtgcctcgcggcgggttgatttcctctgctgcttggacgcatttaactacaaattgacatgaatagtactaaattagcatggcctttttaatggttgctggactcaactgctcattagctacgtccgttatgaaactttgagtttggtataatcgaacgtggctatttgctgtttcaatggtagttgatgataagatcctcttttttttttctaatatacgagacattaggtaatgcacaggacaaaagctaattggccatataagattgatttgactacttgcttattcgtgatacaattgtgacacaagctgcatacgcttgcagctcttatgtctgagcagtgttataataattaggtgactaggatgacaaagtagccaagcttatccttgttttttttgtatgattcaacccttcaacgatgttaatcttgttgaagcagtaaatcggcagctcttaagaagtgagtgcactgggctctaaaacacttttcaactgaaagactgaaatgcagaactttttaccatatttcctcctgataccactgtggcaaccaactaccatagactactgttttttttaataaaaaaaatgacaccagtcacatgctttttcttgatgccaagccatcaagataccgaaatcaaaagaagcaggtgatctagtcatttttgatcgatgtgcatcttcatttcattggtttgttgacctttcttgataaattattttcagaagagaccttttgcaaaaaaaacaagtgtttgtcatgtatgctgtgattttgcttgaactgagcgggattaattggatggaatcactgaaagtatgttattttttaagttttatggttagatgacaaaaatactatatcactgaaacacttgctcagagagaaatctaattaattacgcgtgtgggtacctcattattgaagaaatcagttgattaaatatgccatgctgactttattctcctgttcatatgaaatagtacagatttggttgcatcatttatggtgacttcctaaaggtatgactccacaggcttagttaaactgagacaattcagttgtgttcacaagggaaattgttgcctcttattattatataaatcaaccagttgcacattactagttggttctttgctcagtttaaatggactctgaataaataagtacaactgattcatgttctgtgaggattactgatcagtcttcctgatatttcagtaaaatgtactgaaagtgtacaagcaggactataccaggtattcggtagaactaattttaactcggtggagtgtacatctccaccagaccaccaccttggttcgagttgtttaatactttgatccaatttgtgtgctttttatctgttttgttaataagaaatgtagttttcctacatgttttaattttcatctttgttccaattatttacttaaaaaatcaataattcaaattattgctgatgttgcttaccaatctccccagtattaattaaaaggtgtgtcatgtaatcacaaaatgaaagggggcttgtctatttgtattcagaggtaaagataaacgacacaggtacacaaatttaaaccacagctgatgccattatgagctgtcgttgaattgttattgcatggttgacaggtttttaagttgctctcttgatgtccagcaggtgaagcaaggtaatttctcaagtgatgccttggacataaacatgtcaagctgtcaactcttcttagttgagaggcagtacctgacatttaactcaagaagaagagaagcaatttgtattagagaactacaaaacctgctgaatttctgggctatggtacattcatgttctcgtaccaaggtttgcagtcactttacttagaacttacctctactaaaatctgcttcacttactagaagaagtcgtttcgctgactggccgaaccgtgcttgtcggggtttgagtggcactattttcttagagatagtaacagctatgcatgaactcatacaattgacgcccccatgtgccgtagtgtattgatgcctgtgcagttggccttcccgtatgtgtgtactcgaactgttaagtggatagtaaaatgcacagcttcagggtaaataggtgtaaaaaatagtgtgtgacagacttgacaatgctagtgctattgtggttacccagcatacttgctagaaaagggtgtgtttagttcacgccaaaattagaagtttggttgaaattaaaacgatgtgatggaaacgttgaaagtttatgtgtgtaggaaagttttgatgtgatggaaaagttggaagtttgaagaaaaaatttgtaactaaacaaggccttaggaaaatggataatcattcgtcatgatcatatacgtcagatttgcaatttttattgtagcttgctgacgcaggatttgccggccagagcagtgaaaggcacctccaggtccggactccagatgagagctacctcgaaagataatgcctatccagcaggcttcgcagaagggtccatgcgaaggaatttccctaatccagacactttaggtaaccggtcacatcaaactcaaaaactacatttgggctgagtttagatccaaactttttcttcaaacgtccaacttatccatcacatcaaaactttcctacacgtacaaacttccaacttttccgtcacatcattccaatttcaaccaaactttcaattttgatatgaactaaacacacccttggtctagtcatatgatgttgtatatctatgtactaatacatgacagtgattgaactagtataagaagtctacaaggcacgtatgttctctgtacttgagcatgtagatgcgcatacatctgaaagaaaacacataataagggagattgagggaggggcttctaaattctcgaaggaacattccgtcgttatttatatatcattcaaatggttgaaaaaaaataaaaaaaattcaaccaaatagattaatatgagatagatcactccacaaatatgcaagttaaaattcaacttctacatgttgaaaaaaaaatagaaaacactatggctagttaacgtgttttcacagtcaaatttgtttttttcgttacaacttgtgaaagttaaatttgaccctacatatttgtggagtgatttatcacatattaatctatcttattaatttttttttaatttttttataatcatttagatgacatgtaaataataagggatatcgccttgagaatttataatagtttcccgggagattgatcagggtgtacattgcttgctcattgggcaaaaccctgtttgaaatttgagaaagagatagagagatgatcacaagggtttgactttgaccagggatagaggaaggcgcaacgctgggagcaaatgaaaattgaccattgaccggccgatcggtatgacgagagattagcccgttccttctgcacagagacaaaaacatcactggagccacaccagcacatgttctaaccttcaggattccaattttttaatgtggaggtaatagccattcgcctgcaggtaatcacttttttttttctgtgcaagcttctgttatatgagtatgttttcgccgggtgttttatgagtatgtttgctttttttttcttttttctctctcattgtttttttagaaccaacagtaccagtgttgaaattgatcttgtttatttcgtttgggagaaacctgttagctgtgtttgagacatctgaattttgtgtactctgaaattgatatatgccttgacatttactattttatttcccattgacagattatacagtgacatgccgagcaacaaaccggcctactatttttcttctttccggatggagtcacgatcgctgttgcacggacattttgtctatgacgcggtaagagggagggaaaaaaaacagtacatattatggacgtttgcgttgcagccttgcagttgcgggttagttggatcagtaggaaggtcagagagtttctgcaagcagagaatcagatctggggaatggaatggcgcgagcaaggaagcaaccaaccgtccacttccatttataagtcgcggctcgcgagctagcaaaccccccttgctacatcaccaacccccacccttttctccatttcgtggccaactcctccgcagacctgcccttccgtatgggccttcccggccgtcgccaccgcggcgccatggccggccgcgccctcgtcgtgctgctgtggtgcgtgtccgcctccgtgttcctcccctccgcccgcgcgcagaccaccaccttcaccagcgccatcgacggcaagaaggcgaccaccttctccttccccacgttcgacaagtccctgatgcagctcggcgccaacctgaccttctccagcaacgccaccgtcagccagagcgcgctgcaagtcaccccggacagcagcaacaatcctctggactacctcgtcaaccaggccggccgcgtcttcttccccaccccgttcgtcctgtggtcctccaactcgtccaactccaccgccgatggcaagtacgtcgcctccttctccacggtgttcagggccaacctctaccgatcaaacacgaccatgaaaggagaggggctggcgtttgtcatcgcgtccaccaacgccatcaacccgccgccgggcagctacggcgagtatcttggtctcaccaacgcctccaccgacggcaacgccaccaacgggttcgcggccgtggagctggacagcgtgaagcagccctacgacatcgacgacaaccacgtcggcctcgacatcaacggcgtccgctccaacgcctccgcctccctcacccccttcggcatccagctcgcgcccagcaacaccaccactgacgacggcaactacttcgtctgggtcgactacaatggcacgtcgcggcacgtgtgggtgtacatggccaagaacgacaccagaaagccctcgaccccggtgctcgacgcgccgctggacctctccaccgtcctccgcggcaacaagggctacttcggcttctcggcgtccaccggcgagacgtacgagctcaactgcgtgctcatgtggaacatgaccgtcgagatgctccccgacgagggcgccaccaagaagaaggcggccctgcccggatggaagctcggggtggtcgtcggcgtgtcatcctgcgccgtcgccgtggtgctcgggctgttcgccgcgctgtacatccggaagaggaggaagaggatcggggacgacccgagctccgtgttcaacaccaccattgatttcaggagcatcccgggtgtgccaagggagttcgattacagggagctaaggagagggaccaacaacttcgacgagaagatgaagctcgggcagggcggctacggcgtggtctaccgcgccaccgtcgttggggagaacggccagaacatggaggtcgccgtgaagcagttctccggtgccaacaccaaggggcaggaggatttcctcgccgagctcagcatcatcaaccgcctccggcaccgtaatctcgtcaagctcgtcggtaagctctactacttttctgaacattcaaatcttagctcgatattgtttatgtttttgttcgatgcatgatagtatctttttgtgatttagtgattaagaatagctgagtaggacattgatgccgccctgatgaactgctaatttcgtgatgaaatatttcctcaagaacatcaccttaataaatgccaacccaaatcgccagattatcttttgatttgatttgatttgaaatattttcgcttttattgaaatggatgctccgataagtttagactttgtactttgtacttgttattagaccgcgtagatgttgtctactcgtgccaatttttaactgttacattctcagcaacaatttccttcgtacggttgcgtgaaaatgaaagcttccgagttccgagccgtcggaaatttcagtagccgtctgagaatagacaaaagtaagcaatttttcatacccacaatcacatgaaaacgatacaccacgacaacgattactgcctttatctcaagaaaagtagcagataaaattctaagataattacacacaacagatgtactagtagatatttttagcagctcagcacgccacatggcaacttggcacctaagttcaaaattaaacactgaccagttcccaccgattaccgagcggattggatcatggccaatacaggttggatcaaggcaaaggtttgacatcgttttgtcgcttgcattgttgttcggagaaaaatatttggtacggagtagttgtagaacggtctgtataccttgcaacactaattaagccttttttttaaggaaatcctattaatttttttaatcttgagaataaccacttgtctctgacttgaataattgggtcattgacaaaaccaacatgattcattctacgtttttcacgtttcaaaaataatacacaattctatctcttgggataagcattcaatattgataataagctagtggtgtaccaaaatacacaatcctaaaatattttggacgacctgtctgcaggttggtgccaccaaaatggcgtcttgttgctggtgtacgactacatgccgaacggtagcctggacacgcacctcttcggcgggccggagtcggaggtgctgaactggcagcagcgctacaacgtcgtcaccggcgtcgcgtcggcgctgaactacctccaccacgagtacgaccagatggtgatccaccgcgacatcaagccgtccaacgtcatgctcgactccgccttcaacgcgcggctcggcgacttcggcctcgcccgcgcgctcgagtccgacaagacgtcgtacaccgacatcatcggcgtcccggggacgctggggtacatcgcgccggagtgcttccacaccggccgcgcgacgcgggagtcggacgtgttcggcttcggcgccgtcatcctggagatcgtctgcggccgccgcatctcctgcagcaaccccgccgggtgcagccagctgctggaggccgtgtggaagctccacggcgcggcgggcggcggcggcggcggcggccgcatcctcgaggccgtcgaccagaggctcgccggcgagttcgacgaggccgaggccgagcggctcctgctgctgggcctcgcgtgcagtcacccgaacccccgggagcggccgacgacccagactatcctgcagatcttgaagggcgccgccccgccgccgcacgttccgccgtcgaagccggcgttcatgtggcccgcgatgcccgtcgcgctcgatggcgacgacgacgacgagacgtcgcgcagcagcacggtgatgaactcgtcgtcgtcgtactacgtgtcctcgtcgggttggacccagaactaccaggtcagcaaggagcacgaggtggcggacagggacgtggcgacggtgtgaccgtagacgagtccacggcccacacgtgcggccgggacccgacccatcgcatcggatttggcacgttaccgtggagttggtgacaacgttgagaacaaagatgggacggatgaaaggtgtaaataatgtccatgaatatgctatcgagctttccatttgttttttttgctctgggagcttctttagtacagtggagtacaagactactggtgtttagatttgtttcattttcttcatactttgatgtcaagctgtaatgttctcaattggtgtaacaatggtggcttgatcacttccaaatagcggaatgtgtaagcattagtcatgataggcgattgctccttatactcgcgtgcaacatgttcctctttgcgttcgatccttcaagttagaggttagtttttacggcacgtaaaataacacgagtcattaacacatgaataactaactattaattattataaatttaggaaatggaattatttgatttttgtgaaaaaaagcacaaaatatatcgtttacagtttgaagatgagaaagctacacgttcaagtttctgaaaagaacggtgtcttagtgctggtcgacactggaccttaaacttcacattacactgtcacactgccttttctgtggcttgcaacgtgagagcaaactttagcaatacatggatcaaacctgtgggagcaaatctgacatctgtggcttgcaacgtgagagcttccatgcttatatattacttaccccagcaatacatggatcaaacctgaccattgtagaccatgcaaatgttaatggagccaattggttctctgtattttgttaggcaaatctgcaatcggagaagtcatgaacttccaaaggatgctaatgtgctttccgaagaagggcatgaaccttcggcataacccaatcggaagttgctggtcccagtctgtcttggtctctttgttcagtcatggtctctcttggactcttggagaagaagagttatgtacaatgtatgtggcaggtggcacgattggcaagtccgcaagtgggagaagtcgacaaccactggaccaattccttcccgcgaatacccccttgactgtacatcagtacatcaccaactccatctccctttacttatgcatcgccaactccactgctccatgttgcttctgcgccgtctccgccgtgccgccatggccgtgctcatgctagtgtggtgcgtgtccgttttcttgctcctcccatctgccaccgcgcaggccaccaccttcaccagcaacgtcgacggcaaggagttcaccacattctccttccccaagttcgacaagcccctgttgcagctccccgacaacctgacctttcaggcaacgccaccatcgcccaggacgggttgcagctcaccccggacagcggcaacaggcccgagatattcctcgtcaaccaggccggccacgccttcttcaccgccccgttcgtcgtctgggaatccaagtcgtcgtcgtcgtcgtccaactccgccgccgctgccgccgatggaaagtacgtcgcctcgttctccaccgtgttcaaggttaacctgttccgctcgaacctgaacaagacggtcaagggcgaggggctgcgttcgtcgtcgcgtcgagcaacgcccgcgggccccggtcggtagccacggcgggttcctcg

SEQ ID NO: 59587 - DNA, 2808 bp, Oryza sativa
caccatcctcctcggcaagacggcgtacttcggcttctcggcgtccaccggcgccgcgacgtaccagctcaactgcgtgcgcatgtggaacatgaccgtcgagaggctccacgacggcaccaccaccaccgccacgaagctagccggcacgtccggctggaagttggccgtcggcgtgttgtgcggcgtcgccgtggtgctcggggtggtcgccgcgctgtacatccggaagaggaggagacggagcggcggcgacccgagctcggcgttcaacgccgccattgatttcaggaagatcccaggtttgcccaaggagttcgactacatggagctgaggagagggacgaacaacttcgacgagaagatgaagctggggcagggcgggtacggcgtggtgtaccgcgccaccgtggtcggggaagatggccggagcacggacgtcgccgtgaagcagttctccggtgcaaacaccaaggggaaggaggatttcctcgccgagctcagaattatcaactgcctccgtcatcgcaatctcgtcaagatcgtcggtaagcgatcatttctcgttctggttaaccgaaaaggatacttagtttagattgaagttgtgattagagtattagattgggtacggtttgtctaataatttggagtaggaaataatattctgagatggcacacaagttggcacggcaaatagatgttttaagaagctcaccacgctatgtggcaacttgggccacttggcagctaaatttaaaattgaatcatcagtccatgacgtctttgcaagcagattgaatcataagatagatattggagtgctctggttgacaatatgataatgcaagatttgatcttttgcttgcattgtgttagaagaaatatagcgttcgttagttggaacttggaacagccatgcaaatgcacatctctctctatatatatatatagtttaattagctgccaattcaccataagaggagacattcatatcccaaaacaaacaccgtacgttcagtcttcatttttcaaatttcaaaatgatacgaaattctgtaagcaagttctaaacacattttggacgacatgcacgtctgcaggttggtgccgccaaaatggcaggctgttgctagtgtacgactacatgccgaacggcagcctggacaggcacatcttcggcgagccgggcgcggcggcgctggactggaagcagcgctacaacgtcgtcgccggcgtcgcgtcggcgctgaactacctccaccacgagtacgaccagatggtgatccaccgcgacatcaagccgtccaacatcatgctcgactccgccttcaacgcgcggctcggcgacttcggcctcgcccgcgcgctcgagtccgacaagacgtcgtacaccgacatggccggcgtcacggggacgctggggtacatcgcgccggagtgcttccacaccggccgcgcgacgcgggagtcggacgtgttcggcttcggcgccgtcgtcctggagatcgtctgcggccgccgcgtctcctgcagcgacctccccggctggctcagcctgctggagtgggtctggaagctccacggcgcggctggcggcggcggcatcctcgaggccgtcgaccagaggctcgccggcgagttcgacgaggtcgaggccgagcggctcctgctgctgggcctcgcgtgcagccacccgaaccccggggagcggccgaggacgcaggccatcctgcagatcctgacgggcgccgccccgccgccgcacgtgccgccgtcgaagccggcgttcatgtggcccgcgatgcccgtcgcgctcgatggcgacgacgacgacagcgagacgccgacgtcgcgcagcagcatgctgctgacctcgtcgtcgacggggtggaccaaaatcttccaggtgagcaaagagcatgacgtggcggagaaggacgtggccgcagagtgaacagccgggaagagtcagcggctcgcgtgcgggcgaggcctggtcaatcgagaccgtcgagctggtggaacactggacgacgtgcaggagtatgaccaaacaaaacggagtaaaaaaatgtgcgttgccatggaatggcggaggttgtttttgctctaacatttttcaacttgctgcgttaaatacaatctagtggtgtacggcggtgagtgtagtttatgcgagtagtagctgtatttgtcacgtcagaatttttttttcccatggtgcgcaagagggaggggaaaacacttgcttattgttccaagctttgcagccaccttagtactaccatactggagtattgcgagaaaggaaggtcttggagcacgttttcaaagatgctttcttattttaatggttcaaacatttcggttggggttatcgacttggattatatcaacaatactagtgtactggaaacgtggttgtgaatttatggtgctcttatcatccaaactagctgggtggtccgctcaattgcgcggctagcacctaaacaaaatcatatactttttagtatgatttaacttaaaatttattaaatagctatctcattgtcttaagactttgaaagaccaaaccttatcatcatcgtgtttctaattatatagtttttaaaagtcacaccagttgctaccccttatgtcatctcattatttatttgcttgctcgatctaccactatttctattcattcttcttggaacctttaaaaattggattttatagtttttagagtttattgtcacgttgggtttcatttttataatttctagatatcccgtcaaacgttgctattatactccttta

SEQ ID NO: 59588 - DNA, 23785 bp, Oryza sativa
ttatacaccctgtccactgcttctcctttttattatcattgagattttaaaaatcgaatatgattatcaatggggcctggtttttttttactttctagaagtctcggcaaccgccttattcgtttgcttcacggcatgcatgacgtccctccttttaatcgtcattaagattctatttgatgttttattaataatttttatatgtcgtatcaaccgccaccactctactcctttataggcatgttacttaatttatcttgtcatgtgttttagatggtattttctttcaataatctttatttttataataaattttagttatttataaattgtattcctaattgaaatcttttttttctaattttagatttcttttgctaatttttgatttatttattttgattctgaattttaattaatctcgtattgggttttatacggactcttcttttaatattccttatttttaaatccgaaattcagttatttttaaattgtattcccacttagactctcattttcttttctaattttggattttattttatttttatttctaattttgattaatctcgtattgggttcttatatggaaacttctttcaatattgcttatttgtaattccgaatttcagctatttttaaattgtatttctacttggactctcctttccttttctaattttggattttattttacttttattttgaattttgattaatctcgtattgggttcttatatggaaatttctttcaatattgcttatttttaattctgaattttaactatttttaaattgtatttctacttggactctcctttccttttctaattttggatttattgggttcctatatggacacttctttccatattgtttttggactctcctttccttttctaattttggattttattttatttttatttcgaattttgattaatgccgtattggcttcttatatggactcctctttccatattgcttatttctaatttcgaatttaagttatttttagattgtacttctatttggactctccttttcttttttttatttctctccgattaatgtgggaatttctagctgggtggcccgcgcaactgcgcggctagcttccattcaaaattatttttttacacacatttttctttaaaatttactaaatagtcatctcgttatcttacatattttgaaaatgaaccttatcatcatcattttatagtagtaattcttaaaagtaacactaatcggcaccccacactccttagcctcccctttattttcttatcatgtttatcacgacttctattcataccctttggaacctttaaaaacatgtctcgtcaggctttctttttcatagtttttagaagtcctatcaaacttaaccactatactcctttacggcatacccattgtactcctcttaattatcattgggattataaaaattaaacttgattatcattagtttcttttttttactttttagaagtcttatcaaccatcgcgacaatactccttcacagccaccctgtcgcccctcctcttaatcgtcattaggattctaaaaattgaatctaatcatcatttaggtgttgtttcatagtattagatgtcccatcaattgttatcatcctacccctttacggcttgcttgatatcccgttccgtatagtcattttccataatgtcccattctttatcgtcatttgccaccctttatcatagatagactttttttaatattctttattttctattttgtatatgtgctatttataaattatattattactcttattttcttttttcttattcctatttttatttttattttttattccaaattttaattaattttgtgctcctattttctacatggactttttaaattattttttattccaaattttaattgtctccctagttgaactaatatttttatttttataattactgaatttatttatttttatattgaattatacttaatctcgtgtttatgttcgagatggtcttttattttaatattatttattatttattctgaaatttagtttttttatagattttatttctacttgaactcttatttctccttttccattttcgaattgattgtattctttttcctaattttaattaatcttgtattgtattatacatggactatctttaattttaaactcttatattttctctgatcaatgtcaaaatttctagcttccacatacgaagggcctcatcttttcgtttatccttatacttatctgccaaaatttaaattttcaacctttatatatatatatatatataagttttattcacaaattacttttcgtttgcaaatatgccgcgaaacgatggctctggaaatttctgaattgtaatagctaggtggtcctcacattatgctgctagaagccatataaaattatctaacttttttacgcatgattttctttaagttttgttaatcgttgtcttaggatttgaaaaaatcgattatgttttccagccgtgtatgttgagcatcgaacagactccgtgcgtgtgctcaccacaactaacggttgatacatatatacatgcatgtggtttctagttgccaacttgagatttaagctgatcgtctgattttgataaatgcaaaccaagttggttttgcttttcccgttccagaattaatgccgattggtttttttaccataaatggttactttatcgtgactatcgccgagggcaacgatatgatgctagttagggttaacaacctgacacctataatgcctcgagttataggtgacgattgttagcttcaatgcctcgcgagcacgacctcgagtaggaaattcgctatagactgggtaatgcgagatggaaatctaaacctgctatgtcttaatgatgtaaatattttagtgtttcaataatattttgagtcaacgatttatttagggatacaaagggagtaaatgtttgtagttgtatatatacatgcaaggctataatttacatgcaatgagcaatccagatgatactgaatccaatataaatggtacccaggctacataaacatgtatgggtcaacagcttgctagtttgctccatcgcttgtttcatttgtaggtccactggtatgttatgacatgcatgagaatgcttatgtggacagcacatgtacggcagcatgttaatccggctgcaaacatatatgcaatccaactctgcttcggcttgttttatccgattcattctacagcaaaagtgtggggatatttgctgtgtatgattatttctctaactctttatccgtttgtagaaagacagtaatatttctatatattcatagctcaacctgaaccattataatctagacccactacgatctaacggtgtagatatttctttttttcttcgattaatgtgggaatttctagcctccacgatgaacgtgatgtcttcttttcgagctgtcttaataatataatatatagatccgtgaaggttgtcgcagtcccgttggctactgccagaaaagaattctcctgtaaagctgcatttgcatgttacttgtcatagaatttcttttttttccattttttttaagaataggctggagatttacctaagaatatattaaggccatctggatcccctggcttcaagaagcttgggcaagttgctatgtgccgctgtgtaagactgtaaggttattctccctgcagaacaatctgaaaaaaagacttgttcagaattctttgggtgctcaagtgcaaagttagggcctgttcactttgatgccaaaaaaaaaaccttaccaaattttggcattaccaaaattttgacaggatttcttatatagttaccaaaatttggcagcaaactaaatgtagccacttttttggcaactttactaaaatttgataaggttaaaaatgacatcaaagtgaacaggcccttatttttcggagccttataagggcccaattcaccatgatggcccaataaaactatcggtgctgtgcaccccaggcccgccatctctctgggctcctttcttgtcgcgaaatttgtattgggcccaaatcaccattatggctcaaatcaccattacggcccaattcatcttctcttcgcctgctgcccaaaactgtatgtaggccacccagtcgacagccatctgggcttctttacaggctaataattacagcccaacgccctcgccgtcgtcagaggccgaaaggccatcccgatgttcgccgtcgagtagatcacggcttccctatgtacttctatagtctctattcatcctcaacacaactacacaagcgacggcggcgcggtgtagtcgtgagttgtgacgcagccggtgcgccatgcgactttggttggcatcgtcgaagcattttggttggcatcgcgtcctcaggtgcgagtgtgtgacagttgttccgcagcgcgctcatgcccactactgtgaaacgtgaatgccctgcgcccctgcctgctgatcacctgccgcacagtgcccgcactccggtatttcgcgatcgcggtggtagcctgtgcaaaggcagcgagcagcagtactactactcactttgctatagcaaatatagcgcccagtcgtaataacactacactgtaaaaagtcttcctggctaaagaaaacagtaaaaaaattactccctccgttccataatataagggattttaagtttttacttacaacgtttaaccactcgtcttattcaatttttttttttgcaaatataaaaagcgaaaagttgtgcttaaagtgctgtagataataaagtaagtcacaaataaaataaataataatttcaaaaaatattgaataagacgagtggtcaaacgttgcaagcaaaaacttaaaatctcttgtattatagaacggagggagtatgtactagtaggccgtgtttagttccccaaattcctaacttttcatcacattacatcacatcaaaaactttactacacatataaactaccaattttttctccaaactaacaactttcttccagcctctcaactttttcagctctaaacatagccgtagtatcgatgatttgttccctttcctcgatcctgggctggctggacccgaccgctgataccgtaaatcgggacgaaacacgaggcgagctgaccaacgagtatggccatgctttcgctttgcagcacgcagagccaagagaaaggcgacccaccaacgggaggactggcccgcgccgcacacgcacacccaaaccccacatcgtgtcgcggagctcgccgtcacggtcacgtgtcgcgagacgccaaccgctgccagttaccgttggttcagctggccccgccgccccgtcgcgccccgcgcggccggcgatgtctcactacgcgcgccagcaacgttaccacctcccttcatgtgcgcctgcatgtacagtagagattgcgtggctcaaattatacagatgggccgaggcgtctcccggtcgtgtcgcgatccgccgcgcggcgcgcgcgcgcgtcgggctggttccacgtactactactgtactccctctatactcgtaaagaaagttattttggacagcgacacagtcttcaaagcataaatttaacttcttatttatataaaaatatttattgaaaagtggtatatgtatatttttataaaaatatttttcaagacaaatttttacattttcaaactcaacaacttgagttattcatgatttatattcctaaagtttaatttaaacattgttctaaacgattttcttacttagtattagggagtactccggtgtttatcatcggcacgcttgcgtcgctgcctggtacagtcggcgtttgtcgtgacagctaacgcctcgcgggttcgcgtggcgctcttcccagcttgaagacaaaggtttggctctcttcgctttcttcttctgtctttcgtggggtatcgacgcgcaaagccgcaaacggcgcaaatggtgtggttggtggtacgtacattcgcttcttgccccagcagattactccaccaggtgcgactatactactactgctgctacctcgtgatattacttttctatgccaaatatgcgttacctgtcttattccattgttggttttgatttgaatgactgtgccgcagattgcgtaatctgatgggcctgaacccttatgttactcgtgttacatgatagctctttcaccaaagaatccagccaattcatgctaaaaggtttgagtatggaggagtcggtgttgctggtgggttacggattatcaaaggaaccaacttggaaccttggactgaaaaacggggttatgcttgttcacgtgtgtgagttgatgatcgctgcgacattttatatagataagctttgtgattcagggtgctgtctgaaagcaaaatattcccgaatcagcaaggtaattaagggattgttctgaatctgtcacgggcaaacattggccctccctttccggcacattgaccttccatcaacggactgtgacattctagttgcgaaattagatttggaatgtgtttgctttcattggatgatacgtcttcgtcgacatggacgcataacccaccgtatttctcagacccgagttacgttcaagtttccctgtgaggctgttgtcagttgctgaaacaaccgttcttctgtgaagcgacgatggaaaaacatgttatcgtgccgatttaatccagtagtgagattaaaaacctttttcgatacttgcatcgatctgacttcgaagatgggtggtgttgtatggagacattcaagaacgcgaagcgatctcgttgccatcatcaaccggggcaaattcgattcggttacggcaagcagacgatacagcctgcccgcgcgaaagcagatgttagatcgaaatactgacagttcagatacaaatcgccaaggacgcacgtcgccagaaattacctcccccgagctcgaactgccatctcgggctctcagcatccaacagagagaaaagaaaaggcaaaaaaaaataaagaaaactgccgcctcgtaatcatagagtagtgttcctacctggaagtttaatcaccgttagtgctgatgcggttgggcacaaccacacggaaagcaagcatctataatagacttgtagagttctatagtgcagaattaagaatatacattggattagcatatgcatcgttagaaatgtggggtactaatacttccgaaaatcataaaggagaaagtcgaaagtattgaggggccctctgttggaaaggtgtgaccttgatggggacgatgaactgttggcgtgcacgatacaggtgtaaggctgcaagcagaggggagcgcggccggagagccagcgaggaaggccgggaaaattagaccgacgagatgacgatcttcttcagacggatagagagaaagagaaaggaatacgagaaccgcaatttcgctgacacgtcgaattctagaactgctcggccgctttgttggagcacgccgtattatttatcctggatcagaacagaacaaaagtgcagtgctgtgacgatcaacgagctgctggtgaagctctgcgctgacacgttgatgcagcggagcacggcctttggagctgcatggcatgcagtgcatgcattgcccagtggtgtctcggatgcgtcaccgatgcactgcccccataccatcatatctatcctaaacaacacaacaaatcttgggcaactttgcaacacggcctctgcctacgagatcggcgacgacgcgatcaccggccgccggtacgacgggctgaacgaacctggctggcatcctaatcttttcgcgttcccattccccggccgttttcttggtgtttgcattgcaccgccaggcgggcggggggccgcactacggttggtggggacgcgcattgcgggtacgtgatgcagtaaacgcggcaggagcgaccaccacggctaccggtggccataactcacaccaggaaaggagaaggcaacctgccttgactgttgctccgctgcctcgccgcgcggctcggcccggcccccatatcccgtttctgccatttcccatcacaattcacacccccacggcgaggagtccagaagcgtcccttctcctctcctctccacgccgtctagtctcgtctcgtctcgccgaccgacccatccatccatcgatcgatcgatcgctggattgagggttcagttcacgcgcgacaccagcagcctgcctcatcaccttccgctcccgtccccttccgcctctcgcatcatcgccttctacattctccgcgcccctcttgaggcgtgataccttggccttctctgcccgccgatctgcctcgccacgcggttcgtcgtgctgctgcggggcggcgtccggcggagagggggcgcgcggcggggtgtaggtagctatgaagaacggggcgaggaaagacgcgggcggcggcggcggcggagtgttcgtcccgtgcgtcgacatcaagtcgttcgtgctctcgctcgccttcctcacggtgttcgtcgcattgtggcagctccagccgtacggctcgttgctcaccgcggcgcgctccaccgcctctgtctcggcctcgccatgttccctcatcgccacgcccgccgccgccgccgcgagcgcaggcgtcatccggtcggagaactccaccgccgacacggccaagaccgcgccggccgccgttgctagcgcagtccccgcgcggttggctagggcggcgaggccggcgcgggtggaggaccccaacaagcgtgagctccggccgtacggcagcgcggcggcgctgttcgttcagatgggcgcgtaccgcggcgggccgcggacgttcgccatcgtgggattagcgtccaagcccacccatgtgttcagcaacccctacttcaaatgcgagtggctgcccaaccccaccgccggcaacccgtcgccgcgccccgtccgcaccaaggcgtacaagatgctcccggactgggggtacggccgcgtctacaccgtcgtcgtcgtcaactgcaccttcccatccaaccccaacgccgacaacgccggcggcaagctgctcgtccacgcctactactccaccacctcccgccgctacgagcgcttcgtggcgctcgaggaggccccgggctcgtacgacgagtcccgcttcagcccgccgttcccgtacgactacctctactgcggctcgtcgctgtacggcaacctcagcgccagccgcatgcgggagtgggtggcctaccacgcgcacttcttcgggccgaggtcgcacttcgtcttccacgacgccggcggcatcagcccggaggtgaaggcggtgctggatccgtgggtccgcgccggccggctcacggtgcaggacatccgggcgcaggcggagtacgacggctactactacaaccagttcttggtggtgaacgactgcctgcaccggtacaggcacgccgccaattggaccttcttcttcgacgtcgatgagtacatttacctgcccaatgggcagacgctcgaccaggtgctcggcaagctctcgggatactcgcagttcaccatcgagcagaatcccatgtccagcaagctctgcgtgcaggatccaagcaaggattactcaaggtttgtctttttgattcctcgcatgttctaattttggtcctcttcttgcatacctactcccattttatatcgaagaaattccatatctgctattttgtttttcagatttagggggtgcttgaatgtaggatatttgagtacttttgcgtgaattagagcaaatgctgtgaaaattttgcaattttttttgttatagccgttcagtatatcagttttaggctgcagggtgcattctgctgggttcggtagcatttttcttttgggtagtttgttgtctgccatggaatgtgcattgtgttgattaatctatcagacattctagacgaggttaagtaagtcagcggttacttatttgtgcaatttgttgatcagttgggcaatgagctgtagtataatatagtagtagtatttcaacttgcaagtccagactgcagacgttgattgactggtatgttcaagtgtgtaaccatgtcttgtattgtattctgatttctgactggtatgttccttcaagttaactttgcataggcttcggttagttcggtacaaaagatccaattttcttttaagagttggtttgaggtactccatctttattcattgggatgagtaggtgatggacataagtcatcgcaattcatcatctttgccaacataggctgtgtttagatccagggtgaaaagttttggcgtgtcatatcggatatacagacatatatatttgaagtattaaacgtagactaataacaaaacaaattacagattccgcctgtaaactgcgagatgaatttattaagcctaattaatccgtcattagcaaatgtttactgtagcaccacattgtcgaatcatggagcaattaggcttaaaagatctcgcaatttacacacaatctgtgtaattagttattttttttcgtttatatttaatactctatacatgtgtccaaatattcgatgtgagatggtgaaaaattttgccaggggatctaaacaggcccataattgtaggaaactgcaaactaattaaggtcactaaaggaacacaactaatgtctggccaggaaaaagggatgcaattaatgaaattaattgatgtctaaaaactctcaccatgctttgctgaataatactgtatagatttccatgtattacatgaaagtgaaactatctatgtgcaagaaacttctttacggaatattcagagcatcatctattattattatgtaacccctgctaacaaatttgacttcacaactactccctccgtttcacaatataagtcattctagcatttcccacattcatattgatgtctatatatatatatatatatatatatatatatatatatatatatatatatatataattttctatagatgctctttctatctgcattcttgatctttgggcaagtcattgcctgtacaagtgctgttgtgaatgttggcgcctgtaaaaggcccaatttttacacaacaaagggctcatgactgttggttcctgaaaaaaaagaccttttttaacaccaaaaggttgaatttttatgctctatcatgcttttatgtctgtttgcaaggaaacaattatagtaactgtttagattggtaggtttgacactgtttgatgctaaaacatattacgtgtgccgttcatatgcagggaatggggttttgagaagcttgtcttccgcaattcaattaccaaagttaggcgagatcgcaaatatgcgatccaggcccgaaacgcatactctgccggcgtacacatgtcacagaatgtctacgggaggacaacccataagacagaaagcctgatcagatactaccactatcacaattcgatcaatgtcatgggagagccttgtcgggaatttgtgccggtgccggtcaatggtagtaagttgatgttcgaggggatcccttacgtatacgatgataacatgaagcgtttggctgggcagatcaagcggtttgagaaggaagcaattggatctgctcatacataggcacatagcaactgaactactgaagactgccggtacataactacagtctacatatatacctgatgatattgtttaggatgcctggttgagagttgagacgggctcacgcttctgctgttgcaagccaccgtgtctggctggtaagcagagggaagagcttgcaagtgggttggtccaagtggtgtaaagttttggttctttttattgacatgccattctctacaggagcactgctgtttttgctccattttctcctttctcttttctccttacccccacatctgttattatagatctgtgtaaactgtaaacttatggccctgcctttttacagtagattctttgatagatctccctccggggttacatgcagtgtttgttgttttgtgtgtaaatctggattgcacattactcttctgtactatccattaggccatcagcaatgggtaccttcgacccgtcccctcacaaacggccgtttccctcccgtcctcttttcggcgtgagccgtctccccagctaggagcgcgtctactccttgggagacgcggctctatgcaaggagcgctcgcttttcgcggagagccggccctcgcccctgcgaggagacccgctgcgaactcccgtctcctcaccgctccccccaaatccccttcctaccctcgccccctcgcctctctcccacggcggcgcccactcgtcgatccgctccaccggccgccatcgaccggcgggcggggaggtccgcgacggcagggaggagctcggcggccttgaagaggaggagggcgagccagtcgtcggcgaggcggcgctgggcggaggtgccgggggcggcagagtcgagggcggagtcgatgtgggagaagagggtgtgggagatggcgatgtggatgaggaagaggagggagagcgggaggacgaaggtggcggcgatgcgggcgaagagagggcggtcggcgacgatgatgatgagcttcgtcggcgacggctggagggagagaggggagcgggaggagggcgaccggcgctgacctcgccggcgagccgccgccgtcgctgcccgaggccagatccggcaagcccaggccggatctggccacctcgccgccactccgacgacgacgaccctgcggtgttctaccttcgcggccggtcggcgcggctcaacttccccgaggagatctccttgctggcttcgccgtcagagggtggcggcgcaggcgagccccgcgagcccgacggcggcacgctgtccgcggcctcgatccggaagaaggccatcgaggtcggctcccatgtcgacgcgctccagaccggcatgatggtcgcgccgacccaccaccgcgagcagcagaagcaccaccaccacccgcacctgcaaccgcacggcgaggagcaacaccaccacgaggattggattagttctaagtatgaagacattcatacttaaaaatctcttgttgatctcttcctctcgcccctgtcttggttggattagttgccatattagagtaagcactaatccatccatacttcttgctcgatcttgatttcgcgtggttaagtaagtcgtattagcctttcaggttaaggaggttgttaaggtttttaagtaagaacctcctgtagcttacttactagtttgtgatgcttgctgtattttcttctagttcttggcttggtcttaaggagtttttgtttgattgtataagctgttttcttagataatggatcgtataagttgttggatggatcagcaagtattaggcctggtccttccttccttgtgtactactattactcccatgtagtactatgtttggttcagttaagcatttttgtgtgtaaactgtgtttgaactctgctttttgatgatgtggaattggaatttgggggagacactgagcgagagagagaacggtcgtcgccgacgccgtgtggtgtgattggtgtcgaattgaaacggcaacgaacgaacccacaggtacggttgggctcgtctcgatcggaattgactagagggttccagggtatttcgggaatttgccacctggggctactgtggactaggacacccactgtggcctgagtacccccacccggttgctttggattttgaagccactgctcagggagataatacatcgtgaggttgttctctatagccactctatgagtgccctcagccactgctcagggggataatacatcgtgaggttgtactctatagccactctatgagtgccctcctcggttaatgaggacactcttctagtagtggctcacattgctgatgcccttagcagtgtgcttctcttctagtagcttgtctggtgagcacttggaacgcaagcaaacatacagtaggctgctactattctgcattgaatactgttgtgctgaatctggaaatgacaaagctgaggtactctctccatcctaaaaaaagacaaactctggttttccgtgttcaactttgactatccgttttatataaattttttttataattcatatttttattgatgttagatgataaaacatgataaatattttatgcgtgacttgtctttttattttttttataatttttttaaataagacggcggttaaatattgggtacggaaactagggtgtctttttttttttggacggagggagtaggcgttttgcacaagtgtagtgcatatgtgtgtggcttcacttacctttgatgagctagctggccttgtgcatgccgagattggctaggcaataagtaggcatttttggggatgtctccaacttttccattagccactatgattggagcatggcctgagatcggacggatataaggtggtgtttagaaaggagggactaaagttcctccaccaccttaagagcaggtacatcaatagactatttcataaaaaagctagctataagtgtattttaagaagataaaagagaaagagaaaagcagcgtgctataaatttatagccagctacagcacggactttaagatataagatacatatgtgtatgataggtaggactagatattaactgtgtagtatatatttataagtaactattgtataaattgactataaatgatttaaagacagtagttggctatactattaaacttgttctaatgagagagcaacaggggggacaggctaaatgataacgcgtgatggctaggcggctccacgtggtcacacgctctacaatggcttttgtgtctggtccaagtaacaacagctgcttaagagcatcgccaacaacatcttcaaattaagctctccaaatactgatatagccaactctctaactgatttgggtagtcaaactaggtattcactccaacaacctctctatttacatctccaaaataaaaaaaagacccactgtcagtctccgttgccttcttcttcctcctctttctctttctcctgcatctgcagcccatcgatggcggcttcccgcgcgcgtgggcagcgacgaggcgggcggcaacggctgcggcggctccccgtgcgcgcgaggagggcgacaacggctgtggcggctccccgtgcgcgcgaggagggcgtgcgcgtgaggcgggcggcgacgatccactgcgatttaggcaaagagaaagatggtaggagtggtgggacccatggatagccagctgaaatgactctccacatttggccagtgactgctatgatttggccagccatatggcttagccaaccaaatatagagactgttggagggtattttttcttcatactctccaaattttagcttggagagccatttggctattctcttagagatgctctaacctagatgcggcaaacgttcagccccatcgtttcgtggaataagcgaaatagcatatttacaaatggaaagtaatttgtgaataaaacttttttatacgtgttcatagcgatctaaaagcaaaggctgaaaaaaatccgataaagaaaatctcaaaatcagtttcaaatttaagattgaaaattcaaaatctgcctaataagcaaaagaatgagcttcagagattttttttttttgtcggtcgggctacgatgaccctttcattatagggttaattagatacatgccattaaaaattcaccggttttgaaatataccattactatttgcgtatttggaacgatgccattgatatttgtttgtaatttcagtagtgccactaagacacgtattttgcatgtattggacaaaaatgccctcatcttctacctctctccctcttctctcatcttcaagctctctctccccgctgcttcaactccggcgccgtcaccgccgctgctgctgccgctgccgcgccgttgctgctcgacgccgctgctgctcgccgctcgtgctgctgctcgctgccgctccgcgtgctgctgccgccgcaccgccgctgccgctcaccgatgccgtcgctccaccgccgctgccgctgctgccgttgttactcgccgccgctccgcacgctgccgccgccgctccgccgctgccgccgccgctccgctgctgccgcccgctccgccactgccgctcgctccatcgctgctgctcgccgctcgctgctaccgccgctgccgctgctgccgttgctgccgccgctgccgctcgccgctcgctccgacgctgccgctgctgccgctcgctccgccgccgcctgttctctgagctgtggaagaaaggagaggggagaaaaagaagcaaaaaagggtaatttggtccaaattttttcgtaaacggtaggtagtggcatatcttgaatatgtgtaaaattgtaatggcatagttccaaatacacgaatactgatggtatatttcaaaactgataaatttttaatggtatgtatctaattaacccttcattatatggtagattaagggtaccttacacaagcatagattagatagaacataactagacctgcaggagcaagcatttatttgcataacagggcattagcttgttcgtatgcacggcctgctataactcgctaatgctttggttcccaggcactaccttaaacattaaaagtataacaccatagcttagtacataaatatcctgggcggctgatgattcatggggacttaaagaggactttatcagcactccccacaatcaccgaaccccgtgagtaaggtacgccctcaaaaagcttggccataggcactactttccaggcctgtagctctgaaatctttccatcaggcctctcacagtgcggtgagctggaccggtgctacacggtgccagcaaggcttttcgcgtgcatggcagatggatgcacgccctagctaagcccctcgcctccaagcaaagccgcgcggaacatggacggcgcgaggagcgcgcaacaccgaaatccccaggcacgcgcgctgtgggcagcgtcgcctcacacgcgcgtgccctagcgccgtgaaatcccagaatcgccctcccaaaatccactcccgccgcagcttccgccacaacactagcgctcccgccacagccactcttcctccggccaccaagtcaagaaaatgcacgaaaaaattcgggattggaagagaagaactcaaagaagacggattcaacaaaacaaatcgagacgtatgtacaccacatgatgaaaaagaaaaaaaaatccgccagatccgccgccgaccaccgcatcagagtcatcttgctgccaaggggagctcggggagaaggagggaggcgtggagcggcgacgtcccccatggcggcgctggaggaggcagggcctcgcgccgacgaccgccgcgtccgccagatccgccaccttggccgggtcgtcgccgagcccgtccacctccttcctggccgcggcccttcgccgccgcctcgaatcgctcgccgctccagggccttgcgccgacgaccgccgcgtctgccagatccgccgccaacaccgccttgcccgggtcatcgccaaggcaacctgtcgtccacccccccgccacggaggatgccgaggtgctgtcggccacggccgcctcatccggcgccgcatccacagacggagccgaggccgcggacgaggaggacgagcggcgagtgcggcggagtgggaagagaagcggagctggcgccggacggggaggacaagcggcgggtacggcggtgcgatgagaggagccggaggggatggaatggataggatcgaatgggcggagtgggaggggaagggtaggtggaggaaattatttcttccactcgcccatgctaaccgcacccaggtcacgcgcactgtaggagtagttgccttgtatagcgtctccatccaattaaggccctgtttgtttcagcttttgattcttataatttagattattaagccagattactataagttggattataataagctggcatagaataagttgtgagttgtttgtttgtctggattattgaaggcatagattattgggtctgaaaggctaaagtctataatgccctcagctatctgttcagttaatgatataggtgggtaatttttctcaagtatgtagaggtagtgggtctttagccactcaataatctgaaaaaagctcctctagagcagcttatcagattataataatctgacttatagattataataatctgctataataatctacttgtttgtttaagcttactcctaataagttagattataataatcctaaactgaatcaaacagggcttaagccacacatatatgggtgcttacactctggggtgagtgtttttgggccaactttttaggctaagggtacgggacccatagcttgcaatgtgagaggcctcagtgaacttgattattccaagtctgcgggacagaccatctctgatagcttccttgttagctctgtccacaaggagcacactgcacacgtctcttgaaggtttcgaagcgctgaaccatctcggcatggtcacgctcctggttgaaagccttgcaccactgcttatacaaggcccacagggcatcatctgaaacaaggtccttctcttctgccacaaagatcaccctaccttcgccgtcgacgtggcaggaaacgcccctaggctaaacgcataggcctaggcaaaattaggcccaaaatccctacagaatgtagactgatcatccggcccattataccaaacgtagccataatccacatggatcatacagaaactacgatccgttttggcccaacacgtttagattagcctgaaattttcatcagaggcctaatccgaaggagatccgacgaaaatatccccccctccggttcgcgtgacctcggttggtggtctccccttctaaaatctcgccgagtccacaagcgcatttaccagcagctccactcccatccatccccgcgaccctcgctgatctcaccaccaccccgacccacccgcaccgccccaccatcacatcgcccgcgtgagattgctacccaaaaatcctcacctccgacgacgaattgaggaggaggggagagagagctcaaaaaccctaggaggaggtttgaggggccagatcgatggagagccccgcgaaggaggaggcgggaggggagctggcgatggagatcgagtccaccgtcacggcggaggactggcgccgggcgctggcactcgtggtgccctccgtcgtcgtcctccgcaccaccgcgccgcgggccttcgacaccgaggtcgccggcgccagctacgccaccggcttcgtcgtcgacaagtccaggggcatcatcctcaccaaccgacacgtcgtcaagccaggtaggggcccgcccgatcccgcccgtttccctccccgggagtttccgtgtgatttgtgcattgactcgtgtgctactggtttgatgctgctgtcgctgtgttcgcagggcctgtcgtcgcggaggcgatgttcgtgaacagggaggagatccccgtgtatcccctgtacagagatcctgtaagtgtttgctttcatttcatttcatttcatttctgttctattctattttgttctccctgtgctaatggcataatgttaatccaaaatttttccccctcttctcgaaacaggtacatgattttggtttttttcgctatgatccaggtgctatcaagttccttaagtatgatgagatcccgctagcacctgaagcagcatctgttggtctggaaatccgggttgtcggcaatgacagcggcgaaaaggttacgtaaaaactagattaacctctttcctagttgatattgtgaactatcatataatgagcaatgtagcacaagaaacttgctaggatttacatctccagaaattctcttatggactatgggacaatcatttttaattgttaggctttaggctttagtttcttatattggccttgtttagttccaaactttttcttcaaacttccaacttttccatcacatcaaaactttcctacacacataaacttccaacttttccgtcgcatcgttccaatttcaaccaaactttcaattttagcgcgaactaaacacacccattgttgagaagcacaatgtagagctcacaaagcaaatgttctgtacatcgtacagttcattgtgggctctattatcacatgatgcagtttggcatttcagcaacagcaagcgaactgtctcttcttgcatctaataaaggctaaaatgatacaattcattgaaacctctatgttccacacatgtagttcactgaaaactatataatcaaatggtacagtttggcatttcagcaagtgaactgtctcctctttcctgtaatattgtgtggtctgtagtgcttataagattttagcatatagggaaaaagacaatgcatacaacatcctattacgggcctttaatcaatatttgttgattcaggagacatctcttcaactagttggctcagaaactgtagatatgtgccaatcaatggtatagatcaaaacatttcacatattaggctggaaagaggcactggaacaaattattttacttcctatttaagtgtggtaattcagattctgttgtgtcctatgtgacatgctttgacgggacaatgatttgtactaacactagatagtgatgcattaatatgtatatacattttctggacctagatgtggaggttaatcacttaatcctttacattccatgggtacacatcagcataataacttcaaaaattatccgatagattgtgtttcatactgcaacggtttctgattttcattcaccgaatgcaggtgtcaattttggcgggaacacttgctcgacttgatagagaagcaccttactacaagaagtatgtctcctttctagttaccataacggcccattacattagtgctattttcttttctcatgattacccctggatctattgttggacatagggatcaaatatatagtacaaaattcatttgttggctactgaacttagaaaatagtaataaaatatagggagatacatatcatagaggatcagagatcatagtttacttgctatgcgaactttatttagtttcagtaagtgaagatacatatggagaaagcggattaaatctcaacctttcgcttcatttttctccaagccttttcaatccaccgaacttgggcaaaaaagactttgtagttcgtattcactctatattctctacccacccaaatggagcagcttgccaccaccagcttctactagataatactatatgattaataatttttatgtgcagccttgctgcatataatcttacgtttaaccttttttttttgacagggatgggtacaacgatttcaacacattctacatgcaggtacttttctcgggctactcaatattacatccatactctcgttctcttctgacttgtcagttgggacattaatacacaccttttaaccattacttatctgaatgatgtgctcatacaatatcgatattaaaatataatgatacccattttaaaaataatgacattaaagtagttctcgtgacaaatatactcttataattttttgcatgacatatttgaatatttttatgtatataataatggccaaaatttctaagtctgactgtatgcattctagaatgaaatctatttgagaatagtatatgtttaattcaaattggtgatgttcatgcatcttctgaaatatcgggcatgttttagtttgatgccgaaaccagccttatcaaattttgttaatgccacaccttatttatttatttttttgggtaaggtaggtatgtggtggtacgtttagtttgaaacctcatctatttgggtgtgatgttaggtcaggaagtttattagctaccaaatattggtatggaaaggtaggtatggttggtttgttgccttgctaaaatttggtaaggttagaaatggtagcaaaccaagcatgcccattatccgtgattttgtcttatagttcaattgcttttatccaatagaggttcactaattttccttttactctctctgtcattttaatgtaatcatatgtttctataggctgcatctggtaccaaaggtggctctagtggttcccctgttgttgattgtcaaggaagagctgtcgccctgaatgctggaagtaaatcttccagtgcttctgcgtttttccttccattagaacgtgtaagttgtttacaaaatgttcattgaaactagctaaatgcatgtgctttgctacggataaaagaaaacgtattaatgtgttacccatcttttttgctatagggaatattcatcttactctaatttaatgtggctatccatttagatttgatattttttaatattaagaagttcagggattaacttgcaaaatttacaatgggagtaggtggggtgacagattcattgccaccaccactaccttcttttaaaggagtatagatatactacttttagcccaggaagcttatgcttttgttctaaaattgcaaggtctcttatttaataagaccaacgaagtggtcctgctagttgaaattgatacgagtcataaaagcacacatgcaattaggttaacatctatactagacatcacaagaagagagagagagagatagaaagaaaaatataatttggcattgaccgacatccgagttcatacaaaaaggaatagcattgctgtttaatattgattaattgtaaggtctcttattgacaggaacaacgaagtggtcctgctagttcaaaatgatgtcattataaagcgcacatgcaattaggctaactttaacatctatactagattagctggcttaatgattttcatcaggtaaaagtatggtatgaagtatcctattatgcactagacatcacaaggagagagagagagaacttatagtttggcactttggcattgaccaaaatccgagatcatacaaataggaatgccattgctgtttaatatttattgattgcccgtggcacccttatgtttattatattgtttgtccaaactgtttccaggttgttagggcacttaatctgatacgtgacagttgggaagcttttggtagcaagcctgaatctgattacattcctcgtggtacacttcaggtgagcatgctgtctgatgatcccattgttctattttttttaccaagacctgctgtgtcattagatgtttatttctattacggtggagctactgaagatgtatggtgaacaagtaaacattttagcacttaattgttcttctttctttgtatgtcagtgataaagtttgtgaatttgcaatgatcagcaccacaagtgtacagagtgctgcagcagccattgtatagtcaattttgctcctctgactgctgtacttttattacagcgatagttaaaaagcacaatctgtccatgagattattagagttaacaaaggctattactcttgtttgtgttgccatttctacctattcttgttgcccccctcctgccagtccttagatcatttcccttttcccttgtttttaaggtgacctttcaacacaaaggatttgaagaaactcggcgtcttggactcaggaatgaaacagaacaggtatttttgtgcatcattgctggtttgctattggctagaatt

SEQ ID NO: 59589 - DNA, 1522 bp, Oryza sativa
cagcgctagtgactattttttctattactattaataagcgacctacatcatactaatttgattcttcaggttgaggatttgcactctataactccaaatcatttcttggaagttagtggtgctgtgatccatccactttcgtaccagcaggtatgtttgccacagtttaatggtcttttctgagctgttgccctctctgccccttctctagcaaataattggattaacatgtttataagtttatgaatcggatagtgtatattttttaatttagaaagtcgtcaagattaaactttgaccattaatctgctataacatgtatatttgatagttaaaaccaatattgtgcgaaagcacgttgaagtatgaatctttggtaaatttacttgtaatttgattatttcttggtcaaaatctgcaaagtttgctagaaatattggatcatgttgaactttttgctagaaatgttagcctccctactctggtcttgcatgaaaatagttgcaactcatttaattgtatacttcatcatatgttccctctttctagaaagtcatttaacatcataaaattatatgtttacaatatttattgagtattgaaacgttactaatcttttttatatgtaggcaaggaattttaggttcaaatgcggtctcgtatatgttgctgaggcagggtaagacatctgatgataacaactgatattcatttcctgaaagggcatcaaagcatagttgtgatttctagctggtctattttaccaggcattggtcatatgataaatccctttccatagattatgataattgagtcgggtttgaactcccaactaagtttcatttttcacagctattactttcagagcacaacaccccttagtgagttttagctgcaatttatgtttatatgttattcatctctttgcaatatttcacgttgggattatatctgtctttttattggcttttcaagtttcctgttggtgtcttgcctgcattaattttcttctatttgttagctgatattctgtctaaaatgtgatgttgtttatcttaccttttctgcaacttaaccaccatcataatatgcaggtacatgctctctcgggcatctgttccacgccatgctattattaaaaagctcgcaggagaggatattgaaaatttaggggaccttattgcatgtatttcaaaactatctagaggagcaagagttcctcttgaatatgtaaagtacaccgaccgttataggaataaggtaggaacatcttccttggaaacttttaatcatgataattagtcatatttctgtgcgtcctagtaaacattaactcacttcaaaaattacaactgatcatttatcttgtttatgtatccagtctgtactggtgaccattgatcggcatgaatggtatgcgcctcctcagttatatactcgaaatgatgcaactggcttgtggactgcaaaatcagctataccgccggaatctccttttatagcttcagctcatcatgctggt

SEQ ID NO: 59590 - DNA, 1625 bp, Oryza sativa
ttcggttttatcaccaattaagctgtgtgttccaatgaccattgctatttctcctgtcttgagaccctgccatagaataacaataacacataaatatatgaatctatgcgtatgggaacttgagagtctagaaagaatgcttgcatttcgaataatccttgattccctcgtggaagttgaaccagttagtaaagcaatgtttggtttgcattcatctccatcaaacttctccagcaatgaagttagatgttcataatgctggagggcaagaacctccgttggaaccatgaaagcagcctagaaataattttacaaggtatatgttagactaacatctcattaatgaagaactgaagagtacaactaggaggaagataatcatttttcgtgtatatcctatttggattaagcatctagtttgcttcagtaagctgtccttttagttgataaaatccttttatatacagtacataaggcaaggatgttggtttgtagtatagatacctgaaatcctgagctaatgacctccatgcatgcaaggaaagcaactacggttttaccacaaccaacatcaccctgtcaaagaaagaaggctttcaagtcttcagcaagatgcatataagccccaatagttgttatttgaagaacaccaattatatataaaaaggaaaacagaatcattaattcactatgtaataccacagccagaacctgtaacttggtacttaagattttcttcccccatatgaggtatacccccatgttccatttccccaagaaaaatggaatgctacatccagtcaattgcaagtttcttgtccacgaacttggtgcttaagaatggtagaaaatagtttggttcaaatatttttgcttaagatcgaaacatttgaaataaactggccaaaataaaacaacgcaatagtagaccagtgatattagagccaagatatactagagttgattacagaggagcatcaagcaactgactggtaaacaagtccagactccagaaacaagagcaagaaagttaatgaaccaagaaatgtgcaattaatagttacttgcaagagtctgttcataggaactggtcttctgagatcccatataatctctttaacagcattcaattgactaggagtaagcaaataaggaagaacttttaacaatttccttgcaagaggagaccactcgtcagcaccaacagcatttagctcatgatttttgcacttcaataacaattcttccttctcaacccgtgtaccaacagcttcaagcatttgaaacagtcttcccaactgaaaaacgatgataaatgtttccatcattgcatatgcttaattgcacacttaaaaacaagatgcgataatatgaacttgaaggacatgacatttgcgcaaatcgatatccatgtttaagcaaaacaaaaatattgcttgctgacaagcatataaatgataacaaaaataatacccaggaaatgcactcctgtatagatgccatcaccgttggagttgtactttgaagattgctaaaaatgcttaaacccccaccccactgccacacatgcgagtgcccgcccatccattcaccccccccccacacacccacacacacccacacac

SEQ ID NO: 59591 - DNA, 6357 bp, Oryza sativa
gtgcacaattgtaaactattattactcctacatattcagatggaaaataataatatcgaactacatgcatttcatattaagttaaggtgatttactctttatcctttgggctttgcagtcatcccttaagtatcatcataatttaaattacttaggtacaatttagctgaatcatattttaggaatggggaatcggcatctttcaactatgatcactttaaaatagctgtgaacttagaggaacatcacttagggcccaccgactcagctttcatttagaaactagaaaagcacacaagctttgcactgaccttgagatggagaggctcagcaaacttggtttcaatcctgcttttgatgggtatataggatatggtttcctgtcaagcagggtgcattgttgttcctcttcttcaagcatgtcaatagtgtactctctcaaatcataatggtctttagtaagcgccttcttgatctgtgcaaacaaaatcagctaagcttaataatcacatataggctgtgaggctacaaagtgcagtccattacatgcataagtgaaaacatctgtatagcagagctacttttatgtcattgtaaagcaaatgtgcggctgcaccaacacaaattttaggattacaattattttgtagtgaagcatcaccaacaaataaagacaaattgaaaggtctgacaagcagcatgtaacaggaaaaggtatgttagttcaccaaccttaccgctgacataagcaagatccccctctttgtacttcgatgatatacacttaagaaaagatggagaagagaagcgtgtgccgctgaaaaatttcttgaggtgcaaatgaattgtcttcttttgttctgcttgagagttacaactcttaactgaagagcttaactcactctcgattattgaacaactaacaacaacctcaaggtaacctaaagtgtgcttaagtctggctcccctgagaaaacaaacgataattattgtttagagtacaggtttttggcgtatgaaaatgacctagccaagtttgttatacgaaaatttttcataatatacatttatgtaactacatttgggtttatgcaaaagaattaagtggtcaaagttacatcttactgactttgaaaattccaatatggcaatcttttgtgactggagggagtaccatttcaattggactcatagtgcttaattatgtttttcagtaatcagtctttctttgcagggaataatcagccaatctatgaattgaatatttttaactaataattttgaacctaaccatttcgctcacacacatgaacataacttttctatgtgttcacaacatccacagtaaaacgtccttttaatagcatcgaaaattgtaccacaatatactgaatgccaccacatgagcaagatcaaagaaatgggggaaacttttacaaacatgctataacacaagcactgtcatatcacagcagtcaagagagtgaaaagacaattctataccaactccaacaaataggatcaaggccagcagttggagcaagggaacgtatcccatgcacacaagcttacggtgcacactccgtcacaccaactaacaaatgtcaccaaattttctaaaaaatatatatacatgtacctccaatagtatttcatatacctgtaaagtataaagttcaaattcattatattctagccataacgaaaagaaaagaaaaatctgatagttttaagagtatatatctgtcagaattttgtcttttatgttacggctaaaatatattgaatttgaagatgagactttgcatataggtgtaatactattggaagtacgtgcacatttttttccagaagttttggtgacatttgttagttggtgtgcacggcgcagtatacataggatatgttcccttggactggagcaagactaattgaaatattaacttatactccccaaatgatcccagcaggggcatcggtcacatgaatatttagaaataataataagatcatcttaaaagatccatgattttaacagaatcttcttgtcccccagcagactcaaatttactctataaactcatttctgactaattcccctacaaactccagaaattgtagtaatggtaggtcttcatttaaattttacagggttaagagaattgactatataaatacccattccactcctccaaactatactgcccttctgtacaaatttcatggattattatgaccaaacgttgagtgtggccctagtgtcattgtgataggatggcacatcccatatcaattcttctttattatcggattaagaattttactcaacaagaatgatctgatattaaataccactaacaatccgagggcatcaattcaaataaggaaatgatatccttcacatgccaaaagatttttatggaaagactaagctcgggagatgccacataattaacatatggcaagtttaatgccgaagaagaagacagtggaaaacatcatatttctgattattcaattacctggaagatacaacggttccaaacagcatgatgtactgcccctcttctattgaaccttgaggattttgtagatctgcataggtccggggaaaatgctgcaacaatttccgtacctgcagagaagaaatatattgcatgctaagaattctatcaaatcaaaagaaaaaaaaaatactgaagcgtatctgctgctagtaccgtatggaaaccaccatcctctagctggcgatattgcctactagttgttccgggaaaacatcttatacttctgtccaagatgctagaatcagaaactgtagcatctgccactgccaatgactctggacaagcatcggtatcaactgccggttcaagagaaacaaactgtgctgtgagagaactctcttcactgattgataggtgatcgacgtttgtaagggttggatctaatggatggcatttgtcagaaaactcataagctgccccaaaatttccaccggactctcgcatgaaattcgtgaggttttcagaaagcacagtttctttctgactcatgctagcagcagcagcatatagttcaataggtgatgaatcaccaatttttatgcatggaaactttgcacacatttctgggaactcaatttctttgcatacactgatcaattctgtagcagatcctctgcgggctctttcttgctcaattaattcttgtgtattactataacccatcaaaacagacacctgcaatcataaataatccagacaatgttcactgttcacagcaagtacagatgaatagttgtgtgacattattagtgaagagtggcatcaagcagagagccgtgcaaatcaaatccagacgtcattaagtagagctattgcataggcttaaactataaaggtcataacatcaaggaagttaatgtacaagtatatgcgcattgtatttaaacaaggttactatgcactagtttgaactcacaacaataattagaggacttgggaaatataaatagctttcacttggtagagcccaaatggtggaacgattgaacagatgaaacatacagaactaaactcattactgatgcctgcaaaatcgaaggctaacactaacaagtgaacacaaccagttgctggcagggcacatactttgttcaggagttttgatctctctgacgtgccatccacctccaacagcttcctgacggacgtgtgattctcgcgcgaacaccaccggaagagcttagagccaagagcattgctagacctgcaacctgaacagttcagtgctagttgctaactcgctattctagccacaagcacaaattgcccacaaggggaggggaacctaacaaaatcaatacctcattctggaaggaatccttctagagcgccctctgcgaaaatccaaagaaaacaccctcgctaattgattggtgtgaccctgaagaagtgaagcgacctcatttcagataaggaagggggatagtatgtgaagagaaacgacatacgcccataccttaatccatgattgcgctgaggaggaggcgatcatgggtgcggccagcgaggagagaaccttcccgattcgccgcagcgctcagttcatccaccgcggagacgaacaccatcaaacaccaccagagcacgagcaggtgcccaacactaatggagcgctccgggttaccaatggaaggcggcggcgaaggggcgggagtgggagggaggcggggtagaggcaaggcagcgggagagagagagagagagagacgaagcgcgagaacctaacgtggagcggggacacgcgagagcctcgccggaccgcgcgcgccttccggggacggcagcggcggaggtgaggtcgtctttcccccctctcgtggaggcgagtggagtggaggccctcaccggcggcgcgggcggtgcagtgccgtcgccgtcgccggaaaaggggacggaggccgtacgtggtgggggtttgggtaggggacaagaggggagcgcagaagagtcggagacgatggaatggagtttccgcaagttgggctggctcctgctggcccaggataaggtggtcgagttccggttaggcccataggaatccaggcccattcatagatggattggttgcgacccaaagaggcccacaaaaatttgttgagaaaatccaaaaaaaatatcgggcctgttcagattgtagccaaaataaacattacctaattttggtataattttggcatgatttcttatgtatttagcaaatttggcaacaaactaaacatagacatttttttggcaatttttttaaaaaaatgatatggttaaaaatggcaacaaagtgaacaggcccatcattgacaaacttctaattgcaagaaatataatcgacatgtgctagttccatgaaatgtcatcgtacaagtgactttatcttagaaataccattatctgtatggtttcattagcaaacctccattaagtgctataggatgaattgtgcattaaacgggatggaattgatggaaccctagcaaagaaggtatttctaagaaatgtcacttgcacgatgttattttgtgaaattcgcactactcgatgacattttttagatttggatatttgccagtggcattatttttgtttttgtcatatttgattggttgcagccctacattcaagttgggcatccgattttggatgcaatatatcgaatttggatttttctggcaacctggttgctgaatcatgacagccattgtgtcttcagactttcaaactcgattcaaatagattgtttcttgtggatttcgaatagacagtatattggctaaagtttacactgacttgtggatttcgaatagacagtatattggctaaagtttacactgagtaaaacggactgatttttgtgctgttgatcgattctgattctgcaatgtgccacagaacagaagttctgacgatactgttatatagatccaagtgaccgggctacaggatagaccatttgacaaaaaaataaatccaatcacaagtgctacagggcgtaggcaacaacaccgaacaacgcgacaagcagcagcaacacgtagaggcgtgacacggccggcgggccgccggcgtcgctgaacctcgcgtactcggccgcgagcggcatgtcgtcgacggggagcgagcacgccgccggcccatccgccgccgccgcgacgcccgcggaggacgcctcgtcggcggccatcagcgcctggatcacggcggtggccgccgcgccgtaccgcgtggcgttccgctgcagcagccacatgatccccatcagctggcactctcgttcgcccgtcacgccggcgccgccctgctgctgctttttcttcgccgccgctgccgccgccgcgcggcgccgccagagccggcctttatctgcggcatcaccaggctcgcgtcagacagaatgaacagtaatggcatttactagttccgtggtactgttaacccacaattaatggacaccaaccggacgaagtaaaacaacaaaaaaaaattactacagtaaaatttaccttacgctacagacattcttgaagtcatgaacacagaattatgacaagtgacagcccgagcctgagctctctgctttctactgttggcacacatggccttctacgtgccatgcatgttacgacgcattaagatctttggaagaacctatcagtaccaatccatatagagcactgccccaaacaaaaaaaaaagacaaattttgtacgtacactagtaacactactataccattttagatgatatagtatacgctagtagagttctagtggagtatcactactatactaagggggtg

SEQ ID NO: 59592 - DNA, 17841 bp, Oryza sativa
ccccctaacattctgcacgctatccggtaaccaagttggaggccaaatggctcgtttgttaacaaattaagcaaatgattcggtctttctaatagcgacgagactccttatgtgggaaaggacgatgatgctgtaattgtgcccccaaacgctatggcaatcaaagggggtaggggaatggaggcatgttccgaacaaatcattctccagggcctacgcaacaggcccggactccagatctcatcattcctggtcactcgcttcaataatgctggcagggcagcagcagctagggcacacacacgccacaccaggcaacagagacggtacccctggttgtatgctagtggctcccctcctgtccatggctttcattaaacgccatgtctccaagaagagcattgctaagaagcaacggcgcaatgcagtcatggctcaaatgagtattatcactctcgtgagtgactaatatgatttttatagtaatatatacgtgatgagaacatcggcgttgcctgttcactgtgcaggactgcatgaatttgcaagatcagtgcaaggaacctttttaactgacgatcgagcagctgacaatctgaacttgaactgtcgaactgaaccgatcagttaatgaacatagctgacagaacagaagcaagcattcaagtagatgcgttaaatgttttaattgtttctaggactatcatgttcatgaggttttaatgcaaagtaggagtacgtggtatagtagtactaagatgtgatctagtatgtgatcgatctcaccgtggtcagggcgcggaggcacttggagcagccggggacgcctggctccgcgcagtccttctccagcctcctcgccgccgcgtccgccggagcccattgcccgccttccgccggcggcgggccgcacgtcagcctcctcagcctcaccccgcagtagcagaacgccacgtcgcacgtcccgttggcgcccggcgggcgaggcagcgccgccccctccgcccgcagcgcgcggtccgcggcgcccgcgcacgcctccgagtcgtcgggcggcacgggcatgtccacggccgcggcggccgccgacttggccggcctctgcgcgagcgccgcgggcgcgtaggccgcaaacagccacgcggccagcggcgggcagcagcgcagcctcgtggtcagcgcgccgccgccgtcgacgcaggaggacgtcacggccgggaggagcgacggggacggggtcagcgggcacgtcgacgacgtcccagacgcggcgtccgactgctccgggaacgccgggatcgtggcgctccctggctgcgccggggtcgccgaggggaagatcagcgccgggtcgagcggcgccgggtccggcaatgccgccgccgtggagcacggcgcgaggcgggacgccgcggccacgtagaggcagaggaggaggagacggcggcgaagcggaggcatcgtctctctctcgtctcgcgtctcgcgcgcgcgcgcgtgcgtgcgtgcgtcgtgcgcggcgggcgcacgcgcgtggtggtttttctggttggatggattgagagagtgagagtgggagtgggcgagtgaagtgaaagcgtggagagtgaatgagtgatcggctatatgcctatatggacgaaatgatgagagaaagctttgtgctttgctggtctagagccaaagaacgcatgattagattggttcttgtataatgttcttccagagagcaaaaccagccgcagccttttgcaaagggagctcctttcatctgtggatcatttttatcgttttacagagagagctatcttctttctttctaccttgtcaaactttgtggggctgtgcattttcgagtgttgtttcagggaagctgcggaaggcgggttaaagtgacctcgctactcaattcagcttaaaaccagcagctttgttgtaatcctgtgtttgctttcagttcatttgctatccacttcaatgttcaaattaaccgtctgatcgagtgctactctagctagtatggcgtatagcacattgccactcgatgtttgctcatgcgtgaaggctgaaggcatcacatacgccctccttgtgtcacggtcatggctagtgttttgtttatgtgagacagagcagcatctcgcagcctacgtatagcctttgcagctgaggtaatactactactcgtatgctgccatgaatcattctggagagagcacagagtatcatgtgttactgctggcgtaatagtttacgactcgtggtaaggtaggtggatattcgttttgttttcagtgcgtgtattatactactccatcccgttctaaaatacttttcgttctaaaatatttaaccacttatcttatttaattaaaaaattataaaattattatttattttatttataacttgctttatcgtcaaaaagtattttaattataacttatctgtttttacatttgcactagttttttaaataagaccagaccaaacgttagaatcaaaaaatcaaacaacatctaatttgggaattgggacggaggtggaggtagtaccagtagtagtatacgaagctacagtgcatgcaccaggctaggatagatgctagtatgctacacatgctgataggagtgccaaactaagggcttattcgtttcaaatgaattgcaaagaaatattataggaatagaaatgagttttaaactatcattcattttataggaatgcactataggaaaactataggaaagttttctattcctccatttttgaaggaaaagcataggaaaaaataatccacttcaacctaatatttgcgtttcttgggttggtttgctcaataacataggaaaaatttctgagtttttcaatccataggtttacacatatatttctatagtattcctacgtttttcctattcatacgttttgaaaatcctgtgaaccgaatgagctctaagcaaatactccctccgtctcattttaaaggcagccatttttttccacgtccaactttgatcgtccgtcttgtttaatttttttttaaaaaaattaaaaacataagtcacgagtaaagtattattcatattttatcatctcataacaacaaatatactaattataaaaaaatttaaataagacgggcaatcaaagttgggtgcggaaactcataattgcacttaaaatggaacggagggtgtaggttattacaacgacatcacatctcacttgctgataatggtaccagtatttagttactacctccgtcccaaaataagtgcagccgtggatatccgtgcccaacatttgaccgtccgtcttatttgaaaattttgaaaatatttagtcacacataaagtactatttatgttttatcatctaatagcaataaaaatactaatcataaaaaaatttcaaataagacgaacggtcaaacgttgaacgtgaatagtgcaaaactgcatttattttgggacggagggagtaataactacgtcgtctgttcatctgtttttagccaaacacacgtagtatccacctagtaaatgtttacagattacaaagtcacagtatgacggaatgttttggaacaggagtcgctggcagagtgaacgagaaatgcgaaacggagagaacgtaatactagtaattcagacaacagaacgcatcgtccaaggagataaaacggatggtggcacacgccgtccgagcgcacgggatcgtcactcactgcacgcctacagcacacttacgacgtacggctattgctggcctgcacgccctgcagccaggagccattaacaaaagcgaaacactgtcgcctaccgcattccaccgcacggcagggaccgcaacacagcagcgccacgcggcggaagcgacgacgacgacacgccaagagcgcgactgcgattctgcgaaagccgagaggcgcctagccttgtgaggcggcgacagcctcgctttcaccgtctcacgcaccgggcggcggacgacggacgcgcggttgattgcctctcatccgcggcgcgtgagcggctgagcgcgtggaagcgaggcgcgcgcgacgtatttcttgctcgccttgaaggcgccacgaccagcggcgtgtggcgtcgcgcgtgcgcgggtggttgtggtttcactggctcggttttaatcccgtgcgtggcgcctgcggcggctgtcggtcacgggcgccaccagcgtccagcgagcgtgtcaagcgagacgtactactactactactactgaacctgaacggatggaatgttttgttggctctcgatcgtccttgttctctcgctcgctcccggagattctttcgagtttacacgcatgctgatgcacgcgctggttttttgggctgaggctgttcgtttcataacacgcctccgagcacgcgcacgcgcatgttggaatcatcaccgcgtaccatataaaatcctggagggatcagagctggagttgcatgctactggatgtacattgatctcactggcaatggagaggtgtgatgcctagtagagtagtaggccggcccacaagagctggggtcataagcccagcttgagttacggacaaaagttcacttttactcccttaagtagtggctggatccaattcatacccttcaaccgcaaaatcgggtataatcactttgccaagcccgactatttataaaccatgaaaaataaaacccttggttgttttgagagtggttttcgctaacatagtttctacatggcagccaactcataaaaaagaatttaaaaactaaagtgggatccacatgtaatcccctctctctccttccctctctgctcgtacctctctccccattgtcttctcagcacaaacagggtggctgctgggtggtagcaggcgatggcagcgaaggaattggggtgtgcacacggcggcgatggcatcccctaagcctaatccgtgcgacaatcgtcttcatcctttaaagccaagtgatcgtggtagctcatcgacgacgtctccaacatcgctatccttgctaagaagaagaccaagtggaagcggtattgcttccacgagcgggagaggccctttccgtcctcttcgccctctcctagttggctcaccgccctacggtggtcgtccccagctattcatggttggatatgatcgcgcatggtcccaccaacgaacatggtcaagaaagacaaaggggtggtcgatcacaatgacggcggtgaggcggagtcagagtcgggcatagtggtgcccccgcacaagtgcagcaacttctcattagctgtgatgttgacggcgcggcaggtgtgcccggtggtggagggccacgatgctgctggatctgcctccctcaccgagctcgggcctccagagttggtgcgcagaggtgacgacgatgaaccttcgaaattcccatggaatcaatccagcagcaaagggtgggggggcagcaaggacaacgtcaatctcccttcctcctttctcctccatctcctcgagccttatagagctcccgcttcgccgtcgagctcctcatcgcctgtagcggcaccactacaaaaaaatatatcctgcattcaaccctcagtgcgccccgagttgttcgccattgccgcgttgtcactaaccggtcgccaccgccgtcgccaccaccaacttccgaccgcagtgctgcacacctgcctcaccgtcggcctaactcgtacccggctcgccactcacgaggagaaagagggccgtggtggtggtggtgaccggtgagcgacaacgcagcgatgggccatgtttagggccagaccatagcctctctcggcccacttcattctacttgggccgaacttctcccacgagaaaggccatcgcccatcgctactgaactacgagtaccatcggattccgactttgcaggctacgacttcgacgaaccatgtacccaacatgccacaaaaccacaatatccaggcgagttttcttcgcttggccctcctgtcgaatcgagcagtcatacgtcgtgccgtcgtatcgtcgactcgtcgtcgtccaactccaaccttgcgcggcaaccgggtttccggtttccttctcctgcttacaaatcgtcgggcccgggcacctcgtgactactccctccgttccaataaaaaaaagacaaacactggtttcgtgtccaacgtttgaccatccgttttatttgaaaaaattatgaaaaaaattaaaaagataagtcacgcataaaatattaatcatgttttatcatctaacaacaacgcaagtacgaattaaaaaaaatttcatataagacgaacagtcaaagttggatacgaaaacccatacgaaaacccatagcttgtggacggagagagtacgtgagaacggagggaaaaaaaaaagaaacagcctgatatgcggccgtcaatcgcggcgcactccatcgtatctcatcatctcctctcccccaccgcgcgcgcgcgcagcccgcgtggttagatcccgtttctaccagcgcatatgatgtgcaaggcactccaagccagaaaaaaatataaatcgcgtggctcgcgagtacatgtatatacatatactgccgtagtgccatggatgggtgtacggaaaatcacaataatttctctctcttcttctaccttgtcatggccatcgccgtcaggccggacaatcaggtagaaacgccagcacgcacgccggcgatgaaagctcttttctttttctttcgccgggcgcttaaaacaaatctcttgtacatggacaacgactcaacatttcataagtttaccgcagtctcaacgatcgtacaattctagagcaaatgatggcgccgttgatcactcgggtcgctctcacaattaaacagaaaagttggcatcttgttcggttcgggcaagtgtggacaggccgctagttggagtaggtgtacgtggggtatgtgccgcggcgatggcgtcatgaggtcgtaggatgccgcgaggttagctcaacgacgaggcgctagtgcgcgcgcgtgcttggatgcttgcgggatttctttgacctcgggaggaagaggaggccaggtcggcaccggattgcgccttttgagtccatatttttcaggcctctgtttctttcagaagggtccatgtcaatcaaaggtcccattgctggttcgctaatgatggatggatcgatcggagatttcgcttttatcgttccgttgttaatttgaagagcatcttctagttgcggaatatgtcaggtttgcaagattttccacacccaaaagttcactttctgatgggttaaaaattaaaacaagaaaaggaagaacagagatgtcactagtaacagtgttcacaagtactttttctttcagtgaactgatgatatttacaagtacttgtgggtatgacgaccaaagaatgaaacaatctgtcaagctccctgtcgatttttttatctccacgctgttatttgtttcttatttttctcaatctccatcaccactagcttatcaaaactctcgtaataaacacagtttgagagagagagagagagaaataaaaaaagaagaaaaaaaacgacgtttttttttctttcttcttttttatcgtggctcgatcatggagatggacacgtcgttgacggactgcgtcttggtggtctccgtcttcatcgccagcgagaactccgacgccgagaccttcttcatctcccgcgccgcgaacagcggcggctgcgcgggctccggcagctgcatctggtcgctgatgagcatgagcaccacgttggacatggtcggccggagctcggggctctcctgcacgcacagcagcccgacgtggaagcaccgccacgcctcctccttcgagtagtcgccggcgagcgacgcgtccatgaactccgccgccttgtcctcgttccacagcttccatgcctgcacacgttcatatgaacacaaacaagttaaaaaaaaaagactctgcttttttttttaccagaaagagtttgatgcaaaaagtttctgaattttttttttacatcttggatcagggtttgctggttattctgaaggtacattgcgccattgcgttggccgctgaggatctcgagcacaagaacgccgaggctgaacacgtcagacttcaccgagaagacgccctccatcgcgtactccggcgccatgtacccactgcaaaatccatcggttcatttcaatacaagttgaggtaagatttgtgcttgatgagccatgagaaatcaggtgatcgatgcacatagtgcaaatacgttgacgtactatgtgcctacgacgtgtccggtgttgacctcgttgctctcctcctcgaagatcttggccatgccgaagtcggagatcttagggttcatcttgttgtcgaggagcacattgctcgccttgaggtctctgtggatgaccttgagacatgaatcctcgtggaggtagagcaaaccacgggcgatcccaaggatgatgctctgccgagtcttccagtccaattgagccctctttctggaatctgacgagacaaaaccgaattagatttacctcatggttactttagttttagactttcagtgttccaagatgaaatgaaacagagcttcagtacaggtcagatcggttaatctgaacagtttataattccaatcgggtttaactacacgcacgaagcacatggacctagtttgcttcccattgacctactttgcatcgatttggtaacttcgttagacttaaacgactcgaaaaaacaataaattatgcagagtgcagaaccacgagtccagctttgacgcaatcatgtgcgtatcccatgtgtatcagtttctcaccagccactaacaaattcaaacaatcacaaaaaatacctataatcctgcaagaatttataatgacaaaacaaaacaaaacaaaaaaacagtaacaaagagagaggaagcagacgaaccgaagaggaaggcatcgaggcttctgttagggaggtactcgtagatgagcatcttctcctccttctccacgcagcagccaagcagcctgaccaggttcctgtgctgcagcttggcgatcagctccacctcgttcctgaactccgccgcgccctgccgcgacctcgccgacagccgcttcaccgcgatctccgcgccaccgcccagaacaccctgatcatcacatccaagaacccaaacttcagtcgatgcaaattggcatatatcaggagtagtgctatttccaggacaaaatctagaaaaatttgctggtgttcataccctgtagacagggccgaagccgccttcgccgagcttgttctccttggagaattggttggtggcgtcgtacatggaggagaggtccatgagaggcaggtccgagttggacagtggcctcaggctctctatctgcgccctcctgacggctgcaaaggaaccaagaaaaccaaatgtaacaattcacaaatttgcagcgtttgcggattgatcatggctgaataatcgatcgatcgatcgatcttaccgttgcgcttcctccatctccagcagtacacgcagtagaagagggtgcagatgatgaccaccaccagaatcgacaccattatcggcatcccattgtggctcgagtgccctggtgcaacaaaccaagaacgcgtaccctgacgccagttcagtcaccttcttccaactcaagaacacgaacatacacacactgcaatatcttcagcaagaaagaaaactgcgcgtacgtacctcctgaatcagtcgcgggtgttgtatccatcagccggcgatgtcgaaaacggtacaacgacgatccagcctcgccttcttctccccggctcttcatcaaaaccagttctctgatgagagaaagccttgggaaattttgcactgcttctctgcaggaatatatacctctcgtcactattgggttgttggagagaggttgcaggctagctagctagcttagccttaatctgaagattggctcgttagtggcttagtgcttactgttgtgctggcaccaatgtgtacagactacagagcatataagtacagctcaggtgagaggagaataaaatggatatgctgctgcctgctgcaggtatggggatggagagggagggggcgttgatggctgcaggatgaactggtttttcaaatgttgctgcaaatatttcatgcttgtccttttaggactgcaaattgtgctgcttgaccattgtgtggaacatgaacacctacgggtacagcgacccctctctctgttattctggttgttttctgatattggacggcagtggatgctgatcatccaaatttttgtccactgcttttgttcagttgttcttatcatcatcgcttgatttgctgatcaatcctgactgactcattctctcgcaaattaatccagctgtactataatctaatcctgccactacaacttgtgatgtgaacccaaacagtaggagtaagtaatcaacgctaacttttcacatgtgctgattcaggattaggtgactgtcaagggggcggtgtgcaagacaaccaccaaaaaggaattagtatctttttcctgccatgtttgagacgtgagcgtgtgaactaattaaagggcactgaaaccagggtaaggcttgtacagctataatgaaatgaaacggggaagtattaaagggttggaagtgtgtttgatttgattcccttttgacaaacgaggacacacgccatgaaaattatttctcggtgtggtgtgggtgcggtgcgtgtgcgtgtgggagcatgacaagctgggccacctcatcggcgtaggagcttgttgccttgtgcgtcaaatggtcaaaacgatttggcattttgtactggttggtagggcggatccggtggtggagatgcacgtttcgcctttttattttgcaaagaggagctaattaaggctatgtttgattcagctattataatctaaattattaggagtaagctgaaacaaatagatagcttattatgatagattgttataatctataagtcagattactataatctggtaagccactctaaaggtgcttttgctttttttaattattgggtggctaacagctaacaaacagataataatcagaaacaaacagctagcagcttattctatatcggcttattataatccagcttatagtaatctagttctataatctatattagaataatcttaagctgaaagaaacagggcctaagactgagttcttttattcactttcctaacttatctcccattttccacgtacatatttatcaaactattaaacggtacaaattttataaaactttttatacaaaagttattttaaaaaaatcatattaatcatttttaagttattttagctaatgcttaattaattatacattaataaaccatcatgttttccgtgcaaggagatggagttccaaactctacctctcaaacacatcctaaggatagtgatgatgcgagcgatgcctacatctctaacatgtgggtctaatgtattgacatcaatggagggagggtccgcgtgccagtcagccagtgtatgtattaatagcatgacggcagtgtctagttattagaatattaaggagctaatgacctctcaattatcatggttagttggtaattttatatggcttacagtttaagcgagcattttaatacgcatcctgcaacggattgagcgagacaggggagtagggggattaagcccccccatgatctaatcaaacgatattcatgggggtgatacatataatagggtggaagataagatggaataagaaatgtcttgcggtggagcatttaggtgggtaagttaagttgacgatcaagacccgataactctccatcagtccaaatcgcagactcttgttgtcatgcgaagaaaagaattctagcgtgacaatgcaatcagggagtagcctccaaatgagaccagtcatggcctagaatttgaatggatgaatgggccaaaattttagtcaccaaacaagttcacctgacgtccctcaattgtatgccgagtctgaccgcaattcaagaaatatgtacctctaaactatgtaaaactgttcaaaacatgtcccaaggcaatatagatgtttggtttcgctgacatggcttcctagtcagcaaaaaataaaaaaaataaatatgtgagacccacctgtaagtaagaaggaaaaatgtgaggtccacgtgtcagcatcatcttcttcatttttcttatcttctcttttgccgccgatggcagatggggagaggcggccaccgtcgactccacgctgcttggccacgtcaacggtggcggcgaccaacccctgcaccctaggccccggcgtgctgctcagcctcgcgctccgaaccacccgacccagccatggatgagagggagatggcggcgaggagagcaccaagcctagctcgtcgtgccatgggtggcgtgcggcattgcgggggatggggttcaaggacgacgacgatgtggacgatgcggtcggcgaagtcgtggacgatggcgatggattcgcacggccgccgctcggaccccaggctgagtgccttcttcaccttcgagaacccgagatggcataccagaaccgccatgcggaatgtgttggtgaaactgccgctggcaatggagccgtcgtcgacctccgcgcgagcgtcgtcgtcaccgccgtccccacgccctcgggagtggcggcgaataaggggacaggcgccgccgacgagcagatctagccgccctcgccctcgacagcagcagaggcggagatgaaggcggtgggcgagagcagcggcctcttctttccccctctcccaccagcctcatctcgccccctctctggctggcaccagttgctgccgccgccgcctctcatccttttgccgttgacgggtgaagaagataagagaagacaaaacaaaaaaaaggaaaagagagaggaggaaaaaaagagatgttaactaggatgtgcgcccccacatacttttttatttttatttttgattactagaatgtcacgttagtgaaaccgggcatctatattgccttgggaatttttttagacggttttacatagtttagggtatacatttctggtattgcagttaggaccttaaatagactcggcgtacaattgagggacgtcaggtgaacttattccatgagacgtacaagccttagtagcattatagttcttgccagagtcatttgggcttggaagttgtattcacctagtaggctattacgtccttcaactataagctttcaacgagttttttttccttaactttgaaaaccagatcaaattagatgaataccccgccgttttgctataggaaattaagttacataatatatacagataggatacaatatgattattaaaaccaaaacaaattgatacttataaattttaagcctataaataattaagattgtatggtgctttgagagaaaaaagaagaaacaatttcaaccatacatctataatctaatggctagaaataattagtgtgatatgacttaatgagaaaagagagaaatagcttaacggggggatgaactatataagtataagtataaatgatacctcctcggcttaattgccgtcgagagtgggaggtgctaatggacgggtggttgctgtgagcgatcacccgtccctcccctaagacggctcccctcccccttccacatccccttcttctctttctactacgccataatttttttaaaaaaaattaaaaaaaaagttagaaaattttatgtatagaaatactatataaaaaatatttgaattcaaattaaaatttaaatcaggtatataaacttttgacttataaactttgggtgtataaactttatatgtatagaaatactatattaaaaaatatttgaatttaaatttaaatttaaatttgaattagatatataaacttttgacttataaactgtgggtctctaaactttaggtgtataagctttagatgtatagaaatagtatatataaaatatatttgaattcaaattcaaatttgaatcggatatataaatttttgacttataaactttggatctctaaattttagatgtgtaaacttaaggtgtacaaactttaggtgcataaatttactaaaatagaaaagtgatacggtgctaaaaaaaaagaaaatcatctggggagagggactgatcgctcctagcgaccgatcgctccttatgactttcggtcgagagtcgtagtctcgtagagtcgagaggatggagcgagacggccgaggaggtccggtgattggcccagtgccgactttacggcccaataattacatagcccaagtggactattttgggggttggagatttgtccgccgacccctccaccgtactccatacacggtgccctcgcttattcccgaagaacaactaccacgaaaccacgcactgtgcggcgacgccattgcaagattgtgaaaactgaaaaccacatttcttctggcgtctctccttgatctggaaactgatgattcagacatcttggacgcataaggtgagtgactgagtgcagaatatttttgtcctggcattgtttggctttatgcttaccccgtcaggagaacggcctatgtgcaaatcatgttgagagattagcccaagaattttgcgtcagagctgtgtaattcttgaatcttgatttcataagcacttcgcagaaattgagattagtcccaagaaattaagatggatcggaagttctttctttggtaaggaaaaaaaaaaagaacgaacatcttccgatctgttctccgttgttacttgttttgatttggttttcgatggagaggatgaagatagtcggctaggagggccggtgattggcgcagttctgactaaacgggccaataactgcatagcccaactgtcacatcgggggtcggagatttattccccgaaacccccagcaggttggagattcatcttccgaacccgctccgccgttacggtgcccctcctactacctcacaagtcacaactccgatgaaccacgcgtacgtgttcctccttggtccccgacgttatttgcgagatcatcgtgaaaccttcaattcttccggcgtttctccttgatctggaaactggacggttcattcaatcatcgtgaaaccctcatttcttccggcatttctcctttttttaatacgcaaggagcgcattttttccattaagagaaataaaagttatttacaaggataaaaggaaaacaagcaggggaccgatacagaacgctatggaaaactataaaaatatctcgcgttaaatttgactaccacgacctcgtaaaggccaaacagcggggaccccgtgattagctgacttccaaagcatggcctcctccgccattgctttcgccacttcggtccaagacctttgttgttgattgaagattcggttgttccgttccttccaaattgtccaagccaccaatgtcacgacagtgttgaagcctcgacgataccgcgccccaattttcattcggctatcacagagccaattgtggaaggatggctcgttgacaggtaagcagttcggactccttatcgcctgaagcgttcaccaccataattgtctcgattcagggcatgctactaagatgtgatcaatgctttcgtcctgttgatcgcaaagaacacaacgatccgggtgtggcaaccctcgactgcgcagacggtcagcggtccagcatctgttcattgtaaccaaccacaagaagaagcggcatcgaggcggagcgagtgacttccaaattggggtggaaaggaaggtgactataggcggattttgagctgtattggcccgaactctctcatttccagatgattgaaccaggagtagtaggatcaagatccaccatttggacaagcgaccaaagctgtagatattctagaataggttggatcccaagtgctcctcggatgtctttgatccattggcgacctgttagtgcctcagccaccgtccgacgccggcgcacgcgtggtggaattttatcatagatgttcggagcaatggaccgaatgcaaccctcttgcaaccagctatcttcccagaagagaatagtttgtccgtctcttaattgacagacggtagaggatgcaacgaagttcctttctttttgcgaccccggaatagctagcccctgccaaggtttgcttgaggaggtccgttgcaaccatgtccacctggaacgaagagctatacccataagctccagattcggtacacccaaaccgccgtagtttttaggggcgcaaactttggaccaagcaaccctgcaacaccctccattagcttgcgctttacctgcccaaaggaacccgcgacggatcttgtcgatgcccttgaccacccacttgggtgcatcaatcacaaccagcagatagatcgggatagcgctgagaacagcgttaaccatagtagcacgaccaattgaagacatttggttggacttccaagtgccggcatttctccttgatcgggaaactggacgtacgattgattcatacatcttggaagacatctgtactaggtgagtgctgcagatttgtcctggaattgtttgtctgtataattctggatttcataagcactttgcagaaattgagattagtccctacaaattaagatggatcagaagttctttctttggcaggcaaaaaggaacgaacatcttccgatccgttctccagcagtgcaacttgacacctgactaaccactgttacatgttttgatctgactaaaacttacatgatggaacgatccatatcatgaagagagaaaagggggttgtatttagtcgcagtacacaagaacatgaccacaaggtttagcaaaatgttaaacctccctgtacgtgtgtcacgctaattaactcccctaaaaaaaggtacattgatagcgctaatgatcagtggcgagagaaaaaaaacaaaagttttgtgcctgcgtacgtatgcatatgcctcccttgattatttatcttcgaacgaggtggttcgttattgattaataatttctatcgtagtttcttcttctacagtagtagttcagttcatgagttgtcccatcagcggcgacgacgacgacaagatggcgtcgagcgcctccttcacctgggatatctccggcgccttccctccctgcgccggccagaactcgtccgtcgcaagaacctgcagttcatcgtcagaaacacagttaattagaacctccaaattctaattctaaccgcgtaatcgcgtgcacattgcgagagatgtgtgcataccttgacttgaagctggaggaacttgacgtagctgatggccttctcgagcatggtgacgaggtcgaccttggtgccgttgggcacgagctcctgcaggatccgcagccgctcgctgatcctctcgcgccgattctgccgccggcaagaacaattcgagttcagttcggtacatggattggtcggagtagcagtaggattttggcgcggaattcagtaaaagtttaattaccttggccgcgaggctttgcgggtccttggttggggtggtcggcgccgacttggccttgcccgccttcctgccggcgccgcactgcttcttgctagggctcatggcctgcgacgactccgcgtgggcccgcttctgcgagccgcggggcgccggcgccggcgcggcgcgttcgggggagacgccgccgcccgacgtgctcgggaacagcagcccgaactgccgcccacccgcgccgccgccg

SEQ ID NO: 59593 - DNA, 17685 bp, Oryza sativa
ttcctgcagcccccgccgaacgcctcggcgtcgcaccctccaccgtacaccatcgcgcgctcccgcaccagcgccatgcgcatgcacactagtacactaccaacaaatacgatcactgcacccttcgtcgcctcggcaacgtacacgcgctcctccgtcgtcgatcagtcacacgcacacccttctcctcggcggcgcggcgtgtggtggtgcagtctgcagtgtggtgtagtgggcggcacgggtgggtttgtatatatacacgcgcgcggccgcggcagtcgggcacatggggagctcgggctaaacaaacaactcaagcgtggaggcgcgagtgcacgcgggcgcattaaatgctggaggtgggctcgctgatcgcggctgccgacgccgtgttcccggagccattcgccgtgccgctcacacgcacgcgggcgcgcgtcggggtgggaggatgacggcgtgcgctacagctaacgggagcgtggagcgcggcggagcgagcgggggagtcccacgtctcaagattcccgactcgtctccatgtcacgtggcccatgccatgcaagcagctggctgcggctgcggctcgctctcgccgctttgccgggccggccgcaatacgaccggcatattgtgcaagcccgcacgcacgcacgcacgctggggttgcggggtgagatgagaggtactagaccggtggggagatgagatgggatcggtgactgttttttttttctcttttgctgtgcctccgctcaacttactgtattctggccgtcaatcaatcatgcatgtcagtgacactaaacagggtgcgaggtgatcgatcgcgtaatttattgggtcaggttagcctggctggaattttctacataccctaagctattagatgtgtgcatgcttagctacacctgatttattgcaccgtgccaacacacgacctaattttctataaaatgctactacgtgtgtgtaactccaagttgatagcggtacatgtttctttagaatgtttatgggtattttagttattaacgttgttcggctgtcatttacagcacctaagccagttttcttgttctaggatataagtagttgcattggttgcgatactgtcaatagcagcggagcagcctcattaagttacctacgctaactaatttaacacaaaagcttaaagtgttgagaaaaggtttagactagagatctttagctctattatcgaaagtcacatgcatcgatcactgtcttcaagcaatttgtttacactccaacactaagtaactaggaaatgttttcttttacccgatttgtatgtttagtgcgaattctcagttctgtcgtgctgaattgatcatctgacttgggatttaaccgagtataatcaaggagccgtgatcgatctgaactccctacagttggcaccttccgatcgtaatctcagccgtcgattcttaatccgacggccatcgaccctcacatccagcgacgttcgtgcaccgtggagtacagatcgagcagggaatgttattggcatatcttaagcaggatcctgatgacgtcccacacacagcaaggaggagggacaagatgcttcggattccgttaatacctgtcattgctgctcgctaatcaagcgccctggagtgtaattatattctctgctgctgttgccctgcctgtacttagctaagcttgtccctgacatgattaagaaactcgctgctgtccccccagcttgccttagtttttcttttattacatgtacacgagtctgtgattaatgcacttgtgttgtgacgactataattaataaacttgatattagcagtagtaatttctctccacacatccatggttgcttggtcattaatgccgttgattagcatgctgcttgcatcgatcctctgccacagtttcagcgaggaaaaagtatagtagcaagttggtgatcaagtagcgagtcaaggatgtctatctcgtttctacgtgcatgcacgtctacgtgtcgatcggttactacagtggacacatcgatcggtttaattttgatcaagctgatcgatatgattcacgcggattaattcagctagatatatagcccatgcacacgtcggtctccatcatccgattccgtgctgggtttaattcgcattgatgtcgcagaatcaagcaccacatgcccctccttaatttgccatatttacaggcttctcaatcgtgtgcaattcgtgtggttcctatatagcgaccactagatcgatcaaaaaaatccaggaaaagaaattaagtaaaaacctcgtgcatgcgtgatgcattagctagctatctgagtatatctactcttgatatgacgatcatcagtgattctgaatttctgatgatgaacctctgttactctgttagtacttacttggggcttggtgatcagtaattctgatgatgaacctctgttactctgttagcactggcctgcaccctacagggagaggtcaaagtctggagttttgagttgtaaatgatgacttttacggcgatgaagcgtgtgggatggagtagtaataatctggaggtcaacttggcaaaatcccatcgctgatgtgggaggattaggggcaattaatggcgttcgtgttcctcaattgatcccggcatgtggagctcattaaatgacggcgaccaatctggctggccaactaaccctgctcctcctccgattcccccttacctcttcgcgtaatcctaccggttaatcccagcatcaatcaagatcgagcaactgatccgattaggttatctactcttttccatgcgtcttgccatctcggcaactcctctcggattctcgcatcgaatgcttctgcaggcttcagcagcagatggagatcgatcgatcaagccggcgacgaaccgaccaccatctgacagtgagttcgttcgcgctagctagctgggagcacgcgtgcgtcgctgacatttcgcgggattttattcagacccacgcgtgcgcgtgcgcgatggccatccgatccgaaagaggggaaaaaagtatatttttactggctactctactgctacgaagaactcattccttaaaaaaaataatctagaaggatatgtgacccctcctaatataacgagattcgttatatctttttaggacggagggagtaatcatgtttgatgctgtgttgagttgatctgtaattgctgtgctcggtatgagacagttgttatttgttaagggtttcagttgagctaaggaaagacaggaggcaaagtgttaggttagctagtggctatctattcttgtgtgctatgaatgatagaatgatttatgataattattttatagtcaaacgaatgaattaaacagtgtaaagttgaaaattaatttaaaaccgtttatataagaaatttgtatattataaagtttttatatgatttgcaccatttagaggctcggaaaatattatttttattattccatttcattacaggaaaaacaacacacctctacctcaatttttaatatatggtgcattgatttttccttctgaaagtttgatcaacaatgtttattcagttacttagttaagtgaaatgaaaataatacaactagatctattatatatcaaaagcattttaaacatacctatagtatatttgtctatttgcacaaatatttgtcaagtgaattaagcaagtactagtaccttttgcacaataatattcatatactagtacttgcttaataatttctgtcttaattattgtattgttggggaaaagttcgatcgtaacatgccggatatgtgatattgtacttgcgataagatttacaattagtaagttgagagtagagtgggtagttcattacccgaattggcgcctagtgagagtattccaatcacgattatgtacttgtgataagatttataattagtacgttgccatagttggatatctatatatgtatggagtactcctagttcattgccgaaattaataaaagtgtacgtatacatatgcacctattcaaagtatttcaagtactcgacttgtcctctacataccaagctgtctggagtatctccgctgcttcgcctgtacaataattgtcgtttattatgagtatattaactaattatgattacaacgtactcgtacatgcacggcgtacgtgaaacatttacttcaataattatttttactggtgtaacttcctcttttacattgtttggttctgtgactctaatcatatatactccattcaaatccatctctctcggcgtgaataccgtcaaatgtgtactctgctttgaattggatttaagtataatcaggagaaatttaaaattgtaaagtttgattctcatgaataatgttaggcagatttttacttgttttaattagttctcaaattcaaaatcaacttaaaattaggtcaaccacacaggcaaggtaactcaacatagcatggctacaataatgataggccatcgaactaaatatgctattcttcttatgtgcaagacttttatgagttaaaaaaaactaaatattcacacacatgcacacaaaaaaaaatacctttactcatagcatatctataatttcttattttcgataaatatctgataataagaaactcgtatatttggggtcatgtttaagtgttgcatctctgcaaggaagatatcagttaaattaaagagagatttttatatatgttcgaacccttcttagagtaataagtatacatcttgtcagtcgggttatcggttttattaataccaaaagagtatggttacaaggatatatatggacctagtcaaggtttatatgctagtcttgttggggattccaacgagtttttattgatcagtgggtgcaccggctcgatggatcttgaggcttgatctctgactcaacgacatatcgacttgcggtggcatatgattgttgtgtcttggcttgcagagtatagatagttggataccagatacccatatggcctgcatatcgactaagatagaaggtaggccggatccatatgatatgagatggaataacatctgtttgccatattgccttgtatcctaaaatagcgtacagagaatcccaaccgaacaatgctatggatagataaggtaaccgaaggcgtgttcggctaggtttcctaacttgtaacactaccccctaacatatataagacatgcagggatcccctcgagggcaacagagaataagaaacaccaaatcgacacaatatcaatacatcaggcataatacaatccatcaaaataggagtaggatattacctcacatcgagagcctaaagctatataaacccatgtcttctgcatccatccacttttagatcttgtgcgtagcccctaaattagtattgatacaaaacttcggtatgtacattatatatactatatagttagaacccagctaactctaaaccttaacacatatacctgccacatcatcacttactataaattattacctaaagctcatataagcatggcatatcatccaacttataacgttttagaactcaagcatgtcaaatcatcatcttccatatagttttcacaatatttcaaaatatatctgtcgacgtttgagatcacgactacggtatttgcatgatatggagatcgttggtactaaggtatatgtgagattgaggtaaaaaagatagagacaaggatttttatacaggttcgagccccttcataggaaggtaacaaccctactcctgttggccgaagccggtgttgctctttattcgtctgaatcacataagtacaacaattaggacaacctatctagctgccgtcgacatggcggcacggacaccaacacgtagtcgacgacagggtaatcttcctcctcgaatatgaactcatcgagattagagatggcgttagatccctcttgtcggcctccacaggcaccatattgggtttgtctaggctaatctctgatgtcgatgtcaggcttgtcttggcttgtgggttgggtgtctcctctcctcataggaggtcttgtatttatacccatagatattctcttgtccaagtagaactagggagacaagtatggatatgatccgagtagtcgttgtcgttttcatatagaactctactcgtcctttcttatctggaactccttatatatatgaggtatgattccgtataagacttggtatatggtgggccctgcagagcttaatcgattgctgttaggtacgtggtatctataaccatgacaatatctcttcatcttttttacaatagttaacatacattcattcatatgtccctaacaaaacatggggtatcatctagttactaacaattattacaccttagaagtcacaaaaaatatcatattatcacgcaccagcaattattacaactaaagagctcatcatgcaagcatgcaccatcatctccatcacatcattttcacgatatttttaacttatacttattcatcatactataatattcaatatatatttattcatgtatttcgcggtaaaacgcgtgacattatttagcatagctatggtatatatatatatatatatatatatatatatatatatatatatatatatatatatatatatatatatatatatatatataatcactagctagctaggccgtactcctgtctgttggccctgactagttggggaaaagaaaatttttaggtgtcacatcggatatttgaccagatatcggaaggggtttttcggacacaataaaaaaactaatttcgtaactcacttgaaaaccacgagacgaattttttgagcctaattaagccgtcattagcacatgtggattactgtggcacttatggctaatcatggactaattcgactcaaaagattcgtctcgcgatttccatacaaactgtgtaattagttttttttatctatatttaatactacaatgtgtgtccaaacattcgatgtgattttttgagaaaaaattttgggaactacaccagaccttagtgtgtcattaatcagttcaaatctgaactaaggtgaaccaatcagatttataagcaaagaactctaatacggaatctaacctatagcgtggtggcttgttattattgttgattttttcacacattaattgcaataatattctctctgttgatcagcttccagtgagatcagaagaacatgagacgacatgcagcgcactcatgcatatgcattcgaacactgatagttatgatagttttagctgccgctaatgtggatcgatcttaataatactaaaccgaaagcttgtaaagtcagctaacttaattagccactggggctgtcttgtttagtcaggttccatttatgatgcctgtagttggtgtaattggtcaaataatattctactgcaagtttaccttttaaatttttctgtgttgcaaaactagccagtgaaatttgcacaatcgtgcataccatgcaaagctgcgtgaatcgtgccgttgtgtatcctgtagatgctacagcctacatgcatatgcttggtcggtacagatcactgtacagtgagcagtaattatgcatcgactcagatatttgtcccagctcgataacttcctgcatatgctagtaatagtttgtgtagatatacgtccaaaaaatagtttgtgtgcgtatatatgcatgctgatatatatagatgattcgcactgaaacatgtacaaattaaactcgatcgtgataatgtttcggtgcctgaccaacgaacgccgctcttgctgttgcgcagattcattgggaaaaaagaagtctgttcatttatttggaagtcgcgaaaatccctgggtaacgtagtcggtcgctaggtcatcacactgaggccagtcacaatccaaaacattagacatagttttcgtaaactttacatcataaaaaaagtagtactagacactactctttcaatacaaacactatatttccatacttaaatttaatgctacttatctcacatgatgtcttggatgttgtttagaaatcatgtctcatgcaagacccggtttaattctctttcctcatttattcacttaccacatcatctttcaatctaggtgtcaccttatttaatgctatggatatcatcctagtcagagcaaggttaatagtatagccaattactagctccaaattatccatagcgcgccaatctaatagctaattcatataatagttatctagaaatatatactacactattaatctggtcacacctatcatacatacattgcgtcttgtagcccgtgctgtatctggctataaatctatagcccgctgctcttctctctcatattttatctccttaaaatatgtttatagttgtcttgtagtctgctatcgtacctgctctcattggattagaaatggcctgatagtgtgagaatatatttaagtcctctttttttcttttccttttctcccctgcctcttactctcctatttgtttagccgttcctgtaaattttgttcctcttaatacaaaagtgaataattcttttacgtataaaaaaaagtcacgatcgaaacaacaatttgtcttttaagagtagtctggctctgggatggaatatgccgtatattaaactgaagcagctatggctgtatttagatcagcgtaaagtttgaattttggttgaaattaaagatggtgtgactgaaaaattatgtgtatatgacagattgatgtaatgaaaaaggactgaaatttagatccaaacacagactgtggaaaattatgttagatatactgcaactcgtaacgaagtcgtaacagactacgtctacgttctgcatgcagacttttgagtctgcttccgtattagagtagactagctgctagctgcctagctctccctgaaatgtgaggacacagctgggcttcgagattttccttttattaatgggtggcagccttgttaggtgatagacagaagaacaagctctctctctctctctcttcttcttcttcttcttcttcttctcgtcgtcgtcgtttgatttgttcatgacaaacagctacttaaagattctactagtatgtgtatatatgtactgtacaacacaaaagtgttaagccttatcttaaagctataggcagtaacttaacagaaataacggacagattgtcgcgtatgtaactacgctagtaggtactgtactagctacttagagcaaatttaatagtatagccaactactaactctaattaatctatagccaatctaatagctcattcatacaatagttacatactacactattaatacctggccccacctgtcatatacacactgcgtcttggagttcgtgctacagctggctataaatttgtagcccgctgctcttctctctccttatttattttcttaaaatatgtttgtagctggcttatagcctgctattgtacctgctcttagcattggatatctccaagtccattcgtgtgcgtgcagaattttattactgcacccgttaggatctatcgatgcacgcatggcttccagcagacagtgcaaaccgacgaccgatcgatcgcacgtgtgatccgcagttgcattcactgcaatagaaagcactcaagcgtgcgaagaggatcgattcatgccgtcgaaactgtgtgggtatagttactgaaggcagactgaatttagtagtgtttgtgtttcaatttcctgtacctgcatatgacagattatactataccgtgaatcgatcccggaatggcataattgatttgggggtttgagacaaaaccattgttaattattccattaattgcttgagtaaaccccgttgccattaatttcctccacgtgcattaagagtttaacaatctatggctcattaaagtgctgagcactgttcactgaaatcttattgggggcccactagcaggattctaaaccaatcagattgatgttattactgtgttgtgaatattctgatgatccagtaactgcattttgtttttccccaaaggttgttctagaagcattgctcgtgcagcgcccagagcccaagacaaattaaaacctgtcgtcccgttattttcgtgatgaggattctatctcagattttattagcatgttttttaaatagctaacgtaaaaaaaaatatatatataaaaagttcctaaaaaatatcagctaaattaatttttaaaatttgacataattaataattaattaatcatactctaataattttctcattcgtatgtccatatttaatctttatcttcatcttttcgaacgggccttctctgcaattcatatactaatactcatgtataggggcatatcatcatgtattgtcatgactgaggttagttgaggtttaagctggctgaggtttctatagcaaatgtcagatgctaatcataagttgattagccatgaaaagcttcacaatgcacttaagaaatcagcagactagtagtgcaagaaaatggcacaagaaaacaaaaggactcattaattattgtagtcggctattagggtagtcccaaccctccacctaggatgatgtatatagcattaagtacattgccatgtaggacttttaacttatgtgtcactatattaattaagagagagagagtgaagagaggaagaaaccgggtctcatgcaagacacagcttcaacacgagaacctatgcactagacactatcaagttttgcattgcgagagaatagtgtcttcataatagatatagaataaatatgattggtagagaagagagatgatgtatttattaatggcccattttaagaaaccatgggttgtggagtatagtttctattgtgatgtcttattgacacggcaccatagacactacttatggacactatgggttgggactgcccttaggcagccattagacaattcaccatttttttcaagactttgcaattcattcatgtctcttccaagacacaaggctagcagtgaccactcagggtgtgttagttccatggacaatgagtgagatagcacatcgttttccgcgcccacgtttcccaaactattaaacggtgtgtttttttaaaaaaatttctatagaaaaattgctttaaaaaatcatattaatccatttttacaatttaaaatagttaatactcaattaatcacatgctaatgactcatctcgttttgcgtatcttcccaatcttttcaatcccctattcctcaaactcaccctcagtgatcaatttggtcagaaaaacaaaagagagctagagaaacattaatgactggtacatcagtaataacatatatactacacattattgcattatgggtttgaggaacaaataaattgattcataagcagattccatctgatgattcagtctgacgaatatacagtatattcatataacctgatcattttgtgagcacttcgaagcgcaagaaaaagatactgcaatttggtgtggatcctgtagactatatagttaagaaacataagttaattgcaagtattcagagtagtaattacacgtacatgcatgcgcgcaacttaacgacatacatattactataagatcaacctaatcaattaggaatcacacagctcaaaggttctggatcatatcataaatcaactggagtaggtaataatgtcctgattgtcttctccagccctactggggacaagttacaattgagaaagaaaaacaattattggctatttggctgtatcccatgcagtagataaccatttcatgaacactttgactgcagggaccaatgaactcctaccagtcaggctatatatcagattatgcagctctctcctggtacactgcacactgttcaagttcattcgtcccctcaaatgtctgctagtaacttagtaagtatattatttccacttacatgcaactaattaaggcgaggttaccattgatatacgcactaagtacgatgtagagctgccccaagcctggtatcaggagacagccggctgctagatgcaatgttctgcagtcacaaaaacaaaagatgcaccctagaaagtaaaatggataactaccttgcgtgcagggtgatgcttggtgaagaaccgcatgaccagtcaagaggatgaacagaaagtttgattaagtatgatcatgggggtgtgtagctgtgttgttttgacttcatgtaattatgctccgtgattggttttaatacctgtaatacagagctttgtgtttggatgtcctcgttgtatgggacataatacgtactaggattccattacatcgattttgaagaagttttatggggtaaacgaaaaaaaatgcgtatctatacgatcctaggagcatgtttcataatatttttgaacgattgagtagcattgtttttcattaaatagaaggggtattgttcatttttagcccctacaacctttctgaaagttcattttacatatctgaactacaaattggttatttttcaacccctacttttaaaatcgtaaaaataacaaccttaaacatgtgtttagtggttttgtttgaaatagttgcgaatcttagaaatttttatgagttttagcaagcctaacaataaattataaagtatacccaattctatacaaatctataaattattttgggctgagcatttgctttgttagtttgctctaagcatgttaattaagcatgtacaatacactactgattttgccaatgacgactaagtaagataattagcaatagtaaggtaattatgattaatttactgaggtatggctgcatgcaagccggcggagcccggacaagtggccaccaggcgccggctccgccgctggtttgaaatggacatactttgagaactaaataaagataaacatcaaacaaaatccaaagcctaagtggctaagtccatgcatgaacaatgctttgaatgcggtggtatatataatctcttcacggtacaggttaactatatacagataactcgtacattaggttgcatgcgttataattaataatttattacctccatattttaatatatgacgccgttaaattttgtccaacgtttgaccattcgtcttattcaaaaaatttatgtaattattatttattttattgtgacttgattcatcatcaaatgttctttaagcatgacataaatattttcatatttgcataaatttttttttgaataaaacgaattgtcaaacgttggtcaaagagtcaacggcgtcgtacattaaagttacagagggagtaattctctacaagtgtaaatatatggactatatgtacaacattaagcagcatgcatttgtactatgtttctaaaagaaagaaaaatactaagcagcctgctgcacatttgcacgtacggttcgaccatcaaacagacaacaccccttctatttctcttgcattgtctccactctctcgacagtgtgagcgtctcttaaggcctaagcatccaaaatctgaagatttcttcgtgcatgggccaccgtcggtaggcctcacctgcctcctgtgccctcgtgggccgtcgccggtgtctcgcgttgcaccggcaggcggcagcgtcgctctcgcccccattgaacgtacgcgtcaaggcctccatggctccgccgaggagtctgacagttttttatttaacttcttttttatcactttcatgtggcctcatgtttacacgtcagcgagtctaatcacgatttgttctgactgctgccacgccagcagatgcaggcatgcagcttcccaaaccactggaaaaatcgattcgcacatgttttcaaagttggagatgggatatacccgaatttagggttgaaggatgcgattcgaacaaaggcaataggtaagggatgcaaaatagacttatattaaaaaaggaaaatatccattttacctctattaactaccgatagaccgagtttgattcacatctcttaattgtaaaatcaattaagatcggatgtataggctcgtttaatgttagaattgaaataatttattttctcatacggtttagatgagagtcttgttctacgtatcattttgatctggtcttttatacgacacgatgcctacggaatacatagtattctaacatctattattttaaaaattaaagatgtttttaccgatattttggtacgtcatccgtgtataagttggtttttaagttcgtttgcttttggaaatacatatccatatttgagtcggcttttaagatcattcacttttggtaatacaaaatgaatcatataataaatccgtttaaaaaaaacttgcatgctaacttagagtctgatagtcccctaactgcaactcatgattttctaaaaatatatatccaagcgaactcccacagtgaatttcatcttaactaaaccatataacaataataagattaaaataaactttatccgttgcaacgtacgggtattttttccagcagttgaaaatttttaaaaagaagacaagacccacaaacgtgaaggtcccttggaaaaaaagtaaaataccaatggctccacgtgtcatcctctcccattatttctctcctctctttctctctctctccacgaaccccaaggtacaagcttttactgtgcaagtcttttttccccaggtacgtacaaactttgagaccttatagtaggagatcgaggtattatatagttggagaccgaagctgactgcaacccccttcaacgtacaggccaccatgcacatatgcgtaggtgcaatccgtgaccactgaaaacccacggatcgatcgatcgatcagccaacctacgtacgtacgtacgtacgcgttccgcccgttagtgctcatcgccggcccggccgcgcgccgtccgtacgtcgtcgcatcatatcacacgtactgacgtacccatgccgccgccgtgttgcaagtcgtgcggtcgcgccggcggcgtcatcggcgtcgagatatcgagcttcccgggcacgccgccactgcagcgtcgtcgtcggctccgccgccaccgtcacctttggacgactaccatgcgcgattgaagacgaggttttccgctaggacattgctcttcatcttccgggtacgtacgcgttcgtaactcgtagtaagtgtgtatatatactaatatcagacagatcgatgctagctgcatgcacgcagagttcgttaaattcgtctgacgccatatagtacatgacgcgcttgattaattactttctcacggatcaaagcttaataacttgatcgatctatgcctcttaactttctgaatcttcgtaacgaaattctgcctagctcggtttgattttctatgcgtttccaagaaaaaatacacgcgatagcggagccaaattttctaatcctagggcttaaataaaactcagttaataggatattggctttctaaaaagaaattgtatgatggtttaaaaatatttacatataattaattgattatgaaggcaaacctaggtcggcttgccctaggcttgcctccacccttgaaaacacacgtacatgtaagtaaatgtaacatgtacaaacgatgctacaagtagttaactctggactaattctattatacaaattagggcatttaatttgttcagcaaattccttatatgtggacagtcagacacttcctaaagcaaaattcactttcgatcatagttttttattaccagtgtttcactttgtattatattttaagcaatgtttttacttaatcaagtaattttacctttatttcgccttgaaccatcctaactcccttctcaagcatataaacgatttcgagtacactagcttttactcgttaattaagtcccactgttatactaaaactatcgttttgacatatgataagttgatggaaatttataaaatagtcaagggtggtgtactgttgtaaagtgtcacaaaggtaaatccactctgttcaaagtgaaaatatttgttaaaagaggatttaaaccgaaacaatggcaataaaatgtgacgaaaattgaaatttactcagttttttataagtgagacacttgctaactgattttttttattttgctggttgaattgatgcagggtctgatgctcttgctgtggctgtatttgttcgattgcatgagaacatacgtgaccgactacgttggcgacggagactcgtggtttactaagtttgttttgtttgttgtagccgtgcccatggctgacctttttagcatcttcgcgtggctatgccttcggctccctttgcccggatgcagcccacttgaacgtccaagagatttttaagtggtaaattttgaggtcaattataagtaggagttatttacgcaattgtacacgctatgcaccaacctcactttcatgtctatagagtaattaatataagatgtagaagttacatttttgtcttttctttatgggtccatattttcttttctcgaagcgatcgacatgttcatctacttcgatacatcgatgctatatgcgaacttgctaggcccctctgaataaaaaaaattatggaggaatttcataatgtagaaattctataggcaattttcctatgtagatctttgattcaaagaattggagttttccaaattctataaaatttctatgaaatagctcgttgcacgtagattttgaagaaaacttagtaaaaggtttaacctcttgaaaaattcctttgagtctatctctcttatcagattcctgtgtttttcctgcagtctaatcaaatgaccagccatttttgtgtttttaataattatctactttatatttgtatttatgttagaattctatattttttctattcctcgtattttccttcctactattgaaagggaccctaaattttatttggccagcaggcattattaattctgcgtttctgaacaatctataaatcaaaacttgtatatagttacaattaaactcaagaaataaatacggccgaggagaaggagaacacttaaatattataggttacaataaacttaattatattgtaccctcgatactaagagcatgacgaaagcgatcactaatagagctcctcaaataccataagatgagatcgtttgctcattgtcagggagtcaacctgggatgctcatcctcgccacttacattatcatgaacgttccatactatcaccagcgagaaaatttgtcattatattatattatgctaccgttggaaacggttttctctagaatttcatctcgcgtgtagaaattaaatgccacccttgaacggtggcaccgccgcgaccttcttcaacaggagcctcatgtcatttggtcgagaagttcagatctatttatactaccacatcaacgccaccgttgagagggcgccgtcgccgtcgaggccgttagggggagggacggctgtcaccgccgtctccgccgcaccccgccgtcactgcgccgtgccggcgagacaggaaggagagcgggagagggaacgcggacgccgccgtcgtcgccgttgacgctgccacacccgccgtcgccgcaccatgccggcgagaagggagggagaagggaaggaaagtggcgccggtggtgggagagacggcaccggtggcgggggagg

SEQ ID NO: 59594 - DNA, 17355 bp, Oryza sativa
  unsure (1)..(17355): unsure at all n locations
atggggaggaggagggggagggttagggatagggttttcatcaatttggaactgatctgaaccgtcctcggctcagatcgatcgagggtttggaccgtaccacttgggccacacgcgggccggtggtccagcaagtgagaggaggagtatgggagtattaactagacttttacgcttgcgggttaaataagaaaatgggttgaaaaaggcccatagagaaaattgatttttattttgatttttatttagataaatgctgaaatgatatttgtattatgaaaattaccaattaagctatataaattccaagaaaattttaaagagtgtaattaatatagaaaatttaataaaaactaaatccaaccataatattttatttctcacacttactttacttgaaaattaatttaattatatacctaccaacataaaaataccctaatattccagaaaatgtgtatatcatttaattagaatttaatatgttttaatttaattttctctttttttctttccattgcaatgcacgagcacttttgctaaaatttcaaagtgtgtaattaatattgtagaaaatttatatttcattaaattaaaatttaatatgttttaatatagtgttctcgttttttctttccgttgcaacgcacgggcacttttgctaaaccaaaaaacacttttggtcaatctacacactccgtaatcacccggtgcaacgcacgggcacttttgctagtttatactaccaccttaattaataatagtaaaaatatggatggacattattatattaaaaaaataggtacattgagatatatggtctgttcagattatagctaaaataaaccatatcaaattttgctaatttggtaatactgccaagttttggcaggattttttatttatttatcagagtttggtaagaaactaaatagatgcacatatttgaaaactttaccaaaaaatggtatgatttgaaatggatcaatctgaataagcccgtaatcgttatttagcagtgtctataaaaacataatactctctccgtttccgtttcatattacaatgtaaatatactaaaattccacatgtaatttagagacttacaatataatacattctgactatatttcatgaaaaatatgacggcacaaatatatatagtccctttttatatattatgaaatagcatcgcactatattgtttatcaactagcgcacgatacaaagtgcttacatattatcttaactaattaaaatattcaacatttttctatcgtcacataatatgttttagttcgtcggcggtgcgccttcctgccctcacaagtgacgccatcgatctctcatgacgcgtacgatggacaaagattaaaattgaaactgatacgaaatccaatcggataatccctacttagagaacccaaagaaaaggggaaaaaaagaaagaaagaaaaaaatcgcacaaatccaaaagcccacccaatcttagcaggatcacattgtcagtgtctcctaagcctcgatctgcctcacaaaacagaaagctcaatcgatctatctcacaaaacagaaagctcaattcgagtcggctctgttcaaatcacatattgatgaccaaatcaatgcccgcatcatgcccagatggatgcctaaatcaataaaatcattcatttagaactgaataaaataggaaatatgtaaatcattcatgtcttacttagttctcagtcccaacaaagaaactaacatctctaatcaacgatatactgaggtcaccgccgccgccgtgcctcgttgcttgctcgaggccgaggacgaagacgccgccgctcctgctacctgccgaataattaaatataattgaatatattttcataataaaattatattgggttgaaaatattactacttattttctataagcttagtcaaacttaaagcggtttaattttaaccaaagtcaaaatgtcttataacctgaaatggatggagtatctaaaacaacgaatttagataaaatatttcctaaattaatttattttaggacgggaatagaattgtagagaagatcctatatatatacccgcacaaatcgtactcgtagatgacatatgcagaacgtgccggatcacgtcattaaactggtataaaggccgtagcaaccaaaaaagaattgataaaagacagagggcccaccgtatatgcatgtacttatgtgacataaggactatacgtgtcctggaatcaaggtgttacccgatctcttttcaagcgttggccgggtggatcaataatcggtgatcgatgccaccaagcgctatgaccacaccaccgtatctccggcgagtctctccggcggcgagttgctttggctgcgccggcggcgaggcccccaccttggacgacaatgacgtggcgccgctgctggacgtcgagaccggcggcggcgatcggagaggacggccgtcggcggaggagatgaggacaggcaagcagccccgccgcgagccgacgacgacggacgccgagatgatgcacgagtggaacagggccggcgttatggccatcaagtgcgtcgtccgggtaagtgtactgatcgatcgatcgatcgagcccgccgtggatcccaaatttaatcctaatttttatgctctattcattcgaaaatatagcaatgcacgattagacatcagctagtaatacggtgcctattgttaggtcaaagaacaaaggattcagtactgattctttctaacaaaaactagcgttttgtacgattggacatcagctagtaatacggtacccattgttaggtcaaaggattcaacactgattctttctaacaaaaactagcgttttgtacgattggacatcagctagtaatacggtacccattgttaggtcaaaggattcaacactgattctttctaacaaagactagtgttttatgcgattagacatcagccagtaatacggtacccattgttaggtcaaaggatgaaaaagattcaacactgattctttctactaggttgattatttttgggatagagagagtaacaatgactagctagcattttgtacgattagacatcagctagtaatacggtacactgttagatcaaaagatgcaaatgattaaacactgattctttctaccaaagactagcgttttgtattgagccgtctgttaaggatacacctattggagcgtgcgtgtgttgtggtacatatatacatgtatttggagaaaaaaaattatatttttgttgacagaaaacacgatgcctgggagatctgcttaactccagtgcagtccaaagctcgccttcgggtgtgctagcatgccagttgatttgatcctgtaaccaacaagaagtagaagcaaagaaatcgcggttaaatctataaatgatagccgatcggctaagtgccgatgacacatcatttatctttatctttgagccgatgtcatatgtgtatcgatcggcaatcttgaataagtaagaaagaactaaatctactcgatcagctatagatgttaacgatatatactccttatatcgatatatacttaaatcaagtgattgggatagatcggtcgccatgccgagacagtataaatcacttagaccgaaatatatatattaataacaggactatatatgtctacagcatagccgatcagatagatctagcatgtatcggctaatactccgatactactttatatcaggatattaaaacaggtatagagtatcaagcaaaagcctaatatactcaaatacagcaatatcttggcataaatggcagatttaacatgttaataaagcatataaagcaaatatagttaaatcagataagatcggctgaaactccgatgctaccctaatcggcaacctgaaggcaggctagaggttgatattctaagtacgacttaatagatcaaacttaactgatgcagcattaagtatgaaaagaagaacaatatctagacaatcaaaccactggaagtttcataaagtggtaaatatcttatataatttaggtcaacgtcgctatttaacctggtcggctgccttctaccgacagatgttagccgattgtagattagatagcggtattgccggagattatgtaagatatatgacagctcggcgaattatataaacgagatcagagtatcataaagatggaagcactaatcccgaaaacacaagtcgtcataacaagttttacctcttgttgaagatcgaaaccgatgcagctcaacccgaaaaagaactcgtcgaaaaaaaactaaagtaaaagggtggcgatgcgccgagattgtattgaacgtgtgttaaaagttacatagggctcgggtctatttatacctcgagaattacaagatatgtccataacggacacgactactatctctaacaaactctaagatattataagtctttgcggcagatttttgcccaatcatatctctaaggaaattacataaaacatcctaattaatagatacaattgcctcctcaggactctatccatgtgcggcaatcgccttgaagcacctcaatccaacccgacatcacacatcaagttgtattgctaggatcggctacatcggcttacctagtccgactcaggctcagccgatcttatcgtaaccgatctggactcctgctctatttccgaactcgatctccgcctccgacttcacttcaatctaatcttctttcccaatgccgatattaccaaatttggttgttaacaattttaaatattaaaaaatatcttattacgcattgttcagcctctaaatcagttcgatttgggtaagatttggaaaaaatgccacatgtaaataggacataaatcttttttgcattctctttctaaaaatactaaggccaataaaatttgcctattaccatagcaaatatgcgagtgtcattttcaccatccacatacccgtggatgatatatttgtgaattttatcaaaatttacgtccaaccaaagaggaaatatccaatgaaaacttgtgaaaattatacctagctaaaagttctctaaatttcatgaaaaaattattagagatagatataagcatgaaatacattgataccaaatctcaaattcaaacttaacttactttgagtggaacgataaagacaaattttagatgaatagtcatgtttctatatatatttccctaaaaaaaattttacccctaaagaaaattgaatccgaacttaagattttgtaagaatatatttcatgcctatatatctatttctaataatttttttatgaatttacaaaaaagttatatctgatcatttccctgaatttttatttatttaatacttttcacccgatataccctatctacgatcagtttggaatgttctcattgttctagttcatctagcttgatttagccaggaatctaattaccgttctacagcccctactgccaggagtagaattcaacaatcctttccatctgtttagaacaattctaattggatattttttgcatgcttttgcagggagtattgacagtgttttggctgtatatggtagatttagtgagaagacttttcagtacccacatacttggagccttaatagcgtacgtggtggcaatgttcgtttcgttcacttttggacggtaagcgagtcattggaagagttgcatgtggcaccatttcacactttcatcctacggggagtaagcagcactacgtgaattacaatggaaaattatttttattcctcgagaggttattgtttgcatgtcatttagataaatataaaaaatttgaaaaaaaagagatgatatattaacatgtgatatatcactccacaaacatgtaagttcaaattccaacttatgcatctcgcaaaaaaacaatttattttttctagtcaaatttgttttcgttgcgatatatagaagttgaatttgaacttgtatgtttgtagagtgatatattatatattaatacattttattaaagtttttcataactatttaaatgacatgtaaacaacgagagaatatcctctcgagggatcaaaattaatccactctcaactaatagctatagaattcgcaatctcattattgtgcaacgttgaagccattctacgtgtaagtacatattgcatatctcttctctatctctacttatctctaatgttataaaaattaaagatgtttttgctggtactttggtacgtcatccgtatatgagtcggtttttaagtttgtttgcttttgaaaaaatatatatgtatttgagtcaggttttaagtttgttcgtttttggaaatacagaaggagtcatataaaaaatctttttaaaaaactcgcatgctaatttgagatgagtggactcctaattacagctcatgaattcatgatcttttagagaaatatatatccaagcaaatttcgacagtgattttcaccttaattaaaccatatatcaataataaaattaaaataaccttcacctgttgcaacgtatgggctttttttaagtatataataaaagacaaattgcatatataataatagtccggcagcttctctattttattactccactacggctacatgcacaattggggtttccacacagtcgttattgtttccgttgcaatgcaggtgcagacagtttgcgctgcgttcggttggaacatttgggacctttgccacgcatataaaacggaacgagttattagcactaattaagtattaattaaaaattaaaaatatattagtattattttttaaagtaacttttttgagatttttaacaatgagttgttcagaagttcaggaagtgtttgtgtaaaaataaaggagcagaaattggaaaagttcaggaagtgtttgtgtaaaaataagggagtaaacgttggaaagagcaggaaacgaatgcacccttcagagcaaatagctactagtactattaaagagcacctcaatttatctctagaagtttgaccaaatgcatttgtgaaatatcccatacgttggcaatgtcaatggcttcaacgaatgatgtggctcatcctgattgcactttgtgattcacttttactaggtaagatatggatgtatttagtttgttaccaaatattggtaatgcttagagaattttggcaacaatacatttggcctattctaaaagaatgacaatattaccaacttgtttgttaaattttgaaaatgtttatttaacagtaatcctaacaggcccaactagaaagtctctcacgctgggccttgttgaccggccagttagccatgcgttctgggccaccgttgcctttcctcgtcgccaactcacctgcccggtggctcgcaacgtcactctcgccgccttgaactcgtccgtcaaggcctcccacctccacgcacggacccaacaagaattcgaacaagctcaactgaacaaagcccagtgcaacaagaattcatgcactcgcctcgtgagggctgtcaaaaatgctcaaaactcgcgagctgctcgagctcggctcgtctaggctcgattcaagctcggctcgagcttcagacaaactaagcctgagcctctccttaagctcgcgagttttatcgagccaagcttgagcttccaacgagtctagtaatatatatttttttgttatttaataaattatgagatcaaatatgttatttgtatgccttatattaatatcatatatttattttattcttttttcctcttctattaatacgatgcactagaaattaattgttttttaaaagattatatttgaaatatatattgttttacttaaaaattaagctcggtagtcgagcttgtcagaaagctcgaatattttatagactcggctggagcttgtatcgagttcgagcctagacaaacgagctcgagcgagctcgttgacagcccttgccctcgtctgcgtctggccgtctggtacacatgtaggagtagtactgtttcacaggaagacaacacaaataagtactacaggctacagagttgctgagactgacgatggcctcaggattggtagcagtaaatcgtgcgtgcattttgtaccttctaggagtaaaaaaggagtactactcctagcagatggtataaacttgatgtcttgtactgtacttaagtgatcgagtgaaatacagtaatctaggtctagatacccctacattaaccatgaacaacagtacatcttggatgtcacccaagggactgattcacatcatcaaatgacgctactatctggcatctgcagcaaaacacaggggacccaacttaacccaaagcattcaagcccccatcatcaatctgaagcaagccaaaaagaacagaaacaatcaaacgagagcagtagtagcacaaccaaaaaaaccaggaggcatcaaagagtggcaggcaagtactatcagattgatccatttattattttctcccatttgctgacaaccttgtatcgagataccattattctgattccacgtcgtaaagcattttctctgctttttgtagacagcctgttgaacatgatgttcgcgctgtcgtacagttcgaaaaggttcgtcatccttcccttttttttcgttctttctttctttcttttcttcacctgaattttataaatgttgtcacggggatcgccgtggccaacatggagcagggatcctttcctttctcgtttgcaacgtaccaacagctagtgtaactagacaaccgagtcatctggagaaaaagattgagagccaaataagtgagacaggcttgtaaaaagctcatgtcatttggctgctcgctcagcggtttttgcatctctctgacgtttggctatgcatctgtcggcgttgttcgatagcgcatcctagaaagaaaaaggtttcttgtacagttgtactcaaaaggacagggtttgttggttctgtttgtgtgatttttattcacgctgtatacaaacaaattataatactccatagtgactatggctgtgttcggatgcctgagttcccaactctaatagtgcgcacgaaaaacggagcgatccattagcacgtgattaattaagtattagctaatttatttttcaaaaatagatcaatatgttttttaggcaacttacgtatagaaactttttataaaaaaacgatccgtttaacagtttgaaaaacatgcacgcgaaaaacgagaggagagtgttgggaacttagagttccgaacacagcctatgtttttttaagtgtagtacgtatgctggtactggcaccaaacttacatgttactctatttgttgatgtattccaagcagggctcataaaactgatgaaaacctcccggttttggcacaatttttaggtttagagccaccttgagctgataaaccgctctgataagaaaaattcaaagtgcatttcaatttttttttacaggacttacttgaaattcatcagatttcaatgcttttcatgaaaacaggtaaaaccgcttaggagcattttcttattagataaaacctgatttcaagttggtcattggacctcaaatccttcagtggtgaattttgtgctcccaacttatgagcttaggaattaaggatttaatgtgtgcacacgcacgtgcgggtgagggttcaaaaatcatttgctcgccaaatactgcactagcctccacagcaattttgacggtttttgtgaatagtatctaacaaatttgtcgaagattgaatttcagcttatttttttaaaaaaagaatcgtcagtttatcagtttgtttcttgatgcgagctgaagcgaacttgttctttatttccacgtattagaccatcatggaattatctctgctattataaaaattgaagatgtttccgcggtccgtcattcatgtttaagtcggttataaaaattgaagatgtttccgcggttcgtcatccgtgtttgagtcggttttaatttttatgatttggttttaatctatatctcttctctactgttataaaaattgaagatgtttttgccggtattttggtacgtgtcatccgtgtatgagtcggtttttaagttcgtttgcttttggaaatacatatccgtatttgagtcagtttttaagattgtttacttttggtaatacagaaggaatcatataagaaatatgtttgaaaaactcgcatgctaacttgagatgatcaggctcctaactgcagctcatgattttctatatatatatatatatatatatatatatatatatatatatatatactagaaaaaatgcccgtgcgttgcaacgggtaaactaaaattataccaaatataaaagtattagatgattagggtttagttttacatgatatgagctttttaagaaaatctattcctaatgaaataaaaacaattcaacttaagggacctcaagtgaacttattctgtgcgtgcacgcggcccatgaggcgggctacagtgtgggcggcctgagaacatattcggggacgactttagggacataaagtaaatgtattctctgaggagattacaagcggcccaatagtgtgggcagcctgggaacgctggagaagctgagccgtccgatctgatggacggtcttgattgatcacgacctatataaaagttcaatgatccaaaccctaaccctaaaaacatttcccctccctccctctccctctccctcagtggcggcgcctctccccctccccggcggcgcctctcctccctccccggtggtgccgctccccctcgcctccctcgcgtgacagatccggcgacggtggtgtcggcgacgaccgtgggtggatccagccgcggtggtggcggccgaggacagatccggcggcggcggctccctccgactcctctcgcctccctcccgcgacggatcttacggcggtggtagcgtcgacggcgaccgcatgtgggctcggtggctgttgctccccctccccggtgtggcgacgtggccaggagcggtggtgggctcgggagcggcggcgggcttgggaaccggtcacagtggaaggctacgatgccgacaacggcggcgacggcggcggacgacggacgacggcgacgaccacgaggagggtggctctgggagatggctagggttaggatttggattttatttttgatttggaatgttgattttgtggggattcttggttttgatttgggattgcaattgagtgattctgtgattcttgggaattgggggcaaaggggttgggaggctgatctgctcggggattttttttaaaaaagacggacttggacttacacgacgatgacggacgaaacggacgatcggaggccttacatgttttgaagtaggtatagagttataaaaccaaacgagaccattatgtcgcatgcatgaccgtaaatgcattaggtggtatgttttaacttaacgaagagaacaaaaaagaaatcaatggaagagcatcttttaacttaactaccgtaatagagagaaaaaaaattaacgggagggaaggctactcccatggaacagaatgggaaacaacgtttgaaacgcatgcgtccaaatgcgaaacggaaagggacgacgtaccaaaaacccatggtaaaaataagttaaacttttataatagtagagatatatccaagcgagctctcacagtgaatttcatcttaactaaaccatctaacaataataagattaaaatatacttcacccgttgcaacgcacgggtattttttctaatcaattaaaaaagtctaagtctaacttatttttaagctttctcattgtctgctaattagtttatcagatgcaacttaattttaaatattttaaatttaattttaaatttatagccgattttatgtttttctgtatttttcccagcaatgaattttaaaccgctaataacataatataaaagtttttataaaatatgtgttggttgttttgctccttttctatggcttatcaaatatcagccgtaacttaaacgatgagagcattagtttgagcgattgggtctagttgcctgtcatcaaaccatctcacaagctaactttacatgccttttcaagtttaaaaataaaactccacatgccttttgaaagcctgatcaaagcgagcgaaatatgctgcaaattttaatctctcaaacaaacacaagacattaaacaaaaccaaatggaggaaaaaatgtctggcagagaatgattgatgaacatgaagcgagatcgacaaaacaagttgcattttctttttctttcttttctagtaataacaaagagagaatagagagagaagagatacccatatcgaggagacacgatgcgcatacggtacgccgtgtacagtgtacagcctcccgagacaaaattcccaacacaccctggcgcctcggcgtactacgctgtaaagaagagagaacgggaactcccgttctcttgtccaacaaaagttggataaaaattaacaaaagttggataaaaattaacatttttatggcacgttttttaaactgctaaacgatgtgtttcgtgtgaacactttctatatgaaagctgctctaaaatatcatattaatctattttttaagtttgtaataaattaaactcaatcaatcatatgttttgcgtaaaaaacttaatctttattttcatctttattttcagtagaaaataactccaccgtaagagagaacgaaagaaaacgagaggccgcgccgccgccgcgcgccatacatgtggccattaattcccgggtggccccatacgtcagccacgtacatcgcggtggggactggggagcggggtgcatttagcatattttatcccgtcgcgctacgcatagcgaatattcgaaaccccccaatcccaacaggcgacagctcgtcccatgacgaaactctggcacgcgattttacgtaactgccctcgcctggacaaagcatttcaccggaattatctgcaaagctgcgtcatcactcgattgggtgaaagcttatgttacgtttaactgcttcatgttttcttgggcaactgaaagccaaaaactgatttggtcgaccagccaaggtcgtgacaaacaagacgtctttgtatatatcttgtgtgtttgcttaacctacttttagtgttctcctgcatatcttaattcaatcaaacttttcttgctttagtcaacttataatctagtaaatcggcaatgaggtgttagagacttagagttggttacctaagattgtgacatggaaaaacttttgtatggcttcgcctgggggcttaaataaagacaggacggcgtacaaaccaagcaagtcagccattgtacttgcttataagtattcggtattttgtttgccaggtagaagggtaatgtttgtttggtacgtaaacctgaggattgaaaatgacgcgactggtcacggtgtcactataaatttatagaccttctattaaaaaataaaataaccttgtttcgtgacattacatatgtatagatttgttatactccactagataatatcacacaccattatagattcgtttatttcggagacagataaggtataggtttactctcttcaatttgttaagaaaacaactgttatcaactagtattaaattagtattatgtaagtgtgagcgtctatgtatatctcggcacataaaaatataaaatgtgagtataatatttgtttatcttcgagaggagagaagaccatcacacaaaatcgactatactagtgtataatagattgttttctctgattacatatgctgatacacatcatcacatacgggcaatacacacaataccgatgataataaaatgcactcacatatgtacaagtagggttcaaatctattaacagataaacgactaggggcggaggatcaagtaagactagcatgaggggctaaacaatctgtccaaagttatagcctcctttttttaagtaaatactccctccgtttcagactataagatattttaacttttgtcaaaatcaaactgttttaaatttaactaagtttgtagacaaatatagtaatatttataatattaaaataatttcatcaaatcaataattgaatatattttcataataaaattgtcttgggttgaaaatgtttctactttttttcaataaacttggtcaaacgtaaagcagtttaactttgaccaaagttaaaacgtcttataacctgaaacgagggagtatatggcaaaaaaaaaagatagacggtttaatggaaactcctataattttaacgctgataataagggcttgagacccgtggtctccatggcatgcagatccactattgtagacaacccacatttttttagcttgtacccgatcattttggttccattagaggaagtaaaaaaacagtgttgtgcagaaactgaagaactaaaaaagacataccaccttgttaacacgttcctaaagtttcctgattttctagcaacgcccagaatcaaccaataataaagctcctttaacacggattattttgcacacgtagaaagtttaggccctccagtgccagccactcaggctgctgcattgcatagtgtactactagtcgttaaacctataaaatggccaatgctagtccagtactacctctggttctataataattaacgctttggacaagtttcaggtcaaatttttataaatttgatcatcaataactttaaaaatatttagtttaaagaaactagaacaacatatatatatttatctttaaagcactataataaaagtaaacatatatttatttattgtatatattataatagaaaaataagatcaaagatatattttgtagaccgtgttattgtccaaaacataaattaaaataaaaccggagggagtatctctgtcaaaataatagtccaatgagaggagaccagttcggacactcaaaatgatcatcacgtcatcaaaaagcggccgtccagggacgagggggggtaccgtggtcatttgccgcaccgcacgctcccctcgcgaagcgccaccgcttttcagccagccgccccacgtgaaattacccctctaccccccacgctccctctctcctcctcttcccctctctctctctcctcccccgctgtcccgcagcctttcccaaatctagccgcacgacgcaccaacccacgcccgagccagagccaggtcgccgcgccacctcttcggcttcgccgcgccgccgcgagcgggcggggagactccccacccccggtgagtgcccgcccgcgcagatccgcgcggttctttatatttgggaacagtccggcggggggtttcttgcggttcttggggttggcgggaattagggtttcgttggtggggttttttcatggtggctagggtttttggtcagatggagcttcggttggtgatttgggtgtttctttgttcggaattgcagggagggagagggcggttcgtttattggatgagccgtgaggaaattgggaggaagaaggcgtgatgtttactccgcaggggaaggggtggaccgggtggtcgacgccggctccggcgaaccagcggagcggtggcggcgctcccgccgcgtcggcgccccttggcaaggggaaagggactactctgcgggtcgccgaactggaacaagaggtgtttttttttaacccaaatcctggcttttctttctgttcgtggatgtagcttttgaattccaatctagggccatgtttctttgctcaccaaatgcaatgtgcggtttttcatggcatgctatcagtcgatgagaagtggaagcagtgaaattgagtgaaaaaaaatattagtgtgcctcgtgatttcattttgaaccgtaaatcatttgaacattccaattttcatttatttgtgcgaggccatttctgcacttgctaatgatttaaataacgtggtttcttatgaactgcttaagaaacagagcgctgcctagggtgctacattacattggtgtcattcttatgtccttttaataactcttcagtcatgttaatctattatttgaatataaaataggcttgtagaaactactgtaacaagtagttaggcatgcaaatacctacggaaggtggaatgttttatgtgattgacttctatgttccattataagcattcgatctaatatatatttttcttcagttcttatctctctcacgctggcttcctaaatcatatttactacagttgcacatccattttcttgtttgatcataccattagtagttattttcttttgtgttcatgtccgcagttacatgaatatcagtacaatatggggctgcttttgattgagaaaaaagagtggacagccaaacttgatgaaatcaatcaagcgctgacacagaaagaagagattttaaagcgggaacaagctgcccatttgaatgccatatcagaatacgaaaggcgggaggaaagcatgcggaaagcattgggtgttgagaagcaatgcgtaacagatgtatgttattctctaataatttcttactcttgctgtttatcagtatttcctaatattcgtaatgctgttaactgttgatgactaagcagttttttgaatactatactgcatatactggtgatatcatatactggtgatatgtaaattttatcacagtcatgaatcatgatgtaataatatctaatggtcaaatgaattggttgaataatttctaggttatggtttctccagccaatagtttttaacactgcattgtccttatgtttatgtttaacaaaagttctatgtatctgagcacacagcacttgtcatctgcagtcctttagccttcggaccatgtacttttgaacgcttcattcttgtttcttatcacttcatatttctgaactttgcagctcgaaaaggcactgcgtgaaattcgtggagagatagccgaggttaagtttatgtctgagaaaaagataactgatgctcaatcccttgaggctagtttggaggaaaaaaggttggagatcgagggtaagcttcatgctgcagatgcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 59595 - DNA, 20607 bp, Oryza sativa
attgaaaaatatttattttagattttggtagtgcattcgcgggtatattgacggatgagcaaggaagagttcaagcattatgggcaagcttttccacccaggttagtttacattacagttgctttgctttagcctgtttcctaagtaatgatgcttgcacgttctcaggaacatttattcaaaagaaaaaaagaaagaacaaaacgccgtcttacacggaaggttagccgtttgatatcttgaacaatcaactaaatggacaatataagaaactatattcactacacttaaaggccctagacttttctgcatgtttgactaaagttgatagattctttgtcctagcattaattcataccctacacatttaatgcttgtaagcaatggtataatggcaccattcttagcagtttagccattcttccatgtgcttatcggggttgtaaatcaattaattattttctccagctgaaatatggttgtagcagttcggaggatcatcaatttgttagaggtataccaatatatgcaataagtcaagtccttgagaaggtaatctctggtactcctggaccatttcgtattatcaatggagttaggaggccaataccattcatcagacttctggaggtggaactctatccaactttgctttcaaaggcaagaagttatggattgagtgatagctgggtgcaggtaatttcacgttggccttgcctttagtcttttctgaagttgctctgcttggtcggacagctatgattcgtttcctgatggactgtcaacctgaatgttctatgtaattacgcgagtgcaatatttattgttctggagaaatattcatgccattcacttgaagtgttcgctgacagataaatgctgcagtttgtaaggaagaggagtaaaggacctcgcttgattggttttggacttgtctaatatgctagtgttatgagcaagtggagaggttttggatgcatgaaatatttactgttcaatatgattatccttgcaggctctagctaagaaggaccctgtgcgaagacaagttttgcgggtcaaaggttgtttggctggatccaaagcagaaaatctccttgaacagggagacatgatccttgctatcaataaggagccaattacatgcttcctagatatcgagaatgcttgccagaaattggaccaatctgttgattcagatggagtccttaacatgacaatattccgtcaggtgaggactggttgtaagaaaccaaccatttttttttgacgaaactgtatgaatctaaatatctatgtgttcaaccgtgtcaacatttaacagggaaaagaaattgatcttattgttggaaccgatgtaagagatggcaatggaacaacacggatggtgaattggtgtggatgcataatccaggatcctcattcagcagtgcgcgcacttggttttttgcccgaagaaggtcatggagtttatgttgctaggtgagaacatgctccacccgaatttatatgttgcttctatgggttctttgattggaactataagcctatagctactgtgggttcagggatgccaacacttgagaagtgcgagcatttgtgatatgtcttttgtttttgtctgttctacaattcccatgtatctcaagttggtatggtcactagctgtgcccgatattagataaaattttaaatttgaatctaacaaccctggtgagtacacttagtcagggtagagtgtaaaccgagtaaccctatcctgataaagggaagagaacaggaattggggtcaagggtctcaacaagttcagctctaccctttcaattgcacatgttttttttgttctttccaactttacaatctcttcctagtacatcctatccaataatgaaacccatttgtgttatcttgggcaccgacagcaaatcagcttcataaaagccatattgatagtgtttcctctaattccactcccaatgtcataatagtagtgtagcgctccaaatcttatatacatatatatgtaatcatttagaattctccctccttgatggtaaatctagagttggttgaaaatttaagatgtgtacatggcttggcggtaggtccatagcattggtgttaagcacattttagatacctaatgggaacgaggaatgagtatcaaatattttatgcagatggtgtcatggaagtcccgtacatagatatggtctctatgctctgcagtggatagtggaagttaatgggaagccaactccagatcttgaaacttttatacaagtggtgaaggtacgtattatcaatagttatcttcctttggtatagtcaagtcttttcatgtgatatatcgacctggcaagcttatgttcaattgatttgaattaatactgataaccttttatttcagggattggaaaatggtgaatttgttagggtgcggaccgtccatttgaatggcaaacctcgtgtgcttactttgaaacaggaccttcactactggccgacctgggagctcaggtttgaaccagagacttccacatggaagaggggaataataaaagcgttgcaatcaactgtagcgtgatcaactatgtttgtgtttgaactcttcatgctctcagagggtgttccttagggagcctaagcatggaggtgcggaaatggggaatgcgtgcccaactgcccatgttggtaagctagaatcctgcgtaatgcaggatggaatggttggcattaggataggatgcttgaagttgaaggatatagttattcatagaaaaatatatggattcattgcctgtggataattagaccgcagcatctgctttttgtataatctattctattgctacaatttttgcagtaataataaatctttagctctttagcgaccatataaccatttttctgcgtaacaacattgttaatcatttttttgtttgaaaccgagttaatcattttgagttacctagcaacagatttcaaccttgccattgcccgccccattctgccgtctgcaccagtcacaacccgccagcctattactcaattttggcttcgcgttccctgaataaaaaaaggtcaccttcctactccgagctttctactttacatgcaaacagattgccttcaggaaaatgaggctagcacgtttcaccggtacaaaaataaggaatcgacacgcaagtaggagtagagagtaagacagcaacttaattttatctatgcaaccttatggtcaaatctgtcaaacccttttgtgccatgtatgacaaatgtaaaccacgcagcatgcaccacctcattttcatccctagttaggcgtctcctctcccacaaacgcattgtcccggccgagcagaatatattctgccaccacttgttagctcgaaccaacgtccacgaaaacgaggaccaccctttatgtgcgtcctgccacttcagtcgatgccttcccctgaggagaaaagaggcgttttaggtaggagttcattgttgccggattccctcttgctaccaaccgatcgtagtattctccttttaaattggccccgttccttccattctctctcgttgccaccgtgaacttgagcgacctcctaagctagcatgtattccacgcacaggctcactcgagcacacgcgcaccaacgcatcatacatcgctacatcccagcgagatagctagggagaaagataagaggaaaactaaggccgagccaggcatgggttgctatcatctgggcaagttcgtgtcgaaagctctcggaaaatgcaacggtaagtcgtcttctacactgcacatgttgttttccttgccacgtcgtggtctgcatcgatcacgtgctaggacatgatcgatcgaactaggtacttctgctaatctgcagccatgcatgcaggctgcttaattaagttttcgctactataagtacgatagattttcagctaataatctcacatgtaaaacccgttcaaaagcatgtatatcgtcctcacatagccacatgtaaatgataatatgatgtgtgatgtttcttaggacaatggattaataatttgataaataatgttagtcaatgttcatgtaccaaatgtccaaaccaatctcaaaatcgcgaagttcatttttttgctaagagttgtgaagcgtggcgacatgcagggcgcgagagggggtggcgggaggagaggctggactacgccatggcctacccgcccggcccacccacggagacgtactacatgcggccggtggcgcgcacggtcaccttcagcgccgccaactccgtctacgtgatcccgcctgcagagccgccgcaccagcaatcccccgagccccagccacagacgccgccgccgccggcacagcagcagcaacacgggcccgagcacgagcaccaccaggcgcagccccaaccccagcaagagccgcctccgccggcgcaggacgcgccaccggccgagccgaagccgccgaagcgtggcaagaacaagaagtctggccgcgtccggttcggccccgagccgccgccaccggagcagcagcagcagcagcagcaacagcagcagccaccgcagcagcaagaacagacgacgcagcaggccccgaacgccggcgccgagcacgcgccggcacgccacgccacgtcggcgccgccggggtacttccggtacacgccgtcgccgctgccgaggtgggaggcggcgacgccgaggcggcacgagtacttctccggcgagtaccgctacagctacccgacgccggtgcgcgaggggatctaccgcatggccaccgacgccaacaggctcaccaccatcttcagcgaggagaaccccaacgcctgcgcgatcatgtgagccatccgccatcgatgatcggtggagcctcgccgccgccgccgccgccgccggcgccggcgcgaggaataatcaaaatccgtacgaacacgtacgcacgcgcgcgcccatttcgttgcattgcatcgggaccgttcattggtcggtttgttggctctaattcgtgcaggaatccggttctgcttgacctgtaggtgtttgtagataaggactgggaattagttctgttccatcgcctgatatgctgagatgaacatttctcttgcttttcgggcctttcggctcttattgcccttccacttttcagtttttaattcacaaagttgctaggatattagtcaaaaatcgttggctacatgacacggatgaagagttaatgacattaacatgcatgttagctaggttttttttgtgtgtgtgtgtacgtgggaacgcattgacaaagtattactaacatgcatactaattaaatctcctcttttaaattactctttgtgggtcgtcgaatgagcatctctcactttaaccgcaaacccttttctttcaccgataccttaaaaatttaccagtgcgcgcaacaatttggtgactccagtcttcggatgccctagcagactctagaaagttgtgtacatcgctgttccttttccagaatgagagcgatcggcgaaggcacattcttcctcacagtgcagagcctctccgtgcgatccggccaacgccggtgcaacgctgcgacctcgcggcctcgcgtacgtacctctccgtgtggtttctgcggctcggttgccgcgtccgcgtccgtgccgagcgccgtacgcgcgcggtggccacaaaagcaaacacggtcgcgaggccgtgacgccatgtgactcgggagtcgtcgcgcgcgggacgggaaaatcacggagatacgcatgaaatcgcgcgcgtcccttctttccggcctcgttccaccggccctgttttgccgttctctccttcctccgtgagcttcggcccgagagacgtgaggtgggcattgcacacagacacacggacacacggccatatgcccatacgccggggcaacgagatgtgctccttcgacagtgtatcatctgagtatgaaactgagtgagtggctacccttgtcgcgctgactgttcttctccattcgacagtgtatcgatctctcttatctttgtaggtgttgagtcaacgctggcccgctcatcaccgccgtgccgcgtcacatcgaacagtcccaagtcaacttaatcgctgcaagtagagccccggactagtggttcagaatgcgattaagcacataaataactctctggccgaaaggtgtcaaggggccacattattagacgctcatttttctctgttacgtcgtttcttattcttcgatgcctatcaccgcacactaccggccacagtcgcatatactcctagattatcattacaaatcaatggccaagcacaaattgagtaattagtactagctgttggatcattacgcactattgcaaaaggcgttgtatgtgaaccatattccgattctgcaagaggcctgcacgcctgcagctgctcgtttggaggatctctatgttcctacgaaagatttccaagcagcaagaggacctttgcctaagtttctaatctacagaatccatattcgatatgcctctcaagggaataactaggatgaactagctactttaattttgtaaagaagaagggggcacaagaaacctcataagaaacacattggattcagcatggtagagtcagaatttttgaagactaaggttaggatatggatcaactaatagagtgtttgttttctataaaatttatatagtgatttaacaaaattttagaggcaaacctagggctcaagccctagctgcccgctgtgccctgggttcaggatttgaacctacttagactgggtgaacaccttcacaccacaccacctgatctatgctcaattctcgaaggttaaggaagcaagatttacaacctctcattgattatgtggtgtgccgattgctgaaagcgaagcaaatagctcttataagctagatcatcacgatgaaggcagttttgagttccatatctatttaccatttggtcggcgtggaacccctaaaatgggtaatcaagggaatcaacaagatccattataggttccactgggcaggtagatcaaatgcacagggcggctactgctgagtctatgaccaaacaaattttggcgatctcgtcatcctcaatcttattgctctcacatcatgctaaatctggttggctagttgcactgaacctcaccgaagaaaccatggcagggactcatgataccttgttcgaacaagaagcacgatttcgcactggctttcacgtcctgttgcatgggcatgggtaatgatgagttggctctattgtgggaggaaaaggctggatgtacgacgttgagatccattccttaccactgaccatccacgatcgtattcccacacacacccaatgccgtaggatggtggctcaagcaatacaaggtaacagatggattagagacatctgtgatgccctcggtgtgcaagcgatcttggaatacttgtagcattggttgtggatcaggtcattcggtagcctctccgccagctagactccttcgtctggaaataggagagttcatgtctctactccttgtgatcggcttaccaaggcctttttctagggtgtgtccttcctccttatcgatttggagaacccctcgcacccccacattgtcgctacttcctatggttggtggcactatgacgctgctagatggttgaccggctaagcaacattgggctaccacgctcggatcatggcattctttatgatcaacatgaggagactatctaccacatcctagatgtctccctggaatcctgaaaacttttgtgtacagtcctcggtgcaattcgacagtgttattgtatgtcaatcaacgggcactccttccacctccggctttgcaatagccagagaaagatcctaaaaggacagaggagagattttgacacggtcgttacactcggagcttgaatgatatggaatgagcacaacaatcacgtgttcaatcagatagagtggagctagcccaaggtggcaaaggcaatggcggaggaggcagcgcggtggcggctgtggctaggacggcctcagctcagcatatatagtgccagagtttaggccgcctattttcagtcacaggaatagaccaactgtgctgtttcttttttcttccccttttcttcttcatgttcttccttctggttttgtttttgtacggttcgttttgtatcaactttacttttcttaatacaatgatgcataagactcttgtttatttctggaaaaaaattcaatattcttatgatcaaactgcttaaagaaatgtagattatatgaccatagctcgctctattcctttacatggcaaccgaacggccagtaagcatccctgtcaaggggacagggccatcctctcttagcttattaatcctctaataaagaaagaactgggtcaaaattaaaggaaaaaattactcccatacaaggttgcacttgcaccaaaattcgttcgctacttgcacgcacagatgacttgcactgataacgacaacaaactggaattgctcaactgcagctagcgaaagactaaatcaaatttagtctgagaaagtatacaccaaagtctctgagtgcacgctcatttgattcctctcgaacaatcaatcgatatgcttgcttagaagattcgtctgtctttcagagtttcagtgaattgaacaacctctttttcaaatatatgttcatgtacgacggccggtacgacacctattaaatttggcccatcatacgcttgatcatataccagagcagagaagaagtactcacaccttaattctgaaaacagtgttgctaaataagtcctggatgctgattgatcaccctacctatccctaattcgttaatgcaagatggttacgttctgtaccaaggcgaacaccagtaccccactcagctcagggttaaccaatttctggttgctacgtgcaagagcaaactacccaaagagaacaactgaaacattgaatggaagtacacaactagagattctaagaataatactgtgatcgatcgttgtcttgtgcctatcaaaacttcgaaagtgtctctgcactttctgaacattcccacatcatcagcaactgcaacttgcgagcacattccctcccagtctgcaaccactactgctcgaagtgtccacgcaattacagatcagaagatatgatccatgcacaaaccgatgagcatggagtgagtgagcgaagcgaggagatcttttcaccctcgtgcttcctttcccagagggtgcaactgtgcaagtgcgagaatgcagacaagaagagagacgccacgccgcggttgcaagtggtggcgccggcgaaagcaaattgattgagggacacggtgctgtcaatctgtagatcactcaactcaccacttacccaaggcaaaagtgttcgtaggaatcgtactggggtatgagaatgtgatgaggtaagagcagagcacgtcaataatggccactagctagtagtagtggccgctctatgtcctgcctgtcgctgcatccactgatccacatgttcagtcacttgtgcgtgcatatcagccgatccgagggccgcgagacgtgtgggacgtatgtaaaatgtggcagctgattgttgtggattcaacttatatttgcgcctgtaattaaaaacgatgccaattattgccccatcggttaccctaaaaaaactaaaactaaagtcaaaatttaaattttgaattgattttaagatatgttcaacttagtttgtttttaatattagcttttaagttgttaaagacacatatataaaaattttcgcaaatcatttttctgatggctaataagttgttatggcttataaaatggctctataataggaaatcagtttttttaattgctaataagttgttatggcttataataaacttatgggtaacggacgaggctctataataggatagttcaggtataatcccagcttcatgcgatacatccccaaagattagttactcagccaaataaaacttgactgaaaagaattccggtagcttagcctccgcgtcgcccacgcgcgggtgacacaggggaaaacctagcgccgccgccgccactttctccccctctccctcccctcgccgctgccggagcccgccgccggataaccgagcggccagccgagatggcggcggcgaggccaaaccttgacggtgccccgtctcgacgcatcacaggcgggccaacgcgcggtgcggaggcgtcacagacgtggtgtggaggcggcgaatccggcgccgccgcggccggatccggcctccccacgggtggatccggcgcctccacgccggagctggccggagcaagccgctctcaggcggtaacgacgggaggtggaggcagcggcgtctggcggtggctggcggctggcggcagctagtggaggaggccggcgtgcgcgacgacgggaggtggaggcggcggctagcggcagccggtgagaggccggcgtgcgcggagacgcgaccgacggcggtggaggacgcggtgacggtcggcagcggaggccgcggtggcggaggtagcggaggacgtggtggcggccggaggcggaggccacggtggcggaggcagcggaggacgcggtggcggaggcagcgcaggccggcgcgaggaggccgcagtggaggccgcaacagaggctggcacgcgcgtgaggctcgtccgaggaaggcgtgcggccagcctggagtggcggcggcgtgcggctgcatttccggtgtcggcgcaggcctagatggtgcaaagggaactggcggcggtgggtcatcttcctcgttgccgatcggcaccctcaccctttctagagctcatccccctctttgcgaggagtttttaggctggattgaggcggccgcttgtcagtggggaagctcaggctgccgaagcaatgctacctagtcccgggttctccttcggccagatctggcgaggaggccggcgggtggtggaacggaggggtcctggaccagctctcagggatggtggttcgaggaagtcggccgacggcggggcgtcggtgcggtgtggtggcagtcttgtcattggcaggactgaaagctgaccgacggaggggcgccggtcgggtgtggtggaagccatgtgccgccgatgtttagatggtggattcagattgggcgacggaccacggcggtagggatcccgagcgaaagcttagcccaagtctttgtgccaacaatgactatgtcttcgggcgtggtaaccctcctgggggcattgttgaggtatccctcctccctcggcaaggagctctggacgaaaacctagtccagttctttggacggatgacgacggcgtcttcggcatcgcgaccttcgtgagggcgtcgtttttgagtcttcgtatcgtagtggtgttgttggccaggtggcaatcggtctcgcatagcgatggccggttcggtgcttggctttcctgtctatagtgtgtgtttgggcggttggcacttggttcggggcgtgtgctctggtgcacatccttcctcgacagtcagctgtcgatgtaaaacttttcttgtaatattttcttcctatcttaattacattgaatgacctccttcggtcattccggcaaaaaaaacaaccccaaagatttttatttatcttcaaatgaccatggagcagtggaagggaaacttttgccacgacccgaattctgaacgcgataagcttgctagctagcgttagtgggctagatcaaccctccaccacggaaacgccaacatgtgctgaccatgttggccaactttaccggccggggcttcgaaatggacagcaaacgacgagcattttctcgtgcgcccccgcccccgcggcccgccgcgatgtggcgcactcgcacgacgcatgcagctagcggcgtgcatcgcaattcgcaacgccactggatgatctctcgatcgatcgcgcttttccggccgccccaaccacgcgcatccaacacccgtacgtcgcacacagtcgcagcagcagcagcggcggctactagctcggatggtcgaatactcgtcgtacgacggccagtgcacaggcgcactcggggagctaatcgatctgacgttgttggtaggtaggagtagatctgtcgatcgacatgagggaggattatcggtgcacgtacaactgtctggattagcttatgcacgaatcatgatgagcgtgtcatgattgattctttcaattctgtttagccgatatgattatgcttgtagatgtagcagcaggtgtgtgcacactgatttatttttaatttcgctccaattgactggtagcacttgtttattgagcatttgatcgagccgatgatttcgatcaacttgaccgactccttcacttcggtcagagttgtatatataactagatgggtaccccgcgcgttcttgtggaagaattgtgtgataatatagtatatatgagttctaaaattttctttcttacctactatactatttttttatgtgcatgtttatatatttttgtaactttatcaattatacaaaggttataaatgattaggttgtatggtgtgcctttaggatgaagatgtgtaatttacactcctgctaaatcatccaaagactaaaaacaattgaggtgatgtgaagagatacattatacaccctcgatgaatcatccaaaggctaaaaacaattaaggtgatgtggcttcatgagagaagagagaattatcattaactatatttagtggggataaattttacagatatataggattactcctccgtctaaaaaaaactcaatttctagattttaaattttatctcacaaaaaactaacttataccatccaatctacccacggcatgtaaaacgagaaactttatctctttcaatagcttttaactacctatcactcttactacttttttcaatgattaatagcattttggttattctcacgcttcactatttttatcttggatgttaggaatgggttatttttggacggagggaatactcgattatggattttaattatgaacaggcaaagtgggattatggatacacttattcgtaatcatgtactagtaccaaatactgacacattaccttcttcccaagtgtatgctctctataggtctatatagtaccacgatgatatttggaagattctgattagccatctcctttaataccccttcattgtctgcactttgcagtacagagccaagccaacacaacccctagcaggctaccatggatccttaattatctctcttaatccccaaccgtctccaagctcaaatctcaatcaacaaggttacgcgcggcttaggttttaatttaattcaactgccaccaacacgcaccagtcaaaacggccaaatttgacatgtaaattcatcagccacaagcacacaattgcacaaatccatcattttcacttcattaaacaagctcgcaagtacgtgtagttcagggacacaaggttactcaccacctaggtatggccacagccatccattagcgaataaaaagattaaattaatccaatcgagctagctaagcaggtcatctaaccgcatcagtcaagcatgaacagggtgattaagtgattattattattaattaattacaccgtcccaaccggctttgtttgacttgtccgaccagctcgccagctacaaatacccgcgggaatggcgagctagcgcagaaggagacgcagaagcgcgcgagagaagagaagagaagctaagctagccatcaaggtctcgaagaggaagcaagagcgcgaggaggagaggaggaggaggcggcggcggcggcgatggggatgagcatcgcgcaggcggtggcggcgctgatggggacgtgcgcgaggcggctgtcgcgggcggcgcggcggctgcacctgcggccgcgggaggggatcgcggcgtcgttctcgtcgcgcgccatcgtgccgttcttggccggcggaggcggcgggaagaaggctatctcgtcgtcgaggaggaggaggaaggccggggcggagctgagcttccgcgcggaggacggggtgtggaggaaggagatactgatgggggagcggtgccagccgctggacttctccggcgtgatctactacgacgccgaggggcggcgcctggagcagccgccgccgccgcgctcgccgctgcgcagcccgctgccgtcgtccatcaagctcgcggccaacgccggcggcggcggcggctactagccggagatcgacacgtacacccgctctctcgcaggcttgcagcaaatctctgaacttttggagccaaagcttagccagccgccttcctctgctttcctgcgacatagtaataggtctctgcttctgatgatctgttcttcttcttctttttttttttattttacttcctttggtgtgcgtagtgattagtgatcactgatcagtatcagtaccatgtaaaagagtttatggaagcttagcttgatgctcttcagaagttggcacctctttttacggtcatcactctgattctctgaatatctttgatcatctagtagttgttcattagcatttactatccggctaccttttcatgtctttgtttttgtcgtattttttgcaccttgtttcttaggtagtactactactcttagcaaattaagaaattgaagttagtaaacgaattttcagagaacttatccagggttggcaaggacatgatggttgaaatggatcagtgtttggtggttggtgcatgcagtggtttgtctcgtgctagtatgtagaacagtagaaggttgtatctagcaagttggactagattattttctttatagactatcaactaccaataccattgttccattccttgttcgttgtttgtttgcgagatcatggtcaacccatgtcggatgtagtcctctacattagcatgcgtatcactttatcaagtttgtccaccatatcatttttcttggtaacgtggctcagaacttcggttctgcacacaaatcaaacagaggacaacctgacttgaataagtttactgtcaattttcatcttgtaccattattgagatcccagttgctgcgcagttgtgcactgatcattgaacagagggggcagctcaagtcccatcgcttttcctacaaaatataggagggattgacttaaacggaaagaattggttgacagaacaattcgggtggaactactcattatgcgtttccaaatgtttgttatgatccaacgtgcacaagcaaactctccaacatcctagacccacaattaattttccccagcatgctcaattataattaattttacagcactctcaaaaaagcttatgccttttttccctctaatataatcggaatataatcggcaatgctcttgccgttctcgttttttttttaaaaaaaagcttatgccttcccacctctgagctctgtacaacataacggaagaggatcctcttgacttacttctctctaactttgagtcactgacatatgagcctactatatagagggcccacatatcaatgacatcagttagagagaagtaagttagaggatcttaatcccaacataactcggaaaattatgcagcggaaacaacctatcctctcttactataaagtccactaaatcctaaagcataacatgaaaagataccacatcatcatccattaacaattattatatttaaacatcatgcaagcatattatattatttataatttattaaattttatagcttttcaaatgcaagcttgttaaatcatcatctcacataattcgcataatatttcaatgtctcttgatcatttttataatatcatatacttatatagttcatcctaactcctaacttagttaaaatgtgctctctctctctcattaaatcatatcacctcaattgtttttagcccttagatgattaatctatgatccaaactatctccctcattttcttctctcgtaaagccacatcaacttagggtctgttcagctgcagcaacactgcagcatgtaggaacagtgaagcaagcacaaaaaaaaaagcagcggccggccacgactggctacaggcagctgttgtacctgcaagccaaacatgcccttacttttcatttgaatcatcattctacatactatttgaatttgaattatcataaaccatatcaatttacgtaagtttatagtatctagctatcttacacattatttttactcagtgttatcatactaaactcccgcatcaacacacagggtccacctattataatgaaaacttgaaaattattgtagaatatgaaaatagatgtaaggcattatgagtgctcttaaacaaatctcaaatgttcatttttatattatatggtagttttcagatttacattaaatatttttctactcgcctaggaggctacagtgcgacacaagattttttttttttacgtcttgcaaggttggagtagtagtttaccgctcttctagtattttcctagcgaaaatggccaaatacctgaacctgataatgccacgaaaatggtccacgaggaacagatgaaatggcttgcctagttgcctgcctgctaggtcagtaccagcgaacagtggttatgcggcgactttatgcggccggatagcgttgcgaggagcaaataattcccccggaaaacgacggcgccaccacccaccccggccaacgccgccgtgaggagggatcgcgcatcgcgtcgcgcggcaaccgtcccgtctcgctctcgcgcgcccgtacgacaacgcgaaccacgttaattgaatgagccgctacctaactaacatttcacgcacaaaatcatctcgttaacaagaaaaatctggaataattaatcaggttgtcagaggaggcagtaggggatactagtcactgtcacaagtcgcaaaccaaaccatatgcgctgagttcactgccacaagcacacagaaatgcagagatcgccattttcacctaggctgtgtctagttcacgctgaagtttgaaaaattgattgaaattgaaacgatgtgattgaaaagttatgtgtgtatgaaaggtttgatgcgatggaaagttagaagtttagaaaaaaactttggaactaaacaggcccaatttatattttgtacaagtgcactcatgcgccatactggcacggcaattccaatggcgaaaggacaagatttttgacgggtaggcttgacatgtactactacaggctcgtgtcgtgcgggtgactcaacgcgacgcgacgcgggcacacgagccggcgcgcgccgcggcctcggcggtgtcacggccagaagcggcagcacactggcttgtcgtcgccggccgccttgccgttgccggcgtgccgcttcttgcccttccgcttcggcacggtcaccgtgagcaccccgtccgccatccgcgcgctcgcctcgtccgccgccgcgtcctccggcagccggaactgcgtcacggccgcgcgccgcctccccgccgccctctccctgcaatgccacctcacgccgtcgttttcctcctcctcctcgccgctggccttccccgccttggctgcgttattggcgtcctcgtgttcgccgccggcgcggacgcggaggatgtggccgtccaccacctcgacggcgacctggtccttggccagcccggggaggtccatctcgaacacgtgcgccaccggcgtctccctccagtccatcggcggccgggcttcaccggcgacgacgccgccggcgccggggaagaacctgtcgagcagcatccgcgagagcaccaaagacattgttgatgttctcctaagcttcttcgcgtgaatcttgcgagttcactccgacttggcatgcacgagtgttcgtcatcatttttatagatgcgagcacggtggcgcgcgagaatgatcgagaacgcgtgtacggacatttcctttgcggtttttctccccgtctggttgcatccggatgcgggaagtgtttgcagactcgcagggaggagcgcgcgaacacgcgatttttctggtagtttctcgcgttttcttcagcgtgttcttcgcaggggaagaaaacgggttaggggaacacagcgatgcagagggatcaatagatccgtgttatcgacggctcagatgattccacgcaggcatgcagacggcaactctgtaggcatggaactgaaggaatttgtgctaattgggagatttgacagattattggtgctgatttattccgttttctgtaaatgacactgcaaaaatcttgctctttttacacattttgcaacaaagaaataacgaatattgccatacgatcagacccagtacgtctaaataagacttaacttaccgatttattataacagtttgggtctcttctgacagattttacacaactgctggtccgcactgctaccggatggtaacaatgaggttcctgtcgacgaacttggcgccaccaactttgccctgcatcgccggcggcagctttacgacgcgcctctggtcgccggcttctatcagtagttctgatccacctctatactgcatttttcagacaaaacaacagattgtcgaaaacagccaatagagatgagtagtactgagatgatgtgctcctttgaatcaagaaagagtactggtaactgccttacttgatatagtttgatttcagacttatcaaagcccggcatgaaaagggtcaccgatttctgaacagaatcaaaactaactgaagggtatactttgttgcttgtattcctcagtaaatcttttgcattttggctcaaagaattcagcactctgctccaatctgctgaagaatcagttggcagaaatggcagaaacgagaaagtcatcggcaaaaacttctctgcaactccttggtgaatttcgaaacgctgttcggtataaccaaatgctccacatatatttccaccagcttgagttgtacatccccagtatcgcaatgcagaagatacagagattgatcttctagggtccatgatgaggaagcatgcaaattttgagggatcggcaaaccaaaccgatattctctaaaagaaaaaaaaaagcagatttcagctaactagttgaacacatatctactaggttgctgcacaaaagaactaaatcgggaaaattaacctgaataagttgttcaatatcattccataactctgaactcagtcttccttcactagttttaccatttggccttgcagaatcgtatattagtctcatcgcggaaggagaagccagtcttcctatgtcagtcttttctgctagatccttcacatacctcaagtaagacctgtcttttgtgtagcaccagcattaagtttagagactatctcctgtgggaagctaaggtgaagttggagcaaggaaaacctataccttgctctctcagtagcaccaattagccgtagaatttcctctgtattgttgcaatcatacactaccacatcaaattcctcttgtgaactattcctttgagttgaaaagaagttaagcagcttctgaagagctaacactgaacagaccgagtccattccgggtaagactccaagctcctcccctacaacctatcccatgaaaaatcatcaatccaaatgactgctttatcctcatgtcccataatacagcaaagttaaattgcctaccgcctcaaggactccttgagtaagattgatctgcgagtccactttctttagccggtcaaggggttcaagcagcatctacaatgtaaccatacaacattcttcagcatcatgaatcagaatatcattccagtttatgatataactatagctaaaacatagaggatatcactttcaagatagtagtttactttactagtctccagcttcatggtggaaagattggcagcgcactcggtcagcgagttaccgatcttacaacccatcaattgctctgcggtgggatcttgggactgtatgaccaagcatgtcttcaagccttcacttgcataatactaaaacgtggaaaagaacaagttaaaggcaattctttcatgaaccaactaaccaggaattgatacaaccatcagaacatattcagtatttcggcaatatgaactcgccatttaattttacctaatgtcatgctacattgtactcggttcaattcatggagcatcccggctaatgatcgataaatgatactacaataaatctaagtaatgtacagcgagctcacaccaaactagtacaattttccatcaagataacgacgaacgcaatcgatggagagaaagttttcacctgagcggcgacggcggccgcggtggtcttcccggagccgcccttcccgaggaaagtcaccagcttgggaggagcaccggcaccggcggagcaggcgatgaccagacgccgccggccgcggcctccccggcggggagcggcgaggatttggctcgccgccgaggcgagcaaggagggagccatccacactctctcagtggctttcctcgcgatccgattgggattccggggtctccggccgcgcgtgtgggc

SEQ ID NO: 59596 - DNA, 7784 bp, Oryza sativa
ccacctacagggacgcccccgacctgcccccgaagatccgtctcctatgcgagatcctggcgtcctcggcacccgacgtcgacgcggcgctcgacgacgccgacgtccgcgtcacctcctccgacgtcgagcaggtgctccggttctcctacgcccacccgcgcgccgccgtcgccttcttccgatgggcggggcaccggcacctccgccaccagcactccccctactcgtggaacctcgtcgtcgacctcctcggcaagaaccgcctgttcgagcccatgtgggacaccgtctcctccatgcggacccagggcctgctctccctggccaccttcgcctccgtgttctcctccctggcggccaacccggccagctccccactcagggcgttcgtggagctgccgatgtacggcatggaccgcgacacgccggcgctcaactccctcctctccgcgctctgccgcgcctcccgcctggacgacgcccgcgccgcgatccccgtggcgcgcgccgaggccggcacccgccccgacgccgactcctacgccatccttctggagggctgcgaggctgccggcgaccctcacgttgcacgcgaggtgttcgacgagatgcggcacgtcatcggattcgatcctgccaatgttcctgcctatgattctttcctcactacactgatttcaagtggttcctccacagcgttaatggatgcgatggactatcttgctatcttgcaccggcagaggtgctcacctggggagaagttcttccgcgccgcactggccgcacacctcaaggcgcgtgaattgcgcggcgcggtggtgctctggaacgactttgtcgtaaggcggggactcatcccagataaggaaatgtatagcacaatgatcatgctgcagggcactcttgggcatcctgaggtgattgttgagtaccttgatgagatgacctttgatggagtgtttccagatgcggacacatacaatatggttttccagttcttgctgaaggggaggaaactccgggaggcgtcggcaatatttagtgagatggtcaagaacgagttctggcccaatgaggcaaattgttcgctcgcgcttcgtatgttcttggatacacgagactgggattcagggatcaagttgtggaaatgcatggtggagaatgggcttccaccattggaggagagtgggaacatgctcgtatcaaagctaaaggatgagaggttacccgaggcatgtaaatatgcagaagacatgattgatcgatgtatcaagttgagctcttccacaatgtcaaagctgaagcaatgtctgatgaaggtttataaaggacatatccacgatcacctacttagaaaatggaaggcgcactaggtatttttacctcttctttgtggttaaatataacaggggaagaaaagctaacattttgcccccaagtagctgagtagcggttgatggtgattttctggttgcaactgcaactataggaacattatgcgcatagcatcagtaaaagttgcaaagcattggctcaaagctaggtgtacaatgtagtgacatatttggtaaggtagtttggtaaattaaacttgactctcctaatgtttttcttttgcatgcgtttcttgcgtagaaattccagtgttttctttgagttttgttctccctttcgacatgatgtggcgttgggaaatgaacatgacatcctggtgacaaggattttctttttggtttgtttgagaaagagagggatcctctcccatttctactaggtaaaatttgctctatgacacccagttttgtggcattggccttgtggttttctccatcggctgtaatagggaaacacactttcagctaactctatcaaatccaacttgagactgataaaagaagaacccatcttgaatctgacaaaaccatctccaccgtcatgcaaatggagctgagcacactccaaagttctctagtttctttccaactttccaggttctgataaatggtgacaaggaagtgtcataatttatcagtaagtaggaagtttactctatggttagattgccgtacattgtggcaagaaatgcacactcgtagtttcttctgggaacgacgtgtaccgactgaaggaagtgcaaagagaattcacattaaatattttgcaaatgatttcctgcatggttggcaagaagctactcacctgtagtagcatcgaagtgcttaattcattaccaaaagacagctaatacagaggctgacatttagtcttcactgtgacactgtatttgacagtgcgtactgctcagaatatgaaccgatatgacacgatatcagcttgaacaactttacaattgttgatctactcagcttattatgtcctgtggctacgaaatttgcaagaacctttcaacaaagtaaataataagcgacgatgagtcgatgatgaatggctgcatgtttgggtgcatcggcggagattgagcccccaaacaccccaaccaaaaaaacaggaccaaagtacccaaagaaaataaaatcaatgtggtaaatttttagttttacctacactatggtaaagaacaaatttatattatttgattatattagtttgaatcaaatgaagaaacgatttgattatattatttttattggtagtctgcttacatcggtaagtaatattaatcgtgactagctatattttttggtgcaacattttccaagaaaaaaaaatcaaaatgtataatgtgaatcacatatattacaatttcaaccatatatttttactataattttaaatcttagaacataatttttcgtgcttgtcatataggaactatgaaacaaataattatctatttgattaaaatattaatttagaataacatataagtaaaaagaaaaaatattttttataaaatgtatcaaatgttagaaaatgtatatgttatattcccaggtggccaagtatcctggtgtaattgtgcctaagaagaaagagaaaattgtcgtatggcatacctcgaggatattttcccgttgactcgacgtcaactccgactcctcgtggggtgtggatcccctagagttgatgctagaaccacctgatgtagttccagaaatatcaacctctatctgtttctaccagctgagaaattctaccaactgagattaatttctcctaattaactctcttaactagtgttgatttagtgagaaaaatattttccttttcaccaatgagataagcaacacatatccccgtgagatcggtttatccttattctacatattgaaaaaaaattgtctcgaacaacgctacttgaaattgatataataaaaacaagaagaaaatacatatgtttttttagattatattgtacttgcatgttacttttgggaaaagagtgttatttgttttagtgttggctggagcgtaattgctattatggaaggaaacaccttaaagaaaaggtagttttcctttaattctacactaatcaagttaactagatgaataccctgccgcgttgctgcggggaattaagttacataatatgtacaaataggattcaatataattattaaaactaaaacaaattgatacttatgaattttgagtctaaaaataattaagattgcatggtgttatgagagaagaaagaagagacaatttgaaccatagatctatcatcaaaaggctagaaataattgggacgatgtggcttaatgggagaagagagaaatagcattaactacatttagtggggatgaactatgtaagtataggattaggtgcgatgagtgccttaattgatctcattcgcacaagaagaatgactataaatttgccaaatcctcgtgtaagttgtcaaatgggccatgtattttcgtgttggcccgggcatgtatgtaacaatctattctcaaaatcacatcaacaaatatttaacaaatatttaggaacgagcttacctgtaaatttaattgtcaggcgcgagctctaacgattggaccttgcatagtaacttgagaagtattgtgtgtatccaaatgagtatgattcccgacggggaatttaactatttggtgcttttacggaccgtcactcgtgatatgccattcttctagataaacttacaaaatgcctagttattaaacagaatcggtccgctcgtttaaccagaaaaaaaaatcaaaaccaatgcctagttcaatgatataattgacccgcgaaaaattggttaaactagacaattttctacataaccgaatgaaaaccgggatggtcagaccggcaagcactttttactgaaaaacatgaagagacgcttggccgccgtttgcccgtaggaggggtaaatagttaaatttccctttcggaccctcgtcactcatcgtcgtttgcccggcgccgcccggccgccgccgatccccatccattccgctagcgagcaggggcgccgtcgttcgtcctgctgcttccgccgcatccatccctggtgagcacatcctccgccaccgccgcctgcgccgatccccatccatcccgcgagcgagcaggggcgcccctcgttcgtcccgctgcttccgccgcatccgttgcgcacatcctctttcccatatctctctctacccacgcacttttttctttatcgaatttgcgttaaccctagcttctgttctggaaatttgccttaaccttgatactgataacagtttgtttgttcccaaaaagtttcccatgttagacccgcccatggaccggttctagcgttggtatggagagcttccgtgatgatcagcgcgctggtcctcaatccgagcaacactctgatcatgtgtctgattctgctgaggatgcaatatctgatgaggtgctgcatctgctgatgttgctacagcatgtgaaatgtgatatgttatgctgctgtacctttttttttcgcccgcaaatttcattaacaccacttcaggttggcaggacatgcacttatgtcttcaatgaaattagagagattccaaatttctttttttttctcttggcaccagaccactttataagatgtacaacaagaagtttgttttatttttggtcttttttctaacaaatgtatttggcatctattaacaaaagtttgttttaactactaatagtgtatttccacttgtagcagtggcgtatgagtgcttgctgaacatgtgcctttatatattaacaggatgttcttgcaccaacaagactgtcattagcttgtgctgcttcaaaagaaagagagaaggaaaacaaaatggtggtgccagatgaatcaaccatctgggatgaagttctggaagaagccgatgagctagcctatgtgcacaaagttcctcctagtatatcattcctatctgctggaacaggcaaaagtacgttgccataaatcctatttatctactgcatagatatgtatattcttgtttgccttacggataaaggaggaattcggttttaggagctttcgtacataacaatttctgtttttttacactgtgagttgtttatcgtttcttcattgatacagggagaaaaggtgaacacaggctcaaattctcaatacgtggatccagttctgtttcactgaatgtgaagactgaaaacccatacattggggagcaagaagtttcatcagtaatgccaacaaacagagctcctgaaaccatgatggctgagcagttggaaaatatcaaggaggaaactgaagatttgccctcagagtttgcttgttcaaccaagaaagcaaatgtttcaatttctgaacttcttgacagtttacaggatagaagtgcctcctctgctgggacaccatttttggttagtgtttagttgcgctattttgttatttggagttcttagacaacgattagcttgtctctaaatattatctcaacgcagttgcatcaacacaccagacctaaggaagaaaagccaaaggtccctacttctgtgaagagaacacttgcacttctaggtcagaggaatcttgagaccgagaatcccttggagcatgtaattggtgaaacatctagcgaggaggaagtaggttgttaacataaccaatgatataaatacttactctattatgatcttcaaaatgatatgtttatcctgcaataggacgatgctcaaaacaacctggctttgatcaacaaagatgtcaaggggcaaactatggctgacatatttcaacaagtatttaatgcaacaagcatggactgttttacactgcccgtgagatcatatgggtataaccgtcctgataattatcttccgaatgatcacttaaatatctctggttgttcacatttatttgttttatgtatctctgtggcagatctggttattatggaaggatgcaacaaattctgcagatggagaaagataggcatgctgagttcctaagacagtataacagagagcaagattatttaggtgcgccttaatcatctgtagctctgtactaccacgtacatgttcataaataagcttcactagtgcatatacacattgctgaagtagctactcgttgtatttccaggcgatccaaagggggttacagttcagattttgtcaaggtctctggaaggaaagctaacaatctgccgctgcttgttcatggagaagagcaatgtatgtggttcatctctcaaaaagaactgtttggtttttgttcattttgaccaattgtgaagcactcaaatcctgcattaccagcattttgtgctactgatgtttccatggtacttgtgtttcagttggccacaacaggggaagtgtcaacagatcttgacatggataatagcagcgtgaaaaggaccatcatcttcagtcccaagatatgtgacaacgtggatcttctagcaggaaacattattcacatcttcccaccatggtttgctttttataatctgtttctgcatttatttttgccgatttctggttgagaaactaacaactgcgctacctcaacaggaaagaagttaaggtgaaagaagagacggtgattctttgcacctacttctcgcatcgtggagtttgatactacttgagatgcttcttttttagatgaatttatcatgagtaagaggaagcaacgattatgcatgaccgtgtcctgtgtatgttggcgctcccgagtcccgagtcactgcacgacctgctgacctgatagtttagaagttagaaccctcctgatgaccacatgatgtagccgagtttgtacacagcgtactttgacacaaccagtatataatgctaatacatcattgccttttttattctggaggagaatgttttttttttaacacaaccagcagcattgccttctttttttggagggagaatgattttcttttctgaggtatactctctgtattcaaatatatgaccgctgttgactttatttggttagatttttaatactttcaaattcaatagtacctttcaaggtatttagtttggaaacgtgaaaatcatatgggtggatttttctttataagtacttataccatataatagaatagattagatattatttttacaattgttgtaaaaattgcatgccaaaaaataactaaattcaccggtgtcacgtatttaaacacaatatataatgatagacatgacgcaaaccagcacacattcaactggaagctctcaaaaacaacagaaatgataagactgctaatcgatgtaaaatttctatagctcagcaatatcaaaacaaattagttcgatacaaacaa

SEQ ID NO: 59597 - DNA, 4048 bp, Oryza sativa
tcaggggcagctgattccgacgatgtttccgtggattcagcttctttggattcagattccgaagagtcagttttctctttgttagcagactcttcttccttgggaggtttcttttctatcttgggttttggtttaggtatcctattgacactagaaacctgcagacaaagatgaatccccaatgttttgagagcggtgaaacatgtgcatattattctagaatcttaatatgaacttcctaaccttatcttgtaggtccagaactttttcgtagacttcttcagatgtgaaagcaggtggactgtagacaggggtgctgcaatatgataaatgggagttagacacatatacacatttaaatgtagaactcgcgaaattgtgttggctctagactcagcataccttttctgtatggcttccttctcctccaaccaagtttttactttctctgcttcacttacaacctagacccagatagcatcacaaccaataaaatgagaatcacatcataaccagaatgaatttatcgaacttcattaagctcactggtttacctcatctaccctcttttttggaagccacggtttgttcgagtcccagttcttaacaatctgcaagaccagaaagtgttacagatgagaatagagtagcacaacaatcatgaagttgagcagcaacaaaaacattgtttggtcttctgtatagataccttttgcaactcagcaaaatacaatctagcattttcacaagccgttggccgggcttttagctcgctcaatctgggcaataaagaaaaaaaaaatcaatgtcagtcaatgacctatatgaacctaagtggatacagagcaagttacctgaaaagaattgggtcaccgatggccttaagttggtcaaggcgttccttgaattcatttgcttgagcatcttcaccatccatatacaaccaatcttgtacctgcacttaaacaatctcagcatgaggattcaacagacaaatgaaacccaccagaagattattattgaacagacctcattaagtttctctgcaaaagattccctctcctgttcagttgagacggtcaaaatttctgtgttctcttccagctgtgatgtgccaaataacagaaaacaagtagtcaacaaacataagtatagcacctagtaaataataactgtgctaaacgttatgaaacttttctgtgtttttctagatttatgtagacaatggagttcctattatcagtgcaaagctgaagttctgaggaatataataccctcaaagatttcagatatatcaagaaacaagaggggtcatgtgaatggcagtaacatgttttatgctattaacactgaaggtagaagagaacagaaggtaccttctccttcatagagtatatgtaagactccaggttatttttcagttcagcagttctcctcctttcagcatccttcttatcaagcgcctctaacctagtttttgcttcagaatacaactccttcgaaagaattgatccagcaccagccatcttttccacaacctgccattggacaacatatttattaagtcatgttctgtcaatattaacaccagatttatgaccttctatctttacctttaacgggaccctgaatgttcttttcttgagcaccttctctgtaacaatatcttgtgcattactctcatctattggagcactggacttatttgcatccccatcagaactcacattctccttactgtcagatgtgtcattagctgctcctccttccgaagacaaagtctgactggtggaattactctctagagttaaattcttctttggaacttcaacccattcagttatctcaatcactgcttctgccctatcaagagaaataattccgctcctactcaaagaaaaatgtagatttgccttgatgggtgcagataaattgcggctactgtacctgtttgaaataaccacatggttaaattcatgcagtgaaattaaacacatacaaattgccaatggcaatggtgttgagatattatttagaaatagaataaacatatgtactgcagcctcgaagatggaatgttccgcccccaaaaaaatagcagttgaaataaaggtactctatgttcagcttgttataagcagtaccatgacacaaaaaaagtacataagatgatatgcattatgcatgcttacttttcgcttgcatctgtcaggcctgatacagaatactccacaaatttgtgtgatgtaacacctggaggcagttcagaagctttttcatagctgatagaaacatcgaagtctttagtatgtctaatggacctgaacatctgtagacaacaaaacaattgcaagctagattattttttaaaaaaaacttttttttttgcatataatcaaaaggaaacaagaaaggtgcattataaccttaattcccaattttttcatccttggcaccagtaattgatcagtgctttcatctttgacataatctgggccatttatttcaaacacaaaaccataagtagaaccatcaatcatccctaacttacggttcaacttaattccatcacttaagttagctgcatgcagtgaggcacccagaacaattgcttcatctgcatcaagatgcttatccaggtcacttcttcccaggaattcctgcagcttagcctgtaccaggagaatggaattttattacaaaaataacaaggtgaatgatggaagcacaactgtttcagaagtacagttaagtcatctgcatagtaggttaccgtggttaacaaatgcctttgagatatgatagcaaatttttaagatgttaactaaaagtaatggattgtattaaacttatgatgagaatcaagtgacaagagagaaataaaaacatggcagtcatgtgcctgaatgccattagagccccacaatacaaggtcaaacataaaaacgagttcagtttaatcacctgcaattttggtactcgagtagctcctcctattaattctacagcatagatatcatcaatcttcattccagaatgtgcaagcacttctttaactggagttagagcctgctcccataattcttcacaaagttcttcaaatttttcacgtgtaatggtactcctgtaacaagaagcgaccattaattcaacaagtagaacctagaaaattgtcctgactcctgatcatgatttaaaactagaaaaagtttactttgtacagaaagaaatcaagaaaagatgaaaggaaggcagaacatcaaccattatagaacaatacagtaaggaagaagggtcgactatgcttgcaaagtattaatattggcaactactgtatagattaagaagccagtgtgtttcactatcttccaggttccgatgttccgtgcaatcaatggatatgcaaagtattaatattggtacctactgtatagattaagaagccagtgtgtttcactatcttccaggttccgatgttctgtacaatcaatggatatgcaaagtattaatattggcaactactgtatagattaagaagccagtgtgtttcactatcttccaggttccgacgttccgtacaatcaatggatatgcaacaaaggccaatgcagaacatcaatggagtagctacacttcaggccacagtaaacaacctttgtagctcttaacgaatttgttctaatggaattgcattcatgtaattcaaagataacaaggtgattgatttaattgaaacaccggtcaggtcattttagcagataagagacaaagcaccagccacctagcatgcatgctactccagcatagtaagttgctatgcaagaatttgccaggctgacaagcatctctaattttcaacaaagtttcaattgttcataaccaattaaactcgagagcgttatcttgaaggcttgaacagagaatccaaaaatgttaagtaaatttccatttatgaatttataaatatcggtccatattacatgtgtgaagattatgcaagtggtgaggacgcacctgaaatcgagatcattatatagtgattcaactg

SEQ ID NO: 59598 - DNA, 2702 bp, Oryza sativa
ttaactccggcaagctgcgccgcctgcgtcaaggcccggcgttcggcctgcccaaagtagggcggaacggcgacgacggcgtcacgcacaggagcgccgacgtgcgcatccgcgagcccagcggcgtagtggagcaccatcgcgacgatctcctcgacggtgtagacctgcccgtcgtccgcgcggaccgcggcggcgccgcgcgcgtcggggacgaggtcgtaggggaggaagagcgcctccgcgacggaccgcacgtaggggaagggcttcgcgaggaggtcccgcgcgcgggcgaacaccttggacgggtggcgcgcggtgatgccggacgcctcctcgccggcgagccggttgccgtcggcgagcgcggcgagcgccggggacttgcgcttcgacatctcgttgatggccaccgcgatcgggacgcgtccgggggcgaggtgcacggcggccaccttgagccactccgaccccaggtcgatgctcgccaccgccgcctccgccggcgggacgaggacgacggcggcggccgcgacgaccgcggcgaggaggaggaggagacccgatgtgcggggcggcgccatgacgagcggcggctagtagaatggcatgcggggtgggggggttagggtttggagatctgggactagtgtggcggatgcagcacacacggtggaaggggagaggagagagcagcgaaggaggggagggggagaacgatctcgacggggaggaggaggaggagaagggcgtgtgctatatttgcaatttttgtgattgtttttcttgcgttcggagttttttcgattatgaccctgaaaggttttttctgatttcgagttgtgcgttgctgctgaaggtgctttggattcttggtgaatatgtagaaaaaattgagggctcatgtgaaaaaggtgagaagaagaccgtggcaggaacgtcacgaattgagtcaccagtccaatgaaaatacgacacgtggaaaaagatccacatggcacgccttggctagcgtggtgcgctggaagagcgagaggagcgtgtgctagaccgcacgtggaagtctcgtgcggcgactaccgagtttatcgagcgtcacgtcacatcaaacatgccagtaccgtcatggcgggaagcttgtacagtaaaaacgtaggagtagtgctagtgtgtttgtgcagtttaaactgtgccatgataaataaggaaatcattcaaattggcgaaagcatttttgggatgataatgaaattatgttactgatttttttttcatctatcactggtcaggtattgctaaaaaaagtgtttgataaaatactactagtagtaacttgcaatcttgccagcatctgaaaaaggattgttcacctgcaccgcacaagccagaatgcaaaagctttgcccaatgagcactacaacgctgttcagtgtcacactctcactgcactgtctgctcagtaaagatcacaggtcaatctccaagaatgcacagcggttgtctcatgctgagctcaacttttagtcctggaaattgtgcaaggtcgttgcttgttcccaaaacgttctgccacaaaaaagctacttttaaaaacatgaacaaataagttatatactacagtgatagaagagttgtctgatcattaatagcaacacgaattggggtttagcaaatgaacttacaagtgcagcaagatgagcttcttgtagaatactgccatcaatctccagtctagctattggaaactctggaagatgccctgactgtttcttgccgagtagatcaccagggccacgcagtagcaggtcggcgttagccaagtagaatccatcggatgacttctcaagcaccttcaaccttggcagcgcgctaggagtggagcataggaacacacatctggatttcctttcgccacgccctacccgaccccttaactggtgcagctgagacattccaaatctctcagcattcatgacaaccatcatggaagcatcaggaacatcgactccaatctcaatcacttgtgttgagaggagaatacgtgtttccccggatctaaaactgctgagggctccatccttctcatcgctcctcatgcgaccgtgcaacagcccacagggataaccttcaaatttttgctttatggaatcaaactcggcttttgctgcatgaagttgtggtagctgctctgattcttctatgataggatatacgaggtagaccttgcctccatcaaccagttcatcactcatcatcttcaagccataagtatttaaaaatgataagcaaattgatcccaaccatatccaagtgcagattgggacagaaaaggaaaacaacaaagatctgaaacaaaaagaaaaaatattgaatgaagtcatgtcatcacctggaagacagattcaaaaccagcatcatttccttcaagagcaagagtttctataggttgtcttcctggaggcaagtccgtgatctataagaaacgtggatcacaattgtaaagatttgaaatagctgtgaaaaatgaaagaccctactagttgttaaagtaacaggtcctggaacatgaaaaatgaaaaatgcaagaacatttttgcactatatcctatccaatatgtgaagtcataaagtagcggatcctggaaaacaacagggtggactactagttgttaaagatataattgtgctagcctagaatt

SEQ ID NO: 59599 - DNA, 3443 bp, Oryza sativa
agacaagactatgtcaaaattcaaattcataactagagttgatttagtttaggacggagggtgattcttcgcatgcggttgatcaactggcccccgagggaccggtttttgtaggcacggtcaattatggtccgcctgcaatctattggggtgatcgtctaggaaaaccatttgtgtagtagtgtatgcagcagtgtctgggatcatgattttgcttcgttacggattgaggtcgcgaagtgaatcggactaaacccacagactgacaacgtaaacgttttcaatttttaagtatggtatgatatgatgatagatatagatgcagggtcttcgtttttgtgctgtcactttatgtcacaggctcacagcaatagtcttctctgtaattgaagcagggcttccacatgatgttcatgcagccggccactcgaccaacttaaagcctcagtagctcagtggtataagcatcaggaggttgccgttgcacatgtgaactgtagcatttcagatttgtgcagattgttttttttagggaaattactaccagtcaattgcctagtaagttatatattaataaaccaaaatattaacttgtgcaacttgttgtcgtctttacttttagccacaattagttattctatcttctgatgacaaatgcagttatgcactcgagaaattttaaatatctacccattcttgcagactgaacaatttcaaatatgtgtaacttgggatctttccttttaaacccttctctaaataagacacattttttttcttttataccagaggtaagtaaggccctgctttcacggaaggcaaacatgtatagtgtttttttatgctgtggataccagctacatgccagaccgaaaacagagaagggctcacaccatctaccaaaaacttcagaacccttaagataagcatacttagggttctacatcctggggcaaaccccgagatactccaggctataagcaagacaccaataactgacatacaactattggaattaacttcattagcgaacaaaaggtcgagatcactgcagattgtctacagcttgatgcagcaagatttcggcatttccagcattattccaagttcatcaggattcaaaagcaccttccaatataccgagaaaatgacgcaaaaaagaaaatcacagttagagggctggaaaggagcttggttttaaatatcataccattgcgcacaattgcacaaacaaaagaagccaacaaacagcagaaaacaacatcattttaagttttaaccctattcttcctagcaccagcccccgattgcctcaatgaagtagtagtgtttagaacctcacggcggaaaatttcatccacaagcattgcaacaaatataatacaccaaacaaattgtgcaatggagcaacagaaaagcattcacggttttcagttatgtgatttttctcataattttcaagaaaataagacgatcgtgcttacaattttcaatcgttcgaaattcttgcagcatggaaagatgacggctaatccctgcatgaagaacaggtattctgttcaatgaatactgctatctccttttcttaagttttggtgagttaagtaagtatttcaggtttgtttcagacctcgccctgtttgtttctcagaaagaagcagatggtaaataaatggtaatcaattggcaagggggcacagagaggcctggggcatttagggcttgggaaccaggcttaaccctataaaattattgagatttcatcaaaataccatcaaaattgttgaatctacagaatgattagctagaagagttagctcagccctacgcttgatctattcctagcttcaccgcctgttggttggtgcttggttttttgcccaccttgcactcatgatttattttgtgcctactaaagagcaaggctaataatacagaagacttgttagctatataagattctttgcagccttctcttagcccacacatataatagttagctatttacaactaatacagggctcacttgtctctctcacagaatttgttggttcttgcgtccaatcgagatataagtttacagcccgcttctcctctctctcggtctctcctctcctctctcctccacctcagcatttagccgacttacatcctcctattatacttactctaagcattatgaagcttttgccttccttcaatatgaaacctcactatggttgttcgatgaatccaatcaagcttttttgcactgttttccttttttgtctaatttaacttcaccaattaaaacccaatatttttgttggcggcattgagcttagttcttcctttcaagaactaaatatcaatgaggactggtatctcttcaggtcagatttttagatggttcatgtttttttccaaatccagctgataattggttgtgctatgtgctgaataacacaagggttgatacaaatttgcaggaaaaaaactctagctagcaggtaattgaccaatcaccttgatgttattttcaaacctataatgtggtgtaaaatttagttttctcataaataaatcattccatcgcatatctgccttttatttgatgaaaattataacctaccattgatttcagtcaaacttttgttattgtgtacttccctttgggttttttcttttggagcaaactgttggatccagtggatcattctggtaaatggtagtcatattgtgcttttacttgcagttgcatgcttgcatttgcccttgcatatgattgcatagataattttcttttgaacactacacatttagggatttcagttttcttagttgtgacaaattataataacgaatggactgaattgtatgttttgcaagctcttttcagttctactgttggctagtacgtgttggcgcatctactaagtgaaaggttaatctcacgacgtcaggaggatgtgccacgttatacaaacgttattagccgtcgatgctaacagtgaaataatgtgtaccgttggatatagtggcaaatagtaaaaacaaagtgcatgcatcttcatgagacttctagacttccagtagaagcctctcagtccacaatgagaagcccgatctgagaaagcccaagaaagaaggtgaggggaaggagaaaactaaagaaagattgaaaaaaaaatatgatttaaattatccagacttatgtacgtataatacattgaaaaaagttctaagaagcactctataatgttgataattttcaatgaaatacaatgagaaaaggagcgagtatgagattagcatttgtgctatttcttaagtctagataaaagggtcatgcaataatagagatggccggaaagtgggctcaagttgcagggaacaagatggttattcatactccaatttttaagtcaaaattttgttggcacaaaaccaactagtgtctttgg

SEQ ID NO: 59600 - DNA, 3319 bp, Oryza sativa
ccagaaagatggggtggggtaagggggggggggctccgggacatcgaagcctctctccggaggtacactttgtttattccggagctcttccccaaacacattttaacgacatattgcaggatagttagagttgtgtgaatgcacgacttcattatatactggccatgtgattgatccacgtaatgaataagaaaaaatgtttaacagcagaggttatagtcgcatgaatgtgcgactgcatagattagtatttcttgaaaccggaggtcagtgcagctctcaacagatagatatggtggaacaattttatttggtcagtgttgagtttccttgacatgcactgtgcattagtaaatgtatatgctctacacacagaaaattgtaggctttttcttgacagaattttatttgtttgtcaagtccaacccactcagcatcaccaagacattgacagtaatcaattcccaaaactaagggtctgttcactttgatgccattttcaaccttaccaaattttagtaaagttgccaaaaaaatggctacatttagtttgctgccaaattttggtaactatataagaaatcctgccaaaattttgacaagttaccaaaattctggcaactatgccaaaattttggcaataacaaaatttggtaaggtttcttttggcatcaaagtgaacagacactaagttttttggagctcctgaactgtatatctaaagtaccgaaagaactaaagtttcttgcaatctggttaggccacgtcatctaaaatatatggaccgtctgatttcccctcgagacaacgtgagtcgttcgatccttcacttggtgtaacctcttcgtgatactccgagaaacttctttttgcaaatagatccttccaggtccctacgatgaaatcgcgattcccctttatctcgtcttctcctcgtcacgctcgcgccgcatccgctcacgaggccgaatcgccctcgcgcctcatctcgtcgtcgtcgccgcctgcccactgccacctcttcccctgccatgccgtcgcctgctctgcactatcacctcttcctagtccccgccaccggcgccgcttcctcctcctcgtccctgccctccacctccagcccccagccaccgcctcttcctcctagtccccactggtactgtcgcgccgcctgcacctcctcgtcctttctccatccctagcgccacgctgccgccgcttcctcctcctgctcctctcctcgcctcccttcagaaagccagcttcaaagcgctatggcacatcccagagcaatggcagcatggacgcatgtgaggacacccatccgtcgagccgaccgtggtaaagctttcatcaaggtgctcgaggccgactccatgtgagttcacctgatctttcctcctgtttgctactccagtatttgggctgaatgtatagctctgctcctgctatgagattgatgagttgcttcacatgtccgttctcccaaatacgttgaactcggtgctgctcaaatacaactggcagtgttgatttgaattatggaaccataatggtcagttacttagttgtttgagtttaatttccagaaacatccactattatgttgtaaaataattgaagaccggacaggtgaagatgatctttcgaataagccgatagaaaaaaaaatatatgggataccttctggctttcaatgggcaaaacctaacagaagacttattcagtttggccttggtgaaatctgtaacctggaaacatattgttttgttttcatatatgatatatgcagatccaacaaatgctttggttattactcagtatagttgaattccatcactcatcagcccgttaaagaatactgttaattttctgaaactaagagcaatgccattacttaatctctattcacttatgaataggaggttttgttcttatgggaaagtaggtttcactattgattcctcaattttttgtagttttttctatgcgcgctaactcagcaagttttttatgggcctaattgttcaaagacagattcttttagactctagattgaattaaatttggatacttgacatgtacatatttttctataattcccatctaaccatagcttttgctagcagactacaaaatagaatttcctagaacctgatttgtgattataacattttgtacataacaggtcgaaatcagatgtgcatatgtaatggctcagttctgccgaccattaataaatttctgaaggttagaagtttcttgccaatctcaattaattaacatccaaaatatcaagtgtgatggctgctctaagttctaattgtttgtgtatactccaatatcgctatgaatctgaacctgtatgtggttaacattacagatttgctatgattgattctatcaataatgccttggcatttccctttacagtgtttgaaggcactcaaagttagatgccctttttgcataatgtaagttttctctggttattgaataaccatgagtggtttttgcctgactgatgattctataaaaacgagtggccactgatcaagctttctatcctggtgttatcttttgtctgacgttatgtaatttgataacatatttttttgtaacataatttgatatagaattttagtttctctaatcattgagccataaaccttttgattcattgactaatttatatgttaatgtgagaacattcttggaactatgaaaatatggcgaagtcccaagtattggaaaccaaaagcaagaggttgatcttgaccataatatttaaaccttttgttcggaacataggttcatctcgatatataattctagctaaatgtttatcaagttatgtaattttgaaagagaaatcaaatttaaagtagaatccaaaattataatacgtatatgtaggtgaatctaacatagctttgccactggctttagtggcttaagtggttttttgcctgactgatgattctataagtctctcgagttattactgcgaactactacgtactccctccatactcataaaggaagtcgtttaggacagtgacacggtctccaaaacacaactttgacttcttattactataaaaatatttattaaaaatgatatatgtatacttttatgaaagtatttttcaagacaaatctatacatataatttttatattttcaaactcaacaacttaagagtaattcatgatttatattcccaaggtttgacttaaacattctcctaaacgacttcctttatgagtatggagggagtatttgttaactgtcaagtagtagtgtctacagtggaatc

SEQ ID NO: 59601 - DNA, 1880 bp, Oryza sativa
atttaatttgacatccctaggtccttttttctgatggattcaccacttcttcagagtgacagagtgtggttcttatgtttcatgcagcgaagtcatgtgaagtgcacatgatggccgacaaggttattgcttattacatggaccaagacaatttgatcaagctattcaaagtaatcagaagagaattcaaatcgtcgtcctctacttttaagaaccctttgttgccaatagatacccacagctgacaaccggagctatatgttgtgagcaaagacatgtttaatctgcacaagttgatgccctgtctttgtttacacttcctcattctcttctcatgctgtaatgacttcacattcaatggcagtatctgctcctcgattatgaatggtggcatgagtgtctggcgccgattcactgacaccaatgacaactacaacgccgccgccaattacatagtgctgacaaagtgtcaattgcctaccacttccagcccaccaatatctttcgacgatatgaaatatggaaaccaaaagcctgttgatcctaccacatagaatctcatattataaattacaggttgtatagagaggcttttatacaggtatacaaagtcgcgcaacgcgcgacaaaggtggctagtaggaaatgaaaaaaataatatttacaatagatagcctaaaaaataataaaataataaaataataataataagaaaacaatagatagcctaaaattgattccccataatgaaaagtgggccctcactttaactaccaatagagaaaattagtttttctgctccctctatgcgcgcactgcgtggccagctcctccttcatctcgcatttttttctccgtgcgcgcacgagagaacgattgggaacaaaaaaaaatcgctcccttgaagtggggaacgagatatctggagttgggaatctggattattaggagacatgttagggattctattggatgcgatttttgaccaaaattttctaaatctgaggatgggaatagaataaagaactattggtcatgctcaagctctaaagtcattcctaacactccatgttatctagtgtctgtagcattaaatacattatcacgtaagaaaaaatatgatgtgacaagagagttaatgagaacggaggtaaaaagatgaaagaaccatttctcatgcaagaaaccatctctacacaagaaccaagaatatgtggataaaagaagagagaaaagaggtgattggatgagaatttaatttgaagacaccattcattggatatatatatatatagtgtctatacatagtgtccaactattcatgttttataagctaataacaataaaaatactaatcataaacaaatttaaataagacgaacgattaaagttggccaaggaaactcatggttgcgtttattttgggacagatagagtaaagaatataatgttgttgcccctgttacatttaaaaattagactgtgataacatcaaatttccttttgaacactacacattgtcacgatatagcgttcaatggttagccccaagtcctaacacacaccaggagggctggacagcacatggctagcaaatgagataactgcagtcagcggttttctggaaaaacaaaaatgatagaacaaaatcattgcctagctctgattcagcattccatgtgttatattaaccgtgtactgctgtttgatctcacaagcatcaattagtcgattgtaacgcactaacaggaaatataatttgtaattgtgaccttcaacaaccctaattgaagaaaagagctagttctttcttcccatcagaaattggtttgattccactcacacaatccagacttatgagctaccagtggtctcaaagg

SEQ ID NO: 59602 - DNA, 4555 bp, Oryza sativa
tataggtaagtttggtttgctctgattttagaaaaaaaaaaggaaagagaaaatagaatagatcaaaaagccctcgagaagattgaaaaacattcggtcgaattggatagggaggatcagccccagtattgtattgacacgggactactttcctgagattgaagacagtggtaggatgtgcaagctgaatgccgaagagaggtagcttactagctaggacgtagtgccgaagagaggtagcgtactaggccggggctgaaaaggaagaaagaaatgggctttcgactcaaaaacaatattaatttttattaactttttaattataatgtatagtgatcccaatgttttaatttattactcagctcctaatagttattgtatataaaaaaatactttacccgttgcaacgcacggtattttttctagtaatttaacaaaactaatttggtaatgtaaatattactatatttgtctataaatagtagaactaagaggttaaatccttcctggcgatgcaccgtgaatagcctaaatattgaatcacaaggcagttgaataacaatctcagttccccaccaggaacaacacattattaaagattattaagaggtttagttggcaactcaaaactggatattatcagacatgaatttcattttaacagatagaatatttcgattctgcttccaaatttcattgacatgatggtagatgaaaatctagcctgaaaatttaggcacaagcatgaaggtatccagcgagtaataattgagagacataagatagtactagtaggattttaggatttgagtttacagacagacttagtggactttttatttttgttattatattattattgtcaagcaactcggttatcttttcatgattgccactagtaggaagtaaacacaaatccaccaaaaaaaagagaggggggattcgtaagaattatgctatctaagtttatttttcactcattccatatataccaatacaaataacaaaaggatagaatacctatctgatcccaatgcaactcccctatgagcatcttcgaagactggccacgcacgcacactcacccctatgagcaatcttcgaagattggatcggcaaatctttgagattgacgaagtcaccaccgtcactaaaagcacaatgtcgttaaattttggaaaattcgtttttatgggaagttgaacccataacctatggtgtcgttaaatcttggaaaattcgttcttatagagagtcgaacccataatctaaggtgctactgaggctcttgtaaccactagattacatgcgctttcgcaactattactcactttatttactcttaatacaattattccctacttttgtaaacttcgatacaattattactcaaaaataaatttatttcgaaataaatgagaggagctgatgaacccaatcaatatggaacatactccctccgttccaaaaaaaaaaagacaaaccccgcgtttccgtgtctaacgtttgaccgtccgtcttatttgaaaaaattacgaaaaaaaattaaaaagacaagtcacacataaagtattaactatgttttatcatctaacaataatgaaaatactaattataaaaaaaatttatataatacggacaatcaaacattggacacggaaatctagggtttattttttttggggggaacggagggagtaggtagtacattggaaattagaagaagcattaggagagattgatggcggtcgctggcaagataggagtagtagagtcgcgggagagaaaggagggaggcgagcgagacgagaagatgatttgatttgatctgattttggttaattttgatttcgatttgatggtacgagatacaagacgagctggtttgtccacccacgcacggcaacgccggtcggtcgtcgtgcaacggagtacgtgatcgaccagggtcggagtggcatgtgcatgcgatcggcaacaacgtcgtgcatctgcacgacgggtccgggtcggactcggacggattacttccccgtccatgtccagatttccttcgacaagttaaggcgaagctactggggcgcggttccgggagcgcttaagtcctaactaacctgttttagactctaactaattgaattagttttagataatagtgataattaagataagattttttttgaacggaatgtttgttgttttacgtcgtgcatcatttctctatctccacatgctgctagctgctgaccaccacgcgtgcatgcatgagccatgcatgggggcggcgggcgagcacctcgcaccaccttaccaagaatcgccgccgccattgctgttgccgttgccgagcatgctgctattctagaaccctgtggtctcatggccaccgatgacgccgccatcgccaccttggttcttgccgtcgtcgtgctgatgatcaccgccgctgttcgtgtcgccagccacagcgctcaccaccggcttcaagtcctcgaaggggaacaacaacatgcccaccgcgctctcttgcaacccagcactgcacgcgccgaacaccccggagccgccgcctgcacccgcgccgtgcgtgtcttgggagaaatcgagcacggtctgaccttgttgctgctgctgctgtcgtggtggcggcatgcggaactcgccgagatgtaacctcgccgctgcatactccgccaacatccctagcgactccatctgaggcagaggaatgcagtagctgatgctcctcagcaactccatcgccgagaacacgcacccacactgcccctgccaccggcgccattcaccgccgccaggttgcctccggggttgcacatgctgctgctctccaagctcgggaacgccgtgaactccagcgactgcagggcgtggccgtggtgttgcgggaatgctaggttgaggtcctgcgcgccctcgtgcatcagcttcaggttcttagccgccagccccacggggaccgagccggacaccgccgcagaggaggaggtcgacgcggccaccgatgacaccacgaggacgacgagcgctttttctcccgtgccattgccgtcgtacgcgcctccctcctcatcgtcgctgtcgtcctcgtggccgtcgccacgtctccaccaccaccccaattgccgctgcaatcgctaaccctagaaatcacacaggtggaggatttgggggagaatggttggatcggaaatgggggagccaaaatgtggggggctaaaatgcaagtatgtttccaccgtggacggccacataagcaagtcaacccagtcagaggcgctttagacctaaatgattcacttaaataagatcgcggactcgaatgacgattttcctatatcatagaactaagtgacacctcactccaactttaagtaccggccatgtactttactctttaaaaaaaagtacgaatctatcgtggtggagggggtatacaataaaccaggagcgcacggcgcgagacatctatcgtggaaaaccttgcagcgctgatgatgaggttacaactcgcactagaagggataccatcatctcaatcgggcggtaaaccccatctcaatcgggcacggcgtccgtcacaggctagaagtcacagatgtgaagagttatctcaatcgggcaaacggccatcacggatgaatctatctcaatcaggccctaattaaagcccgtcaccgatagctttgacctagacgaccagtcaaactatagcccatcacagatgacctatctcaatcgggccacaactagcgcccgtcacagatgacccttatctgtgacgggcattaactatggcccgtcacagatgagtcatctgtgacgggcattaactatggcccatcacagatgaccctcatctcaatcggacctaagttaacgcccgtcacagatgagtataatcaaaaaaaataaattttattttttggctagtctcaggcctcctaggctagtctttttttgtcctcacttgaagttcaaactttccggtcggtcaccgtgaaattgctccaagccaagtacgcttaacatcaaggttctttggagattggcttccggaaaagtagttgtaacttgttggtatgagtattctattaatcttattaagccctagaccaggatatcaaattggggttattaaatgatttcaaatggaaaagttaccaaaaccaaagttgtagaactcatcgaggtgcaaaatttttattttggtcatttctccatatgactctatttaaacaatttgaaatttgaaattcaaagtttgaaaagtttaaatagaattttagatcagtgaatgacttcaactgaaaaagtcatcaacaacaaagttgtataactcatcaagatctataacttttattttggtcatttttctatataacattttttgaaccgtttaaatttgaatttgaaaatatgaaaacttcaaataacattttcaaatactaaatgatatcaactgaaaaagtcatcaacaacaaagttgaataactcatcaagatctaaaacttttattttggtcatttcttcatac

SEQ ID NO: 59603 - DNA, 32758 bp, Oryza sativa
  unsure (1)..(32758): unsure at all n locations
gaaataacaaaaataaaagttttagatcttgatgagttattcaactttgttgttgatgactttttcaattgaaatcgtttagtatttgaaaatgttgttgaatttgttatattttcaaattcaaattcaaagtgttcaaaaaaaatgttatatagaaaaatgaccaaactaaaagttgtaaatcttgataagttatacaactttgttgttgacattttttctatttgaaatcatttactacccgtaaaattattttgactcataaaataaattattatactgcatttaattattttgctatagttcaacttacaaatataaacatttcatatgaaaaatgaaaaaatagtcatcggtgacgggctttagttaatgcccgatagagattaagtatatagcccgtcactgatgagtcatctgtgacaggcctagttgctatctcaaacgggcctcaagttggtgcacgtcacggatgatggtcatctgtaacgggctacaacttgaggcccgtttaagatatgaaatgttatctcaatcgggtctaaagttggcgtccgttggttatctgtgacgggccacaactttaggctcgtttgagatatggaatgttatctcaatcgggtctaaactacggcccgtcactgataggtgtcatccgtgacgggcttaagttttatgcccatctaatttgtctgtgcgaccataactcaatcgggcactttttgacccgattgagatgacttccttatgacggcccgctatttctaggcatattagagcttgtcacagatagaaggatctctagtagtgtcggcgttcaccgtggcggccgcaactggagctccggctggcgcggcctctagcgcccgcggcatctaatttcttcaggggaatgagcccatctatctatccaagtgaaaggtgaattctgctttgatcgtagaataagccacgccatctgttgaataatgaccgttcgatgcaacacaaatttaatatgtaccgttggatatagtcatccgcagcaccgtccaatccacatctcgctataaacacctggagaaaaaagtgaggtctggacgagcacttcccgaggaaaaaaaatatgaattagctaggaaattaaaaaaacatattccctccattcacaattaatcatcctattattaaaataaaaaaaagaattgatcgtcccataacatgtggagccagcggaattcctattttctcatgtgcatgcattcaagaattcagcgaggagagattactggttggatgcaagcatatgatttgaatgcacagtaattagtgggtgattagtttgtcatttggcatgcgctgctagcgtgcatgcgtgggccatccaaccgacattacggcgttatggttttctgaaagttaactgtctctcaatttatttttttccttagtactgttgcacaaacacaatgtgaccatcaattgcgaatggagggagtactggcatccctatctgcctgttatcgccatctgccttgcacaacagaactaatagatagtcagatggcaacaagcaatagctcatcgccgagaaccgatggagccacaaagggaagcttgccgacacacgcgaaggaggttgatatcgtcggtcattgcctagatttgacatctgaagcttttgggaccgaaagatcgagatggacaacgtatgccagcggctgcacaccaaggaggaaggtaatagaaagtgcgtagtttcaatctacccgagtgtcaattcccctaggcaatagctgcagacaggcagttgaagccaagacacttgagcgacgacaaccatcaacgcgagcgagtcaacacatgagggaagcaacggcgttagcgttatggcgagagagataaaggggctctgcacatctcatattggtaggcttaatgggctggctgtgctacttaggccaaatggtcatttgcacctagggatggatattgagcctcggctcggtttattatcctaacgagctaaaaacctagctcggctcggctcgttggaaaactcgagccagctcgtttggctcgcaagcctggccattgtttcccggtgcctctgttccatctttgatggcaggctcctcctcctccatgacgcctcggacgacgattctgtggcgaacggcggcgcgcgcgcatgaagtggtgcttgctcctcgtcctcctactctatatcgcctcggacggtgattccgcggcggacagcaacacacacgcatcaggggaaggagaggaaaagggaagcgcacgctccggatgtcgtgggaagaagagcaacagcgggaggcggcgcttgcacatgcgagcgacggggccattgtgacgcacagaggtgagcagcgacacaagcgtaggacgagcaacggcggtggtggcgtggtttgtgtgtgaccgtgaccctgtttagttggtgaaatgaaaatttttgggtgtcacattggatatttgaccggatgtcgtaagtggtttttggacacgaatgaaaaaactaatttcataactcaccaggaaaccgcgagacgaatcttttgagcctaattaagccgttattagcacatgtgggttactgtagcacttataactaatcatggactaattaggttcaaaagattcgtctcgcgatttacatgcaaactgtacaattagctttttttatctatatttaatgctccatacatatgtctaaagattcgatgtgatgttttttgcgaaaagtttttggagattaaacagggcctgcgtttatgtgttctacttgcttgcctagggtttgtgatgtgcatgtgtgtgggcctactgctgggccgtagacttgctgcttggctgtggacctgtaatttggtgggagtacactacttcttaatgggagtgcagacacgtgactagctactgcagctcgtttggcttgcgagctaagaccctagctcagctcgttaacaatttcaaacgagccgagcgagctaacgagtcacgaatttttcatccagtcctatttgcaccggatcaaattacgagaagagcaaaatgaacaaaaaaaaacatgttattttacatataagactttgtaataataagtaaaattatagaaggtaataaaaaactattgttcttttgcaaataaactttttaactaattaacaatatcttttcctgacaatactttatttacagatctatttctactatgtaaaataaaattaagtttgcttataagctgaggaggacagggggaacataagaggggctcatatgacagcaggaatggtaagaaggcagttgactttggtggtgcgatgggctaaggtgtagatgtgtttattctctatgtatgtaagggcacgtttccttttcagacaaatgctggatattatgcttcatgatagcattatttataaaaaaaacacactaaactccttacaggatttacaaaagattcttcaattatataatattattaagatttcttacacactatggaccatagttcatatgcacttcagtcatatgcctgacacatgtacgcattgtacagggatgtgtttgatctattatgttcctaatgcaggtgtaagatgtacctactccgttacattcctatagagagatatatgcatgctcatttgcgtggtacaagttagctgtacaactgccacacccacatggccacatcctgacaccaaagtccctgtttggtcaaaactttatcttgtgtctagccaagccgacgtcacatgcctgtgattgaaatcattttgcaatattattttcggacatcactttgcaaaaatgatttaggacatgttcttaagtttcccaacttcacattcctttttctcatgcacaacttcactttgcacgttagtgagtttttgttgaataaatctctcacttaatgtgagcacgttttcaatatgctaaaacggtatgtttctttgtaatagatttctatatagaagtttttttaaaaaatcaaataaatctatttttaaaacttatattcgctaatgatttatatcgtctcgcgtgccataacagctagttcgaacgcatactaaatcacatttggtgatgaaatgggcatgttgtaaaatactaccagtttttgtcagttggtcactgtgtctatcggttatatataactgtgctatatcactttggcgtgtattaaaataaaagaatgcatgtctggtaatttttttacatctatatgctaacatctcattttgttatagtctgcttagaaaatatatcaccatgaatgtccactcaccacccaaacatgatatattgtgaaaatgacatttaaagtgatgtctgaaaatgatatatcacttgggatttattgaaataaaaaaatacatgactgatatttctacaaatatatcctacatcataaacctatttttctataatctagagaaaataatgtctagagaaaatattgtctgtgagataagatagcatgtggcccatcaactaatgtacccagattttgatatatacgtactttggtcaattttggtatccattaactgccaatcaacttgtctggtgcgtatatgtctttctaaccaaccaatctagtaatgctaattgtaattacaaaagtaatataatccagccataatactagtataccaccggtaaagagccaattttgagattagatagtatcacttgacatgcaaaaatcgattagatcatctaattagcaatatttactaacccaaatatataaataaatttataaaattagttttgcacagtgaatgtcggatcaagggaaaaaagctacgcaggtagtcttcccaactctcctggctagttggacctggtttagttcccaactttttctttaaacttctagctttttcattacatcaaaatttttctactcacacaaactttcaacttttccgttacatcgttccaatttcaaccaaacttgcaattttgataaaaatataagattggcatgaatgagtgacaagacaaaacaagtctgtgcttgaagtgtgaaaaaaaaaaccatctctgtactacttgtacgtgagcactatgactgtttgctagtgtaattaagaaaggaacagtcctgctaagtagaactcaaccctcctaactcttagccacttgcgcacgtatcttggtacccctcaacggtcaagatttatggttcatatgaactacttccgttcatatatgatttaccctataggaaaatgattttatactcctaggagtacatactccctctccatccaccgttcatccgcaacctgctctaggtcctctattcggctctcctaacgggtgcgtacacaataaacccgtttccatttatatgaaaaggaaataattctcgtagctgttaattatacccccataatcggaacagatgcccacatcgatcccgtttcgatcaaacaactcgatctcgttggcgttcccaggcggcgacgccgtaatcgatctcatcggcgttccgcagatgctgaagcatgagggtgatcgacctggagatgctgccacccattggtgtcactggaggagaggcgggtcggcggagtgcatgagcagggcaaacgtggcataatcgacgggtcatagtagtggagatcatccaaaacagcaggttagtatcggtgtatttctacggccagatcgacgcacgacgtctaaatttttcttgtttgcaggggcacaagagaagagaaccagtttatcgaaattgtcaaagatatatcccagaaattttgatgcctgtgattgaatatcttgatgtctatagagaaggaatatgtttacgtagttcggtccatgcatgcttttagtttcagatgttttttttttcctgtagatgctgtttttttttggtaaattatatgctgttgcctgcttttacacatgaatgtttatatgctactttgattgctatgctagtctctgtatatataactgcactgttcccggaggtgtatgtgtgctaatttatttaatttttaccgagagacatatacactacatgttccttagagagggtgtatgctgctttatttccagtaggggtatgtaatgatttttttttctccagaagaatatgctttccatacagggatatgtactgaatttttttctaacagaagtatttacttaactttgtatatatactgcatttatatggagtgataatattgagtttttctatagagaggtatatactgaactttgttagacaatactagtatatagttcattttccataaatatgctgattttttccatagaggggtatatgctgattttttttttacagaagtacatactgaactttgttagacaaaagtatatactgcattttccatagatatgctgaattttttcaatacagcggtacatactggcttttttacactgaaaggtagtacatactgaaaaaaagaacagtatatactccagagaaaaagaacagtatatactccaacaaaaaattcagtatacaaatttagaaaaaaaagtggtatatactatagatctagaacaagtggtatatactagtactctagaaagaactgcataaactaccctctttatccctgctaaccgatcgatatgtcagcggggatgtagagattaaggctttcaatctggtattacatgtatttggctagcaattaattaaccgatactttgatgcgtccaattgatatttgatatatattttaattttttcttgtagaacggccgccatttaaagtacgtgaagaaattactctacttatctgaagcagcaaaagaccaaaaagcagagagctacatagtgcaatttttataagagtgaattgcactttgggccatgttttattaccaaagttttattttggaccacctgtacttaatatttttactttggactaggtaaccttacctttgttgcacaatagactacccaaactcttttcgcttgtgatgtctagcgtctctttcgacaaaagtatgtcatgtatataggtatgaaagtttgttggcatgtcgttaacaatttgctcgaagtcatcgaagaaataaaaatgtgttttggggtggtccattgtgcaacaaaggtaaagttacctagtccaaagtaaaaagattagataaagggtggtccaaagtgaaactttggcaataaaacatggcccaaagtgaaattaactctttttataaagaaagaaaagcagaatatacttggccaagcaaaaaaaatcttcaatgagaaacgtagtagtatatactgaccaaaggagcattatactcctttaacgaaaaaatgagtatataactcattaaacttgaaatgcagtacatacagaccaaacaaagagatcttcaatgaggaatgcatatatactaactctttacattctgaaaaaaatacatactgaaaaaaagagagaacagtatatactcctaatttagaaatgtggtatatactacaaatctagaacaggtggcatatactactctagagataacggtatatacttgtagtcttaaaaaaaagtggtatgtactactaatgtacatctcaaattttgaacgtacgtgagcattcctgtgtatgcatgcaaaaaatttgaaaaaagaaaccgagcacggcccatggacatgcatccatgcgaacgcacgacgttggcaggagagaggaactacgagcttgagatatgcatcggcgtcatcatcattcatccttgcctctgctttcgtggtcaccatcgccatcgccagacgccagctcgactgactagcaggcattgttaagccactgactgactaaatatttatttcagtaatataaaatctcgactaaattgaaaccatgataaaaacaatggtccactatatagtttattattacttttcattttacaattttcccacactactctcttctatattgcttatatacgcacactatatggtctaaattaataggcctttccccttttttttcatattataagtaggcacacacaaaaagaaaaaaaaatacacgtaccatcacatactcctgcaggagtagaagtaacgtgtgtactgtactcttacccgaactactccctccgtaaaaaaaacaacctagaagaaaatgtgacagagggttatccagattcatatagaggggtcattctcctcatagattgtctttttcttggacggagggagtacaagagtgaaagtaacgtgtgtaggcggtgatgagatcgataggatacgagtagaaaggtcgtcgttccctgcaatgcagggtgagtttagttcctgaaaaaagttgaaagtttgaagaaagttgggcgtttgaaaaaaaagttagaagtttacgtgtgtagaaaagtttttatgtgatatgatgtgatggaaagttgggaataggaggaaactaaacacggccgtagatatgcaggttcaatattgatagacgtgtccagcaatgatgcggctgtgtttggaagttatcttcaaacttccaaaaattccgtcacatcaaatgtttgactcatgtatggagcattaaatatggacgaaaaaaaccaattgcacagtttacatgtaaattgcgagataaatcttttgagcctaattatgccatgatttaacaatatggtgctacagtaaatatttactaatgatgaattaattaggcttaatagatttgtctcgcagtttacaagtagaatctataatttattttgtagcggcgcactggagaaaattttggccaatcaactaaggccgagtttagttccaaactttttcttcaaactttcaatttttccatcacatcaaaactttcctacacacaaacttctaacttttcagtcacatcgtttcaatttcaatcaaacttttaattttggagtgaactaagggtgtgtttagttcacttcaaaattataagtttgattgaaattgtaacgatgtgacggaaaagttaaaagtttgtgtgtagaaaagttttggtgtgataaaaaagttaaaagtttaaaaaaaaagttgagaactaaaccatgcgtaaacactccctaaactcctactcctagcctatagcgacgcactggagcatagcgatgggacttgggagggataagatgcagaaaaacaaggcagcctacttactgatcgatggttcaaacttcacccgactcgcttgcctactggccggcttacctactgtccggccggtcagtttgctcacgctctctctggaaataatcttgatctttactattcgttccgttacagttcatggctgtgtttagttacattcagacttccaacttttctgttacatcaaatgtttggacacatcagtctaaaaaaatatttgaatatatacatggagcattaaatatggacaaaaaaaacccaattacacagtttacatgtaaattgcgagacgaatcttttgagcctaattacactataatttgacaatatggtgctacagtaaatatttgctaatgacggattaattaggcttaatagattcgtctcgtagtttacaggcggaatctgtaatttgttttgttattagtctatgtttaatactttaaatgtgtgtccgtatactttaatttttttttgaaaagtaactaaacatggcctataaatcgttttgtttttttaccaaacttaaactactctaagtttagctaagtttgtagacaaatataataatatttacaataccaaattagtttttattaaatataatatatttgtcttgcgttgaaaatgttactactttttttctacaaacttagtcaaaattgaagcaggttgattttgatcaaaatcaaaacgacttattttctaaaacagagggagtattactgtactagtactctctccgtctgaaaataaatcaacatcgtggtagaaaaatctaaacatatactccctccgtcccataatagatgacgtttttgactttttatttgtaatgtttgaccattcgttttatttgaaaaattagtgcaaatataaaaaaagataagtcatatgtaaagtacttttgataataaaacaaatgacaaacaaaataaataataattctaaatttttttaaataagacgaatgatcaaacattgacaaacaaaaactcaaaaagacaagtaatattaggacggaggaagtacatgtctaattcatcgtagtaagagatttgtttttaagtagattcgactctatgttgaggtggagtcgaatctctgacctggcacgctcaggtcaaatgacacctgagcgcactatgaaaaccctaatctcgctactcaaaccctatatggctatatcggtagacttttgctctcactactgtagacaacaaggaatcggtaggaaggccagcaggcaaatcgcgtgcttcagtttgattccacccacagttcgtgcggtactcaaattttaccctatcagctctcgcaaataatacttttcaagacccagttttttttcaacaccaaactaatttaactatctcgttttccgttaacattcaaagaaattcacttttaaagtttaaaattattaatacttaattaattataaactaatgagctttctcatttcgtgtacattaaaaatctctctctccgcgaagtgagcatagctcaactggttaggttccttgtggtggaaccagcccacccgggttcaaatcctagatttgacacgggtgctcgtatttacggctaattattctttcagtggtagacgacgtacccgtcgacagcgaggcgtctgtcagtcttcctctcctctctaaaacacggtcatctgtggtgactttatgcttttcccaatccactgccactactagaaaaacgatttttcatggcgttggtctatgattttcgctggcagaaaaatgccaaaatcgctagcaaaattgtaacgaagggtaaggggcaccgaccgccagcgaaaatggatcttcgctggcggtcacgctatactagccgccagcgaagatatgtctattttcgctggcggtcacttaggtgcaccgctatcgaagatggataattttcgctggcggttgtgttatacagaccggtagggaaaatgcaattattttttggcctacttaagcaaccgccagtgaaaatacatttttgcttgcgttcattttaagccaaccgccagcaaaaatacattttcgcttgcgttagcttaagacagctgccagcgaaaatagattttcgctggcggtagaaggaccgcttgcatagatggaccaccatctattaatatagaccacgtggcccaccaccaccaccaccagtccaccacccacccgccccctctctccagctcccctccctcccttctctcccttgcgtctatcctccctctcttctccaccaccaccgccgacgccatccatcctcaccaaccagctcctcccaccccacagtcggcagcggcggttttggcgtggcgacgacgacgcgaggcgggtgcgcggcagcgacggtaggcaggcgagcgacggtggcgggaggcggcgcggcggcggctctcgggcatgggagcggtggcgctcgggagcaggtggtggcccgcggggaggccggattcgccgccgctgggccgcggggaggcaggatccaccgtagccgggccgcggagaggcgggatccgccgccgccaggccgcggcgaggccggatccgccgccgtcggctagatttgattttttgtctttttctttttacatgttgttccagatgatgcatatgtttggatctgagtaaatcatgtttgattgtgtaaatgatgtttgatctgtgctgatgatgattttgtatttcgtgtttgaatttggaaatgagcagcgaatctagatgtggatttgaaattaatgaatcaatgggtgccttcatgggtattttcgctggcggctgggcagctgcatgcgtgttttttttccccaaatccattttcgctagcggccgatttaacacagttgacagcaaaaatctattttcgctggcagccgtcttaagctaacgcaagcgaaaatgtatttttgctggcggctggcttaaaannnnnnnnnnnnnnnnnnnnnnnnnnntggcggtcaataaccgctagcgaagatcttgatcttcactggcctttgctttgtggcggccgtaaatttcgctagcaaaaatctaaaatagccgccatgaaaaatggttttcgtagtagtgtgcacctctgcaaaccccaaccgacgcctccttccccttgctgtggcggacaaggagctccgagctgagcggcggtgcgatcgtcctcgtagaggttgccgcggacctcgtcttccttgtggagccaagacgagccgtggcgcgctcatcctcgcggagccgagccgagcggcgcgttcgtcctcacggaggtcgccgcggaccttggcttcctcacgcagccaggcagagcagcggcggggcggctagattcggccttggctcatcagatctcccctctcctcgctggctgttcaaggcaacatcagcgaactcctcggctatggaatgagctggatcaacctatatcagttgtccccttccacggatcgtcctcggccacggcctcttcttctctgtcgctttccccattgagccggcgagcttcaacagtgagagacggcatccggtcgccctcctcccctcccctggacgacgagctcggcagtgtggagcacgaggcaacgacacatccctttctctctccccctcttccttggcggtacagagcactagtgtgggtcgtatctaaaaaactgatgaggaaccgatgggatagtttggctacgcggtttttgctttgctccactggtgaaggaggtggcactgaatatattcggttccctctgcccagtcggaactcggaacgccacatgcgcaccttgtgaatggcctaacccgcattatgcctgcccaccttaattgacccggactgaagcggcagaccgcgcgcataacgcagctgcgccgcacaccatcccatccaggacgagcatcgacaagttgcgttgatcttcacctttttttctcctcttccctgagtcctctgttcgatgtgttcggcacacgtacaccgccaagaacactgctgcgctatgatacggaggcccctggcagagaaagtggccatatataacaaggcagttctagacaagcaagaagagcagaagaagttggacgaggcacttagcgcgccggaagacccgcgaactgcacagcttgagctactgccgttgctcggcaaaaacctgccagatctgaacgtaactgtgtatgatcgccgcagcgcgagaatccggaatgcctacaacgggcagcgggtggccgaagcagtgcaatcaagctccggctccgacaaatgcagcagaacaacgaaaagggtaatacacgaacgttcgtgtccggcgaatcagtcggaagggacacgtgaaacaggatgacacgtcattttcttccgttttcattttttcccttcttttacgttattctcttctgtaatccgttgtatcttttacgtgattcttccataataagtatttctgtttctttccttcgcttctgtttatttctcagattccttttttcgttatacatagtatttttttatatcttcttaacggaaattttctatacaaataatttccggggaaacttttctatatatagtgagactttatatatatgtaaactttatatatatgggctttgaatatatatacttcatatatatatatatatagattatatatatgtagactttatatatagagtttgtatatacaaactttatatacaaattatatctataattaaaaagtttagtgcataaattttactaaaaataaaaatacttagatatttttcaaaaaaagtataatccaatctgatcaatcctcataacagaaaaaggataaaaaaaggaaaagtttatcttttaccatcacgtgaaaggaaaacgagaaaccggaaaacatttttttttgcgcggctccgtttttctttttgtcgttttctgttcgctaggttcgacgctagcgcgcgtttgcgcattagacccacacccattgtatccatttacctcggctgtctatttctagtcagaaaaagtgcaccggaggtccctgaacttgtcaccgagatacgaaaacgtcctcaaaccgcaaaaccaaatatatgtggtcccttaactatagaaaactggtcacccaaggtccttcggtggttttgaccccggttttggtctacgtggcggctaagtcagtgtgggacccacctgtcagcatgccacgtcatcactcctgtcgacgtttgatgtcacaattctgctatttgcatagtatggggatcgtcggtgctaggatatatgtgagactgaggtaaaagagacggagacgaggatttttatacaggttcgggcccctgaactgtcaggtaataaccctacatcctgttggccggagccggtgttgctctttattcaccataatcacaccagtacaatatatggggtagcctatctgactgttgtcgacatggcggtctgaaggtctgactcgtagtcgacaacagggtaatcttcctcctcgaatccgtgcccggcgagatcagagatagctctttcgtctctcctgacagtatccggagacaccgtaggagactagccgtgtctatccctgaagtcgatatccggcgtcttgtcttggcgtatgtaggcttgtatattgtcccgtgtattgtggtgggtgttgattgaggtagtcgtttgtgttgtccgtgttgttcgtgttgatcgtcgattgttcgtgtcccctctcctcctagggggccttgtatttatacccatagatgtccccttgtccaagtagaaccagggaaaccaatatggatacaatccgagtagtccttgtcattttcatgtagaactctggttatctttccttatccggaactccctccatatctgaagtcagtttccgtataggacatggtatgtggtgggtcctgccgagatgtagttgactactattaggtatgtggtatccataacccggacagtatcccccgacttcaatgcaaatgaacgaattcatattctcaaccgcgcgcagaccttggagtaattgttatcgagctcatgtgaccgttctcggtgagttcagagataacgttagacttcctttgttagcctcgtgcgggcacctaaagggtttgtctaagtcaatctccgatgtcaaccaaggaagtacatagcgtacgactaagtctcccgtcttgctgtaatcgagaatttggattgaagtcaagaaattttatctcgacgggtacaccatctcttcattccgtattccttgtcaagatccagcaaccgttctcgagtgatcgagaaggcgtagagtctgcgacggagccttgtcgacatttatcgttctcgccttagtcaatcttggtgtagaaccatagagacatggagtcttcgtcaatgtcaaatagaattttcctgaaatcaatactcagaaaagaatattagatagaaatagcccccgagtgaatgctcaaagggtgacatgttataatatgtatggtaaattgaaaatgaattaaatttactgaccaatgttttgtgtatgagcgtcttctctcttaccgacttcgatcagtcagtttgtagagtcatacactctccctagcccccagccttgtcgtcggagaatcgttctcggaggataaggctcttggacccttgacctgcctttgttaaataagcgctgatcctaaccccaagccgtgtagttggaaagctcagtttccgattacacagcttggttaatacggacggcgagaactcttacacgaccagatcttacatggtcttttgtctctacaagatccgacaaggccttatcggctctgggcgtccccagccgaagttcccttaggttcctcggaggccttgtcaagacggcgtaaagggacagtaggataggtttcaacgctaggtgtcgtcatggtaagggatctctgggtaaaacacttggcgatattgtgtacctgctatcaactttgttgaaatagaggtagtaggagagtcgctacaccgctggtcgaggatcaggtagtagtcataactcgaccacttgaagtggaaatagtggaagaatcgctacaccgctggtcgagaaccagacagtagtcgtaacttgaccacttaaagtggaaatagtgggagaaacgctacatcgctggtcgaggaccaggcagtagtcgtaactcgaccacttaaagtgaaagtagtgggagaaacgctacattgctggtcgagaaaggcagtagtcgtaactcgaccacttaaagtggaaatagtgggagaaacgctacatcgctggtcgagaaccaggcagtagtcataactcgaccactagaagcaaatgtacgagagctcactacgatcaactggttgagaaccggtgagtaggtgtctctcgatcatttggagtcgtggtacaagaaccgctacgctgccggtcgaagaccagtcgtagctgttcctcaaccatctgaagttaaggtgcgagagattgctacgtactggtgcgagaaccagcgagcgagtagaattatctctcgagcaccaatggaagttgctagagttggtttattacatgtgtatctcatgtggccagcatgactcacatacccaacttatagcatatccggatatccgtttgaaatcatgtcgggtgatcaagccgacggcgttcgcgaggaattatccgttaacaaccttttctcgagtagtccagcgatggccggtgctatgagataggtcgtcggtcttcgttggcaggttgggtgcgataactccgcatttgtcgagaatgttctcaataatggagtgtactcgaccataacctactcgagtgctcaatttttcctgaaaaatattttctagaaggcaagatatatagcagataatatcgagtatgtactcaaaaaactgcatggatcttctagtattatcaggatacaacaaacagatgtaaatatcaggcattatgtaaaccgtaaacaagcatgatttatacataagagaacagagtgagcccccagcgttagaccgtagttggcctatcgtcggaagtactcgcacaacggatattgtataagaaacatgctctaggtaaacataataaattatagatctgacaatgctgtatcatctgaataggtacgataaattgcacataaaatattgcgtacctttgtagatacatgccggatgtatctacgaaattagtagatcaatttgaaaaaccaatctaccaattaccttattgcgtactcgttcaacatcatatgatctgacatcttttggtacgccgcgtatcttgaggcttgggtgatctcgatagaccaagttgtcaatgacgatgatgattccgatctcgtcggaagacatgctccggtcgggttagatctccacagccgaagtcgtcgagcagcttgttgttggagaatccatctcttaaacccatctcgtctaaatcctgaagcaccaaaatccccctacctggcgcgccactgtcgacgtttgatgtcacaattctggtatttgcatagtatggggatcgtcggtgctaggatatatgcgagactgaggtaaaagagacggagacgatgatttttatacaggttcgggcccctgaactgtcaggtaataaccctacatcctgttggccggagccggtggttctctttattcaccataatcacaccagtacaatatgtggggtagcctatctaactgttgtcgacatgacggtctgaaggtctgactcgtagtcgacaacagggtagtcttcctcctcgaatccgtgcccggcgagatcagagatagcgctttcttctctcctgacagtacccggagacaccgtaggagactagccgtgcctatccctgaagtcaatatccggcgtcttgtcttggcatatgtaggcttgtatattgtcccgtgtattgtggtgggtgttgattgaggtggtcgtttgtgttgttcgtgttgatcgtcgattgttcgtgtcccctctcctcctagggggccttgtatttatacccatagatgtccccttgtccaagtagaactaggaaaaccaatatggatacaatccgagtagtccttgtcgtttccatgtagaactctggttgtctttccttatccggaactccctccatatctgaagtcagttttcgtataggacatggtatgtggtgggtcctgccgagatgtagtcgactactattaggtatgtggtatccataaccctgacaactccctctctctctctctcccttcctctccctttctcctctctctcttcacttttctccagctggcatgggcggcgggggcggtcgcagcggcggcgctctgggaacggcagggacggtggaaggggaggaggggtcgacccagacgttctacggtcgctgccggtcacggtgtacagccgcagcacgacggcggcggcggcgaaggaggaggaggacgacggcgtcgagtgcgtggtgtgcctcgcggagctcgaggagggcgacgaggccaggttcctcccccggtgcggccacggcttccacgccgaatgcgtcgacatgtgggtcggctcccactccacctgcccgctctgtcgcctgaccgtcgtcgtgttgtcgccgcttcttcttactcccgtcccgccggcgccggccgtgatgcacgacgacgacgtacgggcacggcggcgcccacgccactcgtcgcagcgggagtcgaacacgagcgcgctcgtggacgcctgggccacgggcccacgtggcgcgagcacgacgtagtcgctgtgcgccgtgcactcgaacccgcccccgccctccgccgtggcgaactgcgtgtgcacctccggcggcatccacgccacctccgtccaagcgccgccgccgcttgctccacctccgtggccgccgccgcgcagcgtccacatgcgtccacagcggagatgttcctgacggcgaaaggggacatgaggtcatccccggccatgacggcaatgatggaggtcgggccggtggccaggccgacggtgggggagaggcgcggggtcggggtgatggggagcgcagcgaggaggcgcgtgattgggttggtgagcagtagcgtcttgtgcccctatgcatcggacatgaaggcgagcatgctggcggacgtggccgtgggtgagaacacggcggggccgctagcgacgggcgggagcgggaggcaggaccagttggagggttgaacctggccgccagcggctacctccagggacctactgctggggcggttggcgatgccgacatagagctcgtggccgcaggggaggtggccgtggaggttgcggcaggcgctgcgggtcgtaccgtcgtcctgacggctggcgagggaggagaagcggggcgcaccgtcgatgcggcgaaggaggaggaggacgctagccaccacgccgcggcaggatctggcggcaaaagaggaggcgaggaggacgccgacgaccaccatggtgacgccgacgaccatcgggagaagcggggcacgccgacaccgacgaccaccatgctcgccgctagggggccactacctccactgcctctgcctccgtcaccgccgtctactggccgccgctccccatccaccggccgttccccgcccgcctgtcgccaccgccgctccgcgcctccgctctactccgcttcgtcggctgccgcacgctcacacaccgcctccgccggccgccgctcagccccactcgccaccgcccattccttccccgcggcaaatagaagtgaaaaaaaagaagagaaaaaagaatgggaaagagagagttgacgtggcacgctgacaggtggggcccacgctgacttagccgccacgtagaccaaaaccagggtcgaaaccaccgaaggacctcgggtgaccggttttatatagttaaggaacctcgcatatctggttttacggtttgaggacgtttttttatcccgttgacaagttgagggaccttcggtgcactttttgctttctagtacaagcagacctcttcaaggcccggcccttttcttttttcatctttgttttcctttagggaaaacgtacaccgaaggtccctcaacttgtcatcgggattaaaaaacgtcctcgaaccgtaaaaccagatatacgaggtcccttacatatgtaaaaccggtcacaatagatccctcggcggttttgatcctgattttatcctacgtggctgctgaatcagcataggacccacgtggacctcacatgtcagcctcctctttctttcccctcttctctctcttcctcttctctctttctcactcttctctggctctaggcaagccgacaccggggcgaggcgggggaggaggtccggcggggcgaggcgggagagaaggttcggcggcggcgtcgacgcgggagcaagggaggggcgtcggcggcggcgagggtgaggaggccgcggccggggtcggcatcctggcgccggcgctcgccctggcgcgccagcggcggagaacggcggcctgggaaggtgtcgccgcggggccggcggtggacgtgagaaggagttgacgtggagccggcagtcggcgtcagcggcggcttggtcgattggtcgattgagcaccgccgccgcgtccatctccacctccgccgctggagaacaagttacgaaagaacttcagagtcaagttacgaaagaacaagatgagggtcttgagaagctggaagagacagtactgagcacaaaacatattgcaagattgattgacgatttagatgatcacgttgatgttacgaactcacgtcttcagcgcgtgcaaagaggcttgccattctgaataagcgcgtcaaaggtggctgctcatgcatggccctgctgctatctgtctttgctatagtgtttcttgcggttttagtcaaaaaaaaatcgtgtttcttgcattgcggtcattgcttggcttcttatcaagcacatgtaacctctgtccaactcaaatcagtttgaaatgtgcagtctttcaaagatgtggatgctcccatctcatctctgttttgtgagattgtgagaatggaatataattgcaacaaatcttcgttcagaagatgtgccaaaagaaatcttgatcattatcacaataaacggaacataatcttgctaagagattgtacaactgggaagcaaacaggtaaatactaacaacaaagagagccaggagctactcatcaaagaacaaactgcatggataatcagtgcaagaaacctacatccatttccagaccaaagccgcatttctccaaacgaactctagatgcaagccatcttctcaggcaatgagattgtaacgaactgagagccgctcattcagcgggctgcggatccaccacctcgctctcggaagaagcagcgggggcatctccctcggacggcgccgcggcggcggcggccttggcggcggcagagcgggacttgacgaagtcgaggaggcggctgctgacctccttggagtagagctgcagcgccttgatgccctcctccacggacgccgacgccgcccctgctcgccgtcctccgcaccccgtctccgccgtcctccgcgccgccctccaacctcgacggcgtgctcgccatgggcggcggccggccgcgctatcccctcgccatgggcagatgcacgcgccagctgcccagctgctccccagccgcccgcgcgccgcttttccgccgccatgccgccgccgccgcctgccgcccttctcgcggcgtcggatgagaagagaagagagagagaatgaagggagagagattgacgtggtattctgacatgtgggtctcatgctgactcagcagccacgtaggataaaatcgggatcaaaacccacctagagacctattgtgaccgattttatatagttaaaggacctcgtatatctggttttgcggttgagggacgattttgtaactggatgacaagttgagtgaccttcggtgtactttttccttccctgaatgttgtaagccgagtaccagcagtttctttacttccaatcgttttctttcccgctgttcactgtcttcccgttatcgcctcgtccttttactcgtttcacgtctccccgcctgtgccctccatcccaatcctttttccttgtcttctcctaaaccgcggcttaggttttggcgacaacttgtttttcattgcgttttcgagggggatattttgctcctctggctcttttcctgtttttggatcctctgttctgttttggttcttccgtcgcctaatctctcagcatgagaattctatcctggaatatcataggcttaggagacaaaaagaaaaaaaatctctacttctgtccactctgattgaacataggccagacatagtttgcttgcaagagaccaagcttgcatccatagacagattcacaatgccagctcttcttcctgttttcctacgagattttcattggcagcctgctctcggctcagctgggggcttgctaacagcttgggactccagagagctgccaaccactctggttcacgaaaacagcgactccatctcctgcactttccactcgagaacagaccaaaccaagttctgggtcactaatgtatacgccccccattcggaagatgaaaagctaatcttctttaatcaactttcaacgctcagaattgcaaacaaagagctatggtgctgcattgggaattttaatatctacagatacccttttgaggaaaacaacgacaacttaaacacaagaggaatggtgggtttcaactgttggataaatgaagaaggccttgtagacattgacattcccaacagaagtttcacttggtctaacaaaagaagaaatcccacactggtgaagcttgacaggattcttgtcgacacaagctggaaccaatcgttcgcaacctcatctgccagagccctagtggcgacaacttcggatcatatccctattctggccgagtgctcaaacaactcaaacacattccgatatttttcgtttggaaaatttctggctacaattaccagattttgtcagctgagtggaagaaagctgggttcaaggtacaagaccaatgagagcaatcacgaaattcaaccataaactaagaagattaagagctagggccaaggcctggaacagaagaaaacgaagcttgccaaccctgttgtcagcaaacaaatgcactcttgaatatcttgataagattgagaaatggagaagcctgacaaacctagagttttgtctgaggcaaaaggtttttaaacacattgaataaataattaaattggcacatcaaactaaaatggcaaagaacggccaggatcggattctgcactctgggagaggagaataacaatttttaccacacagtagcctcggtcagcagacagaaaaacgatttaaatttgaaaatatactgttcatttaattttttctcaggaatattcgggatgcaaacacttttgcagaaatataccgtcggtctcgcacaacgtaccgttgcgcaaaaatgacgtgggaatgacgtcgcatgtggtatcgcacggtctcgcggaatggaagagcgagactactgtgattaattatctggattagcgattaattattaggtctaagaaaccagcgacattgtacaatgggcttcatttgattagtaattaattacttaattaacaattaactaataataattagtgattaattatccggattagagattaattaattaattaatcgctaatcaggataattaatcgtaattaaatcgcaaggcaccggtattgttgtttgcttgagcgatatcgctgattacttgagcgagaccgcgcggttgctgcgtggagacgacgtcacctggcggcggcgtaggtggccggcgtggagatgtaagccttcaggcggcaacaatgtggtagccaagtaaggcagccctccacggtaggtatggctcgaggtctcgggtacgcccacccggacatgggcctcatgctcgatcttcagaaaatacgggtcagtagctatgcccagtagcccccttacgccgaggtagaatgaggttaattcattgtaacttggggtaaaaagtacacttatcttcttggaaaagagaagccgggtagcctcctgactccatgccgggatgactggggtcatcgcgaggtggagttgtcttgcacttttgcagcgaatcaagtctatagtcttccactgtgccactggatggttttgagccatggggcaagcaggtaaggtacacctggcttagccggccaagacatggccagggccgactaggtcgccggcaggttttgagcctccgggcgtagcagtaccacagacaacaaggactatcaagcccaagtgcctgaggtcttcgctcaacccctaggtggttgccagccacctgcggggccaaccgggagtaggtggccgggaggttttaagcctttgggcgtggcagtaccatcggtaacaacgaccgtcaagcccaagaacccgaggtctttgttcaaccccctaggtggttgcaagccacctgcggggccgacagaaaaaggactcctgctcagccgggtagggcgtggccagggccaagtgaggggctaggaggttacaggcctccgggcatggcagtaccaaagaaaagaaggaccgtcaagcccaagaacccgaggtcttcgatcgctcgactcctagatggccgcaaaccatttccgaagccgacagaaggggggacacctggctcagccggtaaggtctgaccagggtcggatgggtggcctggaggtcgtaagcctccgagcgcggccatacttcaggtaacgaggaccgtcaagcccaaaaacctaaagccttcgctcaacccctaggtggttgccagtcacctgcggggccgacagaaaaagggacacctaacttagccaagtagggcatggccagggccgagtgagtggccgggaggtcaccaacctccgggtgtggcaataccacaggtaatatggactgtcaagcctaagaacccgaggtcttcgctcaactcctaggtggttgccggccacctgtggagccgacggaagaaaggacacctggcttagccgggtagggcatatggccagggccgagtgggtggcggggagctcgtcacttggtcagagcgacagctcattgttttcttttccttttttaatatattgatgatcgcttcttcatttttaatatttcctgatataaaattcataaattgtgaaagaaattgtaaaagtttcagacaaattaaatgcataataagtaataacttttagggtctattcatacatgcacactctaatccataggtatttttcaagagatttgagtggatagatattttctatgtttttctctctacaatttataagaaagaaaaatttcatttggttttcctataaatacattcgtacgaaccgaatggcactcatgggaattaatccatagaaatccaaaaactttggtttttctctaaaccgaacaagtccttaatattgttttaaaaattcagtaaaacacctacaccttactcatttacggtcagcccatcctttcactaggattttataaaaatcgaatctaatcttcattgggttctattttatagcttttatatgtcccatcgatcaatgtcacctactccattacgacaggttaagaaataaatttatctaatattttaaggcaacttttatatacaaagtttttgcgcaaaatgcatgggttagtagtttgaaaagtgtgctaatagaatacgagaaaaaatctagatcttaataaaaacgaatggaccaataatacccctataagtgtacatacttaagaaataactttttttttgtcacaagtagggcatacgcataaagagcgccatccacgtttcacacgtgtataacaaaatgattgtggcccaattgaaatgcataacatacgagatagtaatcttttttcatataatttttttcgctccactaccaggctaaagctagcgtggcgcaaaatctagctaaaagtttcccgttgcaacgcacgggtatttttctagttagctaaaaaatcaaaaaaaaaagtgcctatactattccatttaaaaaagtgcaaatttcttcgcattgcaccgatgaaaactgacaaaaatggaagaaaaagaaggagaacaagctctacaccttttatatggaacccaatcatagatttgaggtcaaaaacctcccccccctaatttgtgtatgtttagaagagagagaacgccgaaaaaaatgggcttgtgtcgggttggtggctatatagcccgacgatcatcgcatgcggtcggattatcccgtgaacgggataatgcgtgcggccgacagcccggcgtcggtccacggatttttccagccggagccacttatgccccgcctggaaactaacggggctggcgtccaagaaaatcaatcctgtagtagtgcatggtcgcctctaccgctcgtcggagtttcatgctcagacctgcttcagtgccgcgcgctcaagcatgagaccgataatggggaagaggcttcgtcattgccgcggcctactgtacaagctgaaggcggcgattcaagggaggtgtacgggggcgagtaccagcgcgccgtcgagaaggcgagggagatcttcttctcggtgagctgcattcctgaaccccctcaagctcccctcatagatgttttttttgtgtgttttcatgtaataatccatgtatatggatgtttcattagttagatcaaagtgcttctacgggtttccaaaggtgtttcattttttctttgattttttctcagatctttgttgatgtttctgtagcttaaatcatttgtttcatgtgttgaactaaattgtttcatccagtgatctgatagtgtttctctattttttaagcgtttcgatgacttaaaccatttgttgcatatgttgatcaaaattattttatctagtgatttgactgtgtttcacattttttaagaactgaaacattttatctagtgatttgatcaaacattattttttcaaaattgtttcacatttttctaattagtgtcccaacatccgatattacgggactaaaaatagcccctgtgaaacaaataccaccttagtttcttgccaaacttgagtaaattttataaaactgtagatactttgcataatctatcataaaactatagatttaaaaacttatttcacaaaagtagagatttagtgtttttttaatcacaaaactacagatactttgtacaatatatatcacaaactgcatatttaagaacttgtttcacaaaattatagatttaatatcttcatttgtcacaaaactacaggtttagtgtttttattatcacaaaactataggttttagcatttgaagacactaaatatgtagttttgtgataaatgaagacattaaatgtatagtttatagttttgtgaatacactgaatttatagttttgtgaaacaagttcttaaatctatagttttgtgatagattgtataaagtacatatagttttgtgataaagggagacattaaatctctaattttgtgaaacaagctcttaaatagttttgtgataaattgtgcaaaatacatgtagttttgtgaagtttactctcataaatacatatctcaccacggcgtccgctcctcctcacggcccaacattggcggcccagacaggggaaaggggcccatgggccagatgagaatcggattccgatattgttttttttttgacaccccaatattgttttttgtttgataggattccgatattgtttacaacaaataaaaggatcctaaaaaaagcgcaacaaaaagaacggatccccctgtgaagcggctcgaaagaggacacacgactccaccgagatacccatcgagcaaaccctagccatccgaccgtgtcgccatggccatgcgcgctctgctccccaagctgaggatcccggcggccgcttcccgccggactctcccaccgtttcgctcttcatccaccgcctctcaggtgagattcaatccaattcgttccccctcctctaccgatacggactcaggttctcatgttcatgtgcgatgcgacacctcgtgattttacacctgcttctacattttttactcttccgattcaccgtttacctatgtgtgccttgcccttgcccgtgccgatgaacctttagaccctttgtttccttcaaattatctagtttctttgctactacctctctctctatatatagtactaccttatatgcgtgtctctgtgtcggaattaaatcttctttatttgccccccgagatgagcaaatcgaccctgttatttccctttgcctgtttttcttcattattatttaccaataacaagtagaagagtagcatttccttttggtccctaagggtgtgtttagttcacgtcaaaattggaagtttggttgaaattggaatgatgtgacggaaaacttggaagtttatgtgcgtaggaaatttttgatgtgatggaaaagttgagaactaaactcggcctaatcttatatagtagctagcctctgtttctcacctagtcttcttacgcgtatgatactcgcctcgctggctgttttttagctagattgatcaagccagtccttccaatttgatgttagattcacaccttacttgattaccagcgcatgtatatagtgtctttgcttccagcagttcattaattatttctggtactctggttgattttcgcttaccattgcatcgccatctgaatttttctcttccatcttatatgcaactgcaggataagcttgcagccgtcaaagaacgctctccacaactttatgacgagtacggtgcagattcatgttctattttgacatcaatttcgtccttttaacttgcccaacatacatgtttaactctaaaataaaacttgctgactaatgacttctctttatttttttcctctccctccaagcctctactggaaaaatgcttgtgaacgcgaggacaggttcgagaggaagattttgttttatcaagtcattttcaatttcatcgcattcaacacatcatcttatcttttcggctcttccagcgagcaggactaagaggagtagtgttaattaatattaattaattaatagcactttgagtaattatgtggcatctcttgtagtagcactttatttatgatatctatctgccccctctctgcatgtaacaacactttgaatgttatcagtgtgccctgaaacaaatgtagcgagcaggactaaaaggagcagtgttaattaataataggtaatgcactttgagtaattatgtggcatctcttgtagtagcactttatttatggtatctatgtgcccccactctgcatgtaacaaccctttgaatgttatcagtgtgccctgaaacaaatgtatgggaagctaacaatttttttgccatagaaattgcgctctctttaattgtttttcaatctgttcaaactactcgaggtatgtataccatgactatttggggtgctgtttggagtcgaattgagtttgtattgtttgctttagttccatgcatgtataataggttgcaacctgaaaccgttagagaagaactgaagttgtaaccgatatactataacatatatactactccctccgtttcaaaatatttgacaccgttaactttttagcacatgtttgaccgttcgtcttattcaaaaaatttgtgaaatatgtaaaactatatgtgtatatgaaagtatatttaacaatgaatcaaatgatatgaaaagaataaataattacttaaatttaaatatttttgaataagacgaatggtcaaacacatgcttaaaaaatcaacggtgttaaacattcttttttgctgataacatccacacatgacacatccaaaaaagcactaggcacttccctcccgatccttctagcgtctcctctcagacatgtggcaagcaagaaaaagattactccataaaaaataaacaatgggctattggttttcatggcaattaattggcataatttaatgggctgcactaattaagatcaattttgagacgtcaaataagtaaaataaacatgaacggttgttgtgaaaaaaaataggaatacatattacgatactgcagtatgtaacttacggactactttatttgtaacaatcaggaaaaagaccactataattacaaggaaaaaaatcttgatatcttttacacataatatggtcgcgcaaacgcgtgactgagtggctcgttaaattaaaataagaaaacttgtaatattttaaaagaaaaacaatagaacaaggtagagacagaaaaaaaaagaataaactatcatagaactgcgggaactgttattcaaactcagtgccttcacgcgagaggaaatgcaatataccagcaggctagtgctccttcattgtctgttagctctgcgcaccttttatattccggaatagaggtcagcgccagctacaatgacggcgagctcaatggttggcgctgaggtcacggcttatttttagaattagtttttgatgtaggttattcttgaaataagttttataaaagggtcaatttgtcaaaaaaaatagcttgttcgattggagttgaatagtacatattggaaatacatatacgaatgatacaaagccagaacatattgctcgaaattttttattagcaataataataataatcctagttactggaaggccttgtatcaacgacttagaacggtaaccaccatctcaatcgggaggcaacccccactcaatcgggcaaacggccgtcatgaagctatctcaatcgggcctcaattaaagcccgataactttgacccagacgaccggtcaaactatagcccatcacgaatgacctatctcaatcgggccacgactatcacccgtcacagatgactactaacctcaatcggacctagactagagcacgtcacagatgacacttatctcaatcgggcctaaactatagcccgtcacagatgaccattaactatagcccatcacagatgagtataataaaaaaaaatttattttttggctagccttaggcctttgttagccatgccatgccgtcccgcctctcccaggccagtctttttttttcaggccaagcatgcttaacattaaagttctttggaaatcggcttccgaaaaagtagttataacttgttggtatgattattctattaatcctattaagccctgggccaggatgtcacaccccaacattccccattcatatacattcattcacatacacaaccatcaatatatttaacacaaccacattcacataacatccattttgatcacatatttcacatcaattcacatatttcactagcaaaaccgagttaattggatcaaatatatatttagcaagtattatcatcaaaaggaggcaaatcagacttctaggaaaaatgaatttcgaattgaattttataatactaaataaactcatatgaaaaagctgtcaaaaacaaagttatagaactcattaagatctgtcaaaaataaagcccatcacagatgagtcatcagtgatgggccctatactaatgcccgattgagatgacctatttctatcgggcattaaataatgcccgtcaccgatgagtattttttccattttccatatgaaatgtttatattcaatttatgtggtattttttattttcaatttatgagaactttaaatttaattttaggccatttttgtgtgtcaaatgcaaaaatcacaaacaacaaaattgtataactcatcgagatctacaactattgtatcggtcctttatacaaataagttcatttgaacaattcaaattttgaattttcaaaatttgacaacttcgaacaaaaattgaggttaataaatgattttaaatggaaaagtcatcataaccaaagttgtagaactcatcgaggtgcaaaatttttattttggtcatttctccatctgactcaatttgaacaatttgaaatttgaaattcaaagtttgagaaattcaaatagaattttttgttagtgaacgacttcaacagaaaaagtcatcaacaacaaagttgtataactcatcaagatctataacttttatttttgtcatttttctatataacattttttgaacagtttgaatttgaatttgaaaatatcacaacttcaaacaacattttcaaatattaaatgatttcaactgaaaaagttatcaacaacagagtagaataactcatcaagatctaaaacttttattttggtcatttcttcatccgataaagtgatagtaacattattcacaaaattgacatatttcttatctggttttataaactataacacatatatgtaaaatttgtgaacaatgttatgaacattttatcggatgaagaaatgacaaaaataaaagttttagatcttgatgagttatacaattttgttgttgattactttttcagctgaaatcatttaatat

SEQ ID NO: 59604 - DNA, 6191 bp, Oryza sativa
catcggtgacaggctttagttactgtccgataaaattaagttatctcaatcgggtattagtatatagccagtcactgatgattagacgatgttattctaatgtatatatagtggctgttagcctgtatatgtagatgattttgcagtcggggttgtcgctgatgtaggctgggagaatcgagtagtgcatgtgcgtggcttgtggccatgagtctaggctatggcagcgcgtccatgatcttgctccccaacccagcggcgaaaagctactccatgaacaggacacggtcgccggtcgtgcgggttgaggcggaggagcggatgctgcacaccgtcggcggcggccggcgtgggtgcgcgcgccgcgccatggtggcgaaggcgagggccttgagccacgtggtgccgcacttgggcgggctcgcgaggacgacttcgccgcggcgctggatggcgatgatcccgggcacccacgtcctctgcacccacactttggtagcaattgaggcgcatcttggggttgctagggagcgaggagataatgctcttgtactcttccagcaggctggggttcaccgccggcacgttgccggcggcgaggcgtggttgaacgtacggcaatggcactggccccatagcagtagattggtcggtggtgctagccatggtaggtacaattggcagagcgccatagcctctccaacaccgtaatactatgtagtattactacacaatctcacattcaaccaacgaagtaaaatgcatacaacggagttgttggattacttgggatcaatataggcgtggaactctcggacccaggggcgggcctaggattttgagattgggtattcggaatgaaaaagggtaaaaaaaactgttttacaacacgaacacaatatttggtacgtatgatcaataacatggtactaccttcgtttcaggttataagactttctggcattatctatattcatataaatgttaatgaatctagacacacatatatgtctagatttattaacatatatatgaatgtgggtaatgctagaaagtcttataatatgaaacgcttattgaattagaactcgcgacatggtttttagcaatttccttgatttattgtgatatactttgtgaaaaaacatatgcagtacaatctactaaccaagtatatatcgattagcatcaatcacagcacggctaatgcacaaattaggcaaccatgcaaattgggtttgaatttgagggagccagcctgctaggctttcttgttgggcttcttttgatcaataatgtttattttctttatttttctgctatttttttggtttaagctaaaaattatgtcgacagaattttgaccttattatagccgatttttcagccgcttgatcctctgatatttgtgcaagagcaaggcaggatgtggactttagagcaagtttaatagtatagccaactaatagctacaaatcatctatagctaatgtaatagctatttcatataatagttgcttactatactattaatatctaatcctacctgtcttggagtccgtgctgcagctagctacaggtctgtagcccgctgcttttctctctcttttttttatctttttaaaatatatttatagctggtttatagcctgctattgtacatgctcttagagcaactcatgtacctcttcaaggccagcggcataggcgagcaacggacatgccacgttgacagtgtaattttacggtgtgtttgactacattaattggtagatttagtagtactacttctcagttaagaaaaaggtaaatactactccagtaaaataaagggtttgtcaatgacatgtggttcagggtggcatattacaaattttgtaaaatttgtgtggtatggttcaaattctcccaataaagaaatagtaagaaccagcacggaacaacaacctcgcccatcatgaccaagacgggtcgtccttcgctcttccgggatcacgcgttggggtcttggtagagatggcaacggggaattcactgtcgggggttacgtctgcgtccccgtccccacggtgataaaatttcaccgtccctgtcaccgtcaacaacgatggggctacattttacccatctccaatccccgtgcggtgaatttatccccgcagttatcccatccccgcttaaacaacaaatccatctccaaatcaagagtacatatctcatcaatatttttctaaataattcactcaacaactgtaggccacagtatcacaaatcaccattacaccatatcaatatatatccaaaatatttcactcaacaaatcaacaaatcataggatcattcatctttgcttcatttgggattgtagcattgtgctgacctagcttcgtggctagaggcaggcgacagcatgaagaaggctggaggcagcgtgctcatcaatggctggaggcggcgggcggcgtgacgacggttggaggcagcaagccacgcgacaacgggtcgacgactggaggtggccggcggcgtgacggcgtctggaggcggccagcgatgcgacgagggctggagacggcgcgctcgtcgatggttggaggcgaccggcggcacggcgtcggccaaaggcgtcgggaccccgcccacgcaaggggacgcggtggcgcacggcacgcgcgtctagagcagcggcagcgtcagcggcggcgctgtggagtggaggactctaatggtgtgtgctgtgtggtggagtggggattggggaatggaagggctgactagggttagaaactatatatatatatatatatatatatatatatagacacacacacacttttgttgttgggcttcaattttatggaccaaaacgattataaagtctaaaatagctccctagctacagtaaatgctggtcacctcgggggatggggacggtgaatggagcaccgtctccgcccccgccatccccgatagtgataggttctggaccattagattcaccatgggtggtagatatcaatcatccccgtcccctaatgtgtgaaatcaccgcggggaatcggtgatcgggtctccattgtcatctctagtcttggggacgacgcattcccttcctcctctcatcccctccctcacacgccgcgacgcctcctcctctttccaatgagcagccaaaccctagcaccgtgcaatcctcactccacggcgccgcgcaatcctctacgtcgcctccatgtcctccttgccggcgctggcggcagcgcgggatcacgccacgtgagagctcaagcggtgccgccgcacgtcacttcggcagcgctgggggggaaggatggggacgccggaggtgacggcgacggagcgaggcggctggtgaacatggatgcccagaagcagatcaggatgggtgattcgctaccaattgtgccgtcggtggcattcatcagggttcatccgcaggctgaggtaagaaatctgtgttctcgcggttgtttatcatgcagattggatgggaaaatgacctctttccctatggcatggatcccttcagataatcagattgctcatattgtttccctgtgtttgattcttcatacctttttttttgtttctttttgtcagcagtgaaagcaaaccaggggactatatgtgcattggagggtgaagcttggtgagatgcattcatctgtattaggacgtgcgtgttccctttgtgtttgttacagtagtttatataggatttggaataaaaaaggggacagttttatgtgcaggggtgcttttggctgcggggtgtccttgttcccaaattcgatgggcacagttgtctggaccatgtcaaaatcgccacaaccaacatcttggttgtgctacaatgcatctgcattgcgattgggcatctactggaaaagaactggtaggtcaatgaatccattaccgtgcttgtcttgcaaggatagttctctcgcgtttgcactccaggtgtttgtagtttttccttacggaagggtagtttcgattctgctccatggcttgcaggggttgatcactagaggtgtgcttcatgcttgtcagtgctgggaagaaaattcacacattcctgtcatcctgtgtctggtgaggacctcttcttcatctattacttccactgatcagtcttcaattctgggcaaactttctatgtaccaatagttcgtgtagttagctcccaaccaaagtggaatttggtttctgttctgtacaggaaaacaaggtgacaatgtgacatgtcttagtttaacttggttttggctaatttaatcttgacaacgaaatgcactgtagtaggaatcacttgagaaattcatgtatttcatatatacacatgatgaaactattttttgcagttgtgtaagatttttttttatctctgaatttatcaaagccatatttttagaactttctcaaacccatgtaatttctgaatgtgaaggtccacttattgaaatggatggattagtcaactacccacccattcccataaaactgtactaaaaaatagattaaacaatcttgactgccctgtcccaaaacaattttttccccctgaaatacagacttaaaaggattgcatcacagtactatctggagcgcttttaaatttagaggacttaggtgctgagtgccaagtgctggatgcgagtaagcttgatcatttagattatttagagaatcagcatccttactcctgcagtaactgaattctaatgtgaatttccagtgttttctttggattagctaataacataaacttttagttgaaatatatatatctttgaaatcactggtagaatatttgtttcattgtagccatctaacctttttctcaatgaattgtatcagtagttttctaacctttttctcaaacttgtacatgaatatattttttttcctggtgaaatttctgaggccaatctttctgatctatagtttggctgcctttctatcagacgccttagattaaactcatggttgaagaattcctctgagaaattcagtcacagatcttacaggctattttattggctgtaatttatgtacctttggtctccattgtatcctgatgaattgagaggctgcatccaagggtaaaatgcgattatgtgcattgtggtagtgatcatgctgcattccaggttatgttggcttgatgaattcattactatcaatgtatgtaacctcacctctatatctccttttctttttctcattttccccttaatcatgtaacgttctaacttattatttctatcaactaaatggctataaggtacggctgctgtaccttcttatgttaagaaaatcattttgagtaccttcaaaggacacacaaaataggatcaagtttatattaacaagagagttacatgtgtaggtaaatcatgtgttttattaaacagacatccgttgaaggatcattcgacaagttgacagagaaagaacataccatcctctattattaatagacaacataagttatttactatttttctgctactttactaaatgggaaattttgttttacgaaacttgtatatcttacccaacatcctattaaaaccgtcacacttcaatcaatcaatgtaaaatccaacattgttgcagctaggttgacagtcagatattagcatattactatttctgtgcatccctctacagaatctaattacatccgtgaaatctgataggccggatactattaaaggccacaagatgttccattcatgccccaacatctccctccaactctatttcctagcgaagattacccaaaggtaaatacgcagctttacaatatcagttgcaatgagttgactaattaatgattgttgaggttttgagcttttcttgctttgttgtttggttttgtgctcttttgcatcatcagtctgtgtgaatgatgcaatatggaagatgtatttcagcgacttgcttccactatcactgtagatgacgatgatgtcatgatggcaactaacattctaaacgaacttgtttagtacatccgtgaaagataacggagcaccatcttcagggtccagaccagtagttcgatttcttcaagaatcctgaatgtagttagatttctatacatatcccaccaagctctaaacatgccattgtttaaaacatattttcagggctgcaggaat

SEQ ID NO: 59605 - DNA, 2228 bp, Oryza sativa
gttaactcaaaagtatgaaaaagttactcatatgctaactgaagtattgatccaaactaaagttaccaaagcagcgaaaagccgaaaacataagaaaagcttagtggcccattggagacaaatcaatagagcacacaagaagcatgttaccatggacatgttcaataggcaccaaacatgctatatatccgtatatggtatcctcaagtactatcatcctaaaatctaggttgctatctattgttatgaataagaagctaaaaaaccagtgcaagcagaaaagcttgagtcggaccattttttagaaaagtttagtgttcatgctcttctataatagttctgtaaaaaaaatactattttttccctgacaaactcttataatctcaaattaatcagttcaaccagtattgaactcccaaattaatgagcccgactggatatcttactgaacagaacaaaaaaaaaaatgcattagatgctcaaatgcttgagatttccatcatgtcattcatcatgaaattccctcttccaatacatgcaatggcaaaagcagtgaaagaacaactatacaggacagtacctgataggatgaggaagaataattatcaactgactggaaggcggccaacgtttgaggtggaagagttgtcttattcaaataagacagtgtttcttcagtctgatcagaagttcagaatgcattactaaccattttttttcagaaaattagtttgtccaatcaagcatttagaggcctaatggctaattgacccctttcatgggactggacaaaaatctaaccaaaaagaaattatcactttaatccattttatattcctcccaatgaacatcatgcatgactccaaaggttccagcatccattccatttcaatttcagagattataaccagaatatgagatatagctttatgcaacgagaagacacagcagaatagcctaccaagacaccgggttgggtagttggcgaacatggccatggcagtgctctcactgtcgggaatgattagcgagtcgagcccctggagccctagaagctgtgtcagcttcaccacctccaccccctcacctcgatcctcctcagcgctgcacccaccggccacaaccgtataaagccatcaataacccaagcacgcagcatcaaagcaaaccataccgaccatgctcgttgtaggagacatgggcgttggacttgaggcggagcgcaggaacagacgccaacgccgatggagaccttcacagagagggatcggaggagcgtcgtgggacggacggggatgcggtgacccgtcttggtccgagcaaagcgcacggtgaggaccattggctagggcctgcagatcatcagtgaggacccgttggctgggacgcgtgatgaatcaatgaggagggctggcgcggcagatcagagcggatcccactctgtcggtggtgttgctgttggagttaatttatttctagaacataccagcctactctctaaccctctctactactcgtgaaactaaagtcaaggttgaagtccttgctctgtaaattttctagaacagtgtagtgtgtagacatgcatgatgtgattttacagtagtactagtaccagtgaagtttgacaatgtagtagtactacaagtctctagctaggtcctgaagcttcctacatgtcggtttatcaagcctataaatagaaagccagtgcatgtgtatagactgatgatggtgtgctgcccaacgtacaagcaagtgtactgttcagccctcaagcaagcaagtaaagaaaccagttaaaactagcacaagcttctctgctcctcttctctgatcccctgcttaggaaatatttagcaccaacaactggtatcagagcgcccaggttcgagtagggcgtgacggagtagcacggcgtatcggtattgtcaattgaagctacaagtatggcttcaagttcgggcgccacaatggcgcagtctatggttcctgtatttgcaggagaaaattatgatatatggagcatcaagatgcggacgctgctgctatctcaaggattgtgggatattgttgagaatggctatcaagagtattccgctggagaaactcttacggcggaacagaaaaagtctttggcagaggatcggatgtcggacgccaaggccttgttcttgatccaacaaggagttgcggaaagtctatttccgcgtattattggcgccaag

SEQ ID NO: 59606 - DNA, 2824 bp, Oryza sativa
aaaggagataagaggtaagtttcttcagctaggtttgaagtgcatgctaactgttctcctcatgcagcgatgcctgaacatttagcacgctctcttcgctgtaaagaccagtgcagcatgcatcgttgtaaagtaagcagccattgtgtcctaattacaagtttattaagttgtgatcagagcatgatccttgtttaactacactaatgccatctgaaccaagcacacaagatcacggatcatagcctctagtacagttttcctgatgtcttttctctctctcttttcttctctttcttttcattcgttttgtcaagagacaagaggattggacatgagtatgccttttgatagtgtgcattccactaaccataccaactaacactagctagctagatcattctttaagcagactggactacaaaattcagacatgatctttctgaacaatgggagataatgttttgcattcttgcagtgctactgctgacaatctttgggagcagggaagccaatggaatcagctaagatagaactgaatgctcttgaccctcttacagtacatgttaggtgttgtccccacttaatccattaatttcaatcttcacttgtttaacctttactgtttgtaccacctgtagttgctttgacaagttctatttcacagtggcttaacacatggcctgagcttggctggactctgctgattggcttgagtttgtgcctgaacacaagctttgtctgtagttacctacatttggagtactagtgtactacatatgcaggtaaaagtaaactaactcttacttacagggttcagatcaagctgtaattaacgaagtgattaaagctaggagtactagttttgcagttacagttgaactcacctagaaagcttgcaaaggtagcgggcatttcatctaaaaaagcagcaacctcaacaactttgggccagctccctgcatttgcatgccagcagtgaacaatcatggtacatgtttcagttggcagagagagaaagatgagctcttgaagactgaacctttttttggccttcactttggatactgttgagcatttgacccttttgttaatacctaaccaccatctctctggcttctgctgtttgcaattacaaccttaagatctggagtagaaagcaatgcatttgccccgaaaaggagggtggtccattttggtagattatcatgttaaatacaatctcatgtgatctcaaatgtaggagtaggattgttatctttttaacagcaggaatctgattagcagtgtcacttgcatgaggagtgactaaactacggaggagtgcaagtgcctggggtcaaaatacacatgcaacttcactcaggtgacagaaagatgaccacctgtttagctaaaatataattaaagtagggaggagaaagtgaggctgagcatcttttcctaaaaagaatcatgaaaatagtatgaaatttatttactctgtattaaaatgcagctttgaaatatgatacaaactttagtgaaataaagttcagatccataacaattcctgatgcttagctgaactgaatacaactgaataaaagaatacaactgaactattttgcgatgaaatgctactggttggatttgatggaatagcaactgaatacacagaatatatatccaagaaccaaatgtcatggtaatttcctgatgaaaattaccattgctccaggcaatagtctcctagacaaatgtttcagccatgtgttctcctggtccaaagactgaatagtgcatgtacttactgttgatgagcagagcagcagcgttggttgatacggataaatacagttgtgaactaccaatcaatcacatgatctgctgagatcaaaccctgctgatatttacctaaactgactgctttactgaagattgaaagtgtttttactgcaatgttgagtacaatacagctatgaattagtatcaatcaatcacatgatatgatgagatcaaatctttctgatagttagttagttagttagttagttacctatacctgactgcattacagcagattaattgcaaagtgtttttactgcaatgttgagtacaaaatgatcacagtttaggagcttggtcaagggaatctactactattacacgagtagctactactacagtatctcaagttttagctgtcgagtggcagtgacaattgaaggtaggggccaccatgggaggcaggggtgggtccacataacagaatggatactctacctctacctctgtgtgcctgggatgccatgtgaggagcaccaagtagtaggacgtcagtctagcatatttcttcagatcaagtgatcaaccactctgctgactgctctcaccagggatcaacatttatgggcgatttcaagtccccaaccatcgccaattcatcgccacacgtcaatgcaggtccatggaaacaaaacacactagcgagatttattgtacgtttgcatgcattatatcgctaaaaattaggagtatatacataatttcttctcttgagcatggatggatatgaactgaatgccatgttgtactagttgagttgagcttgagcaggttagctcatgaacagttcgtggtcatgaatgaggtagtatgatactataggtaaactagccaattttttttttgataaaggaagcttttattaatctcagacgattacatcaagttgatagaaccatactaagaaaactcccggcctctgcataactaggatgcacacagccaaaacacacaaacccacaaaagagtttgtaacaagagaaggaaagcagtaaaa

SEQ ID NO: 59607 - DNA, 8329 bp, Oryza sativa
tattttaaatttaattaagttttatagataaatatagtaatatttacaataccaaattagttcaattaaatctataattgaatatattttcaaaatatatttatcttgattaaaaatattattactttttttaacaaacaaagtcaaatttaaagtagtttgactttgactaaaatcaaaacaatttataacttgaaacagagagaacatattaagcagtaaaactttgaagaaaagattcatttgatttttaacaacaactcagaagcgtgctaccaaaaaacacagtacaatgaaaaaaaatgaaacttttccattggtagggcccacatccagccacggtggcaaaagcaaaaggtcaggagagagagacacacacagaggaggcatggcacattttcctctctctgttttttctcggattttccgggcacacacacggttcacgaggcaacgggggttatcctcctccggcggctgccatgtggggcccacctgcagcgacctaccggacccggtgcgtgcgtgcgcgccggcgtggagtgagccgcatttgagccgcggttttggggtccgcgagggaaagaagagggggcgggggacccgaggcggaaccaaaccaaacccaaccgcgcctgttgcgttgcaactccgttttgttttggcgcgcgcgcgagggaaaggaagagatttcgcgggaaaggggaggagaaaagattacgggaaaggaggggggacactgggagggagacggggggatttggccattttacgttttggcccctgacctgctagtgtatttcgctgttttgtacgaattgtaaaacagagtgtcgagtcaaactctgatccatgttgggactaattcgtactgtaggctcgtacagtgatgggtgggtgtattggtacgctgtagttagtaggtgagcagggtcaaggctcacacaattttatatcaaggttttgacagggttttcattgagaattgtaatatatatataatatagaggtaaaccagatagtagctcattaattagttaggtctgtgttttcgaaaaaagaaataatgtatttagatcgacgaaccccttatatctattttaaaatgttggtgaacgacgtaactatattttcatatcaataaagatagctaaatataattgccccctaaaaatcacacaattataaaaggtgtagggaaaagaacacgtttttttattcaaactaaaaaaatattctgtattgcctgccaaaatcgtatatactcatagaatgtgtacgcagcattatgatcccattattaaaggagaaactaccatagtaataccattggtcaaagtgtttccgtattgtttagttgtcaccagtacaaccacagtaccactgcattgaacaactgaggggtcgatttcacacataatcataatcacaaggaccaaaacgcaaaaatgcacaataaaaaaccgcgaggagaaaacaaaacagagcacaagcagaggtaaaaaacaaaccaaaaaaaaaaaagattcatctagccaacacacagagagagaaaggacacagtcccactccccactgccgccgctgctccctcctctcctttctacctcttcccctgcaggcttgcagccaccaccaccaccattcccctctcttctcctccttctccctagcagccaagccaccaagaacccaatcccccattgctagggttcctcgcttcgccgccgtcctcccttctctccacggcattgcctccaccacttcccctcctcccctgccgccgcaaccattcattcttttccttcattctccaaggtggtgtggttgcttgttcttaatgcgtcagagcaaccggcctcattgctgggtaaggaggatgcaagattgcaagtgtataaagattgtgtgtaggttttttgttttgtttgctggttgcatctggggtttgtttttcttttggtttcttggtggcttggatggatgagtaaaagtttctgctttttgagctgtgtttttgtgggttgaagctgtgataatacactagtggtagttgggctgttttagtgaggggggaaagatggtgcttttttttacctgcatgattgggtgttaaaagctggtgaggggtttaaccaactctttggatcccttactaaagttgccatttctttgtactagctggatttttacctgcttgcagggaggctcaaagattcggtccttaacttgccattccgtgcttatttcaggttggaaggagctgaaaagttgggggttttatggtgatgtgtggtactgtggagatcagctgaaagggacaagtgttgtgggtattagtggcagcttgttgtgagagccttctggtagatacactctacacttccagtccatttttgctgcaagaaatgcttcaggtgctgtgtctttgaggctcagtagcttccaatctttgtctggagagcagcaatggggattcttgggagttttttggtgctgctcctgcttgctgcccctgcatttggccagctaccttcacaggacatccttgcgctccttgctttcaagaagggcatcactcatgaccctgctggattcatcaccgattcgtggaacgacgagtcgattgatttcaatggctgtccggcttcctggaacggcatcgtgtgcaatggcgcaaacgtggcaggggttgtgcttgatggccatggcatctccggtgtcgccgatctgtccgtgttcgtcaatctgactatgcttgtgaagctctctatggccaataacaatctgtctgggagcctgccgagcaatgtgggtagtctgaagagcctgaagttcatggatatctcaaacaaccggttctcggggccgattcctgataacataggcaatctccggagcctgcagaacctgtcgcttgccaggaacaacttctcagggccactgcctgactccatcgatgggcttgcgtcgcttcagtcactggatgtgagtggaaactctttgtctggtccattgccttcatctctgaaaggtctccgcagcatggttgctctgaacctctcatacaatgccttcacaaagggcatcccatctgggcttggccttcttgtgaatctccaatctttggatctaagctggaatcaattggaaggcggtgttgattggaaattcttgattgagtcaactgttgctcatgttgacttcagtgggaacttgctcaccagtaccacccccaaagagctcaagttcctggcagatatttcagagacagttctatatctcaacttgagcaacaataagttgactgggtcattgattgatggagttgagctctcgacatttgggagattgaaggtgcttgatctgagccataatcagttatctggagacttgccagggttcaattatgtctatgatcttgaagttttgcgactggcaaacaatgcattcacggggtttgtacctagtggacttctgaaaggggattctctggttctcagtgagctggacctgagtgcaaataatctgactggtaatgagctctacctgaaaattgttcttcttacaccttttgttccttttctcttcataccatgtggatgcccattctgatttaaaaaaattggatgtggggctccttcacaaaaggtccagcctccaaaacagatcggtagtgttcagcttgcataaaactttgaatcggcatcttacattagtgttcttagttcattataccaattgattctctcatttcaatgatgtactgatctgttgattacattacacagcatggcatgagcttttactgatctgtggttgagtgtgcaccagtgtaggtcatttgattgttttgtcttatgccaattctatatttgcattcttcttgttttgcgtgaaaggttctttcttggaatctttgctcctagcctcctactgactaataattttctccaaagcaattactggatcagtgatggctagcttgtgatagttttggtcatgaagagagacgttatttattatgcatgcataccccaatggtattattgagaatatttgaaagtagtttgtgatggatttctgttccacagtaatgttaaatgcattgtgtagttgcagtgacagtacatgtatcttaacctttgttgttagatcttcacctttggatgttgtgaaaaatacaattattaataggacgcagctagttgtatatacctgactgggtgtatgagtaagaatactgaactgttgcatttcaaaatattatgtctcacagattatatcttgcatttgagtaaagtcatcactcctagaactcaatgcattcatcatagttatctaaattgttattaaaagagcaggacaactcaaacacgctcctatgttttctgtcatatcatgacatttctcttaaaacaaaagtatcacttttaagttccacttgtgttattttggactaacaatatttttcgttaatccacaggacacatcaatatgatcacatcgaccaccttgcaagttattaatctttcctccaatgctctctttggggatcttccaatgcttgctggaagctgcactgtgttagatctgtcaaataacaagtttaaaggaaatttgccagttattgccaaatggagcaatgatttggagtatgtcgatcttagccagaacaatctaactggaacaattcctgatgtgagctctcaattccttcgcttgaactacctgaatctttcccataattccctagctgacaccatccctgaagctgttgttcagtaccccaaactcactgtccttgatctcagctccaatcagttcagaggtcctattcctgctaatttactcacttcgtccatgctgcaagagctctacatccacgacaatatgcttagtggaggtctatcatttccaggatcatcgtcaaaaaatctgagtcttcaagttcttgatatttctggaaatcactttaatggcagcctccctgatgaaatagcatctttatctagcctccaagctcttgatatatctacaaacaatttctctggtcctttgccagcctctatcaccaagcttgcagcgctcactgctctcgacatatcaataaaccagttcactgggtcattgcctgatgcacttccagatacattgcaatcattcaatgcctcttataatgatctatctggtgttgttccagtgaacttgaggaagtttccagaatcttccttccatcctgggaactcgagactagactatcctgctagctcttctgggtctggcagttcctctggttcagctggtggcaggtcactcagtgcagcagctaaaatagcacttatagcagctagtatcgttgctcttgtcatccttatccttgttgccattgtttgccattacaagcaaatctcacggcagttccctagctcagaaaaggtttcagacaagaacctccacaagactagcaaagacatggccagtacaaaaggaaaggatgacaaaggtggtttggtggtctcagcagatgagcttggtgctcctcgaaagggctctacatctgaagcactaagccaagaagagaagctgtcaggtgtagggggattttccccatccaaaggtagccgcttctcttggtcaccagattctggagaggcatacacccaggaaggcctggcacggttggatgtcagatcacctgacaggttagcaggggagttgcacttcctggatgaaacaatcacactgacaccggaggaattgtcaagggcaccggctgaggttcttgggaggagcagccacgggacttcgtacagagcaacacttgagaatggtgtcttcctaacagtgaaatggctgagggaaggtgttgcaaggcccaagaaagagttctcgaaggagccaagaagtttgcaaacattaggcatcccaatgttgttggcttgcgtggttactactggggtccaacagcacatgaaaaactgatcttgtcggattatgtttcaccaggaagtcttgcgagctttttgtacggtaatgctctcatttactggtttctcatttctgcaattgaacacatcaggcttagagatcttgtatactccatctgcacatgcatgtgactggttggttaccaatatgttcagtctctaactaagctttatgttcctctgaaacttagcagatcgtccaggaaggagaggccctccactgacctgggcgcaacggctgaagatcgcagttgatgtcgcgcgtggcctgaactacctccattttgaccgagcgatgcctcatggaaacctcaaggctaccaacatcttgttggacggacttgacctcaatgcccgtgtcgctgactactgcctgcaccgcctgatgactcaggctggagttgttgagcagatcctcgacctgggcgtgctaggctaccgtgccccagagctagcagcgtccaagaagccatctccctcgttcaagtctgacgtgtacgccttcggtgtcgtgctgctggagctcctaactggcaggtgtgctggggatgttgtctcgggttctgaaggtggtgttgacctgactgattgggtccgtctgcgggtggctgaaggtcggggatcagattgctttgatccagccatggcttcagattctgagaaccaagtttctgtcaagggcatgaaggatgtgctgggcattgccttgagatgcatccggccggtctctgaaagacctgggatcaagtctgtgtatgaggatctttcatcaatctagtttagcctcattgtctctagcattagatggatactcttctgtgtgttgagttgagtgcattattttgactgaaaactctagtgtcgctgtagcaaatgcaagtgtatggttggcctcgccttgatgcctccaagttcatatggcatgtctcaattgctcaagtgtcaatgctgccttaattgtttacataattttctcttgcaagttagagttgcaaattagatttctctgtaaatccagtcacttgaatctgtgatttggttgtcagtgagtcgtactaaccaggacggtactgaacatgacggtactgtcagggacttgtacatctcatgtgatgtttgtccaatgtactggcaagaaataggattcatgttgaacatcatctggatgctgacaggtgacagcaagtagtttcactaaaatttgtgtatatgtacagtactaatcttgtgatgctatcttggacatgggaggaaaacacacgaagaacagtacaagagaacactcgtgacagactcttaagacacatgattctctttagatcaagccaacagaacagcaaacatgagaagtaatagccatagatcacatgcaaatgcactaaaccaaaatgttatcctagacacacgcaacaaaacaagtactcatactacagaagtataataaattctacatcagtatcatcagacttcgttgcaaacacaaccatggatcagtaatttttcaaaacagctatgggtcagaaattaaattacaggatttttccattcacacagcaactgaaatacctaagcacacgcaatccgcaagaaatataaaacacaaatgccaatgaaattgtcaaattgaattaatgatcctagtaggcaagtctagcttcaaataatcatggcacattggagatttggggatcagcgccggtaacccaaaaatccccaaaccctaacccgttccccaatgcggtcgttttattagtatgcgcccgttaatgaaaccctaaccctcccttcttcccgttcgtacagatccatggttgccatcgagtttgcccttagtagcagcattgcagcaacgagaagggaagggagtggagagaaaattacctccggcgcggcggtggatgcgtggattcgaactgcgaatggaggggcatccaggctctaggagtggcggtggccggtggagacgatggcggcggcggcgcggcggcgccggcgatgaacgggacgacgaggcggagagaattcgtattggtaaaacccacgcaggggctattttgtaaaaatgcaccaaacccactggaagccggtcgccgatctgagccacgcagttttgatcggacggtgtacgacgacccgaggattggatcgctaccaattttattttagcggtccaaataggggggttcatttaaacagtaatatatttaaagggtgtttctgcataagttgctcgtaccgcttcgagtattatttaatccacgccgtgcatgcacgatccaagaatttttcaaatcggcccctatgaagtgtaatgttgcaagttcaattcatacattggt

SEQ ID NO: 59608 - DNA, 16538 bp, Oryza sativa
  unsure (1)..(16538): unsure at all n locations
cggcgtgaagtcgttcttgatcccaaactccttcctgatctgctccggcgacttgcctttgatcaggttcgccgtgtgctggcagcacaaatccagcaagctcttgatgttcatgaaattggacgccaggagcaggtcgtacagcatgttcttgtccacatcgatgaactcggcgtcgaagctcttcagatccttctcctcctcctccccggcggcggcgtgcttgatgcagtattcgatgaccttggcgaggaccttggaggcgacgttggggagaggcaccccgttcgtcgtgcagtcgtcctcgatcatgttggagacgagctgtgacaggctcgccgccgccgacggcacgttgaagtgctcgccgtcggagctgattaggaggattgtgtcgctgccgctgccggcggcggcgtcggcaacctccttcttctctgccgccattgatctctctactttgaagtttgaacacggacgaaagaactcgcggattgcaaagctcaactgtttcttgtcttgtcttgtcttggaccccaagactcttggaacgttagcgtttggtgcttggatcacggcgagaggtggtctgtttttattgcgtgaaaccgcgcaaaaacaagacggatgcggtgatccggagtccgaatctgatccaaattcaattgattttcagttatttccgcgttagttttgagtacgtacaaacgtacgtacgtcgtgaagagatttaactggactcattttcgaaaccttctcccatggtctaattggactccttttcgaaacgactactctaattatttctcgatattaaattacattattacagaagtaaaatgagattaaaatacgactcctactcggagtttaattatctcccgctggtttaagcaataaatacaaccacacgaggttctaccaggggcagcccagctataattaaagggcattcagatgtatacccaagatttttggacaaaaaataggtatatatactatatagttcatatatatatatatgaaaaagatcagaataattggggttgcccaaaaagtcattagtagtactcaaactgcttttattactgggagaaatatcatgaaaagagttgttattttacatgaaactattcatgaattgcatcgcaaaaacaagaatggggtaattattaagattgactttgagaaaacttatgataaggtaaagtagtcttttgttcaacaaaccttaaggatgaagggtttctggtcaaaatggtgtcaatggattgcctcttttatctaggggggacatgtgggtataaaagtaaacgatcaagttggttctaattttcaaacttataagggtcttagacaaggagatccattatctccaattctttttaatatagttgttaatatgcttactatattaattaagagggccaaggatgatggtcaaattagtgggattattccacacttggtggatgatggtctttctattttgcaatatgcagatgatactcttatttttttgaacatgatctactacaagccaaaaatctaaaattgttactatcgacttttgaaaaattatctggccttaaaattaattttcataaaagtgaattattttgttttggtcaggcaaaggaatgtcaagagctttattctactatttttggttgtaagcttgggaatttccctatgagatatcttggtattcctatgcattttagaaaacttagtaacaaggattggaaaacagttgaggaaagaattgaaaagaaacttagtagttggaaaggtaaacatatggggagggggggaggttggtgttgattaattttgtgctttctagattagccatgtttatgatttctttttttgagattccaaaaggaggtcttcaaaaaaattgattattatagatcactttcttttgacaaggggatgaacacaagaagaagtataggcttactaaatgggatatgatttgtcaacccaaagattagggtggtcttggagttcataatcttgaaattcaaaatcaatatcttttgagtaaatggttgtttaggctcataaacgagcagggtgtgtggcaggatctattgaaaatgaaatatctttataatcaatcctaaagtcaggttgagaagaaacaaggggattcccatttttggtctggtcttatgaaagttaagagtaagtttctaaatatgggttcctggattgtgaataatggtgtacaagtcaaattttgggaagataaatgggtagggaattattcttttaaagataggtatccgtcgttatatgctatagttcgtaggaggaatgcttcaattgcaaatgttatgtctcttgtttcacttaatatttcttttaggagagcttttagtaggacagaatttaaacaattggcataatttatgtgcttcaattgttcatattcatttgtcagaggagaatgatatttttagatggaatttccatcaaaatggtgtattctcggtttggtctatgtatttagctttaattaataatggcaacattgagaggaataagattatatggagacttaagatgcctctcaagattaagatttttatgtggtacctacttaaaggggttgttctaacaaaggataacttatctaggagaaattggcatggtagtttgaaatgttgtttttgcatgagaaatgagactattcaatatttgtttgtagagtgtcattatgcaaaatttctttggagagctctacagtttaatgttggtttatatactcctcatagtatatcttatatttttgagaattggctcgtgggagttataaaaaatctaccaaacttattcttgttagagcatccgctatatgttgggctatatggttgtgtagaaatgatatggtttttgataaatcaccatctatatcctatatgcaggttcttttcaggacaacatattggctccgatcctgggctcagctacaaaagtgtgatgaagaaatcaagtcaatgaaagctgcatgtcgtaatcttgagtcattggttatgcagctgttcgccaactttggatggagattcacaaatagaattcaataatttttgtgatcgtttatgctgtgtgtgttttattagttcgtctatgcttttgtttattcaggtgtgagtttttgttgagttgatataataattggctgtagctatttgagtaaaggccgggattatattccattatctaaaaaaatgtatgaaaaagataaagaaaaagagttaaactacttatttgggccttgttttaccatttctgttgtattgggcctaaattttacactcccctccccctttccactcggcccgcggtctatttgggctggaactgagcccatttccaaacaaaaatcccctcctcccaaaaatccccaattccctaagaccttaaccctaattttgcttggagacagccacagccggcggcgtgtgttgcggcgcgagtggtggcgtgcgttgcggcgcgggcggcgggcgcggcgtgcggcggcggcggcgcggcgagccgaagaccacgccagcacgggggcagcacggcaggggcggccgccggctgggcgcaccggcggaggcgggagccgcggcgcagtgccggcagcggccgtcggccgagtgggcacgatttccggcaagacaccggaacagatgagggagacgctttcgattaagaacgaattcacgccggaggaggaggcggtgatgagctcttttcctatccttgaaaagatactatgagataccaatcaaatctagccattgatttggcaggggcacgataggataaaaaaggaggtattcgctgattgggcctctgggtcggctacgctcaagcagcgagccgtcgtcgcaatcccttcccgtcaagtcagagcgcgagtctcggggcggagcgtttcgtcctccgccgcagcagttccgccgccgtagcccctaatcatccgtcgttgccgccatttagttccgccgccggcgccaatgccggctgggagtttttagttcgcccaccgcccaccgccgccggccatcccggacagagcagcgcaatcccctactgtgttctccttctgtcagttccgtcgccatcgccggttgatccaatcgtttcgtcgccacgccatcgcctgtgttgctgtatgtatagattagctggcaagattatttgtattggagcagaagtacttgcatgttatgtttttttcacttgagctaaactgtacgagtagctattaatcagttctgtttaagtgcaaaatatccatgcagtgtgcctggatttgaagatgtttgttagtttgaaatatgcatgtaccacacgcctggagttgaagttgtgtgtaactgggtgccgaattacacaacagaattacacggaagaaccaatgccgaaagaacttcatagccgccagaaccgaagcagccagaacatcaattttcaaagcaaactgaatagcatccatttaggattaaacagatgtgtagatagttcatccactaacttaattacatcataggaaggcagtacatattgcttgataaaatagtgatgttcatccatcacagtacataagtgcaggaacattaagactaagcacatcgtcatatagtcttcacgattacatcatatatactaacttaggagtggcggtacacagtgccaggcaaaatggtgatgttcatccatcacactaactaagaacatgtacttcaagagtaagctcatcatcagagtcattgaaacggaaaacacatacatcacccatcttgacagcttcggcatcaaccaattgattccagccggtggccaaactctccaggatctggcggtgtagcggtgtggccctacgatctggcggttcctctccgttttccaggccacgactcccgcagcagctgaatctaaccgctgttgcgctgttgacagcaccagccccaccctacttgcggcagaattgcctcaattgcttgaaggggagcacgaccagattggggggggggggggggggtctagggatctgccatcccccatcatctgcactcctccctctgcgtgcgcccacaacgaaattggagagaaagatgagagaaggaaacagagccgagagaacgaaagagatgggcagatgaagacgaactaaggaaagagagcccagagaggataccgctcggcggaatcgagcggaatcaaaggaccccttctctctcgctgttgcgggataacgcgaaaataccttttccccccacagcggtaccgctgaaaccagcgcgtgcggtacgacgcggtacgctccaatctcagccgtccgatgatacaagatcgatggtcaagatttggtacctcacatcctcaaggacagtaaaaaatctccatttgtaatcgtttcgactcctaatttataatatgcaataaagttttgttttgttttgttttgtttaagaggaatttcaccatccttgaggaggtaccactaggtaccaagtatataccattcaaatctaaccgtccattttaaaagggtaggatattggaatgtgtaattgccagttcctactcgcaacaccatcgtctcaaatcattctctttgcgttgcgccgcagtgtgcccatgctctggcactgcgccgtatgcctcgtgaggccgtgctcctgtgccgcccgtcaaaggagggtaaattgaactgttttgatagttagagagtgttggtgttaacgaccgaatttggtaatttaagtatcggagatggatataaaaccgaagcggaatcgaagatagagaccgttccggaaacagaggaagaatcggctaaagtccgaatcggctgcaactagaatcggtagagttctagtcggacaaggttagccgattgagccgattccgacaatacgattcggtacacgttatcgggttgaattagggtgcttcatatggattgccacgcacggattgagtactgaaaaggcaattgtatctattaattatgatattttatgtaaattccttatacataagtttggcaaaagtctgccgcaaagatttatggtatcttagagtttgttagagataagagtcgtgtccgacaaggacatattttgtatctcgggtataaatatgacccgaacccatgtaatcaaataatagacgttcaatacaatctcggcgcatcgccacccttttacttcgtttactttcgacgagttcttgctttcgggttgagctgcatcggtttcgatcttcagctagaggtaaaacttgttatggcggcttgtgttctcgggattagtgcttccatctttatgatactctaatcttgtttatgtaattcgtctagttatcatatatcttatataatctttgataatattgctatttaaccttcgatcaactaacatctatcattggaaggcagccgattaggttaaatagcaatgttggcttagattatataggatatctaccaccctatgaaacatccaacggcttgattgtctagatatggtccttcttttcatacttataactgcatcagttgagtttgaccttataagtcgtgatgagaatctcaatctctagcctgtttttggtagtcgattagggtagtatcggggtttcagccgatcttatctgatttaactactttatgtcttatatgctttattgacatgttaaatccgccctttatgttaagatcttgttgcatttcggtatattaagcttcctgtctgatatattctgcctgctttaatatcttaatatagagtggtatcagagtattaaccgatacatgctagatctatctaatcggctatgttatgaacggttataatctttatgttaatgtatattttgacctaagtaatttatactgtctcggcatgacgaccgatctatcccaatcacttgatttaaatatacatcgacagaaggattatatatcgttaatacctacagccgatcgaatagatttagttctttttcagttattcatgattgccgatcgattcaaatatgacatcggctcaaatataaatgatacgtcatcagcgactggccgatcggctatcgtttatggatttaattgttattttctgtctttgtttcttgttgattgcatgatcaaattaactggcacgcttacgaacctaaaggcaagatttttggacctacactgaagttaagcagatctttcaggcctcgtgtttttcgcatcaacagttggatacccggtttaagagtttgggatgagttttaaacctagacaagacttgaagggtgtaaaatggactcatccctatttttttattacaatatatgtagaaatattaataaacatataattttatttatgtttttttagactaaaacaaatatagttctccttatatctaacacatactttagatcttgatattcatagtccaagtttttaaaactttgacaatagtctttgttcaaatgaagtattatcaacccctctggaagtacaaacttatctatactctttcttcctaccttctactcatttgttttcactgagtacgcttcccgaatggctagatgtaccacacattttttcacaaaaaaaatatatagcaaaattaatttaaaaatttatattaattcctttctatgtttttctttaagctaagacttaattattcatgcgctaatgagccaccctattttacgtgtgcgggaaagaagcttccagcccctaccacagaacacacaatctaatactcgtacttttcataatggtttactagcctatgatattgcgcattcgcgtgactctatgcctcatgttacatggtacacatgagtggcaatctgtttttatgggtttctcatcgctcgaaaaaaaatgggtcaggatgactaatattatgctcatacaatagatagcttaatatttattacaaattttatatctgcgtgagtcattgttttataggttttcacggctgcatgaccccttatttcgtataggcgcgcactatttatagcctatgctgaaatattttgtaggtttttaaggaatgaatttgatttcattttaaattcatgtgaaaaacgttaaacctatattcggacgatatgattgtgcatgttattgtagcaatttttgcctcaaatatgttaacaattaattgttagaaacaaaattaatcgtatgaacgcacatttgtatatgttcttaaatagccgaatcttgacatgtgaatatgtgattaggatgagggtttatttgtaaaataatttattttattataggagcatttcgtaaattatttgcatcatatgcctattctctagctttttttccctttactctttctttcctcttctagtagctttatcaccggaagcctctttaattattatttttatcatccatctaatccaacggtccagatttatttattctcaattcattaaatgatgtcactcatcctcaattcattttgagttccacttttcattagttaagatatcgatagatttagtgttggcatcttcttgcttgatgcaacaatactactattacttaagtaatcatgcacgtgcaacacacgtaataaccgctatgatttaaaccaagcatattgcacatgtaatgcaagttttccatcatattgtactnnttcagaaaccataatagaaaaaggtaaatcattcaccgatactatattgaaatgtaatgtaccaacaatacacataagtctctatatacaaatacatacgacatacaaaaggattaggatcaatggtctccgatctagcactttacacattgttgatgcaaacaaacatacactggcctgagagatttgcttaactctagtgcaaaaacttgccttagggtctagggcgtgccaattggtttgatcctacaaccaacaagaaacgagataaacagttaaatttataaacgatagccaatcggctggagggccgatgacatatcgtctttaacctagccgatgcaacctggtttgaatcggctataagatgtagcaataaaattaagaccctaaattcgtgtcatcggctgtaaagatgaacgttacataatctatgaatcgtcattacttcaaataacagtgattgggataaatcaaacttaatcgagacagtataaatcacttgtatccgaagttctatgaaataaagattatacaagttcatgtcatagctgatgaacaaatttaagcatgtatcggctatagctccgatacaaccttatactggaatattttttttgaacaaatatgtatctaatgttagattaattctaacaagaccgatgataagcttaatatatttagatgattaagattccaatataagggcatatataacttgtaaagcaatacaaagcaaagcaaaacaattgtgcccgagcatcgtggcgaaggttcgggtgtaaaccatgcgtcacatcacgacgtggtaactgcggagctcgaccctcatgtcgtcgtgggagtgaaggagacgatggtcaatcagctcactatacaattggagttttttttatcaaatgacaacgccctccatttccattaatagaaacccagatgagactacagcccataaaagagaaaaatgaaatataggttctagtacagcgatcaggccacatccaaaacaaacaggcgttcacaggtcttgcaaacaaaaaaagagcacaaagaaaggaaaacccatctaagctactacatctgtttcaggttataagactttctagcattgtccacattcatatagatgttaatgatctacgcacacatatatgtctagattcattaacatatatatgaatgtgagcaatgctagaaagtcttacaatatgaaatggaggaagtaagaagcaaaagccttagtattttccaactatccagatattgcacgtagttggtgtttttgttcattctcctccccatctggaagtccagttgtgttcacccctccaatcttcttgatcctgttctccatccatactgtgatttgaagatctcatttgtgacctgttttagaagttgtaccccccactgcagctttcttcgcttttcctccgaaatctgcaaaacagcccaggttgatatccagtaacaagcacaaaaaataatttcagttggatcaataggataaatttgactaaaacatgcattatttctatgtttccagattgaccaaagtactgctgcaacccccactagaatcaattggcttgttgttttgtccttgccctgtatccaatctccccaaatatgtttgagacttgtgatctgttttaaatcaaaagcacagaacaccacattccatgtaaacctggcaagtggacaatctaaaaataaatggtttactgtttctttttatcacagaattgacacaactcagctccttttttccaccctctcttcattaaattatcctttgtgaggatgctttttcttatcagaagccagataaagatccttatctttaatggaacttttaacttccagatttttttgtgcttccctggcaatcttgggatcatatcctgtattttcaaaaaagtgtaaaaagttttgagagtgtattccccattcttagtttatcttttttgtatagacagtttgatattatcacatctttgtaactttgttttattcattccaactcctcagcctgtctccagttaagtttcttctaaaaacaattgattgccaacctttttcttttaccatagctagagttatattttttgaatgagtgacactgtaaacctggggtatttgttcagctatgggtctcccacccaaccaattatcttcccaaaaaagaatattcttcccatcccctggctttttccttatgaactgcatgaatgcctccttaatatctatcatcccctgccagaaatgagaatcaccatttttcaacttcttgtttgcaagaattttctttatcagatacttttctctaagtaattgctgccatataccatctgtattttccaaaggccaaagccatttcccgagaagtgctttgttcataatgtctaaatctaacaaaaccatgcctccctgatctctaggtgaacacaccacaggccactgcactatatggtactttctgattcctcgatcttcctgccacaagtatcttcttctatagaaatccattatttctttgaccccttttggaattctataaaaatacaacatatactgaggtgttccactcagactggaatttattagagtaactttgccccctattgactgcaacttcctttgccagcaacccactttcttctccattttcttttctgtctgcccccaatccttatttagaatgtgtttttgatcaattggtattcctaaatatctcataggcaggtcccctttgttgcatgtgaaaattttgctgtattcctgatgcctcagtacatcatttccaaggaaaataacttcacttttgttgaaatttattttcagtcctgacaattgttcaaacaaacacaaaatgtttttcaggttctttgcatcttccagcttgtctctcaataaaaagattttgtcatctgcatattgcattatgcagaattggaatactacactcattatttatctccaacccttgaatcaactgtttctgttctgccctctgttgggatatgcagaggctacgatagcataaatcaaaattttctaccgtataaactaggaaccatgcaagtattagatcatagatcattaccactcgacgcgctgcacaacggaagaaagtgctaagtaggtgaaggaaccctcgcgatgtagcgcgcgtcgatgtagacgaagtagtcgatcgcaccggctcgaccttctcctcctcgtgcgttctcctcgtcgttctcccacgccgatcagcaccgcaaaacagcggcgcctctaccggtatccacacgtacagggacggaacaccacgtgcagatgtgctagcacccccacgcggctagggtttgctcggagaggggagtggcggctagagtttctcacgtgatgcaatacatccgtcggtcacaccagtcacgaatatataggatccaatgactcgggcctccaaggcccgtaggactcctatttggatccctatccgaattaagctcatattggatctccatccaattcccttattccggcccattaagcgtgcaaccctataggttcacgtacactcggctgtaacctaaaaactccttttcggtccacgtgtcaacagcggcccctagcagaacgtattgacccatcgggcatacataaagatcacatcggctgaacctctagtgtatacttgtatgaacccctttgcctcacgacatcgattaagctcaaggctagatatgtgccatcctctattagctcaatcattcactcgaacctgtgatagattatataatttgtgattgactcctcaatcatctttggcatagccatacacttccataatctataacatcgaggggcccagagatatctctccataggaggggcaaatcccatcttgattattcatatcccactacatgtttcatagcataccctaaaactacttttataactacccaattacggagtagtgtttagcagtctctaagtaagctactacacatgtcgagaaccatgataatctcaggtctaaggattcagcaccaacattaaatgagatatcactgatgacacaacacatatggctcttgcagtctcttgttgggtctatccaacaacatgttccccaacatgtgtccacattattaatttggtatctttataccatgatctatgagacatgatcatcaattaatacatgtgctgatcatttaaacatatttgttccacatatgatatttgatcagagatcctttagaaatagtaacatacaacataaaaagtctcatgaaagaatcacatattcattaatcaataatgagttatctatttcaaggaacaatgtcagataaatatgtaaacataatatgcgatacaatcatctctatgattgcctctaggacatatcaccaacaccctctacaccatcatagtcagtgcttctacagccaaattaaaaagcaatggcgacatggggtcaccttgtctgagacctttatatgtactataaggaccaatctaatcattgatcttaattgcaaccttatcacctctcacagttttcataatccaatcacaccatttgtcaggaaatttctttgctttcagaacttgaaaaatgaagctccaattgactttgtcatatgctttttcgaaatctaccttgaataacaaaccactctgttttttctgatgtaaggaattcaaactctcatgcaagaccaaaaccccctccattatgtttctgttctttatgaatgatgtctggtttttggctatcaagtattgaatgattgtaaccaatctcatcattaacactttagttataattttaaaactcacattcaacaagcaaattggcctatacttctaaatctgtaaatgagtttttgagactagattatcacaccataattcaggttttatgtcaatgagcccttgttggaaatctaatataaccttcatcaaatcagcactaatcaagccccaaaaatgttcatagaattcaatgggggaaaccatcaggaccagggtcccaattttttctcatttctttcacaactgccaaaacttcctctttgaaaatttctttaatcagatcttctttgtcttcttcctgaagctctgagcatccctccatgttaagggacatgatatttgtctcagcatgaccagatagatttttataataattggtgatgtactcaaccaaattgtgctgatcttttattgctcattcctctcttgcagtaggctatatatatggatcttcctcttcctaccatttgccttggcattgtagtactttgtattattatccccgtctatagtttcctgatccttgcatctctgaaaccatttaaccctttcttctcttattgtataatttaacttctgttcgaactcccttctcagttcactgtcctcccaattcatcccatggactttagtttttctgtcaatttattctatttgtgaaattatttctttcttttctcttttatacttaccttcccaattcagttcatgtgtcaattctcttaggaaatcttctttgttttctttctaggcagcctcaatcatcaaatcccactccttatcatttttattcacaattgtttgtttgaaaaaaatattttcctttttatttttgtctctataatcccaaatatttcctcctttaacccaatcaaaattctcccacacaaaaactacttctctatcgttcaatgttttaatcttgcttcttgtaagcctaactagtccaccctaatttatttaatcaactctctcaagtgctttagctttttttggggtttttcatacttcttatgctctatataagacctctctcttttttttctttttattgtttttcgcaggtttttcttattagttttgttttaggggttatcttatcatggcaaggttcccgttttgtatcttttttgctactatgtgaatgagactgtatcaacaaactttcaaacatatatatttcaaatttattgtaatcagaatctatttcatccaacaaatttaaaatgtcgggtacaaattgggaaggggtgaaacttgctgatagagaggactaaatgcagtgtctggatagttagaaaatactgagtcttttgcttcttagcttagatgggcttcatttctttgtgctcttttgttgtaaaacctgtgaacgcctatttgttttttatatggcctagtcgctgtagcagaacctaccttccttttctcttttatgtgctgtagcctgatctacgttctattaatgaaaatggagggtatttgataaaaaaaattccatcttctccttcactcccacgacgacatgagggccaagctccggggttaccatgtcgtgatgcgacgcatggttttcgcccgtaccttcaccacgatcctcgggcatggggcactttatcttctactgggctcgatcgactgggccaaactcattaaatactagttgacaatgataggacttctattggtggcaagaagagcgatgaatcataaatgataactagttttatctagggaactgctgcagtggtcgtaaggtggatgcggcagatgcagcgacgatatcgtgttgctcgtgaggaggcgaggagcgagcccgctcgtgagcaggaggtggtggcaaccgctgcgtagttcttatgttttgctctatagcatacgtttctgtactgagctattgttgtttatggattaaacaaatttggttatatgttttgctctatggagtagcattttgattctatttttctgtattgagctagtattgacttgggcctcatttccatataagttgctgtttgagatgcaattactgaagcagcaattatatggtagcatgacgattgaactaaaaactacaatgtcaaccctattagttccattctagggcagtgattatgtgaaaataattgaagccgtgttggcggcgtagcctgctccacttgcaccattaccggccggttaaggtgcatagctgctgctcatcgtcgttgccatgcacggctagtggcgatcaccggcacctggcgcagcacgtcgatcattttcgaagggcgcacagcgccggcacagggacagggtgcctaattaacttgtcgtcgttgatccagtactcacacacctcaccgggcgctggcacgtacgtgctctgcttccccaagatccgttctgagagcgtggaagtggaacgagacgccaacgaccgaccgccatcccagtcccagaccgatgtggcagcgctgtgcctcacgagtgcgcgcgccaacaaggagggccaggatcagccccaagtcagacacgctgaggtcgagcacgttgaacgcgctgtggggatatggaatccgccattacgatgatcgatgttcctttgcgcgattccggtacgtgtacgcgcgcgccagccgacgtcgtcgagcgagtctagactccagagcgcgtcttcgattgtcatctcgctgctcatgtccgcatgctcgccatcctcgccatgacgattggcgatcaccgccaccggccaccgggcgtggcacgcatattgcagcatagggtgctgaacatgccatcctcgctgatctagtgcttgccgtgaacgccgtctcgcaaacatccgtgccacgcaccacctcgccttagtcgagcacgttgaaccatcgaagcagcagaagcttcactcggaatgggcaagaaaatgttaacgatgtgggtgaggtggaggcgagcaaaaatggccctcgaggacataaaagaagctcttcacgcgcaccgccgaggctggctagtaggtgaccggccggcatgctcgacagctcgaggccgtct

SEQ ID NO: 59609 - DNA, 10604 bp, Oryza sativa
cccccccccccaccctctacccatgccatatttttcctctcctctctagtgtagaagagagacgtgcaacttttttatttttattttatgtttttgatatttttttcacacttaggagcccacaagaaccaaccatagaaaagttaaactcaaatagatgaaatatgtgacctatagaattttccaagactctaccaaaaaacttcttgtctcgaaaacacaatctaagtttgaccaagttaatagaaaaatatattagtattttcaacaaaaaaacatattgtcaaaatatattcaatattacattaaatgaaacaaattcgatattttagatgttgctattttgttctataagcttagtcaaacttgactaggaaaaagtcaaattacttataatatgaaaaagtcaaatgacggtggtgggccggtaaatgaagatttttgttccccacttagcgatttctatggccatcatcaacatagtttggaagatatgagttaacgaccaaatttggtaatatatggattggatttggagataaacactgaattagatttggaagagatgcgatatttctggaagcagagtttgcatcggctggaagtctgtataggctgatatcgagttgaacacggtgagtcgatacaaccgatattggcaagattggtctcataatcaatgtcggatttgaatgaagagcatcaatgatattgctgggcaaggatagagtccgagataggaaattgtatccattaattaggatattaagtattttccttattaagagtccacctaagggacttgttcgtcggttagagttgtaataggaagtgtgagtcgtgtccgttatggatgagttatgtatttgggtataaatatatactctcggcgcatcgccaccttttcattactttacttttcgacgagttcttgcttttgagttgggctgcatcgattacgatcttcgacaagaggtaaaacttgttatggtggttagcattttcgggatttgtgcttacatcattatgacactctaatcttgctcatgtaaaatgtcgagttatcatatatgttatataatctagattgacaatactttgtacttatattggtcgatcactttctagggttttcccgataacggctagattactttgttggcttagattagtataacatatccaccatcctgaaaaacaatcatcatcttgattgtctagatattatgtttctctatacacttagtgttgcatcaattgggttcgacctactaagtcatgtttagaaccataatctctaggctactttatgattgtaattaaggatagaatcggagtttccaccgatcttacatgatataattgttttgctttgctttgtattgctttacaagttatatctgcccttatattggaatcttaatcatctaaatatattatgcttatcatcggtcttgttataattaatctaacattagattgatatttccccgcaaaaaaaacattagattgatatttgttcaatatatttatattagagtaatattccagtataaggttgtattgaagctatagccgatacatgcttaaattctttcatcagctatgacatgaactcgtataatctttatttcatataacttcggatacaagtgatttatactgtctcgattaagttctatctatcccaatcactgttatttcaagtaatgatgattcatagattatgtaatgttaatctttacagctgatgacatgaatttagggtcttaattttattgctacaccttcagctgattcaaaccaggttgcatcggctaggttaaagacgatatgtcatcagccctccagccgattggctatcgtttataaatttaactgtttatcttgtttcttgttggttgcagtattaaaccaattggcacgccttaggtctgaaggcaagctttttcactagagttaagcaaatctcttaggccagggttttattttttttttgcatcaacaatgtgtaaagtgctagttcggagaccattgatcctcatccttttgtatgttgtatgtatttttatatagagacttatgtgtattgttggtacattaaatttcaatatagtatcatgaatgatttaccttttttattatggattctgaattacataaaatatgacggaaatcttgcattacatgggcaatatgcttgttttaaatcatagtggttattacatgtgttgcatgtgcatgattacttaagtaatagtagtattgttgcatcaagcaagaagatgccaacactaaagctatcgatatcttaactaatgaaaagtgaaactcaaaatgaattgaggatgagtgacatcatttgatgaattgagaataaatgaatctggaccgttggattagatggatgataaaaataataattaaagaggcttccggagataaagctactagaagaggaaagaaagagggaaggggaaaaaagctagagaataggcataggatgcaaataatttatgaattgctcatgtaataaaataaattattttacaaataaaccctcatcctaattaaatattcacatgtcaagattcagctatttaagaacatatacaaatgtgcgttcatacgattaattttgtttctaacaattaattgttaacatatttgaggcaaaaattgctgcaagaacatgcacaatcatatcgcccgaatataggtttaatgtttttcacatgaatataaaatgaaatcaaattcattccttaaaaacctacaaaatatttcagcataggctataaatagtgtgcgcttattcaaaataaggggtcatgcaacgtgaaaacctataaaacaatgactcactcagatacaaaatttgtaataaatattaagctatctattgtatgagcataatattagtcattctgacctatattttttacgagcgatgagaaacccataaaaacatattgccactcctaagtaccatgtaacaggaggcatagagtcacgcgaatgcgcgacatcacaggctagtaaaccatgatggaaggtgccagtattaggccgtgtgtttagtggtaggggctggaagcttctttcccgcgcacgtaaaacaaggtggctcattagcgcatgaataattaagtcttagcttaaagaaaagggagaattgcaaatatatcactactttccaccccctaactcggaatagccattagaaaaacatgaattgcaaatttgccacttaagttagcattagagggaatgggaaggagaattaaattcagttagcatccatttgatatgctatggagccttagccaaatgtttcttgtcttttgtttgttgcctcagatgctataatgtttataccttttaacgatgttagctcatgccgtcaatccaatggcaggtaggtagggttcaaatcatttttagtggcaaatttgcaattgcaatttttttaatggcatattcacaataccggttcaatcgagtggcaaatatgcaattggtcctaaagaaaaacataaaaatgaattaatatgatttttttaaaattaattttactatttttttttgcgaaaaaacgtgttgtacatctagccattcgggaagtttactcgcagaaaacaaatgagtagaaggtaggaagaaagagtatcaataaatttgtacttctagaggggttcataatacttgtcatcttgaacaaagactattgtcaaagttttaaagacttggactatgaatatcatgatgtaaagtatgtgttagaaataaggagaactatattagttttagtctaaaaatagcataaataaaattatatatttattaatatttctatatatatgtaataaaaaaatagggatgaatccattttacacccttcaagtcctgtctaggtctaaaattcatagcaaactctaaaaccgggtatccaacactctctaaatatcaaaatagttcaatttacccacctttggcccaaggcacgaggttttgactcgatggcacggaccaggcacggcaaggcccgattgctgtcaggcccgtgccggcacggcccagctgttgggctgtgcctgggcctatgcctcatcatggtgggccggcctagcacgacatgaagttcaaggaggtgaaatagacttactttcgaccatatgtaagacagggcacagagaataggaagacaaatcgacgtattatatggcacgactcaaagagtagggacgtaaaatagacttattttagctatatatatgtcacaacccaaagaggagggagggaaatagacttatttcaaagaaagcacgatgggctgcccgtgccttcgggccggcccagcacggcccgacccttattgggtgcctgggccataggtggagcacgtgggccggcacggtacgacctggtgtgtaggtcgaaccgtgccagcccgacaaatcttggcctaggccatgccgggccgggcgggccatttggccaactataattgtggcgcaacgcagagagaatgatttgagacgatggtgttgtgagcacgaactggcaattacacattctggtacctcctcaaggatggtaactcctctcaaacaaaacaaaactaactttgttgcatattataaattagagatcttttacggtacttggaaggtaccttaggtacctccttaatcaattgatatctaccgttaattcataaagggtaatttaggaaaaaaaattatattaacaggggtatcttaattagtggcagtggcagcttgtgtgacggcgtcgaccggcgggagcgtgcgcggcggctgtgaccagcgggcgtgatgggcgcgtgtggcggtggtgacggcgagtcggcgacgggcgggcgctatgggcgcaacaagcgcatgcggtggcggtaatggagaccagcgggcgcaacaggtgcatgcggcggcgcgacgatgaccggctgccgtgtgtgtcggcttggactggcgggcgctacgggcgcgtgcggcggctgcgatggcgaccggctgccacattagtcagctgtgaccgtagggcgtgtacggcggcggcaaccccagggcgcgtgcagcggctgcgatcggtgggtgcgtccggcttcgacgaggagagctccaaagcggcgatggcgcgggcggctgccgcgagctagcgatcctgtgagccgagctcacggtcgtcgacgctgtaaggggtgcccgtctgcctccgtctctccccctatgcctcagcgcctaagtcacctccaccgacgcctcgaaccaagcagcgatacgaatggatggaatacagaacagaacatatataggaaggatatacatatattgaaggcaaaatttgctacaggacactcaaaaaatatgtaattagctatgggacaccacgaaaacaagaatttgcccgaggacactaaaaaaatgtggtaatttgctgcaggacactggacacattatagtataatatttgttcaattgatgagagagaaacaacgtaaaatgacagttttgcccttatcttcttctccctctagatcttgccgaacctggagaatagcctcctcatctcgtcgtgttgggcgtgcgacgggagagagatcgaccagagacagccgagagagagatcggcgccggctgagttcgacgcatcgccatctcgtccctgctgcatcgccatccgaggaagagagctccagctctccctctctatctctcttttgttgtcgaccgccgagaaggagggcgccgccgatcaccaacgagctgtctccattcctatctaattcatgttctattatcttctctccatgccgatcaaatctcgctttgacaacctctcgattcgtgcagccaatcgacgggaacgctgtcgtgcccaccagagctctggagcgcgctctgtgcaccgccgcagcgacatcatcgccgttcccgcttatctggaccaagccgggccaagctgtcgcgccagcatctccgcctcatcctcctctctatctcccctcaaggaccccgaaaaatggtgcgccggagaaggagatcacaccccttcttcatcggcgccgatctgaacccgccgccatcgccatggtcgattccgctttctccggtgagcagtggtgacgccgggacccaagtcgtgatgccaagacccatcgtagcctccccgcctgcgcttggtgctgccgctcagccgcgccccgctacaccggcactgtcgtcgcctacccgccatcgatctagctggacaccgcgcctccatggtcgtgccatgccatcgaccgccctggccgccgatgttgccgcaccacgccgcgccgacctcgccccaccgcggctttgaggctgctatgccgttctcggcgaaatcaacaagaaggtgaaaagaaggaaagagtgggagaaaaggaaggaaagagaaggggcaatccaggaatttagaaaaatatctcacctcttttgacccagaaataataaaataatgcgaccggtgtcctagagctaattacacattttttgtagtgtctatcagccgtgtcacgttttcgtggtgtctcccagccaattacacgttttttgagtgttctgaggcaaattttgcctattgaaaattagacgttttggcccttaaccgtaaaaatcaattataatactcaattaccattttaacctttcaccttccatacctggtccacacttttaatacatttttcctgatacttctctcttagagcgttagatcattagtgataaacgatcctaattaattccaagcacagaagaagatctctataaattaggattcgaaaagattacaaatgtacatagtactatagagagcttttaaggtgcttgagaggtaccagaggtacctcccttactactttctggtacctcccttactacttaatcacccaccgttgatctgttaagggcaacttaggaatagaaaacattaataaacaccgataattaactccttttacatgtaaccgtctatctctttttttgcatcaagttattacttatctccgattctgtcgttcgcatcgtttctaggtaattcaatttttttttgcgttttagtacatgagatcataaatcctaacacttgtccaaaatcccctttccctaattgattcttcaggtcctcatctaaatttagactccaaagaaacaaatataatcctctttcgtccatacacaaagacaagtatggctcgatcaaccagtttgttgaatctgtgtatgtatacaaaattcatggtcattgtggatcatcagtggtggtggcgtttcgtccgtatggtacttgctgaagaaagctgttcttatcagcaagcagggcttatcgatcctaattcttttactgattaaagccccaccctctaatctgtatgaaactaaagttatcaatctaaccttccacctaatcatcaagttaataccttgctcatttttttaattataccttctgagacataccttttatcacagaccgttagatggcaactggcaagtaatcaacggacaccataactcccaagcaccggaggaagtctcagtactataataagcaaaacatctaagcgattaattacttagcataaaacacctaaatcataaaactaagaaaatctcatatatatatatgcctaaattctgcttagattaaatttgatgatgtaggcagctacagctagtcgtcgaaggcccaggcgttctcctggcgaatcgccgcctcctcctccggcgtgaagtcgttctcgatcgaaaacgtctccctcatctgctccggcgtcttgccggacatcatgtccgccacgcgctggcacgtcatgtccagcaagctcttgatgttcaagaaattggccgccaagatcagcttgaacagcaccggattctcgagggcttgcaccaactcggcgtcgaacttcttcagctcctcctccgtgcttgatgctttcatggtgtcgccggcggcggcggcgtcgccggcgtgcatgttgcagtagtcgacgaccatggtgaggatgtcgccgtcgacgttggggagacgcaccccgttctccgtgcaatcgtcctcgatcatgttggatatcagctgcgattggctcgccaccgcctccgtcacctcgaagcgtttcccgtcggcgctgatcaggatgatcatcttgccgccgccatcggtcgtggcctccgctgctgctgccgccattgttgatgaacttctgacgataatctaatcctgaagtagtattatttggtcgatggcttggaaagtttggtgttaatcagatagaacctcgcggcgtgattgtatttattgcataaagcagcgtgagataattaaactccgagtaggagtcgtattttaatctcattttactactgtaataattgtaaattaattaatatcgagaaataattagagtactcgtttccaaaaggagtctaattagactatggaagaaggttccgaagatcagtccagttaaaaatctctcgagtctcgacgacgtacgtacaccaaactaacgcggaaatcaccgaaaatcaattgaattcggattggatttcgactccacatgaccgaatccgagttgtttttgcgcggtttcacgcaataaaaacacaccacctcctctctcgccatgatccaagcacacccaacgtttacgttccaagaaagacaagaaacagttgagctttgcaatccgcgagtttcgtccgtccgtgtttcaaagtagcgagatcaatggcggcagacaagaaggaggttgccgacgacacgatcctcttaatcagctccgacggcgagcactttaacgtgccgtcggcggcggcgagcctgtcgcagctcgtctccaacatgatcgagaacgactgcacgacgaacggggtgcctctccccaacgtcgcctccaaggtcctcgccaaggtcatcgaatactgcgtcaagcacgccgccgccgcggaggacgaggagaaggagctgaagagcttcgacgccgagttcatgatcgacgtggacaagaacatgctgtacggcttgctcctggcgtccaatttcctgaacatcaagagcttgctggatttgtgctgccagcacacggcgaacctgatcaaaggcaagtcgccggagcagatcaggaaggagtttgggatcaagaacgacttcacgccggaggaggaggaaatccgcaaggagaacacatgggcgttcgagtagattattagaaaattatatatatatatatacatatatatatatatatatgtcacaacccaaaaaagagggaggggaaatagatttattttaaagaaagcacgatgggctgtccgtgccttcggactggctcagcatggtgccccgacccctattgggccgtgtcgggctgggtggctcatttggccatctataactgtggcgcaacatatagcgaatgatttgagacgatggtgttgcaagcaggagctggcaattacatattccaatcctaccctttttaaatagacggttatatttaaatggtgagatcttcttctatacttggaattaattaggatcgttgatctctaatgatctaacgctccaagagagaagttactagaagaaaggtattaaaagagtgggcaaagtatgtaaggtgaaaggttaaaatggtaattgagttttataattgatttgtatggctaaggacaaaatcgtcttttttttagatctgtatcctactcctatccgtttcaagataagctgcattcatgcagcagaggaggaagaacgttgtgcttctttatgtagttaaacgtttatgtaatacttttaccgatatgtcttgtcaccgccgtacgcgcccgccgctcaccgaggccgcacgcgcccaccggtctcagccgctgcacacacgctgaggtcgctgctgaattatgcgccctccagtcacagcaaactaacgcggcagtcggtcgccgtctccgccgccgcacgcgcccgtctcgcccgcccatcgtagccgacgtatgcggcagccagtcgacatcaccgccgccgcacgctggtcatagccattgctcgcgctagccggtcgccgcctcgcacgtgcttgctggtcgccgccgtcgcgcgcgcagcccctgctccttgcctccgagctcgttcaattgggattggaattgattatggttaagcactgaaatcgtggaaaggaaatcgtgaacgcttggcagtggatggagaaccggtgattggtcaattactaagctatccttgttaataataaattttgtccctaaattaacctttgtgaattaacggtggatatcaattgattaaggaggtagatacctggtggtaccttgagactcctcaaggatagtaaaattcctcttaaacaaaacaaaactttattgcaccaactcattcttacacctacattactcattcatcaaatccaactatcagtattcatctacaaataatcgagtggcccagatgagtccccccttccctccgcgctcctccccgagcccaccttggcaccctctctctcgcgcgcgtaactccctctcacgccc

SEQ ID NO: 59610 - DNA, 4586 bp, Oryza sativa
tcttggcatatctatttggtaaaaagattaaattttattgtacatacgatttgtgccctttacagttcctaaatcctgctggcggatacgttcacttaagctttgctcaatgcgatcattcacactataagtttctcagatttttttttctgaataagctgataagtagtactatgccacctgtgagaagaaaaaaagttattgtttgtatgtgtgagaaaaaaaggttattttctgcatgtgtgagaaaataagttattaattatctgcatatgtttccctagttcaaatagcaggcttaatcttttgtcaagctaggaaaaattctaaccgtctcagcattactgcagagtgtttgggctgcaactaatttttgaagtacagtgagtctcagaccttggagataaattactgaagaactggactctaatgtgagtacctgtttaatatctgttctattaaccttgaaagatttctttgtaacaagttttaaattcagtcaacactgcttaagacttaaaataattaagtatatttttcttataaattctgtgccgctatggctcttttcaatgcgcgcattcactgtttggaatgcgagtatgttcaaacttaagagtagcatttggatattgctgttttaaaaccatattggtgaatatgcagatttctgacttgctcttttcaacaaaaataaactatgatatacacacattacttcagcaaacatgactttagcagctaagcttttctgaaacttgatgtgtgtgtgtttagtacttcctccgttttatattataagactttctagcattgtccacattcatatatatgttaatgaatctagacatgtatgtgtatttagattcattaacatctatagagggagtatgtttgttgaagtctgattttagagataaacttagaggtacaattgctcagctgccaagatctgttttatagaggtacaattgctcagctgccaagatctgttttataggggtacaactatacaaatgtgactcatggcttcttcttttttccctctctttaattaaggctgatgaaagatcgggtccgtgcatttgagaagaggatgaggagggatctgttcgttggttgcaggcttgccaacttccttgggttttgtggtgggtgctatcttttcgcccgtgtctacatgtagttgtttgatgaaaacaaatcaacgaacacacagaaaatagagaaaccctgtattttattaatcatgattcattaacatgaatgtttacaaaatacataggagggctcccacagaagttcgccttttgccttcgcgaggaatgcttaatggaaaggtatgctaactggagattgcgtgcagtctgctgattcccggcgcctagcaatgaggctgccggttaattacatccataggacgagcctatggaatacctctgattaagctgcgctttatgatcgtcgtcttcaaaattatttgctcgcccaagattgaggttggtgcagatttaatggtgaatatagtgaatatgtaatgggtggctttgttttgccaaaacccaatcacaatacactaccatcacgtcggtgtgtggagggaatttggtgaagcgggtgacttttgcctcgtcggtgctcagtcatgtatcccggccttcatcaaacatggattttgtggttgcttttgcttcgtcggtgcccagcaacggtgtatccggctccgtccattttagacgtgttaatagtatagtgacctggcctcgtcggcactcagccatgatttcgtctagcctcgtcggtcatagacaaatgaaatgagtgaatggctatagctttgttagcttttagccaatatgttgtccggcctcgtcggtctcggacatagcacaaatattgataaattagccatttcatctcgtcgacactcggccatgatgtagatgtgtgttttaatctgcatgcctcgccctcctggctagcattgtttttgttgtcttcaagaattttgagaatcacccccatccatctgatagaatttagagagagaagaaattgctctcgtacatgacatgcacgaggcaatgtgtgattcatccggcatgaatataaatatgtatatatcatggttggtctgatgccaataagacttaaactcattccaagtttatataaataaatatccacatccaatatttgatattgataatttagacggtccaaccctcacgagggtcaggctcgccttgtatttatttgcagctcatgttaattgcttgacaaagatgacgtgtgcatgtgcatgcgccgttggggatacttatatccatggctacaagttcacaacgtatccatgacatattcaccagtactccactttactgttttaccgtccggactgcgtaactgcacaacgctacggtgtatatttgctccctctaggagacaatgtcgggctatgcataatatctgcacagcactacggcgccattgtgttgtcgatgacaaataacttgacggagaaattatgttgatgaagcgcggctcgacagaaggcgaatgattaatttggagttgcaccagcgatgatgaagcagactccttgacgattactttgccttctcccgattcctcccaaatatttgtgtagctataatgtttatcatcaccagctcagggcctgcatcttggcgcagcgcttggcggcggcgtgtacatgtgtgcgccccggtgacggcttgtaaattgtgtagatgttggatatgggattgtggaactataagcagatcagagcacgcagcagagttgcctgcctacgtctcctcctctgtcagccgcctcagcaccagagattttctcccatctccttcccttgttttataatttggggctcgctcccggcatgtgcaccgtaaaacatatgttttgattataaaaaaatacgaggatagtccgatccgtagattagacatgcccaagtttatgtttcaagaaagcagatgcgatttgattttcatcgcacttcaattgttgaggagaaaagaggtactccaatcatccattagaacgaccgatttagcaacaggattggaggaaattattcatcgtactcaccgcctagcacgatcatctccgcctgcgacatcagctcgatgggggaatgtttaatctccactgcacggcgcgcctgcttgcgagccgccggcaagtcaccgagaattgagtgggtgcatgtgccaccggccaccggcgcagggcctgcgtccctgcgcagcgcatagcgtcggcggcgccggcgtggcgtgtatgtgcagcgccttagcgcttctgcatggatgcatctgccagccccccgagcagtgggagtcaaggtgctttataggcagatgtagggatggatagatcaggctgggactctcaaccacgtccgaatacaacggcaaatcacgcgtgaatttccttggataagacagcaaacaggcgtactaatccaccgatctgcacgagataactactgccgattaaatcatcctagaattaacagtgctaatgacagtgggcctcctgcgtttaatctccaaattagagataatgactgcatgctcacgtaccaaagcaagtaacgatagcacttgcttatttcttttctttccatggctcaaatcttttgaattgtacatcggatttaaaatctgtttgaaccattattttctatttaaattatacaacaaaccgagtccaatatttaatatatttgaacgccgccttgtatttgattttcttgggcccacgtgtcaaagacacccttcacatatattttggaaaattgggcggcaaattatattcgaatatgaaattaatgaccaatgatttatcattttttctataaattttggtaaaaatatccatcaaacagtagtcaagcagagaagggcgagcagcaaacaaacatctatctggttttattttctgtgctacaattaatttgcttctatggctatgtaaaattaagcaatatgatcatgtaagagcttgcactctggttagccagtttgtcttatggttcagctctaagtaagaagtaagaacactctgatgtcttgtgtgggagagcgctcgatcttttgttgtggctatgtatctgatatgcactcgatctcttctgtaagagcactctatatacttatgatatctatgcgcacttagtttggaacaaatgttgatttatatatatataacttgaggactatcttgccagtttttttttttcatagagataatgggataaagcatgcatgtgatggaatacgaggtgaaatgcacagatcgagctgcagactacgtacagcaaatgctttgggatagtttgcaggatgtgaagtataaacatgcataagcatagatagatcaagcagaaaacatgcagatattgtgatcaccattctctctcccaggtcctgtgaggacagaccaccagagagaactctgttaagtcaaaatgtacgttttgaagttgagtagggctaacatttagcacaacagtttgtacgttttgatggatcctataatgtattaccaatcggtta

SEQ ID NO: 59611 - DNA, 1273 bp, Oryza sativa
  unsure (1)..(1273): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaaaggtgtacggtttggtactgccttggtaggacttctatttaaaatataaacggcagtattaactgcttcagcccagaaagatttaggcatacctttgtcttggagcatagaattggccatatcattgatcgtccgatttttccgttctgcaactccattttgttgcgcactatagcctgtcgtcagctgtcttcggatgccagcattttcacaatatttctcaaattcttttgagatatattctcctccttgatcactgcgcaatactttaatttttcgattactttgattttccaccatgaccttgaattttttgaatgtctccagggctgcagatttttcttttagaaaatatacccagatcattcttgtataatcatcaataaatgtgataaagtaccaatttcctccttctgacattgttggcactttaccaactatatcagtgtgcactagttcgaatggtgcacttgctctccaagctccactgtgtgggaaagaagcccggatttgttttccaaatacacaaccttcacatgggtcagacttgagagtaataaatggaaggccttgaaccataccttttgtcctgagtagcttcaatgctctgtaattaagatgacccattcttttgtgccataaatcggaaatatcaacttcacttctgagagccatttgagttgtatgattcatccttaatagaaaatttctattcttctccatatttattttagcgaccagacgattatttttacggtccaatattttgcaagaaaaatcttcaaaataaaccgcgtacccgtgttctagaagctgcccaatacttagcaaattttgctttaaatcgggtaccaacaaaacatcttttataaattttggaccgtctgctgtttgaacagcaaccgtacctttgccttcactttgggctatagagccatttcccatgtggatctttgcatgatacgatgaatccatttctcgaaataaatttggatcagcggccatatggtttgtacaaccactgtcaataacccaaacatcatctttttcttcttgagcagtatggcaagagaaaaccatttcttcagatttttccttttcttgtgaaaaattagcccgattaatttctcgagttctgcaatatgggctgcagga

SEQ ID NO: 59612 - DNA, 1905 bp, Oryza sativa
agcaaatctacaggttatgtaacgatgcagccttttatgctcgtactgagctgccatccagcatgccaaatcttgaaaggcttcttatacattctgacactgaggtatacgctcttaataagattttaaaacgaccaactcgtgatgcatacgcttataaccaataattgtcttacagtgaaacctagtagtatttgaatctgcagatggtcaatacacagatgctgcctagcaaattctatcacctcaagtacttaaatattgctcttggtggaggaacctatgattatctctctcaggtttccttctttgatacttctcctttcttggagactttcaacttgaatgtaataaaggtataaagtaaatgtggtggaattgctgctaattaatttgggttttttgttcactgttaggcactctgagtccgagaacgaaaggaatgtgtctcaggctgtgtttagttctatgggtgaaaagttttaacgtgtcacatcggatatacggacacacatttgaagtattaaatgtagcctaattaatccgtcattagcaaatgtttactataacaccatattatcaaatcatagagcaattaggtttaaaagattcgtcttgtaatttacatgtaatctgcgtaattagtttttttatctatatttaatactcaatacatgtgtctaaatatctgacgtgacaggatgaaaagtttttgcgtggcaactaaatggtttttttaggacccttcaggtctgagggtgatgccagagcaccgccgtcatgacaaactcaatttcttttctgcaaagagtttggttgagctaacatgtcacattgttgaatcggcgacatcactcggaaaaaagtgtctttacgctggacacaaccaatttttcctccgcattatctgttatccgttgcctctcactggccggtgggccactagtccaagttgtggctctttggtagtactggtgcaaattgacaaatacaacgcttcctgcgcgggcagagaaacgccgcgcccttcttctcagatgagactcccgagtgctgggcaggctcactgcctatccacggttccacacacaactactactgtagcaattgttacacgtaaaccgcaccaagagagatgcaatgcaaccaaacacagtaatcaatccatagggcagcccaaccattttaggttgcaaacgtatcatcatagctcatcagtagtaatccatatcgccctatgcgtatcattaccagtgctgataaaatgtttcgactctcttataatcacgagtactactgacaaccaccctccttcctcgcgtagttgcgctcctaagcctcgcttttgccggtggttggaatctccacacctgcaagcatgagacacattttatcagcattgctgggcaaactatccacaaaagaacaagaccctcaacagcgcagcgaacctggacgctcagcctgctgctgcaaaaccccgaagactgcggcggtgactcccaacagcaagacactatttttcaagcactccttctgagaattttcgtgaagacccctaaagaattcaatcaatttgtcagagaaaagccttagaatttcaattgcttggaatgcttatagttatgaacaaaggaagtagtacctcattgtggccacgacggtttccatctttgccactttcaagtccagctctgatttcgtaaacttctgcagcgcctcgaattcatgccttatgaaacgctgttcgtccttcagcgcttggagctacaatatgattcgacagaaaatagggtcccaaattagttacatatttaatacactactgaaattgaatacaattctcattacatgaacaactactacaatggtacaactatgttctaaattaactcaatccttaca

SEQ ID NO: 59613 - DNA, 736 bp, Oryza sativa
gcgctcgatctctctctctctctctctctctctctctctctctctctctctctctctctgagctgttcctctggggtgtctctccctctctcctgttcttgcgttgaagaaagaagaggctcccgcctcccaccgtccgattggatcggatggtcgagacggcacgtgctagcgtacgcgtatctcccgtctcccttgcctcccaccgtccgattggatcggatggtcgagacggcacgtgctcgcgtacgcgtgtctcccgtctctctttcttctcaaacgtttaaggcttaacggaatccaatgctactataaattccaactatttggtagcccgcgcaattacgcacctagcccccatataaaattatttatatatatattgggcttgatcggtatagcttgctgcgtctgtagctgtgctgcatctacagtatcaatagcatatttttgaattggagctgttgcagtgtagccgcagcaaagctgaaccgatcaagcccattttaatatgtctttttgaaagaccaaatattatcataacagtatttctaattttatttttttaaaaaaatcacaccagttgctacgccttacttttatcatcccttctttatttacatacttgatctaccactgtttttattaattcttctcgaaacctttaaaaattaaaccttataatttttagagttttttttgtctcgttggtttcattttaacaaattttagaagt

SEQ ID NO: 59614 - DNA, 2173 bp, Oryza sativa
atttctttgaaactcatgcaaaaaaaatttgtataggaattagttgaatttctttagagttcattaaaaaaaattgtacattctaataaatcgttccaatttaacataacaatttgagaaaatcgtcaatttactctttgtttccatctatgctattcaaagttcctttgtctgtctaaaattgtaattaaattgtcaactaatgaaaaatagatgttcataattttttaaaaaattaaaagtgttcaagttttttttttcaagaagctacaaaatttcttcctatgtcataacaatttcttttgtacgatgattcattaaatagagtaggaaaaaagtacaaagctaacaccctgcaagacaatagccaggaaagtaaaaaacccaccatcacgcaccgacacagaacccaggagaattgacaacctatgccacattatcaaaatcaatagagttacaaatttattcctatgacataacaaattgcaaatatattgtagaattgatagtatataaacaacatcataccgaccagcatcactattacaaagattggacccatgtaaaaatcgataggaagatctacttctcaatttgtacaaatattaatcagtacaatattacaaggattggtataaggtgatcacccaacatcttgaactctgccaaatgttggatgcattttctgtctgcgcaaaggcctctcgagaccatcatattgcctttggattgataagcactgcacccggcatggctaggacagtaaagaacctacaggttcatggaggttgtcataatggtattaaacttctaggcaagatttacgagaggtgcataattgcaaagctggcaaatgaactatatataactatttctaaaatgaaaacacattcttattgtcgatgtgtcatttgcatttctaaaaaaaatgtcatcgacttattgcacttaaagctcatttttttgcatgatcaagtagtcaagcctcttgaaatcttactaaaccatggtttgcattaatcagtatagagaacttatttctccctcatctaccgcctaccccaaacacacgttcccaccaccgatcattccgtgctgataattccttcagcctcaatagcatggttcacctgagcaactaatagcctgtagagaacagaaggtgcaaaggttttaagtcatacaccatattgctgaaaattgcagctgcactcagtacctagcatctagcgactatctaaatatttgtatagttattgacttattgggcaatatctaccttgaccaatcaactacattatcacagaatggaaactttgagctcagtaaccatgaacaaacaaatatagaggtgatctggacctttaattcgaagatattaataatacatactataggaccagcaagcaaggaagttccagagtccacaatagcagcgcagccttttgcatagaagccagttgagtggccatcaataaggagatcccccgtgtttaactgctagtagccttaacgagaaactgggacataggcgtgatccctcttatagtgctttggatccatgccaccaaaatacaggctcacctcaccaccagaggatgcaccaggtctcggttcagccaaaatgataaaatcacctgttgacatactgcagctgtgagtgcctactgatgcaagaaatttctagccttcacaaatccgtgctaactctgcactttgtttgtttattgctataacatttgattttaactgggcaagtgtaaatcgtctgtactaatggaaaatagcagtagctggtacctaacttcatgtttcagtacaggttacagtaacccaatgcaattcagcttagactagaaaatctgttaccaagcaattaggctcatatcaaagcctttgcaggttagtcaggttatggtgcaacattgcagcctgcgaactactatattttcatttgcaacaaagcaaaccacatttggctcataatcttgtaaataggccatgcaagccattttacccaaatgaatggcaagagcaatgtaagtcttcctcacaactaatgatggccatgcaagtcattttacccaaatgaatgtgccatcttcatccgcatggcaacccatccagtcatgtacatactgatgtagcatacatagtacttcctccgtttcac

SEQ ID NO: 59615 - DNA, 8591 bp, Oryza sativa
cacctcacaggtgctattcgcgggggactgcggccgaattacggcgaaccggagggctatttcgaaaaatcgccacctcgctcgccccatgcgcgacgcttaataattccccgaagagtgagagaaggcaaaaaggttgggttcgatccccaatcgcgatgtgctagggtttggaggcccgtgctcagtcctcgccgccgccgggcgccatcctccccccctgcacctgctaaggtcagctttctttctttccgtgtctttaagttccctgttgagattcgatttggattccttgctgctcaatctcatgggggcctgcacctcacctgacctgcttcgatcacatctcggactgatttcgttttgtttttggttttagcccctttttttttcttataagcagcaagcgctcgccggaaattccaagcagagagacgcacggatcagatcgccgacatgtctaggcgtttcttgtttcagaaattttcagtgctgtccggatcgatgcctaatcgtcctacctccgctgtatgtatacacgctcctccaaatctttcaaattttttatttttctttcacaacagggaagaacataattgctcttttcctcctttcagcaaggaggagacgtttctgctatccacgatgctctccgtcgttttagcacggtgcttcccaattaccatggccttcctgtctctgtaagtagctattactcaatttctttgcctagcactagttttacactttcaaaccggccaatttataattcctttcctttcctttttttcttttttttaaaaaaaaacatgaacaaggcggtgccttttcttttgtttcctttctcacatctatgcaatttctgataattttgatttttccacaatataagagtgaacttgtatgcctttggtgaaaaaaatattaatttccttatactgccttccaatgcagcaagcaaagtgcctgaattctattcaaagccctcacgcagccaccaaattaaaccacccaacaattggtgtggttccttttgccagccggactttcttctcttatacaaaaccctaccacctgccttctctgggtgaaaccaattaccctgattatgtagcagcagacattaaagcgtaagtctgagtactagcctgtatcattttacttcctgttactttaattgatgtgtttattgttggcttagcccgagtcttgttctactccctccgtttcaggttataagacgttttgactttggtcaaagtcaaagtgctttaagtttgttcaagtttgtagaaaaaaatagtatcattttcaacctaagacaaatttattatgaaagtatattcaattattgatttgatgaaactattattagtattataaatattactatatttgtctgtcaaacttgaaacagtttgactttgaccaaagtcaaaacgtcttataacctgaaacggagggagtactatagataaactaaatttcagcttatttggtcttttctttatttatggggtcatttgagagcatattgtcattgtaccgttagatctggttacagggacggctgttaaggagttacaggccagatgatgattttattgtttgtttgttaatatgtgagcaacgctaagaaaattttagttcatcagttggctccttcccatagtacgtgattgttggaaagcaaatactagtaatctaggtcgatcaaattaaacataatcgaatcaaagaacctgtttacaggaaaaaggtaagctttgctcccctgaactttagctatgggaatttttgtaacataggttctgatcccatctatcatcccataaattttcaacttagaacacagcttgtacgacaggaagcaaaaatggcagttgtttttagggattaaaacaagctatcacttcttttggtgaaatagttccgctgtagaaaaatggactgattaacttagttatgcgacatgagcatctgcatgtatagtttctcgttttctggagaaatctccagttcaattgaacctatgaaaactcgatttctctatgttcacgaagaaattattaaaggtagggataggcatgatctctttctcaccaaatttctaagaccaaactcaacttcgtttggaaagttaaaataagacaaattttgcatgaaacttccctatcactatccgtgcaaagtttgtatttcttgtatcttgcaagcaaatttgaatttggtcttgaaattttgtggagatatagaccatgcctatacctaccactaatatttatggatgagagtcatctcgctgggatgtactagaaagtaggggtggtctattttgtttattttgaatgaatgggtttattgttggcttattgtaaattgcatttcaacttattccatttttattctcccgtgttgcattttgagcatattatgtcgttatggttgctctattgttttttctaaattgggtcatttcccttctattttctccgtcccataatatcacaaaatttgttggacatgagacttgttcagattcgccaatcctaggttgctatgggacagggagagtataaaatattgaactttacatcatcacaatcagaagcataaaatcgcatcagggagagaggtgaaggggagtaagaggctgacgagtgggtcccacaccttttccacccgagtttgccatgagggcaaaagtggcaaatagttaagaccatctctaagaaagggcaaaaaaaaaaacataagaagggtattttcgtattttgataattgtcaaacctaaaagtgacaaatagttaaattccccgtatcagcttacagttactgatggtgtctctgcctctctgcacgttattaacaccgttcgcgaacatacttttttttttcaagatataaatagataaaaatttagcctttggttcaacagaagctagctacattagagttggataacttaaggtgcttaattataaacaacagccgcccacacattaccaaggataacttaaggtacccaatacataatcataaaggttggttgcatgtttctcatatcgatcgccggtgcttctaaacctcatcttcgtcaattcgacgcaatcatttcggcaacgaagtagcctgaaacaacggctggaataatcacagccaagttcaaacgtctctttgctgtcttgagccttaagtagttactagaggctggggcgcgccattgcgcgccgcctgcacggattaaaatctacgatgagggaaatctacgataatttgataagtgacatcatagattacagttcaacagttgtggatatcaatagcatcgtaattagtattgcttcgtccgtggtaaatatcttactacagatggacactttattatcaacgtagagcatctctgttgaaatttcggttcattagagactcatggttcacatgaatatacaatattttcattacataataacccaaaattaatagaaaaataatccctggtacacattgctatacactttgggtttttgcaaataggacaactgaagaataatgggcccaacttttcaagattacattcagcatcccatcatattctgaagaatccaaacatgttggaatgtaaataagtacatgaaagcatacgttagccaatgaaatcatatattgagaagcacatgcagataaataccataccctaataaaaccttaccgcactaagtgcccgagcacggaaaaactgttaataggtcaaccagtgataatggaacaccaaaattccattgatgtttatttatgagctagcagctaattagaagtgggcaaaatttactcagctagtaatatatatcatgcaaaatcacattcaacacatcaaccagaaaatatgatttttaccatttaagtaatgtcattcaatcctgctacccatctatcctcacagctgaagttgtagccatacaagataacagtaaattataagtggaagcaaagctatagaggagctattgtgccattcatgcaataattaatattaggatatctcaaactgaaagtgagaaaagcatgaatatctcaacgactaatcaatctacagagggcccccatcttactgatatatagaaagtagtggtggtgatggtagtagtctatgatgaataatattgtaaatgattaaatcattttgttagctacttatctgtatatgcatgtgtctatttaggtttagggataccttttctttctagtttacaacttcaactatatttagtttagatccattgcaacgagcaggcaccattgaatcccttttctaatgtaacagaatgttatgcccaattttactttcccttgtttcatctggtccaatcgtactattatatggtttcattgaacctgagaaaagtggtacacagtcaattaacatatagagtaaaacatctaactataaatatttgcagaggaaatgcatagagcaaaccacaaacattgataaccaccatcttatcaaagaatcgaggttgcaaaacactgatgcattatatatcataaacaggttccaagattgtattaatatgagagctgcataatccaatatgagttatttaaatatcacttaaatacgattaaaaagaaattaagcattgtagaaaaacatggatctttaaatgccacatttctataactcagaatgaagtttagaataaaggtgagaccattgtcagatttattgggactacagacaacttcaactgatagagaacctaactattttactttgcttcatgaagggtggccactactaatgccttactcataaattctggaaatacttgaacattacagacataagactgtaaggtgcaaccagatccctttttttcctcttctataattcggagtttttcaaaggagacatatgattgcgaaatgcattaaacttgtatacagtaaacttatttagcagtacatgagtacatgaccaggcaaaatatggaaagaaaaaaaaatagaagttatggagaaatcatcagataggatatatctactgaacttaactattgcactaagggcaatacatatatgtttctgctgttattagaagcatgcgattctcgagtttggggattgttttcgcatagaggaggtcgatgacatacagtagtaggtgatcactaatatatcagttgatgccttcccagaagtaacatcaacatatattgaacaaacgcacgaaaaataattccagcatatgtgtcaacctgatgaaggaggaggagcatagcaaagaccaagccagtgcctttggatgatggcagctgctggacttggaaacctgggcaacaccagcagctaaaccaaccaggcatcgcaattaaccagcaaaacttgtgaccgctgatgggcactctgcttaacagggagatgtggagcagaacaatatatgacctagataaatggaaataaaaaatgatcacttaaacaacacacataacattaatatgctttttagtgagtagacaaatcatatgatgaacaaatagatgtagaattacagtaagaaaaacatgcttcttttcaatctgtaaattatgtgcgctaagtgtattaagtagaacattgaaaggtgccaagaacaaacccgggtggtgtgcctcctagattggccgcccacttcctctacctcttgtcgttctgccggggtccgccgccgcgatgccctggccatccccatcgaccttggctccagatctgccaccatccttggatcctcttctttccatcataccattcgctacctgcatctaatgccgctgctcatgaattttccatgtgaaagactaaccatgacttataccttagtaacatcttacttaaatcaagcatagtagcagcttactaaaattgtaagaaaaatgaaagtaagaaaaaatctcgagtgaaacaagacaatcccatggatgtaatttttcaactggcaagcaaaatttacccaggtaacaatacgctaatatgtatgaactatcaattcctgacctaaaaatttaccagtactacaggattaaatgtgaaaattgggactggcaaacatgatagcttaaaaaacttcaaagcaatgccctatagaaatgtcagttatcagaaaaatgaaccaatagataatgtcacaccattgggaaaaaaaattatcattggcaactccgttgtgatttaaatagcagaaaaatgcaatcttggaactatctacaaaataacttttcctcttcagcacaaaagcacaacatgtaaactaatgctctactattgctagttttaactgcagcgaaattcatcagtacattgatcagtgtattttttatgttaatagcaccatgtttctgggagcacacagttcaggaagcaaagttacaaagcatagtaagcatgatataagcatgatataaggatagacctcactgctttccctttcacactgcaggtttgccttgctaagcaaagcctaaaactctaccaatgttaagtgaagggaaggagctaaatatgaaggtaaacaataaggaagtagcattatttactgggacacagtatagtttacagatgattcttctttttgtctgtaatacatccattatgttcatcctaccatgaaaaccaaagtgataggacaggcaaaatagaagtaactattgacgagctataggaaaagagaactgaaaagcaggaacagtgcatctcctgaaatgcaagtaggagttaattacattggatagctgttaattgatgacccttagatatattagtggaatgagtaagcatgttaaaggtgaaagctgtagttttgaaatatttagtattacaggtaagcacttagtcatcagttaacaattggagaaaagcaggcaatgcctgaaaaataatctctgaaggagaatacatgaatacgatttctcgagcaattttgctactacatcgcgtgataggtgagcattgatcattaaccagggagaagccgcaactcatttgctataggtattagatattgcttgaatgtgaaatgtactatcccagaaaccataataagtacctcaaggtcaggacagcggtagaataagggatctcgagcattgactaccaccaccagtttcatggaagaaaagagaataaaagtaagtatattaggaactaaaaataatccaaagaggttctactctttaatccagtaaaagcaaatatgattgagcacaacagagtagcacttccaggggaaaaaatgcaataatactacggaacattgaaagcaaagtcattatgtgagccaaaatttgcaaagcattgcctttaaaaatgcatgtcctacttattttttttttggagaaatgcttggttttagtatcataagtactggcaagcaatcaaccacaagagcgatggatgaaactgatagtgaaggttaagcgttactcaccagatcactacgttcaaggactctccagagctgtctccagatgtcaacgttcttctcaaagggtgtaagcacaagcttgtcattttcttccagtttgcagaaatggatcactctcacaaggtgtctatattcaaacatttaaattgacaagcaatggcattaagtactacattttttgaattgttacagccaacatatgctatttacaacttatgcataaatagtaattggtttaatttgcccaagaaacaaatatgcaacaccaatgctcatgatcagattatacataaggtggttcaaacagaaatgttcaagagaaagctcatcctcgcattagtcttatcttgtaccataaccagattatacaagataataagaaatgctgatagttggatatcagtcccaaggtcccaaacacgcttttgcaagtgaatctccatttcactatgaatttccaagcataatgaataagctacaactcggtcatatagcactaactcagatgaaatttcatatatgaggttgttcaactaacaaaatagagctagaaatactgtctccgcaaaactattatgtcacttaatcatgtcgaaagaatggcaagcaaaaaatagatatgaaacatagacttgaattgaacccacttcaattgaagcacctccacatggcacaagacagaaattagccatcacgtgtagataggctaaatatagaatgagcattgtattatatatatcctataacgacaatgccaatatttatctacgatcatatggaaaataaatcaatctttcgcataaattgaggaagagtaagaatgcatgtgatgtcaatacttataatagaaaaatataaatggggtgcttttagagcaatttatgtattacaaatggaatagtatatagttctgccctctacctgaactaaccaaattaaatacataattttgcaaagagaatatgttttttctaaagaatcataagaaattctagcggactatatacactttctaaatatgcaaatcaactgaagacttcacccaaaataaaaaagtggaaatacaaccattaaccagcatcaaccatgacacatggattgtggtgtggagaaaacaaagtgggaggaa

SEQ ID NO: 59616 - DNA, 7189 bp, Oryza sativa
  unsure (1)..(7189): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatacaaccgggcatatgctagtaacgacaatatatactacatgtcaatattgtacgtacctttgactcgttgtgctatgtacaggctcttgactactcccaactgagcttagcagtggtcaacattaggttaacattacatttttacaatttgcacgttgtcacttgtcaggttagttcacattatttaatcattgaaagctcaatctgttacatttgcaggtacacttgattagttgattacctgtcctaattcacaaaaggaccgagtttggcagcagacaagagatgtaccaccagctcaatccacgactccacgtgtaactgaacctgggcccgtttagttcctcaaaaaattttcccaaaaatatcatatcgaatctttggacacatgcataaagcattaaatatagataaaaagaaaaactaattgcatagttatgagggaaatcgcgagacgaatcttttaagcctaattagttcgtgattagccataagtgccacagtaacccatatgtgctaatgacggcttaattagtctcaaaagattcgtctcgcggtttccacgcgagttctaaaattagttttttcattcgtgtccgaaaacccctcccgacatccggtcaaacgttcgatgtaacacccaaaaatttactcttcctcaactaaacacacccctagtgtactagtgtcctgcccaaaagtattaacatttcacatgataaaaataacaaaaggctataaatagagcatagctgcagacgtacgtgcgtggtgcacaagtatacacgttagctaagatagtactcatattatgtttcagaatataaaacgtttctactttggtcaaagtcaaactgctttatatttgactaagtttatagaaaaaaatagtaacattttcaaccaagacaaatttattatgaaaatatatttaattatcgatttgatgaaactaatttagtattataaatattactatatttatctataaacttagtcaaactgaaaatagtttaactttgccaaagtcaaaatatcttgtaacttgaaacggagggagtacatatataaaaaaaataatgtgaaaatttcttgagcagcctagctctcctggaaagaaaacaaaacaaaatcttaagcaaaaaatgattaaatcgatcgatcaggttaattaagaaataagcacggaataagacaagcatataaacatcaactgtatagtggtggcagaagtattttaacacacaacgcacgcgcaccaatctcatttctagtttactccaaattaaagaccagtcagaattttcgcctttgcaaaactcctctcatttcatttcctcccaagagtcaagctagcccttcttgcttgctccgttcaacgcctcttccccagcttcacagtactccatgtctggacctggaggaggaggtcatggcctctacgaggatcatcctgcagccgccggcttcctccccttcgaccacgacgacgacgtggtggccagcttcttctttggcagatcggcggcgtccggaggaggagccggcgccggcgccggcgctggagacgatgatggtgttgggctcatcacgccctactccagcatcacggattatctgcaaggcttcctgcaggaccccgtgtacgcgtcgtccccgttgggcggcgatgctgccgtgaagcacgaaacggtggtggatcatcccagtcaggccggcggcgtggcggcggcgccggccacgccgaactcgtcggtgctgtcgtcgtccagcgaggcggctggaggggacgatctgcgccggtgcaagaaaggtcgtcggccggaggacgaggaggaggaggagattgacgatgagggatcggccgttcagagttgcaagtaagttcagtattaatttgatcttgttttgtagctagatccatgctgaatttatgtctgatcgatttatcacacgtgcatggctagatagatcttggatgaattaattaatttggcttcggtgtgtacatgcatctacctacctagtttttaattcatcgatcggtacaaattaattaactttacgggtctgaatacgaagattccgtgtgtgtatataccgcgtgtgaagtgttaacgtcggaatttagggtttgttccctcccttcttttcacaataatttgttgaaaccgatcttttcacaataattaacaatatatatatatatgaattaatgattaactgacgagactagcgatcgatgattaacaaatgattcacgagacagtagcaatcatgcaccggctgatatatatgcgcaagaggccaatatctcaactgagacagcatatgtcgatctcgatcgatcgatctggtgcgtgcaggacgaacaaaatgaagaataaaaaaggggcgaagaaggagcgtgagccacgtgtggcgttcatgaccaagagcgaggtcgaccacctcgaggacggctaccggtggcgcaagtacggccagaaagccgtcaagaacagctcctacccaaggtcagctagccaaattttcacttgcatatgcattattctccatcataattggcatgcatatatttgacagaagcagctaccacagcattagcaacaagctaagcacacattggcattggtctgagttttttttttctcagaatatctcgatggatccatatgttagaagtatatatctacgatggacagttcttcacctaatacctgcgtcttcttctgtgtcgtcacttgactcttctctattccaacgaatgcaggagctactaccggtgcacggcgccgcggtgcggggtgaagaagcgggtggagaggtcggagcaggacccgtccatggtgatcaccacatacgaagggcagcacacgcacccgagccccgtgagctaccacatgcacaggcagcaggggctcatgcatgtgagcgcgcgcggtgtcatgcccggcgccgccggcgcctaccagttcggcgcgccgccgccgccgctccttggcttcgacgaagccctcgccgctcgggtgcgaatgacgatgaaccagcagcagcagcagcagcagttaggcttcgtgccgagcatacacgccgccgccgcccggccgacgatgcctcctcttcatctctacaccgcgcagcaagacctcttccttccgtgacaggcagtcaccacggctattgatattagatctttcttatttacggtttacagaatgcatgctgctcgagataaatttgtgcgcggctatatatatatggttacgttaccgatgaccaagtgaagtgtgggatgcatgttttgtgtcctcgtttttttggttggtctacaaaacatgtttgtttgagttgcattgctaagtgcctagctagctatataaacactgtctttaattccaaactgtagatcatgaggaatttgggtcttgttattgatttgaattctgatgtgtcacgccccgaactagtaccgaccggaactagtctgtgacgctccaatttaacctgttaatcaataccagtcccaggacacagtgctggtatcacaggaagacagattatcacagcaacagaggtctctttattatagagtagatgtacagtcatgttgggctgcggacagatcccgagctcacaactgcattacaaaagggaaacggaagccgggacttggaccaaacaacacaggcgcgacttgggaactaggccgaaaccctaaaactcatcgtagccggcttgctcctggaagaactcctcatcagcaggatccgcttcgtcttcttcagcgactggggggggattatttatatagagcaagggtgagtacggggagtactcagcaagccaagggaaataagtgtttaatgcaggcttcaaggaaaggccgttgtttttgcaattgattttagttgaactcctttctgaaaacaactaagtgagtgcttctcaaacgacacggttgagacagtgcgtctcgtccggtcggagtatgtgtaatgtatcggtctttagacttgattcaaggttggcatccggccaacagcttttcaaacggccacccgggcctacaactttcaaacggccacccgggcctagctgatcccatcagctgcagatttttcaaacatcgaacccctttccacaatagcaatttcacaagcagtagtcaaacaaaactacgctaggaatcacctcacatccgcccatgaccgtgggcacggctgttcgaacagtttgttaacctctgcagaggggggtacactttacccacacgacattactaacccggatcacccagcccgtggggatcagccacgtcgggagacctccaagctttcatgacaaggcatttccaaagccgatacaggtttaccatatgccgacgagaggggtcccagaccaacaacaggttaggtcccagaccatactgtgccaggaagcccaggggtcctccccgacaccaccccagcgaatccacatgtctctcgacatcaaggctcccctgataagctagttactcagccaggggtgtcccattccacccatgtggtcgtacttgtcttatgtttagatgaaattccaaggaatcggttcttaagtgcgagagcgggaaaaccgtacacccggtacgttccccggtccgcggttttggaaattcatttagttcacaagcaccgacctaggtgtcgggttttccaagtcttttgtaaaactcaagttttacccaagaagttgctcagattttaaatttgaaggcgcccttcggtactcgcacagattgcatgatttccgaggcgcaactgggtggttacaagggcacatggtataacaattaacaaaggaaggatcaaatgcaacaaactaggtagatccgccaatctgccttgcagacgggacaacagattaagtgcgatcctatcaatgcataatattttgcaagcaacataattaaatttcaaatataggctcaagatgttcaaaggtggcttgccttgctcgagatctggagcttgatcctcgaaatcctcgcactgcgggtcttcgggctccggaactacacgcgaaacgggacaactcaacaaacggcgaaaatgaagccctaataatgacctctaagcgtgccattagatagatctcgagatttgaggaattttggaagttgaacggagtcaaacggatctacggttgggaagatattgaatttctaagattattggatttttggtctaaaggaaaaggatttaattaaatcctttttggaaaagaaaaagaaaagaaaagggaaagagggagggattatagacttctcctcgagcggctagggcgcggcccaagggaaaaggagcggactggccgagctaaatgggccggccggcccaaggcggcccaagtgcgcgcgggggaggggaggagagagagggccggtggaccgggctcaccgtgcgcggtcccgggtgggacccgcttgtcagcggctcggctcaccgtgcggagggagcacgcggcgcacgcgcgcgggcgggggagggacgcggtgcacgcgcgcggtctgcggaggaacggatgcggcgggcccacgcgcagcctcacggctcgcggtggaacgcgtgcacgggaggggctgaccggggtcggcccgtcccgacctcggctgagctggcgccgacgtggcgccgacgtggctgccacgcgggccggcgggaggtagacgacgacgccggtcggaacggatggcggacaacagcggcgagcggcggagcgaaccacggcgataccggcgaaagcgagcacaccgggtggttgcacgagacgaggggagacgagccaacggctcggattcgccggaggaagcttgacggcggcgaatcgcggcggcggcaaccggtggggagggaagagggaaacggcgacgaggtcacgaggggccgattcccggcggtgagagcatctacgcggccacgggaatccgatgctagcgtcggattgggcggagctacgccgagcgaggctggcaacgagcgggtgctacggagctcgagcggcgatggcagcgagcacacggcgggcgacggcaacggtcggggcggcgctggctagctacggggaggctactcgtgctaccaccgaaaactaagggggggagatggagcgaggaggaagaacggagggaggcatcaccgaggtgaggaggggcgctgtgacgagaggccgacggcgcgggagggatctctccggcctcgggccggggaagaggaggaagacgagcgcccggagtccccttccgcgtcctagtgcgcaccggctcctccggcacacacgcgacggctgcggtcggcgagagggacggcaatggcgcgggcgagaaacagggaagaatgggagaaaagggaagggagggcgcttgggtttatagggggcggcaatgtcggtttggaaaccgactttggcggtcaaggcgcgagctgtcgctccggctagcggccaaaacggcgacaggagggagggaggatgacgccggcgggaggaaaaggggaaaaaggagggagagaaaggggggctcgcccctttcttctttgggaaaattgggaggggagcgggggcgtcgcggcagagggaggagggctcggcctccgtcccttggcggcttgcgcgcggagtggcggggccgaggcgatgacgacggcgatgacggcggggcggtttggagcggcgcgacgacacgggcgacaggcgtgggctggcgcggcagagggtgacggcggcggcgaccagatggtcggccactcggcacgcgcgcgcggcttgcaatgggagggcgcggcggatggagaggcgcggctcgagcacgcgcgctggctgcggggccgagcggctgcatgcgcggcagggcagcggggccgggcggcgcaaacgcgaatgacgcgtggggagcggcagcgaaggggcggaaaggagggcttggctcggcgcgggcggctctcgcgctcgcgcgcggggcgcgcgggcggagcagagggagagggaggcgcgcggcgcggcggctc

SEQ ID NO: 59617 - DNA, 10323 bp, Oryza sativa
ccgggccacccccgggggagatgggccgagagggaattggcccatcgaccccgggggaggcaaaatagacttttgcggaggaaaaagatttggaagaatttggattcggaattgaactcaacgatagatcggggattgagatcttgagatggcacggacactagacgacaagcgaagaaacaaatttcgcaattagggtttttaagagataattttcccgctaggcgccacgacggaacgggcgctacatgatgctattaccttattgatctattatccagtggatctattaccttatctttttggctgtgtatccacggacaaaggccggagatataatttatttccattatcttaaaaaaaattgtccagtggatgggccgggcattggtcgatggagctaaaaacggggataaagacgaacaggcgtttttggcaacagctcctcgatccccaacagccggtgcagtgagactagtcgcgggagtacgtgcgcggccgtctaaacacacgatcgagacgtacgcgcatgcagtacgtcggcgcctggctgctcggctcgccaatgtgtctgctgcgccggtgggtcggtgggatcgacacagtacgtctcgatcaatcgtgcaacgcgcgtccatgctccatatatcggcacgaggtgcccgcgcgcgcgtagaccacgacgtccgatgcgagagcgctgcaagtggccggcgagctccttccttgccgatgggcagccacagcccacacggcgcgatccgcgtggagggagttcccactcaacctcccttctgcgtagggaatgagatcctctgcagtcactgcactttacctttgttactgacatatgggcccagactcatatgggcccacatgtcagtgacaaaaggtagaaagcagccaatgcgtgtccatgatccatacattgggtgatgagaaaaggctggaaggctggccttgtttggatgggcccaattcaggcctatccacgtgtgggacagcactaattctctttacttttgtttgctataaaatgagggggaaaagaaaaatatgagattacttggactgtaaaatatagcgttccggagtccgaagcagaggttcaccaacattcccgagcgaaaaaacgaggttctttgttttcgtgaaaattgtttgaaaatcattgattcccgataatatccgatcaaattttatcaattttttcccttaactagaacagaaaaccaatcggtttgtgttctcgagcagaccgaacatccggttttcgaaagaaaagaatttggctttttttggtttttgtaaaccctgctccggagtacaggagagcaaaataggcctttttctgatcgaaaattcgaaataaggagctccgtctttataagatttgtcttttgcttctaagtccttgttattgaatatactgcattggtagtttggtacaaagtgatccttcggtattgccctctgatcttggactgaacaaaaaacaaacctgaataagctgccttctagaggagataatcccaatgaaatcaggatagtttatcacgatgaattcaaccacaccagaagaaaaaattatagactcaaatgcttgtattcctcgatgtactctgctcgattctaaaatcagattagagtttgacaccgcaagagatgaggccacaggttggcctccgccggcgcccggagtgcggagtcaggccgcgcgcttcatcccgccgtggcgcccgaatagccccgcctgcaacacccaatcctcgatcatctcctgcgccgcgcggccgttgtccgccggcatgaggtgcccggcgccgtagacgacgacgtgggagagcgggccggagcgctgcacgtacccggcgagctcctcgccgatgcgccacacggcgcggtcggcgtcgaggaaggcgggcaggccgtcccactccagctcccgcatccacgcctccgtcgataccacgccgtccctgaggtcgcggatgccctggtacagcagcacgcgcgttccccgcagcagcgcctccacctccggcttcacgctcttcatcacgtccccgtgcatcgccgcgcccaccgcgtcgctgcactcctcccactccacgtcgccgcgcgcgcccagcgccgccttcacctccgcccggttcacgaacttccccacggggcccgtctcgtaggggcgcttcttcgccgcgtcgaacagcgtcgccaggcccgtcgcgttctccagccacgacagcacgagccccctcgcgtcggccgcctcgctccacctcgccgcgttcgtcagctccaccgccctcgcctgcagcgcctccagctcccgcttctgcttggcgttgatcaggcccatgaagtaggcggtgtccgcgtgcgtcgccacctgcgcgacggggtgcgtcagcccgttgccgatggccacgccgtggaggttaacccgcagccgcgtcggcagcgtggggttcacggccaggatgtacgacccagccgccgggatatacttgccggcgtagctctcgccggtgaggaagaaggggcgggagcgggagcccggctggagcgcgaagaacgactgcagcgcggcgaagaggtgcgcggcgacgacggactggttggtggggatggcggcgggggacggcgcggcgctgaagcccgtgccgagcgggttgtcgatgaagaggagaccaaaccggcgattccacgagaaggggttgggcgagagggagagcgcgtcgcggttgacgaagtaggggccgagctcgaagaaattgccggcgaggccggagcagccggggccgccctggagccagaggaggagcggcgtggaggccggcggcgtgagcgggtgcgtggcctcgtagtaggcgaagaagagcgaggcgttggttgtcgtgatggggaggtagccggagttggtcggcagggcttccttcgggaacaccgccgccgcttcagctgagggtgtgatggctctggcgctgacgaagccgatgagcaggagcgagacgaggagaagcggcggagccattggtgagtgaccgcagttgagatgggaacaggatgagcttgtcagtctgtggtttgtggcgttgaaatggcagtgaatgcaccgatcaatcagctcagctcatgccggtaataatcagatattcctctctgtcctagtaaaatataaaaaatataagcactttacttctaagcggtttccgaaatgctattttgttcaacaatatctagttttaaataaaaagagttacatattagtttgtttaataataaatctagtaataacaattttatatgattatttcttttcaattttttttattaatagtcaaagttacaaatatttaatttggtactatggccgagtttagttttaaaatttttctttaaactttcaacttttctatcacatcaaaacttttatacacacataaatttacaaatttttcataacatcgtttcaatttcaaccaaacgtttaattttagcgtgagctaaatatatcttatattaaaaatgtttatattttgggacgaggaatagagatagtacgacaagatgtttgtgtctcactgtgttttgtactgtgcggtgtgtctgtgactctgtgcctgcctgtttgtcattgacgagagatgactttggaaagtgacacgtcatggccggggtgtggttgtggtgtaagcggtgattacaacaagaaaatgacatctgaattatgatctgctcgtccgtctccgcgataaactgaagcggggatgatatattctttgccaactgctgcaatttttagttttaaaaagaactgctgcatttttttggtcgctggtttggtccgttcaagggcataaatcaaaccaaataaagcccctcaccaaccctctgccactgggccttgcgtcacttgatgaatccatcactcgttgccattgattgctctcgtcaattctttaccttccaaagctgccgcctgccggattgccggatgtgtgctggcgtgcaggatcagtaccgcgcgacgtcgccacgggtgcccagcacggccgtcacctcgtcgcctcgtcggtcctctgctgaagtgatccatcgtcagcgtacggtcccgtggattttgggcggcagccgatggtaacaacccatttcggcccatcagattttggatcgctgcgagatatccgatggtgcattctcactctctctactgctcacactgagggcccgagaagccttcgcggccggaacggaagagcgagaccgacattgaaacagcgatacgccgatacctgacgaataaaaattgaaaatatccttttttttttattaataatttacgtttatatacatacatgagatgaatttgcgaaaatatacctaacccgcgatgccggcatgtgggagcgacgggcaagcgcaggttggtcagagcgggacgaaggcccgagcggtcacgcagggcagggcggcggcaccggctcggtcccgcagggctgttgcgcggtaccggcccaatcccgtggagcagcggtgccgcatctccgccgcgcgggaccgctggcgacgccgcatggtcgaggcgcgggaacggctcgtcagagcactgatcaataaaaaaaaaaagcaaatcctcccggcactaaccacgtactgagcatgcttcaagccctaatcaatcaactcccggcactaaccacgtactgaatctattgcatgcttcaagcactaatcaatcaaaagaatagcaaatcctccggcactaaccacatataaaagaatctcttgcatgcttcagctgtatccaatggccaatggtgtacagggtgctgggggagggcgtcgccagcggtcccgcgtcacggagatgcggcaccgctgctccaagggattgggccggccggtgccgcgcaaccatccagcgggaccgagccggtgccgcgcttcggctctaaggaaccgagccggtaccgcgtggccctctcctgttccgcgggagcgcgccggttccgtttgtctaagccgcgggaccgacgctgtctaccccaccctgcgcgaccgctcgagcctccggtcccgcacatccaacctgcgcttgcccgtcgctcccgcatccggcgtcgcgtgttagttatattttcgcaaattcaccgcatgcatgtatataaacgcaaattattaataaaaaacggatattttcaaaattttttcgatacctgactgccaccgaatcaattagtgattaactatcctaattagcgattaattaattattaattaatcactaattattattagttaatagtaattatgtacttaatcaccaaataaatggagccggttgacactgtcgctgattgtttcaacgactttcgcccgcgcggtctcgcactttcctggcgtgataccgtctgcgacatctcgcttacgtaattttcgtataatggttgtacgagatcgacgatatattttcgtcaaaaattttgcatccggaatattcgtgaaaaaataaataaaaagtatattttcaaatctaattccacaaatatagctagcccctttattatttatttatttacttatatatgccttgaaatgatgttcaggttctagacggtgcccgcgctgaataatccctttctgaacacccaatcctcgatcatctcctgcgccacgcgcccctgagaatacggcacgaagtgcccggcaccatacacggccacatgcacgagcgcgtcatggcgctgcacgtacccggcgagcccgcctccgcttcgccacacggcgcggccggcgtcctggaacgcggcgaggccgtcccactccagctcccgcagccacgcctccgcgcacaccggcccgttccccacgtcgcggatcccctcgtacagcagcacgcgggtcggcgtcggcgtcgccgtcggcgacgccccgcggtgcagcagcgcctccacgtcacgcttcgcgctcttcatcacgtcctcctcctgcgccgcgcccaccgccgcggagcacgcctcccacgcgacgtcggggcgggcgcccaccgccgccttcacctcggcggtgctgaggaagtccgcgagccccgcggccatcaccgccaccgactgctgaacttccacgtcgagcagcgtcacgacgcccgtggcgttctccagccacgacatcagccgcgcacgcgcggcggacgcctcgcgccacctctcctccctcgtcagcgccactgcctccgcctgcatcgcctcggccgcgcgcttctgcttcgcgttgatcaggcccatgaagtaggcgatgtccgcgtgcgtcgtcacctccgcgacggggtgcgtcatgccgttgccgatggccacgccgcgcaggttaatcctcttctgctccggcaacgtcgggtttgttgctactatgagcgcgccggccgcggggatggtcttgccggcgtagctctcgccggtgaggtacagagggcgggcacggaagctcggttcgagagagagaaacgactggagcgcggcgaggacgtggtcggcgacgacggactggttggtggggatgttggcgggggaaggcgcgacgctgaagccggtgccaagcgggctgtcgatgaagaggagaccaaagcggcggttccacgcgaaggggttgggagacagtgagccgccggcgaaaaggtaagggccgatctggaggaagttgctgaggaagccggagcagccggggccgccctctagccagacgagaagcggcgtcgtggccagcggtgtcaccggctcggttgcctcgtagaaggcgaagtagagcgaagcgttcgccgccggtgggatggggaggtagcccgacttggtcggcagggctcctctgggcaataccgccgccgcggtggcagtggcagccgtggccgagagtgagacggccacaaatattacgacgtacacgaggtaaaacggccgggaaggaggtgccatggctggatggaatgatttgtacctatgggcagttcagttgtgcttgagaatggcactgtcacacacacaaagccttaagtaggagtatgtgtattgtcggaaattctccgaagcgtgtattgtcgtgtaatagctgagaattttctcaggtgcaagttcttggaagtgtacctgatgtgatatatgtaaggaaatacaaatgtttgaagctaaagtacattatcatcaagtagtcaattgagtatttgttccaagctgacatcgttacccacagcaagtcaaacaagtgactagtgagccaaaacgcggctgttttgcgcgtgacagatcaaagaaggccatacatatatggacagaacatatgttctccgtttcctggtcagaggagagcagcatttcttaatttcttatttggtcaggtcaaacaacagatgtcaagccccgcaaaaaaaaaaaatgtcaagagcctaaactgaatcactactagtcattagcaacacatactctttgtgacccatacatattgtttactgatataaaaaactttgcataatttttataggattagtatattcaatctccgctagattcctgcaataactatacatttaaaatgacctttaatttgacatatatattttatatctttgaaaattttcaattttctctcttgttttataacatacttattagaacttaattttgtacatgtacttctgtaaccctaagataaaatctatgtattatacttatgtaagtctagggggaaactattttgatccctcgaggagatatcccctcgttgtttatatgtcacttaaatggttatgaaaaaaattgagaagatgtattaacatgtgatatatcactcgactgtggaacgaaggctgattttatattaaaatttgaatagagtgtttgcattacaaatcggagataaattcgatgcggggttcaaagaagatctttcttctttgcaaacgttattttaaaagtcagcaacatcatttattaaaagccagagataacaacaaggtccatcaaatgtaccttgtaaaaaaatagagtaaattttaaaaaacagcaacttttactcatgctattataaaagttatagttttgtggtaatttctcatgctattgttgcagcaaactgaaatatgtcgctaatgttgtagcaaactaatagttttatcactaaagttgtagttttctgaaatttactctaaaaaatatagtgtcatatcacatagaaggatttctatttgaccaatcaggagctcatcaaggaaagtggaatccatttgtagcaatcgggagacttctagaactatagatggtcatatggcccgaggcccgtggcccgacccaaggcacgccattttggctcggcccgacggcacggtgggctggcccgacacggccacgattgaagaaaaatagtacagggatgcaaaatagacttaaataaccatataaggcaaggcccaaagagtagattaatacaaaatagacttatttccagctatacgacacaaccgctgagttgagggatgaaaaaatagatttattatgtggagaagtacgatgggctgtcgtgccttcgggctggcccggcatggcttgagtcgtattgggccgtgtatgtagctcgtgggctagcacagcacagcccggcgtgtcggtcaggccgtgccggcccaactaaccttggcccaagcacgatcgggcatgggtcgtgccgtgccgggcggcccatttggccaactatatctagaactcacgtgcctagtctttttaaaagtatatttggttgatgaatcggctaatcaaataaagaaaaaaaataaatgaatgtgtcaatcttgaatttataaggattattaacctctatgattaaggagagaaatgggagggagggaggagtccatgcggaccgggaggaagaaaggaggatagggtagcccgtttggacagtaacagttgggaattttcatgggagagtttgtgaaagaaatttaattattttggaattggtttaaattcaaactggattatttgataggagtatcaggcaatctttggtaaattttggaaggaaaaatctgatggacttggcattggatccaaggagatatatatttagtgaataatttcggtggaaaaattcgaattgtgaaattcaaccttcgaggttagaatttggatagaaattttgggattagatttttgggcctcaatgagggattttgagattcgttggcacttaggtccttttcaaaaccattctgacaaggaaaaactgtaattctactagctcccactgtaggttgactctaatttatcctcaagtgagtatatcgattcatccaactactaaaaccagttttgttacgccgagaagacattgctgccgagatcctacatggcatccagttccaagcgcggacttggggatgaactttgtgagctgaaatgatctagcatgtatactacaccaaggaacgatggaaagaggcaaggcgcattgatccaaaattttatttatttatttatttatcataggtgctgaaatgatctacgtataaactacagagcacaatacggtgtgtacggccgtggcagcggactaactacatattctctccgtttcataatgtaacactttctagacttacttcatatagatattaataaatatagatatatatatatatatgtatctagattcattaatatctatatagatattagcaatgctagaaagtcttacattatgaaacggagaaaatactccctactataaatgaagaaacattttgccttacgccttcccgccgctggcgccgaacaatcccttgccgaacacccaatcctcgatcatctcctgcgccgcgcgcccttgagaaaacggcacgaagtgccccgcgccatacaccgcaacgttcacgagcgcgccgtggcgctgcacgctcccggcgagctcgccgcctcggtgtcgccacacggcgcggtcggcgtcctggaacgcggcgaggccgtcccactccagctcccgaacccacgcctccgtggacaccggcccgtccttcacgtcgcggatcccgccgtacagcagcacgcgcgtcggcgtcgtcccacgccgcagcagcgcctccacctccggcttcacgctcttcatcacgtccttgtgctgcgccgcgcccaccgccgcgctgcacatcttccactccgcgtcgccccgcgcgcccagcgccgccttcgcctcggcgccgttcagcagcggcgcgagcgccgcggcctccgcctccagcgacgtcgtcacctccacgtcgaacagcgacggcacacc

SEQ ID NO: 59618 - DNA, 7457 bp, Oryza sativa
catgaagtaggcgatgtccgcgtgcgtggtcacctgcgtgaccgggtgcgtcatcccgttgccgatggccacgccgcgcaggttaatcctcttcttctccggcaacgtcgggtttgttgctactatgagcgcgccggccgcggggatggtcttgccggcgtagctctcgccggtgaggtacagagggcgggcacggaagctcggctcgagggagtacaaggactggagcgcggcgaggacgtggtcggcgacgacggactggttggtggggatggcggcgggggaaggcgcgacgctgaagccggtgccgagcgggctgtcgatgaagaggagaccaaagcggcggttccacgcgaaggggttgggagacagtgagccgccggcgagaaggtaagggccgatctggaggaagttgctgaggaagccggagcagccggggccgccctccagccagacgagaagcggcgtggtggcgggcggtgtcaccggctcggtggcctcgtagaaggcgaagtagagcgaagcgtttgccggcgggatggggaggtagcccgacttggtcgggatggctcctctgggcaataccgacgccggtgcggcggccgccgaggccgagagcgagacggccgcgaggacgacgaagacgagggacagcggcgaaggaggtgccactgccatggcgcgcccgcgtcggctgtcgcgggctcaacgtggcttatcggctgagtgatgtattgcaaatttgcaattttgcaaggaggtttcgattagtgttgacagctgatcgagccggtgtgcttgggaaatggaggcattcggagagccttaaataggttggcatttggtggtcttaattaaaaaattgtgtacgtaagtatgctccggtagaaattctcggaagcataccttgaacagacgtttcaaacgcatagacttcaattatcatcgacttgtcaaaaagtagtcgtcccaaatcacggcgtcacgtgctgtaaacattgaagccagatgtcttcagctgtgaggagaacgtacttgctttgcgcgtaaacatctctgttgttctagtctctactagtaataactacaagtagcaaggtggaagagtgaaatttctgctgacctgtgtgatgtagtatttgtaatttagcaagaaagagtatgtcgctgggtacatctctgttgtttgtctggtgcacagagaagaaagacaattgtacctagctgatcaggtgaaacaacaagtggaagaggtcaaactgaatcacctctaatagtcgtcctcatccatctgaccatcttccaggcaaacttctccgtttattactggtggctggtaaataattaggagccaatccagcaacgaaatccaatatatgccaatcaatttaggctgttagccactactaatacatccttgaggtgctgatgggtacagcaccaacctttctgttagtaccaacgcctgccgaagtcgcggcagcaacaataccgttaagagatcttgtgtatatgtcagtctgtgttaccattctatctaacgagccgttctttgatcctgctgaatgatggaacgtggatcctctcatgtccagagcaacatcagccgtgactttgctgttcggataagcataggcctgcgtctgtgactgtgaatgcattttataagcatccatggcttgtgattgttcaacacagttcatccttgcaggcacttgatgataaccatatgcttgtgagatttgttgctggggaggataccctgaactcatcactggtccccttggaccataaggatcattggtgcttccagtctcataaggaaatactgacccaacaggtctccctggtgccactgttaagaaggaaatatattagaaatataaacagaacatgtagatatactagtattaataaatgaaacacaagtgcacctggttttgccacttgtgaaacctgagaagaagtgggaatatttccagaaaatcctcccatgacccaggggtttttacaaggttcatcagagacaggcctgctgctcttcaatgaggccgcaagaggttgttccttgggaggaattggagtagagtgaacagtagtagaccttacaaaatgtagttgtagattagcaaaaaaactcaaggtttaactaaatcaaagggtataacattatgaatgcatgctaatcaattctcgtctaatgtcaaaatatctagactgcaaaattcttttgtaacatgactctaactaacgtgcgagttcctttcttcatcatatcatataccaagtcaaacggagaatttggccatctagatagcagttatatgcgccaactctacaacattgacagaaccacaaattcctagagaaatctccatccctgtgcttggtgcaagaccatgcacaagattttgacacacttcaggaataaagcagctgttttctttgaactcatgtgagccccagttacttcagtccaaagttttatataacccagtttgccatctggacaaggaacccctggcctgatctagatgtttctttcatcatttggcaccaaggttgccttgatattgagaaatcttaagatgaccttcaaagcacgcctcaaaaaaaaaaaacacgagatcagaatttgatgccatattacctaggaagcgatgcatgttttctttccattggaattgctgagccacttccattgctttcttcaagattagagaactgcttcttaaactgatcaaccgcactgtataatcatgacgacaagttatcaccgtcaatgagacttgatacagtaaaagaaacgtataaatacatggtacatgcatgtgcaaaagcaccatacgtgtgcaaatacagaaaagctaaaaccttgggtagagaaaggttgctctctctcttccatttctgtagttcttctgcaattgtggatgatattccaatatctcctggaatatcagctcccttatatcttccttagacaattttttctgctcaaattcaaactccagttttctgattggctggcatgatggttctctatcaatcttggaaaggcctttaaagtatggatcagtcaatgcctgacaagttttaagtatcaggagaatgccacaacaatacaaaatacttcacataccaaactaaagttgcaagcaaaatcttaacatataaaagaaattgacatatcagtttatcacagtgacaaaagacaccaaacagttacctcttcagcagttggacggtcctttggatcaaaggctaataaccgttgcaagagttttagtgccaaaggatctgcattaggaaacttttgagagaaggggactggatctttctttctcatgctgctcaagtaccgtcttgctttctcattccgaacctggaaaggaagagaacaataagacaaatgttgggggtcactgaagtctcctcccaggaggacctacaaaaaacttttacctaacagtattatcatacccgggaaattgtatccatggaaggtgttcctagaagatcagtcatcaagtctaactgatggacaacatttttaccaggaaacaaaggcttccctgtcaacacctcagcaaagatgcacccaatgctccaaatgtcaatagctggtgtatactgcagtgaaatgataatgcaaaacacattaagatgctgcatataaccacacccttgaaaaattatgataagcataaaagcagcacattagttcaccaggcatgtgaattttttttaaaaaagcttgtactgttctaagttgctttttttttacagtaatctgaattgttgtaaacgttgctattcagcaggatattggtccatatttgcgtaaaacatggaattgatgggaaataataataagtccttgaattaaaatacaaaacagaacaaaaaaatgatatcagaacaagattgaacggatataaatctagcaaaaatggataaacagtatcaaagaaacacaaagatgaattgtatatgctttataaaaacatataaaagagaaaataccaaataaaacataatatgacatcgtcaagtctaacaagcacattgtatttctgtcaggataaacatatgcatgaactgcaaagctcacctttgagaagaaggatccacagagctctggagccctgtaccatcttgttgctacataatcctgcagagcatacgtgttatgtccataaatcatggtggtacttcaaccaaatcagttggtgttgggtttgtgcttcgtactaacataccgtccagaagacagttgttggggtatcattgaatgcaactcgtgctagtccgaaatcacatattttcagtttgcagttagaatttgctaaaatgttcttgggcttcagatcacggtgataaacactagctacagttatataaactcagtgttagcacacattatggcaatagaaaaataaaagaataatatgcaattgagtcataagattttacacagggtgtcaataaggtagaaaaacaacagggcatggttgatgtgtttttagcagtggccagtggcaagtcaatacctatgacaattattggacaagaatcccctcaagcaatcagactgtgtccttatcagagtagatactacataaatgtaatgaggaaaatgacaagagtgctaaataagtcacaaagcttccatgaacttacagtcaggtcttataccttgactgttacaattaagtataatttactttcatggtaattttagaaggcgtgtgggctaaaagaaagctactagtttgaacaaactaaaaggacgcagactgatatgtaaatggatatgttaagtggacatattaaaatatagagggatagtaacaggtatcatggttggaccagctagcacaaagcaaggaaccagattaataataggtaaaattataatctacagaaatcatacacaaacccattggttaacttggttttacatcataaaggggaaagcccctgctgctaaattggtttgcaaaaatatggtgatttattatctgcatttgattgactgcactccaagcaacctttggtaaataaaaatattctcacattcactgtagattatctagacatggtcaccgaggaagccataactaccccattacttcactttcttttataattatactgaagcacaaacacatggggagagtggttgaagggcatgatgagtaggtgacttccctctatgcaatgaatatgcaatacatataagactaaccacagaatgctgcattgtgaaatgagatcaaagggggtaactaatatacagactacagatgcacactatctaaaagggggaaatggaactagagctgaaggagttaatgtttcctaccagtatgaatgtatttgagggcccggagtaattgataaaggaaaaattggtagtgctcttttgttaagtcatcattagcctttataacttggtggagatcagattccataagctcaaaaacaacataaatatctttgaagtcccttcttgacggaggtagcataatgtgcttgatctcaacaatgtccggatgccttaggagtctcagaagcttgatctcacggagaatacgcgcagcatccgagacatgctcaaaaatattgtgcaccttcttgatcgccaccttctgtctagtgtgcaaatcaatggcagagcacacaaccccatagcttcccttaccaatgacttcttggatcctgtaccggttcgcatcaccatactctgtaaaaaactcctccgcagagctctgaaaaaaaaaagaaatttcacacaccgaatcaacagcccatcactgaagattgcaatgaacttcatataatcaatctcataaaaaaaacggcaccatattgttgaggtcacaaaattattgcaattcgaaaccgaacattgagaagcttccatcttccaccagcattaaatcatggacacagcaacgaactgttgttttcgttttaccaccgagatgggtttgcttgtgggcattaccgaagccgggagccccacacgagtacacgaggtaagggaaaagctttttcccaccgacagggcaaagcagcagcatgcggcgttgtttagttcggcgcagaagcatctcgcagcgacacggtaatggtcaactttggcatgtgaaggatgagctgttcgtaactcaccgttcggtgcacatcgcatttggccttttcaaccacatactccagattgctagctggatcgcacatttcgtccatgatgaacaacgcaataactaaatccattagaacatgtaaaaaaaagtaaaaaaaaaatctcaaaaaagtttatgtaaaaatggcgatggggagttaaaaaactagcctatttgcaaatcgcgcgctagaactgaaatgaacagcaacaccagaacgccattagacaatccacaacttataaagaacaaaataacaagacaaaaacatcgaaggacaccgaggcgattcgcgcatcgcaccaacatcaacgggcacccatatacgttccagagagctacacagagaaacacgaggggggaagaggggcgagagatcgccggaacccgggaaacccaccttcttccgctgctcctgctgcattccgctcccttacagatctctccccccagaccaactcccacagcgcccccctcgaatccgcctcgcgacaaccccaaacgcgccgccactcgaatcccccctgccccccacaaatccacaccgcgcgagtcgcgagcaccgccgctgccggcgcgcggtcggtgatggtgaaggcgatggcgatggccgatggcctctcccgccgcgtccgcctcctcccgatctcgcggcgtccgcctgagaggagcacgagagagaggaaggggaaagaggaagaggaggagaggagtaacggggggaaaggctcgaaatcaaaaggaggggagcggattaatttcgcgagagatggtgtgtgtggattcgtggtgccgtaaatcaaatactgcaaggatggttttgtatgtgcgctccgggccacatgcggcgggtgggatgcggacctcagcaataccctgctggattgctcttcgccgtccgatccgcatcttgacggccatccttctttggaacgtatcaacctcccacaccctccttttattacagttttttttactttttttttaagtgtgaaattgggtggagtacagtaaaaacatattattcatgtatcatatttcgtatttttcttccaagtcagacccgggtgcgggtgcagctagtgccgacaatatatcactcatcatgtaccaaaatttttctttctcagaattagattcaaaacggatatctagttgtgtccctaatccataaataaatatcaaagtaagggatacaattcaattaaagtgttaaaaaaagttcaataatatatatatatatatatatatatatatatatatata

SEQ ID NO: 59619 - DNA, 2596 bp, Oryza sativa
cttttgtaatgtaaaagaaaattgttcttcattgcctacctgccaaaaaaacatcaccttccttcctgcatcaagcagcctaatcttttaataagatgtactacaaagcgacagctccacatcacatgttaggattacaggagacgcgtccatcgatcttacggcacgcaccgacacacacggtgcctcctctgccacaattaattaacaagtaaaacatgctttgacactagtagtgaactcctgcatgatgggagagtttctgtgcgttacaatgtccatctcgctattcatatcgcattagatgtgtccattgactagcgtcatcacaagttgttccaggacactgtccatgctctgaaaattagtgatagcgatcactgattacaggcttacagtaccattcaagtgcacagacggagacatgatggaatctcgtagcagtatcacgttattccagaatctaaatgctgttttccaataatcgataggtgcccatgtgactcgcagtgtgctggctataaagtataatcatgttaattaattcatagtcgttctccaatgacaaatgaaatggcagaaaggggaggggaaaaaaatactatttcgtgtatcaagaagctgaaactactatgaaatatacactatgcttccttagttcctttatctgccttgtagttacataaactgcaaaataggatgctatgatacatgttggtggtggatccacaacaaaaagttgctgcttgtaatcatcttcccaagatcgacattattctagcaagatgaacttctttgggagctactaacccacatgggtgcgagcatcttatattcagagaaatcaagtgattcagaggaatcaagtgaatccatcagtcaatcctctgaagattatatttcaccacgttctcaagggtacttctgaactggctcttgggaaggcactgcaaattttggagagccaagtcacctttctcctttgcaagctcctgcgcccttcttattccaccacttctgtgaaccaagtcgattgcagtagccaatgaatcactttcactgaactcagaatcgattatctcccttagtttgggttcatcttgcaaagcgaatatgactggagctgtcaggtttccctttgctaagtcactccctgctggtttcccaagttgctcagctgattgggtaaagtcaagaatatcatctactacctggaacgagagcccgagattcctgccgtattcatacatttgttcgcatatagtggtgcttacaccactgaatattgcagcagatcttgtgcttgaggcgagcaacgaagcggttttataatagctcttgagcaagtaatcatcaagggtgacgtcgcagtcaaaaagagtagatgcttgttttatctcaccactggcaaagtccttgatcacctgtgaacacatcatctataagcaaacaatgcaggagcacagtcttaatgaagagatggaagtttgctcttcattcattacctggctgatgagcttaataacttcgatgttttctaagttcgctaggaaccaagaagattgtgcaaacataaaatcaccagcaagtacggccacccgtgttccatatagctgatgaatagtttctttccctgaatataatcagatgcgtttcagaataaattggtcaattggttcttaccaatgtccaaagtacatgaaccacccaaaaaggcaaaaagcaaaagaaacccacacattctgccaggcataaagaatatgtataaattgtttctaagaagctatgaaccaaaatgaaaaggaaagaaacagcgatatttattgacagcgacttgtttgtaatagaatgatatgtacctctcctcatgccactatcatctatgacatcatcatgtattaaacttgctgtgtgaatcatctctatgatctctgccaggcgttgatgctctgtagtaagctccctgaattgcaaaaaaaacaaaaggattgagtgcataattgcaaaacacctaattataagtagtagagctgcaacacgagtaacttacaacaaaccagctaattcagcagttgctctggacaccagaaaaactaatgctggtcttaacctttttccaccagcaccgaaaatttgttctgccgcagaaactaaaactggattttctgcaccaacaagctattaaaattatgtcagctagttgctgcggtagcctggtaggtaggaaaaacacaaagaactagcctagcaaatttttctctactcaagtgctcacacactatatgaagcaaattagtgaagatatatgtattcaatatgtaatgctctgaagtatgctctcttaattatacaaaaaaatgatgatctgtggatggagtacaaacaagaaactgttgtagtttttgagggagaatcgtgtgttgtgcagaaccacaaaaaatatgtatattttggtcggagtaggaagactagtagcaaactagcaattcaacaacacgcgagccattcaaaagtattatggagcctacagatataggaaataagagccagaaaaatctgtccgcgtactcctggtgatgctaagtccaagtcatca

SEQ ID NO: 59620 - DNA, 42566 bp, Oryza sativa
  unsure (1)..(42566): unsure at all n locations
atattttccttacaactaaatgaaccaagcatagtagcttaagttgttactcatgatactgaactgatcgaactatagtctgtgagcggctttggtatataaggcgcaagtgccaagtatttactagctatcaagatgctggttctgccagtttaagaatcgaaatgagttaactctgatcatagcttcttcctgattagattcttaaatcttaagtagacttgactctccccatgaccgctcagcgggtcacagttgtaaaagttttttcttctgctaatatatcggcatgcaaggctcttgcgcattcgaagaaaaaaaaaaactagacttaactcatttcaaccatgataatgtatcagacgaattcacagaaagagaaactattgagtaagaaatgtatagcctacatgaatgcatctctatttaacgcaattctgagtaaatcaaacaaaagatgtggccttcagaagaagctcaccgatttcagattattgttgagtttcagcaggtcgtcggagacaacctccaaaagtgaagaaacagaaattcgctcagggatcattgttgttgttctcgcactagaaatcgcctctgctggcacatcaactgcagcaaggcctgcgcaaatacgctaagtcgttagctcagctcactccaaaacacagcggctcaacagaccaataggaacaagagctgcaggatgaagaacctggctggctcggtgaggccacgaaacaaacacatggcatgcgccgcctcggcgccacccgcatgccggaccggccagcccaacggcaccggcaggaggccagctgaccgaaatccagcgccttcctgctcatgtacactctcgggcagctcacagacaacatctcccacaatcagtaccgccaatccaagaacccaaagaaccaagaaatgaagctacagcaacttggagctccctagaaccgacaaattctttggacaccaagaacctcttccccggacaatagcagccaagaaattaaacgaatgctagcttgtgattggtttcgtgtgagaatcttgctcaatttggtggctatagattttttttcccctcttcctttttggaaggaaggaagtggcggctccggatggagggacggagggtgtgggggatttaaatatggagcatgcggaggaggagaaagggggatttgtggatccatgagggccatagaacgaaggcgattgtgtgagctcaggagcaaagcagcgtgtgagctagtcagtctatcactttggagtttggactggctctagaagttcatgtaccttttgctctttggtcccgcacatttggctctaattgcagtttaggactattaggacttgtgaacttttttgtaatacgccttggatttctttatctttgttgtattataagaagagagtttgtatattgcattcacatatattgaaaggagaaaaaaaagacaaaatagcaaataataaattccgttaacgtcagaatttggtactgttctttcctggattcggttaaaggaaaaaacggattagatggaaatgtatttagattagggtgagttcaaagagaatcataataccagggcaaggaaatttcatattttcttagtatatcttctaaataggtaggattatttatttttatttttaggaaatcttattcatgttagagtataaatatgtacacccgagatctttgtaagacatctcctcgtattgatacaattgtatttcggcacatcaccaccctagttgtagtttatgtggttcatattctcgagcggggctgtatcggttaaattcgatatttggcgaatggggtaagtcatgtcaccccgtcaattgtactggtatagttaggactttttcgggttccgctcaatattttgactaggctttatggtcatcaatttatcttgttgtaccggcttcgactaaggctgcatcgttttgatttcttagttagatctggtatatccatcacgtttatatagatctattggctaaatagatttttcttattatcttcaatcttatattgttttggttaggttccaatctattagattattgctaataagtttaattctactaagtgtataggtttttatgcagcgtatgttagagttctagctgatgagttatcattactctaaacttcagttatatgatgtattggttagttagcccgtagatatatctacattggacctccagccaatggcggaaatagggaaagggcagctaggacggctgctctactcctaagcataaatattcatgcatttcaaaaactcataacatgaaagataaaggtaaattataatagttactccacttcctttagccgatgtatattttaaccatcggatctgtatctactacactatatattagtcgattggttcatggtttgattatttttatcatcattgttagttgcaggaacaaactaaccggcacattctgaacctgatttttggcatgtcgtgaacccgatttctaggacctgcactagagctaattagtaaactctcaaaccttcgtgtattggataaatttggtgataacatacatagggctatctcttgcgacatactacctccgtttttttaatagatgacgccgntgacttttaaacatatgtttgaccattcgtcttattcaaaaaaaatttatgtaaatgtatagatataaatcatgcttaaaatactttgggtgataaaacaactcacaacaaaataaattataattacgtaaattttttgaataagacgaatggttaatcgtgtgataaaaagtcaacggcgtcatctattaaaaaacggaggtagtagtttataatgtatcgacgcggtggattgttatcctaacttgacggttaacactccagctaaatgcatgaacgcggccttctctgcagcatggcaagtgatattgttgtagcttctgctttggttgttgaaaagacgatggttcccattcttctctttccaaaatggaatcacgctgcgagaattattacggtgtcgaagcctcgtcaatatggcctgttgattaatttgtttccggacacggtttcaccgccaaaagaagtgtaaaatcaaaggtgttgacggagcgtggggctcctcaccgggagaccgcgcaggcccccctttgccggttcggccgggggcgctaagtgaggttcttcgccctcgatctgaggaacgtcagcgagagaggaaatgcacaagacacgggcgacgtagacaggttcgggccgctgagaagcgtaacaccctactcctgtgttttggtggatctgtgtgtgaaggaatacagagagccggagagcgagagagagttcaggctctagaacccattcgccagagtcccaacccctctgcttcctcttcctcttttctctttttctctttttctaggcctgggcctcctttttatctgttccggggtcaccacatgagcctcctgctgcctaagaaaggaaacatgctttttacaatgagggctagtctacagccggaagtgacctctgacaagcagagcacacgcctcctgccccgctcgcccgcttttccggtggacgcccatttcaaccttcatttaatggccagcgacttccttgccatacttgcgctgaagcctggaatggatctgaccgggactgacataccaactccaggagttagcacgccggctccggctagggacgagagccaggaagctctcatcattccgacgggacggggcgaggcatgtgacaggccgcctgttgccacctaacccgcgatctctgaccggtcacacaccgcgaccggtcacggaccggataagcgtgcgctgcgccgcattaaatgcggcgtggcgcgctcgtccaacctgctataaatgcggttaggtgagcccggtgggctcacctaacccacacacgtggcgccaaaaccacagggggtcggggcgccccagccctcggggccgaaacgggagcggcccgacccttcggggagacagagggaggggtggccacgtcaccctcgggcccgacccccctgagggggtcaggccacgtgggtgaccgcggctacccaagcctctagtcacgataccctcggccccatgtcaccgacagtagcccctggcgttacgccagggcgatcgccccccttgagggaagcgctcgggcgtgacgccactccttaggcccggtgacaggtggggccggtccctacaggcgggcagaaacccagcggtcgcaaatcgcgcgcatcggcaagggaaaaccggccgacaataatgagcggcctcttcaagaccgctacattactcgagcagcgcgcgaatcgggacgagccggttcgtttcgccagggaggtggaggaggagcgggagactgccctcatcgccaccgccgtgctcgacgaggcgcgggacgacctccgcctccaatacgggagccgggcggcggagctagaggagaagctcgacgccgcccgggaagtccttgacgccgccgctgcccgggaacggcgggcggcggagaacgaggcggcgtcccggcagcgcgaagaggcccttgaggctcgcgccacggcgctggaggagcgcccccacgccctggacgcgaaggagagagacctggcggaccgcgaggccgccgtcgccacccgggaggcaacactggcgacgcacgaggccgcctgcgccgaagaggagtccgcactccgcctccgcgaggacgcgctcaccgagcgggggcgagctctcgaggaggccgaggccgcgacgcagcggctggcggacagcctgttcctccgcgaggcagcgcgggaggagcaggcacgccgcaatctggaaggcgcccgcgccgagagggccgcactggatcagcgggccactgagctcgaggcgcgggcgaaggagctggacgcgagagcgcacagtggcggggcggccgcgggccacggcgacctagccgcccgcctcgcagccgccgaacacaccatcgccgagctgcagggcgcgctggactcgtccgccggggaggtcgaggccctccgcttggcgagcgaggtagggcctggcatgcttcgggacgccgtctcccgtctagaccgcgccgggcggcaggcgggcctctggggcgggcggtacgcgaagtacgccgccaaccaggggggcctcgcccagcgcctctcagagatggccggggccctcgagcggctccccgaggagctcgaggagacgatcaagtcatcctcgagggacctcgcccggggtgcagtggagctcgtactggcaagctaccaggccagggaccctgacttctccccgtgggcagcgctggaagagttccctctcggaaccgaggacggcgcgcgcgcgcaggtccgggacgccgccgaccacatcgtccacagcttcgagggtacggcccctcggctcgcgttcgcgctcgactccgacgaggagggcggtgacgacggtgcggacgacagcgacgacgaggccgacgacccgggcgcgtcggagtgagcccccaggcccccgccaatcttaataacttttccttcttcttccgaggccttcgggcccccttcttgtatagactgatttaatctgcaatcaagtaaagaggaaatttctgcgtcagttctgtttgttgtgtgtatgagacgaggatggtctgtgccgcggtccttctgtgtcttggcttgaacaagggctcgtgcccaggtcccagcctcaaacggcgcgggtcggggcctgcgttaccccgatacgctgatacggatacggatacgcgatacggtgttaccgggatacaccgtcttcctaaaaacatggatacggggatacgcgaatatatacatatatacaatttaaaaatacaaaaaaactaagtgtgaaatatggacttaaaaaataggaatcacaacacatgtgttcttcaaatagatggtagataaaattgttcacatagtagataaatcaacagtagagcatcaccacagcgctaaactaattagaattaattaacttgtccttgacttcaaattcaactcaataactagattgcaagactagataaattgattgttgatttcatccattggaaccgaagtggatgaaggcccgttatcgccttgtatgtccaatgcaccaagatcttccagtagtctctcaaggtcaggctcatcaagtgtcagttcagcttgttgaagaaaatcagcaccaccatcaaacaactcatatctatctcctgcaacatcccacattattgatgggccactgtagtattcttcagatctcctagaaagaagacgcatattttggtgcacaaacaccaaatcctcagcacgtgcaggcctaagactaaaaaaaatgcaattgtgttaatttcatgcattactaacatacaggaaactaaataagtaagagaaggaactaaacttgtttctcattgaactatggatgaaaccataagtgctccagtttctttcggcacaagaagatgatgttggctgtccgtaattttagtgccaactttttaagctcaggtgcagagttaccatagattccccaccattgctttgcattcatatgggctctatcctcaattgagtcaaaggaattaaacccactgccaaacaatgagaaatatgcaaattgttgtttgatctttctcaagtcatccccagagaaatatcttctaaaacacttatttctcatatctgaaatctcctcatccatatgaggggcttggcggtttggagcctcctccaaccaagtctcatagtagtacctacatgttgtaaaaaagattattgagctgctagcaacaattataaattatgcacataaaaattgaaaagaggtagaacatcattactttgggtttagtgaatgtgctaagcaatgcaagggggtagtactttttgcccatcggaagtgtaagatctcattcacatgaaagaaaaaagaacattgctcatctagttctttcccttcatgacgatagatgattttttttcaccttatctatcatggaatcccacatctcatagatcaaatggaggcatggtttgtcagtgtcagcagcacgaatcatagagtagataggctcacagaaatcaatgatatatttcactttatcccaccataaatcatttaaaatcttctccttgacatgttgtgcttgaacttgattgtcctccctataggcattccatttttcactagccaccatcaagattaagttctctttgatagcacgaaacctcttaagcatcacaatagtagatgcaaatctagtatcagcaatggcaagaaatttcagcttactaaaatcattgaacatggagagcctcattgagtgattcataatgaaattctttatggcagatgcatctgcagccacttcactaatccattggaattctagaaaagcatccccactagagtttttggcagcacatatactcttcaaggctaagttcaaagtatggacaacacatggtgtccagaaaatgtggctgtacttttgttcaaccatcaatccagcagccctacaattagatgcattatcagtaataacttgcacgacattatttgggccaacctcttcaatgatggcaaacattttctcagcaatatattccttcctcttgatttctccttcagtatagattgcttttaaaaacattggtccatcttctgtcactgcaagaaaattcaagattggtcgcctttgagcatcagaccatccatcagatacaatactcacacctttcgtagaccatgttgacttgacagcattcagcaagcgctcaacatttgtcctctcttgaacaagaagtgttgttcttaatttgttgaaatttggaggggtataaccaccaagttggttgttgcaagcaaactggaaagccttcctgaaatatggatttcttgcaacattgaaaggaatacctgcaaaccaaatgcacacatataattagttgcacgtcataaacaaaacaaaattgataatgttagaactgaaaaaaaaacatgctatattctgacctgatgtatagaacatcctcgcaatcaaagcatcaagcttggcacgagcatctaaattgaagcttgactcaatagctgaaacagcccttctcttccccctactcacactctctgttggtagtgggatgtccttaggcaaattccttgcagagattgcttcagctctagtcatttcatcttgaagttgcccaagtatatctactgtcacctttttgcatgtagccacaccaattgttccaattttcaagagatgtgctttaactcttgagtaactcccatggataacttggttacaaaactgcatctgaaccttgcattccctccttgacctttccctgtcttttccagcagctcaacatacctccacaagggcttcttttcatcatcattgggtggaatcacacgagcagcattcaaaatgctccttgcatgccctcccattgttgaaccactcccactagatggtctcgatgcatcaaaaccagtattaccactaggattgctagcactaccactatcatttgagcttccacttctaaaatccattgaatctaccaaagatgacagcaattatactaagaaaaattgaaccggaacactacgcacagtgcagatcaaacttggaggggatattcacttacctaaggatcctcagcgtcgtcggaggccgggatcgaaggaagccaacacggtgctgggcgccggttggaggcttggagcgggcggcgcggcaccttgtggaggaggagtcgcggaggagagcgcagaggagggggcgctgtgccggccgtaggcggcagcgcggcgcctgccgctggcggcggcgaggcggcgcagcgacggcgtaggcggcggcgctgagatggggatcggggaagcgaggagagaggggcagcgtgagttgtgacttgtgagagcgaggggcggcgcgggtggaggaggagagcatgttttgttcctgtgcgatgcgatttagggttaccccgtatcaggtccgtatcccaccgtatcgggagaatatccatatttattttaattatctaaaaataagaaaaatgagggatacgtatgggatacgtatccggacgtatcccgcacgtatccgtatccggaggcgtatcagatactgatacgacggtaatctaccgtatcagggtaacgtaggtcggggctagtgcctggggagatcctcgtgtcgagactggccaggccgggagcgcggtgaccgagggttatggatgacccgattgtgggcctttgccgattcccccccggagttcaccacgccccggggcacggctcggttctgggccccgtttggcgattttagccggcccaggccactgagggcagggtcgagcacgagcgtgctaattcaagccaagattcttcaaaaggaaacgatggcacagacacagtcctcaggaaatcgaaaatgcttttattgaaatacggaagagaaaaaaaggtaagtatatgcatgtggtagcccccggccaaccctgcacgcccggggggggtgcggggttggcccgagcccgagacatgacacccgacccccactaggggtagaagcggcaaaggtgttcgatgttccacgggttaggcagctctgtgccgtcgcccgtggccagccgaacggagcccggtcgggggacgccgatcactcgatacggaccctcccacattggtgagagcttgctcagtccagcacgcgtttggacgcggcgtaggacgaggtcgtcgacgcagagtgatcgggcccggacgtggcgctgatggtagcgccgcaggctctgctggtagcgcgcggctcggagggccgcgcgccgccttcgctcttccaaatagtcgaggtcgtctcggcgaagctgatcttgatcagcctcgcaatacatggtgacccgaggggacctcagggtgagctcagatgggaggaccgcctccgcgccgtagacgaggaagaaaggcgtttccccggttgctcggcttggcgtggttcggttcgcccagagcaccgctggcagctcctcgatccacgagtcgccgtgcttcttgaggatgttgaaggtcttggttttgaggcccttgaggatttccgcgttggcgcgctccacttggccattgcttctggggtgggtgggggaggcgaagcagagcttgatgcccatgtcttcgcagtagtcaccgaagagctcactagtgaactgggtgccgttatccgtaatgatacggttaggcaccccaaaccgagcagtgatgcccctgatgaatttaagcgcggagtgcttatcgatcttgatgaccggataagcctcgggccacttagtgaacttgtcgacagcgacatacagatactcgaacccacccggggcccgcctgaacggacccaaggatatcgagcccccagacagcaaacggccacgaaagaggtatggtctgcagggcctgggccggctgatgggtttgcctggcgtggaactggcacgccctgcaccgccggaccagatcgaccgcatcgttgagagccgtcggccaatagaaaccctggcgaaaggccttgccaaccaaggtgcgtgagacggagtgggctccgcactcaccttcatggacatcggcgagaagctcgacgccttgttcccgaggaatgcacttcaggaggactccgttagccgcgcgccgatagagggtcccttccaccagcacgtagcgcttggagatgcgccggacgcgttcactcccttcgcggtcctcgggtagagtcttatctgcgaggtacgcctggatctcagtgatccaagcaatcaatctaggggagctggaagcgctcccctcgggtcccgaggcctagactccgacgggcctcgggggccgttcaggcgcgtccgtctctcctagggggtcgggtcgcgccgacggctgggcaagcctttcttcaaaggcgcccggtggggtctgggctcgcgaggaagcaagccttgagagttcgtcggcgaccgcgttatcccgtctgggcacgtgccgaagctctatcctgtcgaaatggcgctccatacgccgcacctggcgcacgtaagcgtccatctgcgggtcagagcactggtactccttacagacctggttaacgaccaactgggagtcgcctaacaccaggaggcggcggatccccagtccagctgccactctgagtcccgcaaggagtccctcgtactccgccatattgttggtcgcccgaaagtcgaggcggaccaggtatctgaggacgtctccgctcggcgaggtcaacgtgacccccgcaccggcgccctgaagagacagggagccatcgaactgcatcacccagtaggcggtgtgaggcagctgcgtggggcccgagctggcctcgggggcggagacgggctcgggagctggggtccactccgccacaaagtcggcgagggcctggctcttgatcgcgtggcgtggttcaaagcgcaaatcgaattcagagagttcgattgcccatctcaccacccgtccagtaccctctcggttatgcaagatttggccgagggggtaagacgtaactaccgtgacccgatgcgcctggaaataatggcgtaacttcctcgaagccatcagaatagcgtaaagcatcttctgggcctgagggtatcgggtcttggcgtcccggagggcctcgctaacgaagtagacaggccgctgcacctttcggcggggccgatcctcttcgccaggggccgcatttccagggcgctcttcgcccgagaggccacacggggcgcactcggcttctgtgccgacgacctcggggtcagagagcgacaggcgcggccttcccgcagtggccctggggccgtcctgggggtcggggacgcctggcaccgtcggacaagcaggcggagggccagctccggccgtcgggggccttgggccgccgttcggctcgggggcctctcctccctgctctctcccgggtcgagtcgacacagggtggggatgcgcggagtgagggttgtcctcgtcgcgctccacgaccaacgccgctttgaggtcgccatggacggtgatggggccaccggggcccggcatcttcatctggagataggcgtagtggaccgccgccatgaacttcaccaacgcgggcctccccaggaccgcgttgtagggcagactgaggtccgccacatcgaagtccacccgctctgtgcggaagttggcggaaccaccgaaggtgaccgggaggtcgatatgacccagcggccaggtgtgccccggcgtcacaccgatgatcggctgggacggccggagcaccatccccggggccttgatggcgtcaaaggctgcgggggaaaggatgttgagggctgctcccccgtctatgaggacacgccccaacttcacattgcaaacggtgggggaaaccaccatcgcgatctgtcctccccgggcaacgcacgacgggtggtcggtctggtcgaaggtgagggcaacctccgaccaccgcgcccgccgcgtcgcctcatgggtaggggccgcggccagaagctctcgcttcatggccttgaggctccggcgagaagcgtgagcgcacgctcccccatcgacggtggcgacggtggcctcaggctcctggaaccccaggtcatcgtcgccatcgtcgatgtcctcggcggtggccttctgcttggcctcacctcgccggttgccggcgggagccgccggggtcttgccctcacggcgctcctgcctcttctcctcctcccacttcctcgtccgctcagccaaacttttgaccgcgcggcagtccacgagatcgtggagggaggtgttgtgcacggtacaccacttgccggtcgggcgctccctgctgggagcgccggcctccttctttttgtcgctcgcaggcctcccctttcggggagcccgcgaagcgccctcgacggcgaggacatgaccctcgtcgtcggaacgggccgatcccttcttcctcctcctgtcccgccgccctgaccgagcggcggacccgggggcagccggagctgccacaccagaaccggaggagttccaggtccaggcctcctctttgtgagccacacggtccgcgagctcaaaaagctgcgcggtggtctgggactccttggaggcgatcttctcgagcatgcggttgtgccgcacgccccccctgaacgcgtagatcaccgcgtgtgcggggatgcacggtatggtgttgcggacttgacagaaccgctgaatgtacgagcgaagagactcatcgtcccttcgctataccacatgcaagtccgcttcttcgcctgggtgcggatatatgccctggaagttcgtggtgaactgctggcacaaatcctcccaagagtggaccgacgcgggtggcaagttcattagccaaccccgcgcctgacccttcagggccatggggaagaaattcgccatgaccctgtcgtcacccccggcggcctcgatcccggtcgtgtagatctggagaaactcggcggggttgacgcttccgtcgtattttttggtgatggtgggccggaaccttgggggccaacggacgttccgaaggctcgccacaaaggctcgacagccggcaccgccaaccggggacacggggggccggcccccgtgcccggaccgaagtggcgctccggacgaggaagcgccctccgttgcgtaggcggcgcgacgagtgtcgtgccggcgctcgatatcgaggcgggcatccggccccccacgcacatcttcttgggttggaggcgttgacgagggaatggcagacgaacggcgggtaacggccgccgctcgccgcgccctccgcctcgacgacatggagccggtggcggcagcgccagaggcctcggtggcggaggaccgcccgccggcgcctaggcgctgctgcgccgtcatgaccaagtcggccacgtcatccagccaacgtcgggctggagtctctggatcggggacgacgggcgggtgacgcaggagcgcgcccgcagcctggagcgcgccctggggcgtgccgccatcgccgtagacgaggcggcgacgcgccccgtcccgccgtcctcccccgtcgcccgcgggcggcgaagtcgcggatccttcgacctccccgagcgcctccccccgcccaagatttcggtgagagggggacggtggggtgcgagcccgacggcgcgggttctgctccccgtcgtcaccactagcgttcggagggaggctgtgcgccactgcccgttcggccattgggctgagcgggagaagcttggcgcacacgaaagaggacgagggcttcgaaagacacgcgcgccctctacctggcgcgccagatgacggagcgtggggctcctcaccgggagaccgcgcaggcccccctttgccggttcggccgggggcgctaagtgaggttcttcgccctcgatctgaggaacgtcagcgagagaggaaatgcacaagatacgggcgacgtatacaggttcgggccgctgagaagcgtaacaccctactcctgtgttctggtggatctgtgtgtgaaggaatacagagagccggagagcgagagagagttcaggctctagaacccattcgccagagtcccaacccctctgcttcctcttcctcttttctctttttctctttttctaggcctgggcctcctttttatctgttccggggtcaccacatgggcctcctgctgcctaagaaaggaaacatgctttttacaatgagggctagtctacagccggaagtgacctctgacaagcagagcacacgcctcctgccccgctcgcccgcttttccggtggacgcccatttcaaccttcatttaatggccaaagacttccttgccatacttgcgctgaagcctggaatggatctgaccgggactgacataccaactccaggagttagcacgccggctccggctagggacgagagccaggaagctctcatcattccgacgggacggggcgaggcatgtgacaggccgcctgttgccacctaacccgcaatctgaccggtctgtgaccggtcacacaccgcgaccggtcacggaccggataagcatgcgctgcgccgcattaaatgcggcgtggcgcgctcgtccaacctgctataaatgcggttaggtgagcccgctgtgctcacctaacccacacacgtggcgccaaaaccacagggggtcggggcgccccagccctcggggccgaaacgggagcggcccgacccttcggggagacagagggaggggtggccacgtcaccctcgggcccgacccccccgagggggtcaggccacgtgggtgaccgcggctacccaagcctctagtcacgatacccccagccccatgtcaccgacaggtgtttttgattattattctatgataaataattgggcattggagattattggttttgttatttagattttattcacgaagtggttttggagatgatcggatttacaggtgatcgcaggatctatcattttatgtggactggtcagaccgggctctggtagccggtcagaccggtgtgtatcgcgcggtcagaccggcgcagcccgcggtctgaccggccgacactgtgtcggtttcggtttcgggttgtttatttggatatccgagtttatttcatgattatgacttctagatggatactatacgtatgtaatactattgtttgctactaatgagtcaaattggagatagcttggtctcggaatatggtttctttgtttgttccatgtgtaggtgactcgatgtctcgggagagtatttgcggtgatggaccgggagtcggcttggggataagacgacgtctgtggtggtcagagatcatgcgggatacttaggctagagttgatgcacgtgattgatggagattccatatggcatacgatggagttattgtgtgcgtatgggatgcggagtcgaatttggaaggagtccaaatttggtacgattgattatgtaaagtttctttcttgtactagtggatttcctagggtgtttaggactcctagtatgagtttggttcgtggctttaggctgcctacctcatgtataaatagagggggagcgtgaggcttcccggtatcgctttagagagcaattgagttgagttttgagttagggtttcgagtttagtcgaaattttcgtaaggagtgctgttggtgcactttgtaaacacatagagaatcaataaagtcgtcatctactttaagagttcttcgatttgtgtttcaccgggtttcggcggtctaaccggcaactcaccggtggtcagaccggcggcattgcggcggtcagaccggcgggagcacggcggtcagaccggcggcggcgacagcgagcggcagctgatctcggcggtcagaccggagatctaatctcggtcagaccgacggcaaccaggcggtcagaccggcagcgagggtaacttttagttccgctaaaagttttcggtttttgggtataccaaccattcacccccctctggttggcttagttcttgtgattcaatcctacaattggtatcagagcctggctaggttaacatctctggcccgatggacacttgtgaaggcctgatggaccgtgggtgcctgcgggacccgtatacctgatggaccgtaggccagtgggggcccggatacggtgaaggggcggtgaagggctgaggaacaccaatgtgtgaagggggagattgttgaatagtcccacattggttatggaagtgcaaaggatctaagatataagtgggggagcccctcacttcaatggctagcttttggggtgggaaatgtcctttacgattctataagaaggactgcgctggaagggaaccactatatgtttggccgatgacaccaaggacgagccaccaaaattagagtgattccggggagccaaccagaaagtggtctagcgtctcttcgtgtttatcatagaagggcacacttcgccgaggtgagggcaaagccctgctcgctgagaaggggaccacctatacatttgtcgacaaattttctactaaaaatttgacagatgtaattatagtacaatcgtagtgtaattacaatgtaacttgtatgtaattacactgtaacttgcatgtaactacagtgtaacttgtatgtaagtttcacgtaattttgaatcgttagatctattacaagatttgttctatggaggaagaaaaaaatcacatcacacacatatatgaaagaatttgttcccacgacctctattttactgaaataacatgttaccgagagattcttgaaagttacatacaagttacattatagttacagtgtaattacatgcaagttacagtgtaattacactacgattgtactgtaattacatctgacaaatattagggggagaaatttaatgacaaatatctagcaaaatcgtgctggaaatgcgtatattaattgtctactggccatgagcaggccagctgcgcgtgctgtgagcagagtctgcaacagaaatggatccaaatggccaacggaacggcgacgacagtagtgaaggaaggaacgtgtgctgggagaaggaccgacgtggacaaacgcggatggctagcgaggaagtgacttgggggccgatattcatccccgcctagcctatcacgtcgctgccgtggcccgtcgccttcggcttcggccggcagcaggcaggctactgtagtttggccttggaaacttggaaattggccgcacccgcacgtacgccgggcgcgcggtagtggacgttctcctatgtaataatcgctctcatgcgatgcgacactagagtggcgttggtgccaaaactctcttccgagtcgttcgttccggccaagtcgtcgtatgccgatctaccgcaatgctatgctagcgaggctgcatgcgccgtggttgcaagcccgcacgccgcacgccgtggctgccggagcattactggagtgatgaccaactgagccaatggcaaattgacgtggtgcatgcaccgacaacgacggacattagcaatgacgcaacgcgagcatcgcgatttttcaatttgttaatcttctcagcatcaaatccggcagtgacataaataagctgctctggccctctagatgatgcatgaacgctgtcgcaaagaaacgagcttaatttcagttgactccatcgatatttttttttctgggcgtgcgtacgtggttgggtgcacgtatcatgcatacggacggcatgtgtcggaggctcggagcatgtactgacgtacggacgggcgctgtagtttatgggcctagcgcatgatgggctattatgggcctgatcgaaaagcccagtttaggacaaaacgaggttaactgcaaagctcacacgaatttaatccaaaattaatcatgttaaaataaatctaactaaaaataatgagaaagtccgagaagtattattgacaatctcacaaattccaaaaaataccatcgataagtacgagttccatgaaataccattatgccagaaatgttattgctgttggggttccgttagcagcacttcgttaagtgttgtaagataactttaacgacgttggatgaatggaatcctatcaataataatatttctgggaaccggcaaatcacaccaatcaagatgtaacgcccaaaagagaggcaagcggtaacacacggttgagacaaatagacaaatggtccacagaggctctaccgctctagaggtgtgattttaattttgaggcagcacaaatggaagaaaccgtttagtgaaaatttacactatcataaaatatatcctaacagcagcatgtcacattctccaccttccctaaatccttgagagcaaactttcggttacagaatgctttttccttttccaccaagccacaaaattaaaatcacaccttcccaatcatacctcttcctcccgtactaacccaccaacaccacaaaggcagaaacagtcccccaataatcgaccaacaaaaccgagtccaaaagaaatcaaatccagaatcatttattcattcaccttttgtgcaccagcagttcatgaatccccctgactcggtatatgtgacactgtgattgtaccaagggaaaaaaagaccgagcacgacacgacacgacggggtcccggtccaaaccaaaccaagccaaactatataaagggtctgttcagatcccaccttaaaattttacaccctatcacatattaaagacctactctcctcgttcttaaaaaaaaaaaagtgaatctaggactgaatgtgatatattatagtacaacgaatctggacagatgtatgtctagattcgttctgtccagatttattatactaggatgtatcacatcaagcactagattggttttttatgggacggatggagtatatgaaatattaaatatagaaaaaaaataacttatgactaatttgcaagacggatcttttaagtataattgcaaatgatttaacaatgtgtttgctacagtaaccattttctaataacggattaattaggcttaataaattcatttcacagcttactgacggattatataattaacttttttattagtaccaaacatcttatacgacactctctatagtaatattcgatgtgacacgtgagtacgtgacgcctgatctaaacaccccaaagaaaaagaggcgaaacgaagggaaaaaggagccccatccccaccaaacgcaacaaccaccacatcccgtcaaccgatgcaaccaaccgcttcgcgtctcctccccgtcattctcctgctgcgcctgcctctgccgccgactccccgctccgctccggcctccctcccgtcccgaccgcgaccagccaccgcccccgtccctcccgcgcgcgcggttgcttcagatctcctcttcccccctccctcacccgccgccaacccctcccgccattacgtagcagtatataaagtcctatccccatcaccctcccatttcgctgcttctccctccctacccgcgccatggcctgctgattgctgctgctgctgctgctgttgactcgtctcccgtggatctggatcttgatccccgcgagaggaatggaggtcttcggccccgtcacgcccggccaagtaagcgcgtgcatcccatcccccgccgcgagaattttgattttcgctttgctgtttcttctaccccgtttcggtttcctccgagcgaattccggcgagggtgcgtgcagtgttcgttcggtgcactacagtagtatattcctgtggcggcaagccggcggcaacggagtgcggcatgtgtatcacgagcaatttggtgaaggttcttatggaatttttcttttttaaggtttctccttcctggattcgtgagagaattgcgtgcctaatacggcgcgcttgtcacatgagcgctcacctaaccgctgtcctggccttccgtcccctcggaggtgtcttagcttccaagctagtactaatttagttttaacttcgcatgtttagccaaattgaatcagatttttgatgcccaataaaaaagttatgacttagtgaatgttgtgaaggggaatagaattcttgtgtctgtatgagtgatctgtaagtcgccgtggttgccatttctacttccattcttatatgacacttcgactgacgtttacaatctgaatttttaggcttagtgatgatacttaaattaaacaaacatcgctgcaagttaagctcactgtctggctctaccatggatgaacataactccatgttttcatttcttgcaggtttcgtttttgctgggtcttttccctgtcctcattggatggatctacgccgaaatcttagaatacaggaaatctttgttgtatgggaaagtgtaagatttctttctgaatactataattttatttagctttaggaacttagagttggttgttgatatgcatatattcgaagtcaactgcccaccattgctcctaataattgaatcatgtaaccagagttttcgtgatgaaactggcatgacatatcttacttcatgcaaatgttgaaaaatccatggtctaatctcctcctatccgggcattcttttcatctgcagtcactcggatgctaatttggagaatgagactatgaaggaagatgataaggctgtattacttgaaggagggcagtcaaaatcgccatctacaaagctccgaaacatgtctacaaaagcaaatttaatacggtactgtttgaatgcataatgcacagtttttaggattttagcaaattctattgcagttaagtgatgtctcgatgtggctgtgagttgcaggtttataacaatggacgagtcttttctgcttgaaaaccgtgctgtgctaagagcaatgtaagactattcagagctaattttttccactctagaatttcgtgctaagacgcacaccctttaactttcttgcagggccgaagtgggcattattctggtctacttttacatttgtgaccggacaaatatatttccagaaactaagaaggtaaccatattgctccttttcttactcttgacactctcaatgatgtactatatggagtagatgtaaactgcaacatgtagcttttggctaaattgtaactgtagcttgttccacatccctggggatagttcttactgttttttataatctaccatatcttgtttcttaattgttcttcctgcaattaattcttgcaagttatagggacttttctgccttagtttcagtgtaggcttatctctaaaacaagatagagaccgtgagttagggctaagtaggtgacatatctgttccttatctagttatctgactggcttaagctttctgccatctcatacagacagaactcatagccaatggatgtgagcatgtggcttgtagaaaggggataggttataagtcggggatcggggtcttgttggccaacttttctcgttgatctaataagctagaatttagggatttacctcaattaggccaaaaaagcattatatgatgttcatttctgcagtatatagtaatctttgtgttgttttgacagagctacaaccgcgacctgtttctgtttctgtacattcttcttatcatagcatcggcacttacttcacttaagaagcacaatgaaaaatcagctttcactggaaagtcaatactctatcttaatcgtcaccaaactgaggaatggaaagggtggatgcaggttagtgactttacttcactgcttctgttcttttagtaaatgtgatttcagttatttctgtactgagtttttatagcgcatggttatcatccttcctgttttgtacacgcaagcaatgtactttgatgtttgttcaccaggcattgagttagaaaaaaaaactctgggtattcttatccaaatcgtgctctcagttttatgtcatgcactgtttttatttggacaagccctatgttacagccatttcatgcctcagaaatttccaactactgtcgtagcacttttatattctttctcgctgttgtattatgcaatccttttagtacttgtatgttggctttaagtgtgctataattattttatctgcctttccaggtcttgtttctgatgtaccactatttcgctgccacagaaatatacaatgcaattcgggtgttcattgctgcctatgtctggatgactggattcgggaatttctcatattattatatcaagaaagattttagcattgcaagatttgcacaggtttccatcctagcccaattatccaatgttgtttcttaccccttgatttgttgtaaccatcttagaaatactaaagaccatcttttaaatgcagatgatgtggaggctaaatttctttgtggccttctgttgcattgtccttgacaatgattacatgctgtattatatatgtccaatgcacacactttttactctgatggtatacggatcacttggtctgttcaacaagtacaatgagaaaccatctgtcatggctattaagattgcttgctgcttcttgactgtcattttgatatgggaaattcctggggtatttgaatttttatgggccccctttacatttcttctaggtgagttatgcatgttttctgtcttagcattattctcattaaccatggataggattttacaccattttcctttcatgtacaggatataaggatccagagccttccaaggcaaacttacccctgctacatgagtggcatttccgatctggccttgatcgatacatatggattattggaatgatctatgcttacttccaccctaatgtaagtaattcggttatggatccacatttcctccctttggaactgcatgagtgagcagtacatataccgtgttcctttcatacatttcttcctagggagttctctcttattttaagaatatgttccttgtttatactatatattaatgtagcatggaatccgctatctgaaataggttgaacgttggatggagaagttggaggaatctgagactaaggttagactgtttatcaagggagccattgtcactctttctttgacggtaagttgcatccatcttttaccaatgcacagactttctatattgtcaagatgacatacttgtttgctttaccaactagatttgcttttgttttaaaccatgatgctgtattgatttcaaatgctgtactaactaggacttctgttcctcattttaggctggttacctatggtatgaatatatctacaggctagacaaaattacatacaacaagtaccatccctacacgtcatggattcctatcacgtacgtataaaaaacactaccatgattatatggcatgtggtaaattgtttctttaattgaatagacactttcagcaaaaagaaaacattgaattgacacaacaccgttgttttacagtgtttatatctgcctacgcaactgcacccagcagttgaggagtgcctccttggctcttttcgcgtaagcacctaatataatgatgtttctttttctttattggctttattttttactaagattttaacctgttttttcaatagctggcttggcaagatcacactagagacatacatttcccagattcacatttggctcaggtatggtatcaatttttttcagcatgtgttactgttgttttaattacttaatgcatgaccgttcaaaaaaaaaatttacgcatgaccagtccagtaatcagctctgcatctgatgtcaaatgtatgaacagaactacgaatgaaaataaacaagcaatttgacgggttgtgtattcagctgcgttgacttaacctacttggtgtaacacctacagctatcataagaactatgatagatttagatttattgatgctaacattgaaaatatattttctactttcaaagagaattcggaattcaaattcaagaaaaacacaagaaatgaagatttctggattagaatacatgtcaaaatttctttctaatatgaaatacgtctaggatttgttggcattgtccactctattgtgtccagtgtttttaattttaagaactggaaccacggtgctgattcttattttacaggtctagcacgccaaatgggcagccaaaatggctcctatcttttgtaccagattatccattgcttaacttcatgcttactacagcaatctatcttcttgtaagtgaacctgcccagggtgcattttcattcaaaaattataatcatcgaagttattaattccatgatgtatactgcagctatcataccgggtgtttgagatcacaggtgtactgaagggagcttttattcccagtagagacaacaatcggctatatcaaaattttattgcagggattgccatatctgcatgcctgtatttctgctcacttattcttgtgaaaattactattgtataggtaaacagctggaacctactatagatacttacggctttcacatagtctgtctctatatatcccagtttcctcagtattggttccacgtgattacaggtagaattgccaagtaaatgaccttgatagaaggtcgttcctgaaaattgtgtgcttggtatctggtggtaagatattcagctcaggcctcaattccattttgcatttggaggtaaagatacagttcccatgaaggacctgccgatcttctagttgggaattgaattgccagaggatgtaggtatagaagtcaaattttgatttatcatttcccccatttaaaacactgtacacagttagcgaagttgtgcattctttgggagttgtagatgctttcctaagttgatacaacagtgtaagaatttcctcccctcaaagcactgtaacatgtggtgtactatacagaatgatactacaaggaagggtttcccttttgtaaaacgaaatataaagggcaagccccaatctttctttctttctttctccttctccatatgcatgcagcatggtacttttggtttatccattggaccaccctcgtactcgttcaccggagcttcagctacttgaggcgctaattgattgatgacctgtgcttttggacctgatcctgcgctttttggaccagctaaaacgatcatgctgggaagtgggagctgcttgggagtacagatccagctctgcaagtctctgaaatttttggagctttctttcagttgacaaggaaataaccgttaaccgacaggagccgtacgtggagactcgctggatgcatgtgcagaactctcgtggattattggcagaatgccatcatccgccaaggccaaaaggccaccgtgcacaggcagccgcacagtctcagccgctagttttgagggaccgatcgagacgagagaccaccaccgcgccgtgcgccgccgcgccgcgccgcgcgacgccgtggcgtggcgtggcggggactacaggcttggcgcaccagaaggcagggccgcaagcgcaaagggtggtggtgtgcatggcgttggcgcccacgccgcccaccggttgttgcccaacttccaggtaggaggtgcgcggcggcgcggtttttctccagcacaggctggctgcgcgccaaacaattaggatatgggtattagctgctgcaatctgacactgaggtaaacgtttgtttgtgcataaacaaaacttgtgtggtctatcaatattaggcacatacaaataacatttcaatatgatttaataagataaaaaaatatgttattgatttcgattctttgaacatgtgttagaggacgtatccatgggagtatgatgtggcatatatagtggtgtatgcgtaaatcgtttattctaaaaaaacaatttgtgtatccatcaaactggttaaaatactctccaataaaaattggataaaattttagatacttgtgacacgttttttaagatgctaaacggtgtatttcactctaaaatattaaattaatatgtttttcaagtttataataattaaaactcaattaatcatatgttaataccatcttgttttgtgtaaaatacttaatcttcgtcatttttaggagaaaagagcatcacctagtctagtctaacatatttgagccaatgtgtttgcgaggaaaatatcatggaagatgtgagttttttagaggtggaagccgaggattacaaggtagtcactggtcagattagcggcttgagttgtgtgatactgtgatgaaatggccggtgatttctgtggtggtagtagtggcttgtgggtccaaatcaataaatcatcatcatgggacaaaataaactagagatcgccagaaaacaggagaaaaatgaccatactccccctgcgctgcgcagccccgcgcgaacatctgcaagctgacgaaatgaagcatcaaacacctaacccaaaaactaatcgcttccgacgttaagcttctccattaaataacgcgcgaaaaatctcaaatctccctcacttacaatcaccaagcttgcttgcctcgctggccttccttgtctccttccacccaccaatggaggctcctctccacctccccctcgccaccgcctcctcctcctcctccggcgccaccgccgacgagtcttcctcctcgccttccaccgccagcatcgtcgcccgcgtcgtggccgtcctcgccgtcgcttctgtctcactgttcgcgcggcacgaggcctctaaaggcttccacgtcgacatcgtcaacgccgcgccgcgcgacaccgtcgccggccggcggttcgacctcttcttcgtgtccaatggcaaggcggagcgcatcctccactacgccaaccgcggcgtggaggcggcgctgttcccggacgcgtcgttcccgcgcaagcaggtcacacgtgtcaccgtcaggatggccgggcacaacctcaccgacgacgacgacgcgacggtgatcgccgccggtgtggctcccggggagtacgtcatttctctgagccccaggctcatgcaccccgccagcgacaaggccgccgacgccgtggcgaacgcggtgcgccgcgccgtggcgcgcatgtggctgtgggacggccgcggcgccgctccggcgcgcgtcacggaggccatggtggactacctctcctccggcgccgacgccgtcgaggcctcgccggctaacgacgacgacgacgacgacgccccgcactgcatgtcggcgcggttcctggggcacctggagcgccgccgcggcgggttcgtcgcgcggctgaaccgggcaatgagggaccggtggagcgacgccgccatggacgccgcgctcggcgtgcccgcccggccggtctgcgccgcgtaccgcgcggcggcggcggcggcggcgctgactcagcagcaaccaccggccgcgctggctggctccacgtcagccggcgacgggtccagggtggcaatgtgaggcagcaagcaaggcaagggcagtttgggtatcacgcatccacgcgcgtcgcttcccatgtaattaatccactattagcgacgataattaagtatggggtgggtcattacctcgcctctaatcgtggttgaaggcgaattaccggtcgctgtccaagctattttgtatgtcattactgtgggttaatcagattaaattaaccctgtcctttgtgcatccgaattaaattatagtgtatgaatgtatgatgttaattactagcagattttttctgtttaggtgggagcatggtgatcggtaatgatacgagaagcttcgagaggttaataatctaagacccccctagccaaaaaaatatatataaatgaaaaaaatctgagaccaacccaacacgagggcccacctgttggtgacctagttatcgtttcattcaacatcgctttcgtccattcgcagtttcatggacgaacaggtgaagaagatatcttgagatgacatgaaaacaatcagatcaaagctgaggctgcagtgttttttggctgtcttgttcattgtggtagcccatggccatgacccatctggacagatggacggcatggaatgggagtggctactgttgcatctgcttgtccagcagcagcagcagaagattttgtttaggggtgacaggcttgcctaaagcggtgaaacgtgcacatacttttgtgagaaagagaatgttgcgtattcaaattttcagcatgtgagtttgtttgtagtttgcactcaaaaaccagtaacatgggttgctcttttttctgcaacttgcctttgaattgttccatctcgtgcagcacgcagctgacattccaataatactcctcaatatatataacaaaacaaagacaccgcagattctgaagaagaaaaggtcaaatcttggcaaaaaatgatatagatgagcaaagtgtttgtcaagtcatgaactcatgtgaggagtgtatttccagaccaaaactcagtgatggagatttctgaagctaacgatgtgaaatctctaatatgttgatgtgcaatactttcacgcgttcgtgaaaaaaaaggtgaaatatgtggaaattaccacgggtcactcactaatgcactttgtcttcctctagctgccacagaaaactgacggctgccattgtcttccagagacgaatcctgactacttctcaccacaagtccacaagtagtaaaagcaatggatctcaccacaagtacgggtccaatttattttcatcaatcagtgaggcagttacctgtctggctggaagattgttgggcccttgtacatcttggatcacaaaacccatacttaactgtctgcagcttcatcatagctacaatgtctgtcaacaattgcttggtttccttatttatattctggtgttgattttgattcggtcgtcgtcgggtctttcatctttgcttgtggacatggcttttgtgtccttaatatatatttatttttgacgtggtttttgtgtccatgattcagtaatggaagctacagaagtagtacagagaattaagatattggaattattgtgttaggacgatgggattaacgaaatgaattattgagttggaagctacagagaattattccattgcataaaaaaactaggaagaatttaagatattggcattattgcaaactgacagaagtctcgctggaaattcttgaatttagaagtactagccaggtagacctgatagcagtcgagctcatttcggcgctttctttgaaattcttttctgaacgaaccgttcttcagaattcagaaccagatggccgatagaactggccgcttacctttccagaatttcaattcccagatcgatttttcacgaacgtgcaaaaaatatatatagtcaatatatattagaagaaagcagagttttgattacacaacgcaaacggttagaaggccattgccggggcgggaattcccggatcgatttgtgaatgacccttggaagaattcaaattcaaattggatggaagggacataagtgaccgaatctctaatctcttcttcctgctcatctcacgtatgtagattgaagagttttgggccttgggacatacagcctttctcaattcttatccgagaagttcgttgtggattcagcccaaagcctcaaatgtgtcgtcgtcgtcgttgtcatatatttctttctcattttcaaatatctcaagctgtcatgcaaaaagtggcatccacggtttagcagcgggccatcaccattaccctcaagcaatcatcgtctccatccattgtttggcatggctttttttttgaaacctaattgtttggcatggtttcatgttagttaaaaacaaaaatgagatttggagggagaaacacgggacctcataattgaaaccaaacattctttaccactgtaactatcagatacagagactctagggttcatctgcaaatataccggaccgctcggaataatagcggaccggaagagggtcttatgtgcaaaatatgggccggtagcaatgaaaaggatctaagcagggactcccatatcactgttcaaacagtgttctctgcatttactgcagaggacctgcatccgatgtttgttgtttgcaagtaaaatttcaggatcttagatggatcgtgccgtccattgtgccttgtccgctttctgcaaccatgcggcggagctccggcgatccacagtgcattggtcgtcgaatcaccgggccgttgccagcggtcatccgccgcgttcttggcttattgccgggcactgtcgagaccggcgggttcggaaatcggaatgccacattctccggtgatctcttcgcagcctcctctgtcctgtgcctaatgtactatctccttggacggcatagctgagtgccaagtgccaaagcagggccatttttctccggcaaaggtcagagctagctccatcagtttcaggcacaaatcgggtgggttcagatggttcatgaattatgacatcgtgtcttcgtcttgtcttgctcatatcctgttccttctccatatctagcgtaaagtattcttttgtcttattcaagatttttgtcaaatatgcaataatataagtcatgattaagtatctttaatgataaaacaagtcacaatacttccatatttttattagtaagactaatgatcagacctcatatctaaaagtaaatggcatcatatatttaaaaattgaggtagtatatagctgtggctatgtggcatatccaagagagtactgaattccatattggaatatcttaagcaagccacatcaaatgtgtaaagaatctgccttgttagtgctttcagatttattattattattattctgcacagcagataatttgaaatacaatgtttcatgattgatagaccggttcaagagaaacaataaatccagtatttgtccaaccacatggcagagccttgtgatgacataagagcagttagaggcctagtgaacaaaattgaatgcacatgactttttttttaatcatctggtaatcaactggcgaggatgaattctagatcaaagcaattgatagtagaataattaggaggcggctgcggtgtcttgttagcatgtagattgatctttcaaacttttcctttttactgaagttcaatttttttttgtaacaggatgaagataacattatatgaggtgctactgattagtttgtatgtttgttggacccatgattgctatcgctaattgaccatgattgccactgggtactggcaaagtccactataacaagaggaatcatgagggttcagttccatttccattggttctacatcttccaatcttacttgtttagttgtaaatgaatgtctaaaaattgccaagcaaaatgagtcacatctaaggaccttcattattctaatgttcagaagtttcagcaccaaactttgcacctgaaagtccatgagaacaatgaccagtgcccagtgggttaagtagctaatcagatggcactatacattccttgcctttagaccagcttgctagtgtgattctgcatagagccgaggcagaggcactattggtactaggtttgttcagtgctatactaatttggctgggagttcagaaatgcaagcacgttcatcgacggcgcctagagcgcaacaccaattcgaggggacaaaaagcaaatctacgagctttttctacgatctgtgcagctgctcgaggagcccaaaaggagatgcaaagtttggaagctggacgcgattcagaccgagcttgctccaggtgacccaacttttccatttccatgcattctttgatcatcaagtgatcatcttgcactgtaaaaaaatataaaaaggagaggcaggcagcatcggctaaaaagtgcatgttctgctattcaaaacatcgaaaccggtgaacctgtcaaagaattcctgtattcaatttgaaagggaaatattttacattcgtataccataccatgactgaattttgaaggggttctgactgaatatctgaatacttttgtgttctggcagtataagtactgcgtaaacctgatactagaatacataattagcgtgcgaatctgaaaatattcgctctaatcccggtgcgcccggctgcgtgccaaatggaaaatccatggatcatcatagcaaagccatcatgaaagcaccccacagagaacaaatttctcttctttcacctcccaactcacccaacctttcttttttactttcctgccacttttgcttaatctattgcatgctgctcacaattatctcgaaattgcgtgatcctgcaaagctcttagcctcccggcccaagtttcctcttattcccctgacccctccactcggggaagaaaagaaaaaacctcgagattattctctcaagacatgcttatgctgatgcttatcagcatcaggagatgcacttgctacaagagtgaggcagcagctagctcgctttaacgctttcctgaatcagcacactcctacttgcagctagagctgagcaagccaaagctttttatcactcttggtggtgttcttagtagagcttttcgcaaagattgtgccatggatctttggcgagttcattgcttgggttggctccttgttctactcctcttcagccatggtgagtttagttactgaccaagtttgcgtctttgtgtagctttctgtcttgttgttttaggatttgaggtgatggtgttactactgctgattctgcttggaagaaattttttgctaggttagaatgaataaattgtttgtttgtttaattccgtttagttaaatcagttactagttgaagctgacgaacagagtgtcatgtcacagcaacagacaaacacatgcttttatcacagattagtaaacacaagtgtcaagtgtgcttttgcttaatttaacaaaaataaatatggaaatatgaagtgaaaactactcacaatgagctatgctttggttgaagaagctgcagggggaggaggagcagagcaggtagcaacacaagcgcatcacgacgcgtcgcggcggctctccgcgcaggtggcgcacggcacgccggagcgggacgtgacctcgccgctcgccactgtcccggtggataacccggcggcgaaccccaccgtgacgtcgacgacgaacccggcggcaatgccggggacgcagacgacgccgtcgctggcgaacccggtggccgcgggcggcggcggcggcggcggaggcgggagctggtgcgtggcgagcccgagcgcgagcacggcggcgctgcaggtggcgctggactacgcgtgcgggcagggcggcgtggactgctccgccatccagtccggcggcggctgcttcaaccccaacaccgttcgcgaccacgcgtcgttcgccttcaacagctactaccagaagaaccccgtccagaccagctgcgacttcgccggcaccgccatcctcaccagcaccgatcccagtaagcaaccaaatttcccttctctagcagagcaagagcatgatcagtgacaactcgtacaagttgaatttgaacatgcatgttggtggagtgatatattatatattgatctatcttgtcgatttttttaaaaaaatttcgtagccatttagttgatatgcaataaacggatggatgcctactcgagctattagaatccatctcctgactgacagatccattcacctctcgttgcaattctgcaggctcctcatcgtgcaagtacccatcgacgaggtaaaatcctagcaactcaaagtctgaaacaaataaacaagaaagaagcagcatgtgaatttcgctgaaaattctttttgcttctcttgttttctttgtgcgatcgaatcggcagcaccggtgcttcggttctgaacacgtcgacgccgacgaacccagctttcggtggctacgacaactctcctcctggattcggcaacaactcccctccgctgtacgggtccatgtcgcctccgggttacaacgacaacatcggcgccgccgcggccatggccggcagcaaggaaacactcctgtcgctggcgtgcgtcgtcgcaacggtttctctgaacctgtacaagtgagaatccaagctgctgtttcacgattcaaatctgtagaaactgcacggctttggtggatgttttggtactcgcacagttgccctgatgcaagcagaaagcagagaaatgaatgtgcagaatatgttttggtcagatgagctaggagaagcaggccggcaagattgatagatagatcgacttctcctagctgtagaaatagtagcatgtggtgctgtatgtagttactagtagtaatcagtaagaacattgagctgaacttttgcgttcacctacatatagaaacaattcctctactcagacgaacacagacacaggaaggaaactactccctccgtccctaaatataagggattttggttagatgtgacgtataatgatacaattaatctggacataaaacatgtccagattcgttgtactaagatatatcacatccaaccaaaaacacttatatttaaaaacagggggagtatttcagtgcaaagagatgattctggaagagcaaccaaccgagatgctggtgtgagtggcgccgccgaggccgaggccgccacagcgccactggtcgccactgccggtcatgggaacgcgacggcgaccacgccgtgcaggttaccacttaccggcgaagaattcctgcagaacgatggcatccaccgcctctgcctcccccattttcctcgtctgcatgcgccggcgccgaccagatctcaccggctacgaggccggagagaccgtcggagattaaatctcggaccccttggttgctcgtgaccgttcgatcagatatgggcggcggggagcgaggagtggccgagtcgttcaaattcttgttttactttaaaagtgggttcaaattcttgttccacgacaaccgttaagattgaacatgagggccagagtcgttcggagtccaaaaatccgaaccacctgggttgcttgtaatcgttagatttaacatatgcggttcagattaaacccttaaaccttaaacattaggggtggttcaaaacaattacagtcacaatggagcagcgctggtagccacatcacgatttcacgacccgtcgcggcagctcgccggcgtggagtcggtgaacgacatgctggaacgagacgtgacctcgccgctcgcctccgtcctggtggataacccggccacgaaccccactatacgtcgatgaacccgtcgctggcgaacccggtggccgcgggagctggtgcatggcgagcacggcggcgctgctctgccatccagtccggcgagaccgtccagacaagctgcgacttcgtcgtcaccggcagcagcagaacactgcaccggatccaaatcccaagctctggcatcagtggcggagccaccatgattcccgggtattcccgggaatacccaacattttttatcaaaaaataagtatacttctagtatatatacatgtacacatatttgtacacctaaatcctcaactcttttatccaaacacagcctaattggtctcttgcgatgcctccaaccaacccgacccactccgtcatgacccatcagacatcagttgacccacttagccaccactcttccagacagccccctctcgctctccctccatgacccatcccaccctggctcggctccctcgcgccactccccatttgcaaaccctaggtggcggcgcagcgagacggcaatcggcggcgggagctggaccgtgctaccgtgcagggggaggccattgccacggcgggcggcgcccgacactccgccaagctaaggcggtcaggtcggttgggtggccggcggccgcgaggggcaggggcgggcaacagcttaacgcttagacgggaatacccaactttaaaatcctggctccgccactgtctggcatgcctcctcgtggcaacggtgtctttgaggatccaagcttctgtttcaagatcaaatcagtacaagcttggtgtagtagtattttggtacttgtactgatgcaacaaccagaaagcagagacggctctgcaaaattaatgcgcataatatgttttgggctgtgtttagttcagtgcaaagtttggattttggttgaaattggagatgatgtgactgaaaagttatgtgtgtatgacaggttgatgtgatgaaaaaggactgaagtttggatccaaactttggatctaaacacagccttggtcagaagagctaggagaagcaggctgacaccaatcccatgaccatgggcactgggtatagggcctgcttggggagcttctggcagctagagagatttttcttaaaactaccactgtcaaaagccctccaaacaatccagatatttactcaaattttaagaagctgcaattgtaaaatttagaaaataaactagaaaccagaagccgtgttcccctgcttctctaaattctcaccagttacttttcataattttaagcttcccaaacagcgccataagcattttgccaaaaaaaaaaagaaaaaaaaagcaaaggaggctggtggagttcggagtatgagaatgtgttgtttctgaccgattggacatatgccatgcaggttaaacacttattaacggatgttaaacatttcattatggttaaagcaattacaggcaaaggatattattgcattcattctacttcccttatcgaatcaccaccaattagttacagcttatgacacgccattgccgataataaacgaaacaaggggaaaaaagaagcaaaagcacgcaacacaggtgatacaaagctagctcatcctttgcttccttgaaattcattcatggtgctgctttgttagatatctcagttttattgtttacatgatatgtaaacggaagaacaaaacaaactgagaaagaacggtcctttctatcagaatataaataaatagagctacagttttaggccatcctagaaaatgctaagggtagtagaacatgatgatcaaacatacatctcctctgcctctccaaaatgtcgacatagcaactcatatacacagttgctattcaggcgcctgaatcaggccaaaagcattgcatggcatctctgacgtagcacgcaccacaacaggaccacacactcaaaagggtttcaaaggctgggtcagtaactatttggccacatttggttagcctgagcggcagcggcagcagagcttaagttgccgtcactagggttccggtgctcatggcccaggccgggctgtgtcggtgcaagtggagcaccaaactgtgaaggcagctgcccctgccgaaggccgccctggtgaccctgctgcccttgataatacaaggcatttgctgcaagaggtggcattgttcgcgaactggcaccatgcatccacatcgcagcgttctcgctctgcaagaaatttacggaagttagattgctattgaattcatgcttgtacaaatttaagtgccatggtagttacctgctgaagagatacaaattgattcccttctttgtattgcgcgggcactgttccatcaaacccaggagcagcggttgctgatggtgtgctttggttcagggcaaaatttcctggcatgctgcttgcagctccaaagcccccaacatagcttgagagcagtgaggcttgctggggtaagctcgcaagggaaacattgcctttgtactgtggcaaaggatattttacactggaattgggaactgcagctgctgcttggtggaataggccactgttcatgtatggttgctgaaaggcaggaggcgggagatatgtataacttggggctagagatgggtagccaatcatgcttgcatacccaagaggaagagttgcttgagcataagggtgaagcgtgagatgctgagggagtggaggaccagaagcaatgctggtgctggtgcttggctgagattgattcaattgagggttggatgaagcacctggattcacaatctgcaagagccgacaccacaagaacaatgatacacaggtaaacaatccaaaagaaaattaaggcagaaaatatattcacaaatcacaagataaacctcaataaaatgaggataaaaaagtacagcttgatgaggtatgcgtttactattgcgagaaaatgatgagccaaaggttgaagcgtgacttttgtagtaagtatgtacagttttgacagcaaagcaggcttaaaaaaaaaacataacaaaacaaatgctatgcaaatggaacttcgccaaatgatgtgaccaaacttaaccaaatttcgattagttactgcctggtctctggcttattaatagtgccttcacgacaaagttaacaaaagaaacagttgcatagcatgaagctatacaggttagttgcatcatgaagccatcaagcgaaatcatcagcaaaaccatgcaacgaggagaaatacccggtcttgattaaactcatcaaaccacaggtttaagttcatcaataaccataaatgccgtttatcagaacaaatatgtatgctactatgtctattcaagagtaaagctagtttatgaattgattctatgacccaaaagatagcatggaagtatgaagtagataaaaagtccaattattcaatgagctgttccacacctcttgtggttgtgtagaaacagtagttgcattgcccatggacgatgatgttgtgccatgaaccatcgtagccaatggtgggttagtaagtaataatgagaaagcaggatcaaagtcacgcaaaggtggaagtgctggtggcaatagtccattcgggatatttccttgctgcaaagataagtaaaataagcttctcagtgaagaaaagataggtgttaatggttataatatatcatcaacagtgaaacagaaatgcgcccacagatttcttcatcagtgaagtaatgtatctctatctagatggagttaattccattattttagagaacatgcactgggggatgcactgacagatatgcttgcagaaactaaattaaatggggcttatacaaaataaaaacacaattccgaattttttatgtagataattccatatggaaactactaataaggtatcaatgtaaaattatttaataaaacaaaaagaagccaataccataaagctagagagaggggaaatgttttgcaattgtcgatgttcttgcagataaatgtgtgcggaagaatctggttgcactgcacttggagttgcataatcggaggttgataaattattgtacatggtgttgtttggaacatctattaaatcggctgttctcaattcaggctgttgtacaggtgcaacatcaacattctccgtgtcactttttgttgaagaggcaacatgttcgtcagctgcaggtgctactgtatccttattttcgtactcatggattctgaaaaatggaaatagatgttacatgatgtttgaaaagaagtgaagaatgcgacagacaaatacatacctgacatctgactgatcaatcgaatggttatcagaaactgctgcaacctcctcatcaccattggcagttttcaaggagactggcgcatcaagtgttccagacacaaaactaccaaatgtcaagtgtgcacaatcagcatttgaaacctgaagatgatcaggaattattacagccgggttatcttcagatgattttgattttttttcctcatgtagaatcaactgttcaaactgtttgtcagtagcagacatatttccctctgaatctgcaactaaggaaatagattatcataaacaattagaaaggaggctcgtaacttccaacagaaaagccaattagaaaatatatagtgtaaaaatgtaatataaaaaggcacatgcagaaccttcacaggccgtggtgctgcactaagatataataaaaaggtcctggtaagaacgtaaaatatgaaaagttgtagtttcagtagagattggataaaaaggtaataatagtgaatagctggagccatacgaacaaataaaatatatcaaactttctactggtccattctcgggtaaatgagcaacaaccttaaaaggtactccctccgtcccaaaatataacaacttttagcccttaggatttgtcccaaaatataacaacttctctaccaacattctcttcccaaccaatcacaaccctccaccattcacttttctcacctacctccactattcatccaattacaaccctccaccactcacttctacctactttcttaataatcgtgtccaaccctaaaacttgttatattctggaacggagggagaatttgattcaaaataaataatttgtattgaactcattactcatcatgaggatttgatttatagtctcatgctaaagtcaagatgttgatggagacagtggttccagtcctaagtagtactagtagttatataagcaaacgcaaaaatttaagacagtattgtatcggatttagacttgcagtagctagtagaaagaaacgggcttagtgctggatatgggaacttgcttaagatccatgtcagacagtaacaccaacacataagccaaatgacaaataggcagagatcaagccgccagcaaaaataaaatcagattgcttccgattcaatgtaataacaatggcttgatgggtattctggttactatagacaaaactataccatgccgaaacacgaaatctatgttctagatttctagaatatatattcgcatttggtgtaggcatacatatgaagtcataaaaaaggtgggggcaattttagatgacctaccacggttattctcaaatgcattgccatcagactgagagtcctctgtttccactatcaagtcattgtgatgggtggcaatttgagtatgttctgagtgtacttctttgctagatgcaggatatggtcctgaagatgttcgatcgtctgcattgcttgcactcatatccttatttttatcagaatccatgtcttcttcaacttcatctttgtaaacatctgcagttgacgatccaggtttaactgtggcgacagattctggcacctccaacccctctctgggaggtaatacatcaatagaggagtcattagatgcaggggagacctcattggtaccatttggtattctatcagttgcaacagagttcacttgtgaaggcaaaactaggtcttgtgaatcttttgaagtatgatttgttgcattggaaatgactgaaccaccaatggttggcatcccggtattacatgcaacagatctcacaggtttagcttggggtttgcccatcttgacaatatcagccatggaagggcgccctggcatcccaccccaaccatgcttcacttgagaagggggctggagaggagtggactttgcatcagcttggccacttgataaaataagactgtcattgatagtagcatggctgaaaaatgagtataaaaggttaggaggtctacaaaaatgaaaagtgcatgataaagagagaagaaaatttctggaacactacacatgatgtctcccagacaacaaactactctgccaagacattagtagttgtataattttaggtcataaactcattaacatatatggagaaatcctgactccattatgtacaaactagatattccgataaatccaccttctagaaagtattacaaaacagacaccgttaagacactgcagttggtaagtctcatgtttacctacgggagctgaataaatcatccaaactattacacatagataaacaaaaatagaattgtagactgttggatggtcatgcatcatactactgggaagacagctaacaaagatctaattaaaatataatgttacatcagacaaaacatgcactgtaatttctgtagtgcttccattagcaaaaggaagagtgaacaaaatgtcgagcatcaatcaacaataccgaaggataacatatacaaaaatagaaaccaggcacat

SEQ ID NO: 59621 - DNA, 2705 bp, Oryza sativa
ctttaccactgccagttgaatctcctaaaatgttaacaggtaacagaatgtgcccccattatatttttttttttaaaaaaaaacaaatttcattatcatgtcataatgcataatgttgcacactacctccagtcttagatcctcgaaatgcaggtttataaaatggccgaggcctggtttcctgaggtgctttgatctacatgtaataataagagtttgttaggagaacaaaaaatggcatagaaatgtcacttggacaaacttcagagatcaataatattcagtaatttttgcaagctctcaaagactcacacataacactactaccttggtgcacttctcatatacaccattgtggggcatatgccatccaggccaactattaggcaagtgaaaaaaaaaaggtggctttgactctgggtgatgtgttgatgggacagcgattaaagggggccatctctaaggctagagaatgcttaaaacttaaaaggactaaaatttgaattctatgatgctcaaaaactccaattgcatacttccaacaaatttcaatttcagttcaactacattatcaaacatcaagctaatttcaactttgaatgtctgaatttggagttcaaataaatgaaatttagcgtaatatctcaaattattattttgattacacaaaatcagaatttcaacattacgatttcaaaatctggaactcataacagaattctcagacctcagattgccccctttatgtgatgtcccaccaacacagcatctaggggtcaaatcaatttttttcatgtgctaacggttggcttggacacagtcacatgatggcgtatgtgagaagtgtactgatggagtagttgcatatgtctcagtataaaaatgttggcggcgcatgtgcaaagcatgtccaatttaatgacataaaaatttcccttgaagagaacttaactgccatcaaatacacttatacagtatcgcgagaacaaagcatttgatacaaaacgacctagtccctaaaaatggcatacagttgtaaacaaatcatgagaatgagaaataaattcagtactactcatcaggtattgcggcaaacaacaacggtaaattagcatgtagcatagttctaactcgtatgtgatcaatgacactatattcgcattgagatggaaaactcacacaaaataaacagggaggaaaaccaaacagtgaatttccttaagaactggcagcatatagaattcagagttcatatgcttacctcctttttcttgtcacgctttcttctcacttcatgaaaaggatctgaacagacatgaaaataagttagaggaactaccaacatggaattatgtttttgatctatagttccatactatgctgcatttattagaaatagatcagctagatgacatagcacaggtaagcattgtatagagcatgactgcatgagtataggacaaataagacactcaggaataaaaggaaaggacaagttttgattagctccttcagccaacaaaagcgaccaacacctaaggtatcacttttatgcttgcagtctagcactttcttcccaacaaagaaaggaattattctcgttacactagcttctaacagaggtaaacaattgtcttttaatgcactagttccaacagaaaaaaaaatatcccaacacaaatagataaatgccactggatgcaattccagatacaattcaaagttaccagcttcctaaaaagcaatgtacctagaccaagcattaaacagatagaaagtaacactaaataataatgaatgcaaatagatctctacagaaaggtaaataaaatgcatgaagaaagcttccaaaaccaaatcattgtatagcttaagttgaataacatgttgcaattccatccaacacacaatctatacacaccaaccacacaactcaaacatggaaaacaatcagcagatattaatatatagataaaccatcatgttcctgaataagcacacaaaccaagcccatcgtactaagatattaaactgaatctgcttactacatcataggtagccaattccatctcaagccaagaaaaaaaattcttctgcacaggaaaatatataagcttcattgattgtaaaaacaatatgaattactagcttcccacataggcagctccatgtaatcaaactcacagcaagtgaatacagataagtacagcgttaaaaaaagaacaccagattgacaggcagttcaatagcaaaggtccaagtttggagttacaagagcaccgaaacatgacaaaaatactaaaaacaataaaggaacagattagctcaaagcgcaactcctccaggtccgaggcaatcgtcacgcgaaatcaaaccctagtactccaacctctcacaagcacaccgcgccgcaaaacaaaataaacctgtacaattcaaaatcgtccggggggagcctaggcgacgacgggcgccagaaaccgggggctataataccttgcgagatgaggcgctcgacggcgacgtcggggtccatgccgcaatccaggagcgtggcgtagatctcggcctcggagcggtcggtcaggatccccttaagcccctgcaccagcttcctcgacgccggcgggatcgcggccgcatcccccgcccgaggctccgccgccgccgccgcggcgtagaagggcaccctcccaccgccgccc

SEQ ID NO: 59622 - DNA, 16120 bp, Oryza sativa
gatccgaaggcggcgagctcccgctgtggcgtcgccgccgcgcacacggtttgcggaggggaggagcagcaaaaccctcgtcgccgcctcctgttcccgtttggtgtactgcccacacccaccaacaccacaccacgcccaagcctaaccttctctttgtctctgcaaggagtaataaaatattaaatatttttgccctactcgtgtgtttcctgtattgcaaaaactatggtgcctgcctagggtttgtcccatgcctaacaaatctacccaggcagggaagaaaagataattggtagtacctccgatttcattttaattgatgttttagataataacacggtctataaaatatatttttaatcttatttttttattataatatatatatataataataaataaaatatatatctacttttattatattgttttaaaagacaaatctatatgtgttgttctagttcctttaaactaaatatttttaaagttattgttggtcaaaattataaaaaaattgacctcaaccttatctaaaacgtcaattaatatggaaccggagggagtagataacagttttgctagcatatggctctagaatagctaaaatgatttttataattgtgcgaaagttttaaatagattgggataatgaagtatatttagaaaccacagctacgttacgcgtcaccaccagtcatctattgctattagaaaaaaaaagttttcacaatcgtgtaaagtttttttaagtttgagagcttatttataaaccatagctataagacgtgcaatcatctgtcgccaattagtatcaattaaacatatttctaaatagttactactaatttgctatacactttttataagagaatttgtttcgcagtgaacatgtgcaatttatctagtaactagtgaaaacctttcttttcccatcttaaattatgttttgagttcaaaatattttgtgtacattgttgatgcatgcatagcaatgccacacatgtttttccttcaggaaaaaaaatcaatgccacaccttgcattagccaaaaggattttcaaaattgcgcaaaagtttcaaattcggagtaaaatagaccgagatttcagagcatattgtcccacatttccaattggtgcttcaattaaattccttgcttccttctctgaatgtatgcactttgttgccctacacaacttcaggtagaggcacagtgtcgttacgatcccttgcttacgtgctaagttttcttctacagctcccattcttcaccagtaaacaaaccaccatgtgcagcaaaacggcaaagtggttcaggcactcgctacgctttaccgcgttggttttctttttgctgggctacatatagcgatggccacttctggcccatacagattgcaggctaggcctttttcctgatgggctaatcctggccattcccaggagatgggccattagtaatttataacaaggccttacacactgtggcccaaattactaatggaccgttcagaacgagttgctgatccggcccagtgtactaagctgctccccaaagctgttttttctcttcttcttttcccctcttgacacatgtttttcttcaagttcagcactattttcaaggttcgaaatcttaatatctcagtagaattcatcagttgagacgtccaaactggtcctgcaaacagtttccaggagaactgcacatctcgacaagtttgtacgtggcacgacccaagtgacagagactgatttagaacaaaaggaacataacgcagcagcacataaggctttggttttggttgttctgggaggagacccgttccctgagtggcttttggttcattccaatcattcccaatggcttaatctaactaaacaccaacattttcgtacaaagaatatatgccaaatgtaatgtggttccttctggtgagaaatcaaaagagcacacactgcacataaacctacttgaaacacatttcagttagtgcaaaagagaggacaagtagggccaggttggtgcatacttaagagccaagcagcactatgaccatacaaagtgacagattccaaaagccatcttctgttggtagtatccactacttctactattatcatccactgaaaacaaggacatggatgcataaactgcttctgaattttattttaattttttggctctcgaccaagggggtccatatgcattggagcattattaacaaagcatgcaacaaagttgtgaattatttttgtgctggaatatggacatggaaggatgttgactccgcctttgtctctgccacgcaagaggaatcatttcgtggataatggatttggagagaaccagcagtgtaatctatatcagtggataatattctcagtagtggagataacaaaagaacaattagtgtgaggaacaaagcaactaaagggaagggcgatgtgaaaagaaacctgatgagaggtattttaattttcttatttagacggtaatgtctcttttttgtttcttcctcatgaaagttcagtggccaagtacatttgagtcgctgaaattgcttcagtaaagcgccactgccgccatgattaccattcaactaggtgagtgtctgagtgatggtggcatttgtttttgctccagcgacgagcatttgttttctactgctaacgtgacaatatgttctgctgaaggatcaatcggtgaagcggtttcctgcccaattaccacgtcgatttgcataggagtacggtgcgttgttgcatggaacagtgataagcaatctgcttctgttcttttcagctgcttcactaaattattacttcatctatatcaaaatataagcgattttagtttgatgaaacttatatttgtactataaatctaggatacgatccatctatctaaaatcctttatattttatattttagaacccaatacctgttgtctcatatcgtttcactaaaaataacaagtgcaatgcgagcttggaaaatttgagaaaaataaaataaaacgcgaggatgagagagaggaatcatggacgaatggatgtgttgagaatataggcatataatgatttaatatattctataaataaatcatgacattacatatgtatactagcattaacgcatcattagatctacacatgtaaactaagcagtaaaacatgaacagatcaaatatgcacaatatgtcgaacacgtaccgaggtggcggaaagaccggttgctcggcaagaactactcgcggttgcgagcgtcgacgaaggcgcgcagcacgcaagcggagaggaaggcgagccgtcgcggacgaacagggagcagtcgcgcgaagcgcttcctaaaaaccttattgtcgccttctcccggtgcaggacgtcgaaggcagaggttccggagacctgctctcccgatcgcaggtgcacgccggcgagcgggatggagtagtctacgagcgacggcgcagcacagaggaggaggcaaaccttagattgatttcgtgtgttttgcgtgaaggcggcggctcggtttatatagagataggtcgcttgatcagggcgcccgcacgatctccactccgcgtaaccgaaccggataagtcgcgcgtaacttatccggactccacgccgttttcacgcactggattttttggatttttcggaatgtttcgaaaacaaaacaaattcgaattttcctgcagcaaaacaaaactgcaaaccactccgcgtaaccgaaccgaataagtcacgcgtaacttatccggactccacgccgttttcacgcaccggatttttcggaatgtttccaaaacaaaacaaatccgaattttcctgcagcaaaacaaaactgcaaaaggaggctgcatctgcgcaagggtgaggagccaatttaaactgcaaaaggaggctgcatctgcgcaagggtgaggagccaattttgcggaccattcgacgcgtacgtcgtgcacgcgcgcctatcaggcgaggcgggcgagcgcacgtgtgttcctccttttctctccaccacaaatgcttcaagtggctaggagggcatcctcccttttaaggaggtcccctctcctagaataagcaaggtggtactaaactccacatgcatgccatcccatgaggtaggcttttataattttttaaagaattaattttcgaatgggtcttagtctatctattaatttcaacaggttagtggtggattagcgagagagagagagcagtaatggagacgagaataatcgccgagacggagcatcgaatttgttccctccgtttcttttccgtctcttcttctgactgaccaaaccaaaccaaaccaaaccaacagtgccggtgcaatgcattcagcagccagcagcacggcgaggtttgcagtattttccaatgcaactcgcacactccacgcaagcatcaagccctcggctcggccatgggaccaacccatggacggatggatggatggacgcatcaagccatgagccaacccggtcgatccgtcttttcataggaaaccagaggcgccggctggaagggggcatatcgagcaatggaatacctcaccaatttgtacccttcccacggttccccctcctcccgtcacgtctgattcacccttcaattctccactcgtgccgataaaaacgattttcgtttcgattattcgcggaataagccaaacaacatactactatttacaaacaaaaaacaagttacaaataaaacttttatatacatgttttaacgatctaaaaacaaaagctgaaaaataaattcaataaaaaatatcttaaaatcaactctaaatttaaagttataaatttattttttggctgataagtataagcaagcgaaaagatgagtcccttacgcttttacgaaaataatttgcgaacctttaaaacttttatatttaactatttagtgacgattgtaatacgatatttatataggtagaaacagatgcagtcaaaaacagtatttttacccgggatgatcgaagaaagactgttattaagataagtctaaaacggtgtcagtttttttgccaccattttttcatgtaagtatactagtaccagtagagtgcatgtttgccagccaaaccaaactacgcccgttggctgtcgtactctttcgtaatgtcgttgcttacggagtactcccctgtccagtactgtacttcggcctgtttaattcagctctaactcttaaatattactccagaagttaagtctgaagtgaagttgttgagctgcctaaacccagctccactactctagtatattttatgagagagctctatctaactccactcccaattttaatggagctgaaactgtttggctgagctctaactctaataggagtggagctgaagctgtgtcaaacatgcccttcgtataatgctactgttaattactgtagtgtagtagtcgtgagttttgttgacagctagcgtcaggtttatctactcgtcgtcctcttgggggcacttggcatctgattctgaattcctgatccatcatgtcacgtgtcaatgtgtcaagcgtccgtctgctacactacacggcccagcctccctctccgtcgtttgccgctcatcctcctgtcccgacacacgacgagtcaggtcagaattctgaaatagtagaaccatctcgcaaccaacagcttcagggggtgtttgggagagtttagcccctctctcccgaaagtaccccctcagattttcatccaacgctgttaccaccgtcggatccaccatccaacggctgtaaaacctcgatgatcgtgcaaacgaaaaaaaaagagtagggaggccaggaacaagaacaaggcaaggcaaaacgtgcacacaagatgtagccaaggagagcttcaattctccattttatgtactttttcacagggattttttttctttttctccactgacatgtgaggccaacttattccacgactgcgagtgctccggcgatggccggcgccacctcgccgtggccgacgccggcgacgatggacatggtcatggtcatcgactcctcgcggtggaacctcgtttgcttggcgatgaacgcctccaccgtccgccggaactcctccgcgtcgtccgcgccccagcacacctccgcgtcgcgcgccgtcaccgacgaccgccgcctgcgcccgttgtccgactccgaccgccgcagctccggcgacaccgcccgccggaacgcgccgcgcgagcccatcttctccgacctgctccgcctcggcgcgcgtgccttgttgacgcgcaccgcctgcttgtcctcgaacgccgccgccgccgccggcgctgccggcgccaccgacggggcgcaggggaccacgggcgccggaggcgctgccaccaccggggcctcggtggcgtgaggcggcggcggtgatggctgcgggacgatgaacagagggaagctggcggcgggtggcgctgtcgtcgacgctggcgtggacccggcgccagcgctgtcgctggagacggcggcggcggcggcggtggtggtggtgccgtggttggaagagatggagaggtcgtgcctggagagcgcgaggagcaggagcacgatggcgttgccgaggacgaacacgaaccgggcgttgagcaggagcgacccggcgagccgcaccacggcggcggcggcggccggcacgcgggaagaagaccacgacaagaacaccacgagcgcgaggagctcgcccacccgcagcatccggtagaggaggcgcagccgcaacgctgctccggcggccgccatggtcgcagcacactgtatcgtgcacagctctagctagctagcacacggcgtggccggcggcgacggcgacggcgactcttgccttcttggagacttgggttagtgtgggttttggaagagagtgaagctgagtgtgaggagaggagagctgtctgaactgaactgatgaaatcttctctttggttggggtgaggtggatgtgagcttatatagcctcaatttcggtggctttctctgtggccttttgtgtttaatacatgcatttgtcttctagtctactgtagtggtgggtcttaataaaatttttttgatgagtatattggtttttaaaattccaggagaatatttttgaaagatcaatttataggagaatatatttgtgctactgatggtagcatataaagttcttgaaatggagcgattataggacaaaatatgataggtgatgtggatagaacattagaaccaccaacttttgtatactgtggacctgtgggagttgtagttattgaagtcaatacaaattttagaatacataatctttttttccttctacaaggtgtggttcatacctaaatcaaagtggctttagagcgaaagatgtttcctacaaaaattcacatgttgatatgttgttagcatcatgttctattgatttttttatagatatatagcgtattaaaatggaccgaaaaaagtttactccgatcaagctttaagctggcaactcaacagtagtaaaccacaagttgtcttattatttttcagcctattcactgagttattaaaatacttcacgactcaaaaagaatacgttttttcaacataattctttttcactatagtattgggatcacttgttttaaactacagtatttgtttaacttttttttttcaaatatttggttttagataatccacactaatagttcctttaataatctaaaacaaacaaacaaccttatattacccaaccgcttccatttacacttgtttggcaacatattatatgtacaccagctctcacgtgtacacacgtacacaccaactaccaaatgtcacaaaaaaatctagaaaaattcatatatgtattttcaacagtattatacctagggataaaatattaaccctaaattcattatattttagccgtaataaaaaaattaaaaaatataacagttttaaggttataattctattagaattttgtctctttttttactttctatgtagaatgaatttgaacgtacgacattgcatgcttgtatgaatttttctagaattttttgtgataatttttagttggtgtacatggtgtgtacgcgtgaggaccttgtatataggataggctccccacttgtttgcttgcatagttgcatatactcgtcacgatgtgtgttttcatatgcccttgatactagtatacttgaaccttaactgagtcttccaatggataacaaacagcaacagcatcagctcgtagcaggagcagggaggcaggggccccaagagggatatgtgtacgtatcacgaggtggttgcccctgcacgagccaggttactattggtttgggtcggcttggagattcgtgtgcggggggccatcgatgtggagtcctcgatcagttcaaaacttcgaaccagctaatactggcagcatatacgttcggtttggagtttggatgcctctgtttgtaccagtgtgtctctctcttttcttcagattacagcactgcagagcagagtagatcatggttcagtctgaactcccaagcctgaatttccaatgtcaccaccggcctctgagcaaagcaaaggggaaaaatgatggcatcaaagcacaacggaatcaaagtgaaaatctctgcggatcgaagcaaagcgagaggataaaatctgagaccaacaacaaaccgagctgaaactcctacccggacttgctgtaaaactggaacgtgtacggatattgcagtgggggcagtggcagtgctgccgcatgcacgagggccggctgaaacactgacccgatggagtatcgcagtgcagtgcagtgcaatggagatgcatgcatgccgctgtgtacatcctgtgccattacacatttacgctacgctggccgtgtgtcgcagttggtgctgaatgctcctcgggcgtgcgtgcatgcatggtcgtgtattagtgttgttgtgtactccatagttactgcgaggcgtccttttgtccctggtcgcgcaggtgcaggatgcattgcagagggcgtttgcaatggaagaaattaagcgagatttagggtggtggccctcgcgccacggccggctgcttggcacaaatgtccctcacgtgtatggccgtgctaaccctgccacaacaacacgagcccctcttggaacatggaaatggcatagcttagctagcacatctgcaggagctaggatcagacgagagaaaggcagtttttcgtcgtgcggccatggactccgcatgcatggggcgttcgttcggtgtaacgccacggatttccagcgcggcccggacgaccaggcacgcacaccggcacacgcacgcgacgcaaacgcgactcgccgcttgtgactcgactctgtttacggaagggaaacgcaaaaacgagcccaaaatcagcggccgcgcgcaacagcggaagagaaggaagaaggggatcacggcgcggcgccgctcgcgtgcgtgcaaatgcatggacgcgcgggcgcggccgtccccttgttttccgcggcgttttttgctggggcgtttgcacgcacgcgcgcttttgccggtgcgcgcgcggcggggagggggaggaggaggagatgccgagacgggacgggacaggacaagcgcgggacgctgggttgtgcacgtgtggtggtggattggtggttccttttctttgccccgggcaagcggccatcggcagcggcagcggcccagccgacgcgacgcgacacgtcgaaacaacacagggagggagggagagtagtactagcagccgttgccgtggaccggccggcctcgcatcagcgccctggtctggtccactgttctcccttggtaacgtgtaagcaaaccccgcgagtaataataaagggctccttcagtttctttttccctttccacaccaactagcacactaattagcaaatatcacataatttttttaaaaaaaatgacacagtattacatctgcctgtaaaatcttatctttaaatttattatatttttatcataaaaaaaagtacacgaccaaccaaaatttagtatcatcacgtagttttggcacatatttactgttacaaaaatttaattgcgttgatgggtttagtctggtactgtttttatgaagatgaaactttaagaaataccgaatttggtaaaataacatttgacataaatatgtttaatttgttaggataccaacctgtaataatatattaaaaatagtagggttgaaagtgattaccaaaatgctttctctacttctcctttggacaccactcaactaaggtgaaaatggaaaatgtttatataatctatattccacatccacatcgagcagatataacgtcacatgcagctcattagagagcatttaggaggactagtattagaaaaactcgcatgatttcgcaggaaaaaggggcttccattcctttcggtacaacaacaacaacaaaaagcacacacggatcgaacaatttgattttgcccaaaggctaaaagcaaagctggcgcctatggctagttcacatagggagactgttaattatgcgtcaggtcgtgttcgtgtgcacgcatgtgaggtgccggtttctgagggcggatcagaaatttttatttttgttgcaaagtaaacttttcgcgcctcacacacacactaactacggctaagctatagccaggtgaggtgattaattagcggcatatattaacaaaaagaggagatttggtggggagacatggtggcatgatgcgccgttcgtcgcagtcaggcaagtttggtatcactaactaaacggccgtagcgattggctcgtgtcgccacaatattgctcttcttctctctctcttttttctttcttgttgctgttgctgttgttgtgttgttgttatgctggtcatgaatgacacctctttcgtcaaagcacagtttccgtggccttgactctaggctgcaaaagctcccggatagtttgctgctctagcatagtgcacgtaggagtactactttagaatagtgagggcaatgattaactattacgattgtgttggattacactaatcatgtcgggcaaccaggtgatatggctagtactatgcaaggtttaattaaacaatcaacacaaccttaattagcttgctgattgatgtttaaggttttgtataggaataggattgtggtgaaatattatagtctctgcctctctttcgaagtatgaatcgttttatcgttttttatatccttttggatttttggctattattgtttttactaaccaaggacgtatatagtattatacttacattcagaaacatatatggactatggtggagttttcatatgacaagtgaagtgttgggaaaaataagtggagtagttcttctaaccatggcaagttttcataggggtagcatgtaaaaaaacaaagttttcataggacaagtctactattattaacaaagttttcatgaattcatgtccagattgtcaggaaaacgaaaacatggcatggttaaaagcgagggatgagaagttgaggacaacattttactccctccgttttatattataagaattttcagcattgaccacattcatatagatgttaatgaatctaggaacatgctagaaagttttataatctgaaacggaggtactagttatgaattcatgtttaggttgtaagcaaaaccaaaatctgaataaaaaaaacttttagttctgaattcatgttcaggttctaagcaaaaccagattgtgaggaaaacgaaaacatggcatggttaaaagcgagggacgagaagttgagggcaacctgaattcatgttcaggttctaagcaaaatcaaaatctcaaaatcaaaaaacacgcgccaggtaggggtcgaacctacggccttctgcttaggaaacagacgctctatccactgagctacaggcgccttatacaaccaaatgaacatataaataatcaagtaggacatgtgtccacaaagaaacacacaaatagcaactgactcattgacagacatactgatccatctagattattctgctttttccatataagcacattgaattattcgccctgcaagctacgtggtgtccagcagtttgctgctcacatgaaatcagctcaacaaattcaacccagaaccgtgttaagaaatggatatgtaccttccaaaacagcgaatagaatcagataccgcaactaaaagcatcacttcttctcttatttgcgccgctttactgaaccacttgccccaaagcacctttccaattccaaatgctcccatggaggcgatcttatcctcctaattctccttgtcattgcctcgacgcaaaacatatgcttaattggttccagattcgcgattcccagctgcatccatgttctttcgcatcgccacgcaattatcgaccagctaaatgttccaggattcgatgataatacccggttctcaacttctgaccacttgaaattcagatgagggagagagagagagagagaaagaaatgcagctttatacttggtttattcgagctgtcttgcctttggaggcgtttattctgggctcaacacgtcagtaataggcccctttcactagcattggagcttaggaattgaaaggtgccttctctagaaggttaggaggagagctactatagctttgctttagtcttgatcattgatttgtgattttcttactggtaccagtagtgcattttggagaagttgatcaatcatccctaaacccatcattgcggagattagagtaataatactcgtggttctttttagacatattaatgacttgtggttctaagtaggaccctatttggtttggtacctcgaagtcacaaccggataaagctaagcaagagcaaatggctattgagcattgagtaggctaagttagttaaagcgttccaaagcctaagctccatcaccaaagcagcatcattactacaactccctcactgtcatggtgatttttgtgtttctttctactggtgtagtggtgctctatcttgattgtttatgatcagtttgagtcatggaagggactcacctgctttgtccaaggacagatccactgaaattagaattcttgttctgccgattccatgaaagctacgaatatctatgatccgttcaattcggttcgatttataaccaccattcagcacaagtatgcactccatctaaaagcatctgtatgactgaaaacaagcatataactttgtcatcatgcaattgcaaattattccaaaatcagatcaggcaagtgcaaattgtcagaaaagatagtaaataatgagcatatgtacaaagaaggtcaaaagtctacatactgatagacatgattcaccgttacataatcaaaatgtcaaaaggaagaatatcctaggagcagttgtcagaaagaatatggtactaacaactctactatagtacaaggattgacattaacattgtatataaaagaagaatcatcaccaagacaccaagcaataatatcttggtcaagaatcaagttattagcaagcagcatgtcacacatattgatgcaacttgggtgccaccaaagcgtcaatgctgctatgaatatctctactgccgtccggctcccttctaaagaactgatgaataagatcaacatcacgcggtctgccacattcctgtctgctccaaatcagtgtgcataaaatgcttccaacttgtattggttaagagcaagaaatgaacttcttcagttcttcactgtacatctgatgcaggaatcaagttgacatatttacgatttaggatatgaaacctgcagtgggtatctcattgaattgaaatccattcttgtaagacatgtctgctactggctgtgtatatccacttgtggatatagaggctggatttctatccattatcttaaaagaaaaaaaaaaggcatgtctgctactacaagctgcaatgctgaagcctggatcagagcatgcagcatggttgcctcatagttgtgcccatcttatcgagagttgtctctcaaacgagcttagcattggtatatgaactattcaatcagtgctttagtgcagtagcagaaatgattggatgaccagaccatcctaagctgcactgactggcaacaaatgctcatcatagcactcattcgtagccaatgcttcttattcagttaactgctaatcatcatatccacttcagatcctaaatccaactgatcaggtacatagcgagccattccagttccgaaatatatcaactcaagcatcctgtagattgcactgtcctggggatgtgtgcgatcactggccacaaacacccctactctcctgccctcccctccaaccgtgattgatgaccagcctgcccctttcacaacccctttctgcttcatcatatgccgttcttgtgcagcctcgtgccattgtcccttgctggcataaagattcgccattgccacatgtgctcctgcgccccatggttctgcctccattgccctctctgcagctttctttccagtttcctcttctcctcgggctgcacacgccctaagcaaagatgtccaaacaacaccatctctttcgttggcagctatctttccaatcagttcctcagcttcgtttattctaccagctctgcccaacaaatccaccacacagccatagtgctccttggcaggatacaggccataaatttggttcatttcattgaggtatctcaatccaagctcgacttccccagcatgacagcaagcattgagcacacctatgaatgtgacatggtctggctttagtccaacatgacacatttcctggaacaattcaagtgccttcttgctgtgcccatgctcagcatatccaacgatcattgcagtccacgaaacaacatcatctttcacacgatgggagaatactatatcagcatctaacatgctaccactctttccatacatgtcaatgagcgcactcctgatcattgcatgatgttcaagtccgcagcaacagcaagtgtgtggagttgccgtccagcatccagtgacgcagcagttgcacaaacacttatgagactggcaagagtgaattcgttcggaccaggacagccgctatgatgcctcatttctctgaacagagcgaatgcatcctcagctaggccttcctgtgcatagcctgatatgatggcactccaagagacaacatccttgactacactctcccggaaaacagcatcagcagccgacagacagcccgcggcgcgtgtgtagagtgtgacaagagaattggccaccgagcgggcacaggcgaagcctttccttgcagcttgagcatgcaactgctccccaagacagacccaagcaatatctgcacacgcagcaataactgcagcatatgtgtattcattcggcatgcagccactgatgattcctcacgaagcattcggacaaacgcctcgatggcctcctttgcacggccggtctgcacataggcagagatcaccgtcgtccaagcggcgacgtcgcgcgtgcccatgcggctgacagcagccagcgcacggtcgacgtcgctgcagcgcgcgtacagagtggcgagcgtgttggcgacgtagggcgtcgagtcaaggccgagcttggcgcagaaggcgtgcacctcgcgcccgcgagacagcaatccggcgtcggcgcacgctgtgagcgcggccgcgtaggcgtacgaatcgcagtgcacgccagaggcgcgcatctcggagaagcggcggagcgcttcgtggcgccggccggccctcgtcagcgaggcaaccagcgtggtccaagagaccacgttcttgtgcggcatttcgtcgaacaccttaagcgcgaggccgaggcatccagccttggcgtagacgtcggccagggccgtggcgacgaagacggaggagacggccgaggagcggaccgcgaacgcgtgcagcgacgccgcgtgcgggaggaacctcgcgtcggccgccgcggcgcaggacttgaagacgaggctgaggacgaaagggtccgcgggcgcgagcggcggagaagaggcgcggagg

SEQ ID NO: 59623 - DNA, 1280 bp, Oryza sativa
cctgcagccccacgattatgggccgtgttttcagcctattgaattgtactccctccgtcctaaatatttttagacacgccggtaacttttttttaaacatgtttgatcgtttattttatttaaatttttttattaattattatttttgatcgctgaaactgaaaagcatgttcgtttgctcaatgtggttacacaaactagtgctactatgtcataatacgttctatatgctccgctagtattagcaatttcactatacaaaccgaaccaccaaacttcaattcctggggatccaggtaggagtacatccaaatgaacatatgtgcatacaataattatacaaaaagcgatgtaaagctgcaaaccaacgagacaaggtagcggtggataggatatgtaaaaagtaataggtgatttcccgtgctttgctgcggaaattactaagcaattctcaatatttttttttgacaatcaagttagaagtcaaaagaaaaaaaaagaaacatcaggtttatcagtcaaatgatacccgtgctttagtattgataagtatatgttaaatattgtaaaagtgacagatagatttgttaaaatattgtacaaatgatatgagaggtgatgattggatatgcttgcattttgatttgtagtattaaataaattgtatatcatgttgtatacttgcatgagattaaatatgtaactattgctagtggttgatgatgtggcatggttacatgttaagctttagacttagtgtgctttaactttatagaaaacatagattggcaagacggttgatgcaatgtcttcaaagcgtgcaagtgcataagataaagaaataagcgaatagggtagctcataaccttgctcaactaggcatgagttcaagatcaagcactgagtggagattgtgtgcacatgtgtgtatcctggacctgttaaaccaggaatgtatcccctatcttaatcattaataaagttctatctttatgttaaaaaaattaattaacaaaaccacaaatagaatcccaaatactattaaaaggagggacgataaacacatcgttaagcaatatggtcatggcaattggtgggattgctacaaagtaaaaaaaataataatcatgtttgattttaaaatctcgatgacattaaagaggggaggcagcgtgtgagccgtaaatgactatagtgacaaagcagttaattgtttggcgggacttatagagagtgaaaaaaatgaacccaaacgataattaagttcgatttttaaaatc

SEQ ID NO: 59624 - DNA, 1656 bp, Oryza sativa
taagtcctcgtatctcttttgtcatcaagatcaaggaaaaattaactcatcccctcatgtatcaaaaccaagaaaacaatatacatgcatacaacctataaacactggtggagaaaccatctttcgtcggtcggccgatttccacaatagtcccggatgcaataaaaaccggggctaaagatgatctttagtcccggttcaaaagggtaacgggcatatttgatctttagtcccggtttgtgttaccaaccgggactaaaaatcatctttagtcccggttcgaatgctgtcagggcctgtcaggcccccccgggatctaacaccaaccgggactaaagatcttaactttagtcccggttggtaataccaaccgggactaaagatcccggtgatctttagccccggttggtgctaccaaccgggactaaagtcacacccctacatatatgtcttcttcctcctccagctgcccgagcaagcttcaaaatttcttcaaaaaagaggggaggtcatgccaaaatttctattgaatttattttggtgattacatacaaatcggagctgcctaaaaggtttacaacttcatcctccaatgtttttttttgtcatactacatttgcacctatgttttgcacactttttttgtctccaaaatttagttgtaagttgatgagagagaaaatgtgtgtgggggaagaaagaatatatagaaatttagttcatttgctaaacaaggttttataaaatagttgagaaggaaaactctagtgaaagttaatcttaaataatagaaaacaaactaaaatgaaaattaaaagaagtaaaacacattaaaattagtttataactttacaaatagcttttaagaattatttggtgtaatattttatgatttttgtatgaataaagatatcttataattattgtatgactgtcattattgtaagaataattatttgtgtacggtttttttgactcatgtagatggatcggcaatggatgtacgctgaccggcggtccaaagagtttattgacggcgtgcactattttttgagagtggccgaagctagtaggcaaaggggttttatttgttgtccatgcaataagtgtaagaatcagaaggagtattctgcatccaggactattcatttccacttgtttgagtcggggttcatgccaagctataattgttggacatcccacggagagcaaggtgttgaaatggaagaagatgaagtggaagacgacaatattccggactttgctcagtatgttggatttgaaggaaatcaaacgggcgaggaggaaatagctgctgatggtaacgacgttgcggatgatcttggtcagatgttgcaggacgccagggaagactgcgaaagtgaaaaggaggcccataaattggacaagatgttggaggaccacagaacttcgttgtacccaggttgcgagcaggggcacaaaaagttggataccactctggagttgttgcaatggaaggcaaaaaatggggttagtgacaaggcatttggcgatttattgaaactcgtcaagaacattcttccagggggaaacaaattgcccgagacaacgtacgaggctaagaagatagtctgcccgttaggactggaagttcataagattcatgcatgtccg

SEQ ID NO: 59625 - DNA, 705 bp, Oryza sativa
ttgttaagatcgagtgacatcataacatgaaaaagttagtgaagcataattattaccttatgcttacaataggtttactccaatctgcttccatgtcatcaacgtggccaccaagcatgtcacctatagacagggataggaacatgaaactttgagattatttcctatcatttatatcaatctaaaaggacagtcactgttgaaggagcaaattacatacttgggccataatagttcactatggcggcctctggcttgaattcctctccagatggcatggctggaatggccatcttttttgcaagagcagataggaggtctggaatcttgttatgtggaagtgatacatcatagttgcgctgtagtgacagaaggattttacacaagaagtcattagcatccttggttaagttgtcattaggaagagctaattgtacaacctttgcatatctccgtaatgtcaaaagattgccagtatgcctcaaatttcaagctgaacaagatgatataattatatgatgtaagcactgtgagattattttgacattactttcaggggttgtaatgttcaggcacatagcttgcagaacagccatactaaaataaaattccttaagtccgtagaattggctgtgtatatcccacttgggcatagaggtcagatttttatcaattatttaaaaataacgtatgtgagcatgtctt

SEQ ID NO: 59626 - DNA, 10325 bp, Oryza sativa
ctaaaatctttccacttttggcagcagtgagtaagtcaaaaattggaccatacaaagctgtcaggttagttctattaggaggctgtgggaaggttttcaagctttccctgatccaatagcattgttcctcaatagatagagcaccaggtatgaaatagaatcctacaaaattaacacaagaaggatatcattaagtgtcacaaacattatgattttttttagaaatatgaccaataggaagtgcaatgtacgatgtgaagaatcaatattaaattgagcaatgtattagttgaattataatcaaatagactacataatatttgttgcagcttgcgcaccatctttctttctggatttattctaaatgaccaaacttatcttaaatttcagagtgagctctatgcctccatcaaaggtataataacaatacaagtctagcatatgttacataggtagtaagatggcatccaggaatgaatcacaccaaggatttggtatcttgctgctaccagagcaatcatgacaaaagtaacacactgttgtgatcacatacaaatcaagcaatgttgcgagtataacaagcaaagtagtagtatacccaaaacaatacttgaatcaaaatacattaggtgctaaaagagtatatataaaaataataagcaagtagtatgccaagaaagcatctatggagtatgatagggtgatcaaaaatccgaagctcccaaactagccgccatgaacaatcgagaaatcgaactgtgaagcgaatggtggagctcccagattttaccaggtcggtccaagaagcagaagaggtcgaacccggcgacgtcgcgcctcccgatcccggcgggcagctcccccccgccgccgccggcggcagcgagcagcgcgtggaagtcgaccaccgcggacaggtcctccaatcctccgccgccgccgccgcctcctggcttgctcctgcagcgctgcagaggtcagggcggctagatagatggatggatggatgcgtgtggacagggggagagagggggaaggagagggagagggatcgagaccttgccctcccgcccttgggcttcagcggcttgtagagcttgtactgcttctcggctcgccggaacgccgtgcgctccgcggcggcggcggcggccggctcggtgtcgccgtacatcgccggagggagaggttttctgacgggtctgtctgtgggcggtggcctaatggctgaccggtgggcccaacaagcgtggtcagggttttgacctgggaatttcctgccaccattatttttcacgaaaccaggtactccctccgttacataccggtacataatacaagccacaactattttttaagttacataatataaaacatgatgtatgcatacaattaattagaacatcttctctattaaattattacttttttaatcttctaccctcaagatctctaattatatttattaagatgatttaaattagaatatgataataattatttattggtctttgggttaagagtggttgtgccttatattttggaacggagggagtaataaactcctactatcgggtaatctatgtctcatattataagttgtttagctcttagtcaaagttctttagatgtgactaaattattgaaaaaactaatagcatttacaacaccagattagttttagtaaatttagcattgaatatattttgataatgtatttattttatatttaacgtattagtatatttttctataaacttactaaaagagtcaaatgacttataatataaaacagagtattaagcactgtgaaagtgatatataactacacccgaatcgcaacactactgccacaagtataaggaaataaaatatgcatgtacacggtattttctgatagcaaaatttaaaaagcaggtgcccgttgctcctcccaaccattgcatgccctgcctctcttgccttttgtatgttgcatctttatcctctaaaaaacatagatgactcaggattttatgaacatgttgaatcaacatatacacattttgtaaaacttcgctagctgagatggatccattagagaggtttcgtgaacttgttgaactaaggcttcccaagccaatattgtagccaaaactccactcctacccaatttccctccactttctcctaatcacagtttccataatcctcacaatttacccaatccttaccacctaattttcaaaccttccacccttttggtcctccagccaactatcacctatatggtagttctcctaactttcaaggttttcagtagcaagtaagttgattataatctgcgccgataagttttcaagatttttgtcctcaagaaagttgggtgcactcaccaaatcaagttgtcgggtctgtctcttctcattgattagaatcaacctcttagcgccctgcaagacaaaaagagaacaatctagttaacatcgaagaatcaagtgataatagccaagaggcaatgagttgaggaacacatgtcaattagactggagaagaaaatttacaactcctcagctcttggttcaataacaacacatctagcaataaccgtaaaaagagagtcatgcaatacaagacacattggggtggtgttaagaaggatattataaaattttgtcgagcttattcttgagctagaagcacctggagcagtggatactctgatgatatgataatgaagaaggcccatgcggtgtataaatcagaaaacaatgagaaaactttcacattaaagtatatgtggagagaattaaatgatcaagcaaaatgacaaaggattcttgaagaggacagcaagaataaagaggacgaggatgtacttcctctgcagctatgaaatccctcgtacgaaattttgtggtttgaggataattgtaactgtttctttcaccagatcttgtttatttgacgacaattataggtatttgaaatgtgcttcctacaaagctgtgttttaaatccagctcctcctgcagttcattgacgtgctgttcttgtagcccacacaaattcttcatcaaatttgcttcttgttctaatgtgaagtacagaactcacagaaaaccactttatgaagaacaaacatgattaattagaacatagcatttcatcacagctgcaagagctgaacctctggatgcatcaatctcaaacccaatattttttttaaaaaaaaatgggattatcacttcattattgttccaaacaaacaaaagaaaacaaacaggcagtgaaacaacaacaattcggtttactagtatacactttacaaactctctgcttgtctttgcattgcatcaaccatcaaggaattcagttcgagctatggaattgcatcaatccagtacctaaagagtagaaagatcaattcttcacattagctcagctcacactagctatgaacaaaccaactgcgcggtcgccgtcgccgtcttcaagaacggctcctgtctccggcgatgccgatggaagggggatctgtgtgctgcattgccaagaaccggcgatgtctccggggagcattggttattggtccggccatccttacaagatctgggcggggccggtcgagcagaacgcgtccggcgggccgccgccggcgacgcggaagtgccagaggcggcccttggcggcggcgaggttgtcctcgcagaggtactcccaggcgtaccaccgctccaccgtgcggtgcacatcgtgcacggcgacgtccaccgcctcccggcctcccgccgccgaggcgcgcgccagcgccgccgccgtgtagatggcgcccatccggccgggctccccggcggcggcgccgctcggcccgtccacgacgagcacgtcccacctcgcgtcgagcacctcccgcggcagcgtggtgatcagcgccaggtggcagccggacctgcgcaccgcccccgtcggacgccggcacgccgggctgtcccgcgcgcgccgcagcagcggccacgcctccccagccgcgtcgcggacctgacctggtggatcttggccgccgccgccgccgacgccgccgagccgccgcggagcgagcggccggcgctgtcggcgtcctcggcgctgtcggtgacgaacgcggtggcggcgccctccccggcgttgaccgcggcaagcgcggcgagctgcggggagaggccgaacacgagcagccggcacggcgcgcgcgcggcgaccacggaccggagcagtgcggcctccttgggcgcgaggccgccgtcccccacgtccgtcccgttcccccacgccgaggcgcggccgcggcgcgcggcggcggcgggcgacgaggagccggtgaggagcagcagcttgacgaaggagagcgcgcagaacacgacgaggacgacggtgagcacctgcttcggcgacatcaccttgctccctccgccgccgccgacgccgacgccgccgctgctcatctgcatcgatccggatgctcctcctccgatctggcctcttcctgtgaacactctaccgatgatttcttgatctggtcttcttccccattgatccgccagattgccacccagatctcctcctccttctctggttcttggattgggttgcttgctgctgttgctggtgtggcttggtgtgtgtgatggtgatgtgtgactagcttagctagctgcctagctaactttgtcctctaagcaattagggtttggttggtgttgacttgtttttgtgtatgctgatgtctttgtgccattttccagaggttggagaagctaaggttgttgaacagttcatgggggtggggagtcactttgctcaactattttcttcacaataataactctcataatacccgtgcgttgcaaccgatttattttaaaaaatagttcgtggcatataaattttaagtattcatattgtctaacatatagcgatgaaaaaattcataataaaaatatttgattctcataattttttatgtatctgattcatggggctaggggaaaaaaagcaaagtctcttctcatttttttttcccacgtgttagttcggagtggtggctgtcaccaccactactattttttaaattagtttttcttcacaatgatttattaaattgacattttttttgtttttagttctttcgtttgtttaattagtattattttttgtttgctttgatttgaagagatatttttcgtgataatttatttccctttgatgtgataacatggatctgttgagctggtggtacggtgcgatgggagtagtgtgctttgcaatgtacgagtgacttcagaataggagaatataagacatttttgtgttcattattttgaataaaatccgcagtatgttattttgtcgcgcttcttcataagttttccatgataattttttgggtaaggtaacaagcatatttagggtcaggaaacaagcaataaaatacgctttatgttacaatttttttccttacttttccattttaactgaggtgaataaacttgagtaattttttttataatagtgtaactttttttggaggtaatacattggaaaaggttaatgtcagattcaaattcttagggtacctttgaaacacaacaattgaaaaacggcggaataggaaaaacacatgattccgataaaaattcaagtataaaacataggaaaacatagaaatgactgcttgattggatcgcaggaaaaacgtaggaataagataagagaaataaattcaaagaaaatttccgcaggttgaagctcttgttaaatttcctccaaaatttctatataattgtcctttccataggaattttaaaatataggatatgattaaatcctttgtttcaaaggcatttatagaaaaaatttctatacgattcaaattcttcaaaattcatatatttttcttccaaatcaaaggcccatagatcatttaaggacagccacccatccacaaatctcctgtcagatccaggcccaatattataattggagaaaatgattcgggccgaatgttggtgggccttgtcaattgggtcttgtgtacctctgggcttgcatttctttttttttttttggaaaaagtatactggaggtccctaaacttgccaccgagatacagaaacgtccttgaaccgcaataccagacacccggggtcccccaactatacaaaaccggtcatccaacgtccctcggtgattttgaccccggttttgatctacgtggcggctgagttagtgtgggacccacgtggccccacatatcaggtgtccacatcatctttatttcccctcttctctctcccttcctcccctctcagctctctctctcgcaggccaggccgacgggttagggagcagacggctgggcggtggcgctgcgacggcggcctgcggccggcggcggcggcgtcgccctcttcttcttctcccgctcccgctccgtccttatcgaaggtgatcaccgcggcatcgggcacgattaggaggatgctcgaggagggccgcggcaacggcggcggcggtgaggacgacgtcgtcgtcaacctccccgaagtcgtccagggcgctgccctcgcccgcgtcatggagtactgcgaccaccaccacggcggcggcgccgacacgggctccgcccggtcctccttccctcccgccctagcaagcgcagcaagcgagggagcgcggcggccagctcctcgcggtggccagcgcgcagcagaggacggccacgccggacgccgacgctccggcctcgccggagccaatgaacgccgcggaaagcgcggcagcgccggccagcgcctcgccgtggttagcgcaccgcagaggatggccacgctggacgcccacgctctggcctagcgggagccgatgaacgctgcggcgagcgcggcggcgcaggccagcgcctcgccgtggccagcgcgccgcagaggacgatggcggcggagtacgggatggtagcagagtgcgggatgacggcggcgggcgggacgacggcttccccttcgccgtcgttgagctcgtcgtcctcgcgaccgtccgcgtcctcgctgcactccaccgccgcgccgttcgaggtgggcgctgccctcttcttcttctcccgctccctcctcatctccctagacgcccaactcgcggccgtctcgttctcggcttcggcggcggcggcgaggggggaggagttgtcggctttggaggaggagcgcttgcggtcggggtcggggacggcggcggcgagggagcccgggaggcggagggtgaggtcggtgtcctcgaagtcaagccccaacaccgcggacgactggagcggctgtgtgcgcctggtgcttcgactcacggacttcgccggcgttggtcttcacggcagcgtcgggtgcctccccacgtgagcggtcgacgaggcgcgcggcctcagcgaggtcgtcgcgggtgatgcaggcggcggacctcgtgcctcggttgttgggggacgacgtgctgggggcctcgggcctcgtggcggcagcggcgaggtgggcgtggtgtgcgcggccatcgccggccgccgtcacagcgccgccgctcggccgtctaatccctactcatcggcccggcctgtgagagagagagcagaaaggggaggaagggaaagagaagagaggaaagagagatgacgtggacactgacatgtgggacccacgtgggtcccacgctgactcagccgccacgtagaccaaaaccggggtcaaaaccactaaaggacctcaggtgaccggttttgtatagttaagggacctgcatatctggttttgtggttcgagtacgttttttatcccgatgacaagttgagggaccttcggtgtactttttctttttttttttctctttcaagtggactgggctgtactttagcttgcaaatttgccatgaaatgcaaaccttttgctcaacatttttatagtgacgagaaaaatgaaaagaggcaaggtagagggggggggtggctgatacgcgatcagccgcgcgggggtgcgcgcgcggtcagtcgccccctcctctagcctatatctaatctactactatacattatatgtatatacgtatgtatatgtgtatatatataaatatttttaatgcataaaaaatatatacatatatacaaagtttatatacgatgtatataaagtttatacaggacatatacaaactttgtatatgataaatataaactttatatacatacgtattaaaaaataataaaactaaaaactacacaacatatacaaactttgcatacgtatatacaaactttgcatacgcgtatacaaactttacatacgtgtatacaaactttgtatatatacaaatacaaacttaatatacatacaaatacaaattttgtatccatacaccttaaaaaaactgggaaaaacataacagaaaccggaagaaaaaaaaggaaaaaccaaccgaacagaaacggaaaaagcggaaaaaacaaaaaaaaacggaaaaactctctctcccttctcctccgcgtggcacgtccgccacccctctccgcgcgcgacacgtgtccagtcgcgtggggagaggcgcgtgcgactgttcgccaactagccttctcgaggtagaagaaccaaaggacttcgtttgggacagggaactatggtattcgtctggaactccgggcgaacctgaggtttcgggcaatatactatggcttggtgcctaccaaaaaatgcctattttgcaagaagtccattttgataccctcatagagtataacccgagtctaatatttgaccgtaaaaccagaaaagaaatacgtcaatcttcacctattaataccggatcaatttagctccatctattttggacattggttttgtcctatgcaacatattgaccagatcaacccgtgctaacgtggcttctacgtggccatatgtgtggtattacaaggtaaaaagatcatagtgagatgcacatgtcagcagcatcacctctacccactctccctcctccaggcgacccggctaccagatgaggcattgcagcgacaccagtgctcgatctccgccgcaaaattgcccggcatgtcagggtcttggtcctcttattcattctctgacctaagataatttatataatgaatgaaaatcaagctagatgcctagattattcaaatctgcaaggttgatgttggttatatcctataaatgtgtgcaacatattaaggaaaacatattctatacatataactttgggatacacataacatacacgcgaactaacaaatgatattgaaaattttataaaaacattgtcggtgtattttcaatagtattatacatatttttttacgtgagtagtattacacatattaagtctcaattttaatttcaatatattttagacttaaaacttttttgacaattttaaggatataagtatgtcaaattttttgtcttttttctctcttcaaaatatgattttgaagatgattttgaagataagactttatacataggtgtaatactattagaaatatatatacaatttttttctagatttttctgtttgacatttattagttagtgtgtgcatctgaagtttatttgcataagatatgttcgatcataatatgtatttcaattcagaacacgattaggagccatgcaaatatgaccaaaatttagaacgtgtccatgctaatggtattttctaataatcttaaaactatttgcatctgaaatgagagatatttttgtttctccatacataattaggttcattttattttgacgtaatttttttcctttgggatactagaatcatcattagtttaccacatttttacgatttaaatatacacataaatctaacatttcttattaggaagacatatagttatttgtcacaactggctcacaaaatatgtcccttcaaatacctggggaccaaacaagcaaggtgacaaaagaaactagctagatcttcatacgtgtggccagatcgactgaaaccattacaaaacttaaaattcatcagtaaagcttcaaacaagataaactaagaaaagtagaggagaaaacgacctgaaaaactaagaatggtagttttgaaacaaaacaaaatgaaggaataacttatagctaggagcgaaatttaacttgcatttgccatgcatggtaatgatcgccatggtggaggaggcttcggcgaagcatagctaggttgaaggcgatgtccttggactatcagtcacatatacacttcagctctgagagcaaggataataatacagccgatctgttgactataag

SEQ ID NO: 59627 - DNA, 933 bp, Oryza sativa
ttgagtaaccaattgaccatagctgaacacggaacctgaaaaatgaaaataaggaaaaatgtgtcaaaaacagaaggcaatctttgtgagaacaaagaaccacgcagaccaaagtttccaaaataaaaaaggggattttctgcccgtatgatatgcaactacacccatcaggattagcacaagtttaagaagcacactactatatagcaggggcatagacgcaaaaaaagtgcaaaaccccatcacatgtgcaatacaagaagacaagcaatgtatattactgatattgccaaatatatatacacaaacttgtcatttttttatcatgcacaaatatagtcaacttttgacacctcttcaaatgcacaacttataatatgctctacatctatgaatgcttcaagaatttgcacttaattacggaccaagttaaagggtttaaagctaaaggctgatctaaaagttaaaaattcaaataacggaccaagttaccaaaaatattgaactttgcaagtaatacaacttcctcattgtattttgaactttaaacatgctaatatacttagaaatctttcctgaagagtgtgataactatactagatattatctcaatttgtgttctttcatttatgcatgttcaaagaccatacagtaataaatgtacccaatgctgacttgaactttgaaatatttgagatagaagtaaatctaccttccagggactcgcaaaacaagatcaattccttcataaccgccttttgttagccttttgttatgtgtgaacatatcttcctctttaaaaaagtgaccactcaaacttttgctgattcttcctcttgaattttctgtacacgaaaaattactgttatgacacattattctcaaacgaaataactagcaaatcacataataccttcaattttgaaaccaaag

SEQ ID NO: 59628 - DNA, 11243 bp, Oryza sativa
aaggcgagaatgatacgcgaagccgagacggagtgtcggtttcgagaaaaataaggagaatatatatgggagattgggagtgcgacaacgaggccgccggggacgatgcacgcgcgacgccgaggggggtcgctaatcggcgcctgggcgcgcgctagctgctcgcgccgtccccattgctgccggcagtaagtaaaaactctagatcgtgttgctgtagaaaattaagttgtatagtgtgtacaaataaattatattatattttgtaaaccaaaataaaatgacttcctatgttttatatagttaacacatgattgtaaacataatgcaaagtgaacatattttatttaattgatacttatgaattttgaataaaaacaattgagattgtagggttttatgagagaaggagaggagactttttttatcatatatctatcatccaaaagctaaaaataattgcaataatgtggcttcatgagagaagagagaaatagcattaattacacttagtggggatgaactatataagcatatacgataatgcgtacgatagcttaaacaatataatataagtttacataagttaatgtgatttaaatttaaatagtatgtggaataataattcaaatgtaaaagtaaaatgatgtggctctatgagatagcaaagaagataatttagaccatacatctaagggataagaaaattatgatgatatgacttaatgggaagaagaaaagataagaaataatttgaaccatagattaatcatttaagaacttaaaataattgacgtgatatgacttaaggagagaaaagaaaaataatataaactaagtaaaaataaactatacagatatacaggatattataaaaaatgaggaagtgattgtttgaatagtcatatgtagatcctattgtttgaactgcacagcaaacaatgcaaacaagcaacaacttcaaagctctagatccaaaccacaagcaaggaggtgagctcaaacaacaactacacaagcgtagaacaaagcaatgcaacaagaagataaagagggaggaggatatcaccaagatttatgtgacgatatattttccggaattcaaattcttgacggaattttcgttgagaagcacacaaaaacagagacttttttaatcctattctcatgaggttgcacaaatacattcctttcactaatggtatctttttcttgcggaggtgagatccggccttcacaaactttctttggtagatcggaggcacaatagcgacacctagctgtctatactgttggtaggtgaaaactttgacgtttaccgttatcttaaacttccataacttcttgtaagggaaggaacaatctactccctccgtttcaacttataagatgttttgactttggtcaaagttaaactgctttaagtttgattgagtttatagaaaacaataataatattttcaacccaagataaatttattataaaaatatatttaactattaatttaataaaaataatttggtgatgtaaatattactaatttatctataaacttagtcaaaatatcttataatctgaaacggagggagtaatttatatccaagctaataaagtatgccacttggacgttccattattttctcatgggaatattattccctattcaatcatatggataattgggaatttcatcagtgtcctcatccaatcataaaaaacatacaaccctaattaaaatcagccgtacgtgcaatatggcctcttttctcagtcctgtcgtcaaattaaaatcagacagctattcatcaagagtcagttggccaacttcgcccgatgctaagattcaaaccgaattattaaactcaaaacacaagacttaattcctagtatactagtacatggtaaacactatcaattccagtttttagctaccctaatcaattacactggctttcgtctgtacatgacgtccaacataaccatcaacacggacgattgtctcaaacaccatgacaataaccaaggctaaaagcttactaattaattcacccaaattaactgcatagatctcaaagcaaacaattttttttataccagtcacaaattcacaattgaactctatgcagttttctccagaaatcaaagggttaacatttgtcaccagtcatgagttgatgcgtacatagtggtctttgttgtaaggccatataaccgtatacattggctccagaagtatatctgtgctgaaggaagcaagtgcagcacagacaacaacaatgtgcaagatcttgttaatttgaatgcagtctgcactctgcagggaaattcaaatgattactttaagcaagaggagggtgagggttaaggcaaattgcaccaaccgcatacctcctcaagtgtagtctgttaagagcattatgtgtttatgggtatattggcaattcccatctctattttactcaatatatgacctttgggctaactcaatagatatagttcaatccccaaattccctaatttcctcaaattatgacatagtcaacaggtagatcatcaatatggacatctagattctcccttgctgccattttacattgcatacttagctcctcgctgcaacggcgtacatgcagccgtgtcagcgacggtggaaggcccatctccgggagcctcgcgacgccggggcagtcttcgacgtctaaccactcgagggaggccagccgtcgtaggcctgcaggaagcgaacggagattcggcaggtgccagaaatcgaggcgatggagggaggccaggagctggagagccctctcctgttcctccgtcaggtcgatcatcgtctcgccacgcctgctatcccatgaccagaaggatagccgtcgcagagacgcgagccgtctgcagagaggcacggtgaggacggagccatcgccgacctggagggtttccagtcgggacaagatctccgcagaggccagttgctgatgtgacagaagctccaagaatgcaggtactccaggtgagttggataccgccagggacctaaggtttgttaaggagccgaatccctcgatcgaagcaagtgagccgcagtctataatcttcagctcccgcagtgccttggagtatcccagctggagagatgtcagctctggactctgccaaatgtacagtgctgtgatggttgggaacaattgcagcaaacgggactggtccttgtctgtgaggttagagatatcgagttcttcgagtgacggatgaggctgcagtgggataatctgtccatgctcctgcagtttgagatcccacgcagcagagagctcaggactcatatcaatctccaggttctcaagagatggtgggagtaatgcaacatccaccttatcactcatgaccaacaacggcatcagcttggggcaacgctgaattcgaagacgctcaagagaggtgtatcctaggagtactctctcccctgcaacaaactccagttgggcagttggagatgtctagccaccttagagaatggatgatattagatggaatttccaacagctgtttatcatctctggctaagggccttgctgctgtagcttccaaactgctcatgccttccttctccgcagcttgatgactgaacgaaacaaattttagttgtgggatctcgtgtaattccaaactatggagggactgcacatgagaaagcatttctgttaaacaatgccctgatatgccacatgcctgaatggagataaattggagagatgggacgacaaagctgcttggaatgatcaaattagggcagttctttatatgcaatttctctaaaactgtgcactgattgagaccttcagtagatagagagactaaatttgggcaatccactagacagaatgatcttatgcgcgcaaagttatggaatgatatgatcttgtcatcaagcataaccaactcttcagatttgattttcaaatcatatgttaactccattgttggaagagttggaatcccgctgatggagaagcgccgcatctgagcagaaaacgggagaggatgtgaaactaccaaacgaggacaatcatgaattgtgagatcatgaagaccagatagcgactcatttcgatctcctaaggaagtggaaatttgcagggatggagaagttagcccactgcaatattccaggcttgccatcttaatcaaaaccaacttctccagtggaaggactaacaactctttgactgcatgcaggtgtactaactccaactccttcagtgattgcatctctctcagaggaagtatttcccatttgctgccatatcatttacagagaatctaagttattaaagaattgaaataacaactgttcaggaaaaggtaaagcaacgaaacaactgctataccttatatgaggacaacacccaatggtgagtttgtttagagatggaaaccatgacttctgctcggttctgaaagaagagaagctctggaaaggagtgaactcattcaattgagggcagtccttgatcttcaatactctgagacgggaagtcaattctgtcccataagtaccaaagcacttctccaatttcggcaactcaattaaaatcaacttctccaaagagggaattgagagttccactagattccacatcttaaccaatttcaattccctaagcactggaagcatttcaagagatccaagaattcgccactccctgcaattgacaagatgaattgtctgcagtgatgtcactgagagattactagaaagccatgttggagatgtaggaccagtgtaaccagctatacacagagctttcaggttatgatgtggttgaagaccctcaagcacatcttttgtcctctcaggttcaaggctcatgctgccaacactccatgacaagaacaacttttttagatactctttatctataagtctggccccgttggcttcatctttagtcttcacattttcaagatgagaaattacaagagttacaagcttattcatggattggagctgtcttatatcaaaaccgctaatattttgaaccttgaacttaagtttttgaagagagatcatgttgcccacaccacctatcgaaaagtgcactttagcatcagctataagatggcgcaacttaactagattattcatagcagcaggcacagaaatatttccagagaaccccacgtccaacacttgaaggtgataaaaacttgtcaaagctcgaggaaaagcagcatccttgtagtctccatataccaacatatctttagtctccgagacacgaataaattcaagatagcggagatgatgaggatttaggaaagtatgtatagcactgatgtcagcgttcaagacgcaaactcttaacaaccgtaaacatttggcttccttgcatacagtttgtatggacttcaatagatatacactgctgcttccaaaaagcatcaagctcctcaacttttgcaaaggcctaatcttttgtaatatctcatatttctcagtgggaaaattggtatttttatcattatcatcaccagtggttatgatagacaaatgacgaataccttgtcgaattgtgctagattgcaaccctcttaccgtataacattcttttgctgaaacctgttgtgctaaatcatgcataagatcatgcataacatagtgccggtcaaccttttggaaaaatccaaaatccaccaaactacctagctattgcaaccctgtctcctccaaccccttgcctatatcttcacattgcacaaaattttgagatatccaaacctgaaccaaagttgctgcactaaacgggtgatcctctgggaataaagaacagtaggagaaacagcgctgcaggtgagaaggtagataatcatagctaagtttcaggatgggtataaaatcatcatcttttatttgaagagatttccatttgtctcgaattgtcctccaatgttcatagctaacatttctgttcaaaagtgcaccaacacttcgtgctgctagtgggcagccctttagtgctttagcaatttgtcgcccaatggattgcaaactaggatcaccctcgtagttttccttgccaaacgcacatgctttgaagaactgccaaaactccttttcatccagaccactgatttggaatgcattcactgttcctatcatttctgcaactgagttttttcgggttgttgctagcaccatacagccggttacttgactatgtttcaatggagctaacagcttatcccatccactcatgtctttttccttccacatatcatccaatacgagaagaaatcttttatctctaatattcttcaaaagaatctcctgtagtacattgaaattgctaacatctttgaattcctgtttatcttgtttatcttcaaatatatgctctaagatctcacgtgttatgtccacttcattgaagtaagtggatacacagatccaaattcgcaaatcaaaatgatcaataattcttcgatcactgtatataaatctagtgagtgttgtcttcccaataccaccaatgccaactattggcaaaacacgtagatcactagattcctcatttaataatatctctattatcctgtccctgtccgcatccctcccgtacaccttaagttcaataggaacagaagttgtcaagcgtgtgttcctgatcttgctttgcctctgatttgatgttaaagctgggtgtgagacacctggtagaagaatccccctcacagaattgccagctttctgtaaatcgttcactattccattgatcctcttagaaatatcaagtctgatctcaagaggcagcatggtgcaatgagttgtgtctccctctccttgtttcctttttctacaatatgaggcccaaacagtaatttggctcctggcactgtgtagtagttgataaggagaaaatggagttgatgaagacgcatagcttgcctcaggataattagcagcagcagcactgcaaccttcgcctgcaaaggaaacccagtttgttatgggaacctgaaaaggaaagtcgcccaacttcttaagcaaaattagatggactcttgcaactgtgaatctagcagaggttaaatcatggattaaaaatataccggaactaaccaacatataaactgagatatggttcctatgttctcaactacaccaatacaagtaagagaagatcatagaacaagacagctatatatctcaaacctttttcaatctgttgttgtagccggtagtagtcaagctcatccataacgtcttctgcatcataaagcaactcccttagaacatccagcgactggataagtggcttcttgtcaatcctccttccctcggcagtagcaagcaccatctccacgttcctcatctcaaattcaagcttcttgacaccttcggtaagctcaactccacgaatccaggcttccatctgctcagtgaagaaactcccgaggatgctttccacaagccatccaattgcagcttctaccgtagctccagctaaccccatcgtctcatggactaccgaagaccgcagcgacagcagcacagcagcaaccttagcataagggagaaaccaagcagatggattcgatgggagaaaccaagtagttattgtcttggctccctaattgtagtaataaactaaatcaataatatactccaacaatagacgtgtctgattgttacctttctaattatatatatttacacaaaaatatagctatattaaaaaaaaacatgagtctagatcatccgctggtattcttcaaagcagtttcgcggaagtcaatggtatttcattgtcagcaagggtgtttattagaatataatcgttttatcttatcagaaggatgctaataccagagcatcctatgcagcataatgaaatggcgcactggatatggtctactctggagagaagggtacttttaagaaggaaaatggagagaactaatacatgggtgcttaatggattaatacatagcacttcacattaggaatactcgaatataatctatgcgtttggctctcatgatgaacatcttactacctattatcttttgcaaattgcgtgcagcagacaacccaagctagtagcttgcggttgcagaccggaatatattccggattgataccaattatataaagtataggagagcccatgttctaaatgtagtcagagttgtcaggtcgatcagaacaatatatccagctgtctacagtaggcatttgttagttcccaatgggaaagtggatgtgtggctccttttagctatgtctttctcttcactatatgactagtgaacttccagcacatgcacaaactactctacacaaacctaaattaatatatctacttgaaggtagaatcgcagtcctaaatcctaattagtacatatgtagtaccttgcaatagcacatagcacaggggaaattatgtaaatcctgcccctagtcctagcaaaaactagacagaatactaacatgcctgtgtgccacacaagctccagtctgctctgatcatgaatctacaagagttttccccaggctccgacctctgccaccgtgcgcccatcaagcaagacacatgcctgctcttcagcactaggcattggagaggagcaagttctattcctgtcttgccatctccagaatccagatggcatgcttgcggaacacaagccagttgattatccacaaatgtcaaatctaagtgtgttaatttggacgatgaagtgtagatactccctccattccataatataagacacaaccactttttttagatgttccataatataaggcatgcatgcatgtaggcaattaactatgacccattctccattaaattattactttttaaaatcctccactctcatattctctaattctattggatgcatgcattgtatttattaggatgatccaaactacaagatgataataattattttttggtctttgggttaggggtggttataccttatattttggaatggagggagtactatatagctataatcactctgaccgcattgagagggtacagagtttcccttggttggaccagttggtaatcctgaatgaggagcaaatattgctagccatccaactattcaaggatccgtcacgaacgaaaagaaaaaaatttctcaaagtatcaaaactggacttactgataagatgcatacctaccaggaatcaccagaggcttacctatgtgtggccatttgccaggctagccaagaagggtgctgtctgtgccgggcaaaatgatgggagattggagagaggcgttggtcaggcatttcgtcgaacgtatgtagggcgcaccgtcaacgtgcgtcgagcgagcacctaccctcggggctcggggcacggaacagcagaggcgcgtggatgccccccgcgcgcgccctcttcgatcggatggcgcccgagatgcgccgcgcccgcgccctcttcgatcggcggccgcggcgcggggggagccggtgcgaacgacgacgaggtctgcagctgcaaggtcgagagtcgagaagctgcacggtcgctggctgtgcgcgaccccaaaaaaggccggaccagtgaatcatgggccaaaaatggggtctcggcccacgagcaccatcgttagatcataagactttcaggaaaaagtatacttttcctcaactatcgctcgagtatgattcatatcctccaaccataaaaccggatatattgactcctccaattatcaaaaccggtgcaaacaatatccctagggacacaggtcgtctgcagtactgcacatgcagtgcagtactgtaggggatctcaattgatatccctaggtggttttggctgacgtggtacctacgtggcgcttacgtggcattagaaaaaaaacaaaataaaaaaatatgtgggacccatatgtcattaaaaaaaatattgcggaacccacatgtcatcctccctcattcccttcttcctccctctctctctctcccttagctctctctcccttatagctctcgagagcggcggtgggccggtggctgtggcggtggggacgggtcagcggcaaggaggtgagacggtgactcgactcctccctctcccggctcggtgatgaggagaggagatggcggcggtgctccaatcgtccctcccttcctcccagatccgtcctccggcggcgggcatggggtggaggagcagccgacggcggcggccaccgtaaaaagcactggccctacccctcccagatcaggacggagtaggggagccggctagcagcggcggatggaggaggagagtcgtcggccggaaggggaggccgctggcgacggtggcgggtaggggtggtggcagtgtatttatttattttattctctgaaaatattttcataggcgggtggatctaccgcctgcaaagatggagatgccgttgcgtgcatgcgtgttagggttaaggataaggtatactctctacccttggatatacgttgtacactgatatggtatacctgcgcgtgtgcggatgtttcctgtacacgttaaggaagttcattatgtaaccaaaacggagtccacggatggaaggagtcctactcgggcagaactgggtcgttaccgtatcgtgtggggtccgatgtctctgagttctacttggagaccaactgacccgcggtataaaagggaccccccgggaggacctaaggcatcgaatctcaccgccaatacatccaccacagcctacgaagtcggagcctacaggagccaaatcgttgggtgatctaatcgaacctactcgactatggtcttgtcggtatcatcgagttttgctattccctttgtaatatgtggttatcatcatataatcccataccaactggattagggctattacctatcaaggggcctgaaccagtataattactgtttcatgtttgcttgatgtcgtactacgtagatcctcgtaccagcgtaccccaataccctctatatccggtctacgggtatacactgtcgacagtggcgcgccaggtaggggaacttggtgcttaaggttctactactatgtcatcaagcttcgtcgacaacagcgtcaaccccggcattaaccaaggagtttcttcttcaacaatgctggtgtggactcaagtcggcgaaatcgtcttcccggtttacaccacggtgccgatctcgactggtccatcaatgaccggaagcgagaacacc

SEQ ID NO: 59629 - DNA, 38224 bp, Oryza sativa
gaatggaacatcgacgatatccaagcccaagaaggatcctaatgcggccaaatcttgtccttccgacgagaatcacgagccgacaagaaccacttctgaggcaacaaggtcttggtgtcctatccacaaaaccaggaagcacaccttgcaagcttgctgggtttttctcgacgtacaagctgagatccgtgcctgcaaaagcgtggaattcaacgtacttctccaacccgtgatgtctattgtcctattcacaagacaaagaatcacgacctctcaagctgcaaggttcttctcagcgccatgaggacgtcacctcctaaggtccagcagtcatagatctctcttagagatgcgcacaaggaatgaggagcagcagttatctcagatcgattcgttgggataatcgacatcgatccccacgagccgtcagttctacacttgctcgaagaccaggcctcatcatcgacgaatacaccacgcgatgtgtttgctatcgatgggaccaacacgtctgtgcacgccaatgcagaagtggaggatcaagtggttacaccagcccagtacatcagggctatcaacgcaatactgagagaaaccctttatgatcccattctggacgatgatctcgcacagtggacagaacgactatgggaatcagtggctaacctcagtaacgcgttcgaagaggccgccgccggagtactgccagaacaaccgccaactggcggtgccaatggcgaactacctgagcagcgggcatcacctcgtcaagcccctactccacctcgtggcaccagtgatctccgtgaacatttgaatggccgccgagaagcatgacgcgcacgagacaacgaaaatcgttcccgacatcgcgtctcttcacgacgtcgtgaaaacgaagagcgaggaggacacccgagcgaaaaccaagaccgtggtaaccgccacaaccgccacgatcgcgacgatcgcgaacagcggatgccgggcgatactggtcgaggacgctgccataacgatgatgatgatggagatcagcgccgggacaacaacggtgggcgacgataggattctcgagaacccggacgtcatcctcgtaatcgtaccccggaactaagtcactcatcatcatcgtcatcatcctcgtcatcagacagacatccatggaggacatacgatcaccaacaacccaccgcccccggcagcggatgtagagcttttagtcgtgccctacgagatgtccgatggcctgagagattccgaccgggagaatagagaagtacgatgggagaaccgaccgagaggagttccttcaggtctactccacagtactctatgctgccggtgcagacaacaatgcgttggcaaattatttgcggcggcgttgaaaggatctgcacgttcatggctagtccacctcccaccatactcgatttcttcatgggcagatctgtggcaacagttcgtcgctaacttccaaggaacatacaagtgccacgcgatcgaagacgacctacatgcgttgacacaaaatccgggcgaatcattgagggactacattcggcgcttcaatgagtgcagaaatacgatccccgagatcaccgatgcttccgtgatccacgcttttaaaactggtgtcagagatcgctacaccacctaggagttggcgacaacacggatcacaactgctcgaaagctattcgagattgtcgatcgatgcgctcacacggacgacgcactgagacgcaagaacgataagccaaagacggcgggagagaagaaaccagccaaggacgcacctgagtcaagcaagaagaagagtcgcaagagtgggaaaaggaaagctcaaacggaagtcatcgcagcagaatacgcggacccgcccaagcacctagacccacagagcaacgacacgaagaaaatatggtgccctatacacaagtcagacaggtactctctggaggattgcttcgtcttcaaaaagtcgctcgcaaagcaactggcattggagaagggcaagcgagtacgtgtagtcgagaaggccgctgaagcagctactcaggactcggactcagcatacccagattccgatctccatgtctcgcacatcttcggaggttccacggcgtactcctcgaagcgagagtacaagaaagtggagcgcgaagtttgttcgacatggcagggggctgcacccaagatgaagtggtctgagcagaagatcgagttctcagaagaagaccaccccaagactgctgtcaccccaggacgatatccgatcatggtcgagcccactattcggaatatcaaggtcgcatgagttctcatcgatggcggcagctccatcaaccttctcttcgccaacaccttggacacgatggggatcccacgaagcgagttgactcccactgatcaaccctttcatggaatttctcctcggtcgtcgtccaaaccattgagcaagatcacgcttcctgtgacttttggccatgcaaacaacttccgaacagagcagatcacctttgacgttgctgagtttgacacagcatataacgccatcatcgggaggactgcactcgcgaagtttatggccgcatctcactacgcgtatcaagtgctcaagatgctcgggccgaagtgaacaatcactattcagggtaacgcaaagctggcggtgcagtgcgacaagcggagcctcgacatggtcgagcacacacccaacccacccgccacagccgagccacccaagaaagtgagcaaaacaaacaaaacgccgcagccagacggcgcaatcaagatcgttccgctttccagtgccaaccacgacaaaaccgtcaagatcggggcatcactggacgagaaataggaactcgcgctcatcgccttcctccgcgacaatacagacgtgttcgcttggcagccgtccgacatgccgggggtccccagggaggtgattgagcacaaactcatggtgtgacccgatgccaagccagtaaaacaaaaactgcgaagatttgtaccagaccagaaacaagccatacgagaggagctcgacaagcttctcaaagctggcttcatcagagaagtactccatccagagtggctagccaatccagtcatggtgcggaaggccaacgggaagtggaggatgtgtgtccacttcaccgagcttaacaaggcgtgtcccaaggttcacttccctcttcctcgaatagaccaattggtggactcaacagctggttgtgagttgttaagctttcttgacgcctactccggctaccaccagatcaacatggcgaaagaggacgaggagaagacagcattcatcatgccgttcggtgtattctgttacattaagatgccgtttggactagtaactgcaggaaataccttccaacgcacggtccaaggggcacttaacgatcagcttggaaacaatgtcgaggcctacgtcgatgacattgtcgtcaagaccaagacaagcgactcattgattgacgatctccgggaaacgttcgacaacctccgacgatatcgcctcatactcaatctagagaagtgcacgtttggagtaccattgggcaagctgctcggtttcctcgtctccggaagagggatcgaagcaaatcccgagaagatcaaggcaatcgagaacatgaagtcgcttacaagactcaaggaagtccagaagctaactggatgcatggcggcattgagcagattcgtcgctaggatgggagaacgaggacaacatttcttcgctctgctgaagaagcaagacaaatttgtgtggacacaagaagcggaagatgcgttcatcgcactcaaatactatctgtcaaatccccctgtacttgttgctccccaacctaatgaagaattattcctctatattgccgccatgcgaatattttgtgagtactgtcattgttgtcaagaaagagaaggtgcaaagaccagtctactacgttagcgaagctctccacgacgcgaagacaagatacccacaaatccaaaagctgctctatgcagcaatcatgacatcaagaaagctatgccactacttccaatcccacagagtcacagttgtttcgtccttcccacttggtgaagtcatgagaaacaaggacgttgtcggtcgcatcgcgaaatgggtagtcgagctaagccagtttgatgttcactttgtgtcacgaacagccatcaagtcccaggtcctcgctgactttgtagctgactggactatgcctaacaacagggcagacagtcaggacgacaacgagacatggacaatggcatttgacggcgcactcaatagccaaggagcaggggcagggttcatcttgacatcaccttcgggacatcagttcaagcatgcaattcacctcaacttcagggtaaccaacaacacagccgagtacgaaggactactcaccgtgataagagcagctgctgcactaggggtcaagcgactaatcgtgacaggggattctgaactagtcgcgaaccaggtgcacaaagattacaagtgctctagccccgagttatctaagtacctcgcagaagtcgggaagctagaaaaaaggttgatgggatcgaggtccggcacgtgtactgcaaggacaacatcgaacctgacgacctagcacggcgcgcgtccagacgagagccactcgaacccggcaccttcctggacgtcttgacaaagccatcggtgaaagaggcaaacgacgaaaatagcatagtcgcccccgacatcagctcgggggctacagaggtagaacgcgccgttgccaacattgagaccgcatacgactggcagaccccactcatcaagttcctaagtagtgacgagttacccgaggacgatgcagaagtcgagaaaataacccgtcaagccaaaatctactgtatgatcggcaacgatctatacaagaaggtgccaaacggggtacttctcaaatgcgtctcgtccgacgacggcaaacatctcctcctcgacatacacgaagggatctgtgggtcacacgccgccagtcgcacattggtcgaaaaagcttttcgacaagggtttttctggccgaccgcccttaaagacgcttgcgacatggttcagcagtgtgaagcctgtcaattccacagtaaacacacgaagctaccagcacaagcgctccagactatccctcttacttggccattctcgtgctaggggctcgacatacttggaccattccgacgaggacagggcggctacaggttcctattcgtggtgatcgacaaattcaccaagtggatcgaaacgacacccacgggggaaatcaaggccgacaacgccatcaaattcatcaaagggatattctgcagatatggattgcctcaccgcatcataacggacaacggctcccagttcatcagtgccgacttccaggactactgtattagattgggagtcaagatctgcttcgcctcggtttctcatcctcagagcaatgggcaggtcgagatggcaaacggcatagtactacaaggaatcaagacccgtgtctatgacagactgatgtcacatgacaagaagtgggttgaagaactcccctctgtactatgggccatgcgtaccacaccgacaacatccaacaaggagacacccttcttcctcgtgtacggctcagaggccatgctccccactgagctacaacatcagagtacacgagtacagaagtacttagacgaggaccaggaggagcagcgaaacgacgacgtgaatctactcgaggaacatcgagaaagagttgccgtcagaggagccagctaccaacaggcccttcgctgataccacgagaagcgcatcagagcacgcacgcttttgatcggcgactacgtcctccgacgggttcaaagccaagcagggcgtaacaagctctcacccaagtgggaaggactgtacacgatgacgcaagtcttgtggccaggtgcattcaagattgcagacggcgatggacgcgagttagcaaattcttggaacattgatcaattacgtaaattctatgtataaatcaatagtatccatacttgtaagacatcttacagcttcaataaagctcattttcaggtaaagatcgcaatcaaagtgttccttcccgacgatcccttaccacgacgatacctagcgttgaatcctatccttatgtccttttacgccgtcttgataaggcctctgaggaacctaagggaactttggctggggacgcccagagcggataaggccttgtcggatcatgtagagacaaaagactatgtaagatctggttgtgtaagagttctcgccgtgcgtattaaccaagccgtgtaatcggaaaccgagttttccaacttcacggctgggggctaggatcagtgcttgttcaaccaaggcaggtcaagagtccaagagcctcatcttccaagaacaaattctccgatgacgaggctgggggctagggagagtgtatgactcaagcgactgatcgaagtcgtgaagtgagaaaacactcatacacagcacatccagagtaagaaaacttagttaaatagatttcttttctatttcgcaagtacttcttacaatttgtaaatattccaaaatatgttacatatctccttgagatatttgtcacaggatacaaagactacaaggatggccaacgccagtccatagactgaaagactttctccgcaagtggcgccatcgacttcgccaaattgtctatctctacgggagtcctccgagaacgtgaaaacccttcgtggaggaactcgaggtgcagctgcgggcggtgatctcggatacaggctagcacgtgtctcggatacaggccagcacgtgccctccggcatatcggctcgatcgacgacactcctgcttcagggcctcatcgatacgcttgccgatgccttcaagctgagcgtaggccccattcaaccacgagatgtatcaggccgctgaatcctcgggattcctgcgaggtactcggagttcccagcagactctggccattgccgtacaacagctcctgaggtacgagttgaaccacaccttgcgacctcggagtgcctccacggctcggtccttcttcacttccaccatagtcctctcgagttcggccacctcgaatttcgtcctccagtattggattcgacgatctcggtcggccagcacactctcgaggtctgctcagcacggaaatgactaagtcaagttgttcttctctctcgagaacacagcaaattaagtcaatccgagcagaagactgaaggagacaaagaccaaagtaccaacgtaaggatgtcatcgccacgtccgcctccacggacaggctttgatcgacatcgtcccgcggcacgtatggctcaagcgcaagtgccggaacgactaccggcgacttaggctacccgcgctgctggacatcctcgatatcgacatctctacaacgacaacaaaatactcggaatcaacatggtaaggaaaacgaaggtgacaactgcatacacaaaggcagtctgaacctataaaagttttacaagcacaattgattaaggagtacaaggggaataaaatcctactcttcaaaaagggggagaacagactcccccaagtcaccgacttcttccatcacgcccttacgcgcgctgttggcggccccctgatccagaatcttctggaggtcgagatcagggcacgccagtttcacgcatgcgaggacgtggcacgccctggtatagatcccgttcgacatctcctcgccgatcctggccgcatgcttggaggggatctcctccattgccgccgccagctctgcgagcaaggacgtcagcgagaactcgtcgggggttgccgggatggtggtcgtgacgccgcactccccgacgagttggtgtaggccagtgtaagacacccgcagcgagccgcggatctccgacaagttgttctcgagctccgacatccggtgctcgagcccttgccgtttcctttcgttaccggtcaccaactccctcatcttgagaaggtcctcgtgggtctccgccagatcacgcgctagctgctcggcgcgtcggcttgccgatgacgccgttgccctggcttcctcgatcttgtggcccacgccatgagcaccagcctggaggatgcgctccatcttggcttggagctccccccggtgagggcatcaacaggcgggccccgagtgggcacaaggccgccggtgggcccacttggcgtcgcctcccgttccctagtcgcgaccacgacatctgtcgaagccgctgcaggagacgcactggaggtcgcaccggacccgtcttgcaccgccttcgcccgcaccgccctgcgaaggatttccacggtttcataaagtcaggcgacgaaggtttcgtgattgaaagaacctcaaaatcatctacttacttttcgccaagcgtcaccagcctttgccgtcgctgaggcgggggggggggacgtgtccgaggcctaagtatgataagcatggtgtgaggtcaagatcttccgactacgcgttaggagacaagagaggcttaccgatgggttaggcgccttccggcgggtcccaagtacagaggagaatttcctctctctcttcgggacattgctgccactcgtcgtgggagcagcaacaacgtcgaacgcctccttcgcgatgccctctttcaacgacgccgccgcctgatggtccacgagcagcccgatgacgtcagtcagagggagagcctgcacaacatgaagtcacaacgcgatcctggaagaaaaagataaaagggtcgttgagtacactcacgttgattgcagcttcgcgttcggccgtcccctcctcgcaaagggggacgacgatgttgctcgccgttgtggggccgctgatcattacttgaccgacgcagcgctccacagtttcgctgttcaaacctgtaggatcgagaagcagaactcgataagtcaggaggaacgtgcacgtaaagaacgaaatctgatatacgagaaaaataccccgaggagaaacccgggccgtgtcctctggcccagaatagtcaaaggctgggtggactcgagcctggagcggctggatccgcctaccgatgaagtcggcagcaacttcataccccgacaaccctcgtactcggaggtcatcgatgatatagatgaaagactgaagggagggagttagggcctgtgttaccctgatacggctgggaaggagcgtatccgtatcagatacgtaataggatacggatacgtatcggatatgctccgatacgtatcccgtacgtatccaccgtttttccgactttcaaaaaaataaaataattaggatacttctctgatacgcgtcagatatggcccaatctctccttctttacgggataacaaccctagccgcctcccatctctttgcgcacaacggtgccgtcgtccttgaccgcggcaccaccgcagcgtgcatgctgccgctgcgtgctgccgagcacggacaccaccggcgtgcgctgcttggctgctaagtacgaaatcaccgccaccgtcaagcgccgccgagaagggaatcgctccgccgccgtcaagtgcagtcgagaagggaatcgccgccaccgccaagtgattcctgtggttgctaggcacaacaccatcgctgcacgggttggtgcctcggtggttcaagtgaggtaggcatgagtactgacagttgagttaaatcacttctttgatctgcaatgattttttttgtttcttgttctcctttcttattttcggaacaaacaactgccatattactatttcagagatccgatagattatgaaattggaaactcaggagtactaagtgcatccaggatcttaatgttgggcgataacatcattcttttttattttggccaccgcatagtagccgtaagtgacttttacagatccagtaattactagtactgccgtacttgaaagctatgctcgatatatctgtgtattgcttcctttagttatctctgaattattggcatgttcattattttgggcttaatcagttctgctattttctttcaggagttcattgatttttattatttattatgtatatatagacgtatccccgaatccatgatttttgaaaatagccgtatcccggtatccccgtatcgcgtatccgtatccgtatccacgtatccgggtaacataggttagggcgggtttggcgatccacgccgggatcttgtctggttgctcctcaggaacaacaaagactggatccgaatcttttatctgaagatagaaccacctcgcccgccatttgctacgagaagaggggcactagaaggggatgtatcgcaacttcaggccatcccgaagcaggaaatcgacacatccggatatctttttaggttccatccagcgcaactcatagtagaagcggaagaggtcaagaaacgactctaccccaatgtaggcctcacaaagataggagaagatactgaggaaggagatggaattggggttcagatggagcaaggaaaggccgtagaaattcaagacgagaagaaggaagaaaaccgtaaagaatgtaatcctcaaccgcaaccatgcggcccaggacaggttcaggttcaatacctcttgtttctcgctccatggtcccgcggccagggagagcatcgtcgtcctgcagtttcttcagggacgcatttgtggaggtggacttgtcgagatccatccccgccggagatcgccggagatcaaaccgagatgaacaaactagggtttttctataggagcggagaaggcgaggggcgtgtggaagctggaaagtctttgctgcaagcagacttcaaaatggatccctaaaactcccttaaatagacgcactaccgacggtgcgaattccaaggaaaggagagagatagccgccggaaatttctgggtccgttacacgcagcagttttcggacttcaatttaaattcactcatgaccgttgaacttcacacggcgttgtcgattactctttgtctctacggttctcacaccgagatcgaccagtagagaacgacaacgactccgacatcagaagtcgcgatcgctcacatgagttcatttaagcagaagtcgggggctactgtcagggttatggataaggtataccctttacccttagatatacgttgtacactgatatggtatacctgcgtgtgtgcggatatttcctgtacacgttaagtaagttcattatgtaaccaaaacggagtccacggatggaatgagtcctactcgggtagaactgggtcattactgtatcgtgtggggtccgatgtctccgagttctacttggagaccaactgacccgcggtataaaatggaccccccgggaggacctaagacatcgaatctcaccgccaacacatccaccacagcctatgaagtcggagcctacaggagccaagtcgccgggtgatctagtcgaacctactcgactacggtctcatcagtatcatcgagttttgctattccctttgtaatctgtggttatcatcatataatcccataccaattggattagggctattacctttctaggggcatgaaccagtataattgctgtttcctgtttgcttgatgtcgtactagtagatcctcgtagcagtgtaccccaataccctctatatccggtctacgggtatccaccatcgacaatgcggtcctttctcctgcctgaaaaaactacttttggttgtctaggaaaacaattttcctagtagtgaatccaatgcaatgcgttctgatatgtttggcgacattctcatctctttttttcccttcacctccactaaatctggctaaacgaccatttttttttcatttcgataagtattcgatggtaatcataaccacctctgatatctattactcatgcatgatgcatgacgatgcgaacacgcatttcatatactgaagatttaaaatttagacttcgtcaagaaaatggaaccattgcatcaggatatgccatgcttttcctaagcttaaccaaatcgtcgcaaccgttgccggctggtatgctttcacagccatatccatgtgtatgctctcccgcataatcccatctgtcgaaacaagatttcggcaataataaaagggagtggctatcaagctagaaaagtgtatgggtttggagacaaggaattttatacaggttcaggccttcttattaaagaagtaataccctactcctgtccggggatgattccgccgagtgtgttattgattgtatgattgggagaaaaaagaatcgtgccccaagaagcatacggaccctccttatataggggaagggatccgtaatacaaggtacagtccatatcctaacggaatatgggattacagataaaatacaattgtagccgactaggatcccgggtattttcttgacacacaagtttagagcctaccccgagtcctcataaagatattctatctatatttagtaccatatatccaactaaagtataactgtcatgcagatatggggtatccataatctccacagtagcccccgagaccttcgcagttgacgaaacaaaaaccagtagtccgagtgcttcaattcaacttgctccagcttgctgagtactaaaaatcaaaaactatgaagggcgaaaataaaacatggtgcatcgagtagatgcacctaattaggtgtagcccccgactatgtgattagttgaaaaactaaacatatagtcaagcaccgagtggttttatagcgaagcacgcatggtacttagtaagatacccagccgactgcttctcaactttaatatatcaaggacaaaaaatacaagaggggccgagtgacaaacactcaaaaggcccaaaaatagatatatttgataggaatccgagcaagaaactcttaaaatgacccaccaaacatgacagaaaatcatggtaattaatgagtctaacagccgaggctgtgacccttaccatagccaaaataagcatataacatgctaggagaatgactactaataaaccagtcatctcaaattaacccaagagctcctgtagcctaaaaaagcttacaaaaatggtataacacctttctgttgggcaccttttcatgtgcatcataataattccaaagaattattgaatcgcgttaaaaatgattttaacagcatcgggccgtgtcattgtgagcacatattgccaaagcaaaaagcgcctaagtccctagggatcacaacgggccacgctgaaaacataattgggctgaagtactgtacaggcctaggcccattagtactcccgataccctaaaaataccgaagtccaaacgtcgcttcgtcttccccgccgagactctcgccattccccactccgtgctacagtacagaaccgcgccgacgaagttagggttcatcaatccgctccaatccatcctcaaaaacttcacaaaatttctccccgcatccaccgctccgagtccccatctcttttcagccatatctcgaactaaatcaaaccatccagttcacattcatggcggaagaaagagaaagcttcgagagtcagtgggcgccctccgatgtgacagaagacaatctgaaggagatggtggcgcacagcgttcttccagcaaaagagatcatcgggtggcgaccagcatttggtgaggcattcccgacccccgacacacacgaaatcgtggtattcactcatttcttctacggcggattttctcttccaacctcaagatttttccggggcattctgaacttctacgggattagcttgcatcacttgaatccaaactccatagtacatattgccaattttatctacgcctgcgaagcttttctaggcattaggcctcatttcgccttgttccgccgcatcttcttcctcaagccccagccaaacaaaatcaagccgtgcgttgttgggggagctggcttccaactcagaggaaccttgagccaaaaatatttctccatgcccttcaaaacctcaaacaaaggctggcatgcgaactggttctatgttcagaatcctgagcccgcactccccgagtattgctgtcttcctccggtttaccaggacacatggagctcattgcctataggagatgaagctgctcaagcagtagaactgatggagaggatgataaagctaaaagaatagggtcttcaaggagagcagatcacccggcactttatcatgtgtcggttagctccaatcaaagaaagatcccgcacagcttttgagttcgatggcaagcatgatccaaatcgggaagatccagattctcttgactttaaggtcatgaaagaaagaatgtacaagatcttctcaaatgctattgttgtcagctattcacatctgctgcccgtcgtgccattcaacgcattcaaccctcctccaccggtatgcactcaaacatttcaacctccctcaagatatgatcttgtcttcctgttgaatcaattaacaatgaaagatattgcacccaggaatttgctttaatgaagtcggatcccccaatcgctcaacgccgatctccccgccaccaaactgggcaagggagcggaggaccaagaattcggtctgaaactcaaccaggtgcttctgatccagttggccagtcagactctcgaaagaggaaactggttctgagtgacgacgaagccgatgatactaccaggaggccttgagaccgagagacaaccaagaaactaccaaaacaggctactctaaggaagaaaacatcagtcgccccgcgccgaagatcaggaagtcttccaagtacaactcatacaacgatctctcttgcattgatgcgcatccattgcggcaataatactgataatcaaacttgcaggaaaccatctgccatagatccgtctgggaaagactctgacccgactagtgtggatgcaagttcttccaaagaaaccaggccaactgccgaggaccgtccgagtgacaatcagccgacaatcgataatgtagaaaccggtgatcaaccaccgactgggaatcagtcggctgaagccgaagccggggttaatcaggagcccccgactgaaaaccagtcggacgcagggccaagccaagagattccagaagttagagctcaagcagacagccttcgcggacaagacgccagcaataaccagagatctagatctcctttaaaggcatccgaacccactcgtcctcgtccaaaaatcattacgggtaaaacactttgtctgaaaccatgtcgacccaaataactctgaccaattgtctaacctctgtcagtggatacattagggccaatgatcggtgatgaagaagaaattccccgcatacaagcagctgaggattcacaccctccgattctggtcaagtggtgggatgacaacatgcagcctcaagggatcatgataaataagcaaaaagaggacgaagagttatgcctactgaagaaggcacttggtcaggcgacccgcattgtaaatgtaagccctctggcacctgatctcaaccatcttgtttgccatttaattcatgcgccaattaaactgtcttgcagaggattcatcttaggaacgaagctaaaacagaaccttagagaagctggtccctcatctcgggaccctcgaagccaccaggagtctgctgcacgagacaaaagagcttgccaggaaaaatgagcatgatctgaggaatcgaattactgagctccaggaatccaattttgaactgagtggctcatcaaaaggtttgcgcaaactctgcccaactgacttgtgctgttagctctgtaatcctgattaaccgaagttaatatagtgcaagctgccaagatatctcagctagagaagcagatccaaattctggaaaatgacaaggcagaactggcaagacaaagagacctggcttcaaaggaagttgaaggtatcaacaatcaatacctcaaaagccattatcctccatatgctgacttattaatgtgaatctgtcgatgcagaccgcaagatcaaatctcaagctcaattcgacgtcctggttggcaagatcaaaaaacttaaaggagcccgggatgaggttcctaatgctgctgccccaattgttcaagcgatgttcctcaataacaatggcccgagtgcacttgatgcttctgaaatttttgacaagctgagagttgcttcggatatatatttcaagaacatcaaagaagctggaagtatgggagcaagtatggcgttggcgatgactaaatccctttatccgagagttgatattgacgccattgatggctttgcagacgggacgagcgaagaagctgctcttgacctcatcagtgatgcgaaaaaagcggctgacaaaattgctgctgatgtagttgagagatttcaggacaacgatcttcgaccgactggtcctgaaaattctgatgatgaaaagactgatactgattaatgtaccgataactttgatgattaacgatgatggaggcacaatttgtacaatactgatgaatttatgctgtgcttgatatcttagcttagctcctgatttcttaaaagtttttgtcaaaccttgttgagcctaaaacccgcaaaagttgttaaaaaactttcagtcctcattgactaagccaagaaatcaaacagggcaatgatacatcaagtaagcaacttgaatggataaaaatcacactccatttttattatagtagccccctgactgaaaacttcgaggaaaaacttgaagttagcagtcaaagaggaaagatacaaacgaaatgcctaagcgtaaaatcgacgaaggtgttcaatattccaagaattgttaatgatagtaccatcttcgtgcttgagtcgataagaaccaggccgagtgacttcagcaattatgaacggtccttcccataaaggagataatttatgccgatcctgtgttgtttgaattttccgtagaaccaggtcaccgactaaaaaggctcgcgatcggacattccgattatgataacgacgcaacccttgctgatatcgagtcgattgaattaaagctgcctctcgggcttcttctagtcggttgatgtcgtctactcggccctcttcatagccctcctcgttgaagttccgaaatcgtagtgattcaaattccacttcactcggcaacattgcttctgcgccataaaccaaaaagaacggcgactggccggtagcccgactaggagtagtacgtaaagaccaaagtacggacggcagctgatctacccacttgccagcataggggagtagtcggtcgaaaactcgtgctttgatcccttgtagtatcatgccgttagcgctctcaacttgtccgttactcatggggtgtgccacggaggcataacaaattttaatgccgaagtcttcacaaaagtctttaaatgctccaccggtgaattgagtgccattatcagtgatgatccgattaggtaccccaaaccgatgcacaatgttgatgaaaaaatctctagctttatttgctgtgatcgtgatgaccggtttagcctcaatccacttggagaatttgtcgatagccacaaagagatgcgtgtaaccgccgactgcccttttaaatgggccgaccatctcaagcccccagaccgcaaacggccaggacaacgggatggtttgcaactcttgggctggcaaatgagtttgtccggcaaaaaattgacaaccttcgcatgtccgcacaatctcgtccgcatcagacacagctgtaggccagaaaaaaccttgccggtaagctttgctgacgatggtccgtgcagcagcatgattaccacaaatgccagaatgtatatccttcaacaattgtctcccttcctccaaagatacacagcgctgcagtattcctgatggacttttcttgtatagttcagcttcgtgaataatgtaaagtctgctgcgcctggaaatccgctcggcttcatttttgtcttgaggaagttcttgtttggtcaaaaattctatgagaggttatctccagtcggcttcaatcatgcttacgccttgagtatccatggcttcagttgtctcttttctgggcatggtcggttcgtaaagatgttcgacgaatacatccgaaggagctgcttcccgttttgaaccaaaattggctagtctgtcggctgcctcattgttatgtcggaggacatgggtgagctcgagtccatcgaatttgtcttccaacttgcgtacctcttgtcgataagcagtcatattatcatctagacaagaccactctttcatgacttgattaacaaccgagagtctccacggacgattaatcgacgaatgcttaaagagattgcaatccttaatccatggagtagcgcctcgtattctgccacgttatgggacgcagaaaaatgtatccacaatacgtagctcaatctttctccagtcggggaaattaagacgaccccacctccagtgcctgcaagcctcttcgacccatcaaaatgcatagtccaatattccatttttttcctctggcatatcttcttggcactcggttcacttggcaaggaaatcagctaaagcttgtgacttgatcgaagttcgtggtttgaaagatatgtccaaagacatcaattctaaggcccactttgcaatctgtccgtttgcttcgcgattatgaagtatatccccgagtaaaaacgatgtgaccactgtgaccgagtgactttgaaaatagtgagataattacctgacggtaattaagacaccatataataacttttgaacctgaggataccttgtcttggagtcggctaaaacctcgctgacaaaatagattgctcgttggactttttgaatatggccttcctcttcacgctgacaaccaggaccgtactcacaacctgggaggttgccgacacatataacagtagtggctcttgtggatgtggcgaggccaaaactggtggagtggtgaggagttccttaaagtcttcgaaggctttctgtgcttcgggtccccactggaaattgtcagtcttcttcagcagcttgaagaaaggcatcccccgctcgccgagtcgtgagacgaaccggctgagcgccgctatgcaaccagtcagcttttggacgtctttttgggagcttggtggtttcatgttgaggatggcattgattttctccgggttggcctgtatgcctctctgagataccataaatccgagcaacttccctgacggtactccgaagatgcacttttccgggtttagtttcatcttgaaagcacgaatgcttgtgaaagtttcttctaaatccgcaatcaggtcatccttctgcttggtcttgacgactacatcatcaacataggctttaacattgccctgtctttttccgaaccaggactgggttagccagccagtcgggatgaaggacttcctttatgaagcctgctgctaacagcttggttaattcctccttgatcgcatccttcctgtcttgtgcgaaacggcggagtcgttgcttgatgggtttggcgtcttccttaacatgtaaagagtgctcaatcacctctctggggataccgggcatatcggatggtttccacgcaaaaatatttttattattctgaagaaaggtgatgagcgcgctttcctatttacaatctaactcagcgcctattacagcagtcttatcaggatcggagggatctaggggaatctttttcgtcttggcatcactttcttcggtcttcgtcagcttggttgcaggtacttctccctcgcttgccgtggttgcagccagtcagatctcttcgcgagcaagagtagtctcgtgggtttggaccatctcgcagctttctttgtcacatgtgacggcctgcttgatgtcgctccgtagtgatatgacccctcgagggccaggcatcttcatcatcatgtaggtgtagtgtgggacggccataaatttggctaaagccggtcgtccaagtatagcatgatatgctgtctcaaaatcggcaacttcgaaacaaacattttctgtgcgaaaactttctcgagtgccgaaggtaactagaagagtgatctggccgagtggtgtagctgacaatcctgggataacactgtggaagggtgcattactcggctttaattccgtgcgaggaatctgcatatcgtccagggtcttagcgaaaaggatgttgagtgcgctgccaccatcgatgagagtccgttggagcttgacattgcgaaccactaggtctagtaccagggggtaccgccccgggtggaccactcggtcgggatgatccgagcagtcgaacttaattgctgtttctgaccaccgaagatattgggacgtgttaggctgaaccgcattgatctcccgctctgtgagcttctgttttctcttggactcataagccaggggtccgccgaagatgtgattaagttctttgcgatgatcttgaaaaccagtcggggcatcgtcttcatcatctttcttctttgatgtgccctaatctccgtctgcaggtttgcgtgcgttcttgacgtattgctccgcgaactgtttgtagacgaagcaatcgttggccacgtggttggaattgggatgatgcggacattgagagttcattatcttgtcgaaggtgttgacgcggggacgttgtcgggaagatggagaggtggtcaccacaagttcttcgggcttacgcttgggatccttgtggttgttacttccactccctcctgtagtcgacgtgtccttctttggcttccaagtggtgcccgactgtttggacgcggtgatagcatcctcggctttggcatactcgttggctttttcgaacatctgcttaaccgtcctgggaggtttacgtccgaacttgccgactaggtcctcgtggagaatgcctttagtgaaggcggcgatgatgacgttgtcggtgatgtcggagatcttgttgcgttgttcggagaagcgtcggatgtaatcccgaagggattctccagacttctgaacgaagttgtagagatcaaactgtgtgtcggggcgttcaaaggtgccctggaagttggcgatgaagtgatcacgaagttccgcccatgatccgatcgtgccacggggtagtccgtggagccaggatcgggcggagtccgctagggccacaagtagatagtttgccatggccttgctgtctccacctgctgcgcggattgcgagtctgtagacggtgagccaagactccggattggtggtgccgtcatacttctcgattccagtcagtttgaagctgactggccaatccactcgacgcaggtcattagtgaaggcagctactccatccacgtcatcgtcataacgatttggtgaatgacggtgacctcgtgctgcacggcactggttgatcatgtcacgaaggtcgacgggacgctgacgaggtggagaacgaggtcgttcagctcggcgctccctgtgacgttcgggaagcgagtgaacagatcgttcgtcgtgacccctgctcctgcgactagatcttgtgccagtgacgctgaggcttggctgatgatgagggactcggctaccagtcggggtgcgggtgcttgcggagttgactggaaccgaggcagcgatcatggtcttcgtctggttcaagatgttgacaacatgatcggcttgattgagtgcgtcttccttgaggagggtgtcgaggagagtgattgctgcaaccgcgttctgctggggggtgcgaaagactgctgtcccgtcgacgtcttgttgcccaatgagctctctcgctcggcgcccagattcccaggcgcggtgctgtcgatcttcagcttcctttgcaatccgttcgcgatcttgttgctcccgctgtagtcgttctcactcctgtcgctgtcgctcttcctccagtcggcgacgttcagcttcttgccgtgcgcgatcttagtctgcttctcgggctcggcgctgttcttccgtttcgttgtcagccatgaatacgccgaagaagaggggtgtgtagttatcctcgtagctgtcgtcgaagttgtcgaagtcgccatggtcgtagtggtagccgaagtcatcgtagtcgaggatctcggttggtcgagaactgacgccgggggagctgaggtagccatccaactcttccgtcgagactgtcccaagaggttggagtataacgccaacctccctggatctagactggatcggggccgatgccagagctcgcctagatctccgagtgggagatgttttggctgtgaagacggcggccaagtcgtcaggaagtttcatcaagattgagggataggacccatcgtcttgatcggatcgtggaggaacagattggatctcatccgagtggcttgaaaccaactcaggagagatgatcttggagtaggcctcggccgagttcggaataccaaacggcacggggacctggtttctccccgactggtttgaatccgagtcaaggagagagatcttgccgaagtcgttggtgatgaagtcgaagctgccgaatcggaacgcctgcccgggagggaaggcgaagtcgtcgatgccagaaacgaaacccatcgtacttagtcggcgagaacttgacgcctcccctacctggcgagccaactatcgaaacaagatttcggcaataataaaagggggtggctatcaagctaggaaagtggatgggtttggagacaatgaattttatacaggttcaagccttcttattaaagaagtaataccctactcctgtccggggatgattccgccgagtgtgttattgattgtatgattgggagaaaaaagaatcgtgccccaagaggcatacggaccctccttatataggggaagggatccgtaatacaaggtacagtccatatcctaacggaatatgggattacagataaaatacaatcgtagccgactaggatcccgggtattttcttgcacggatatatcattgtagcatttcgcccgaaagtattctaagggtatcatatttatttaatcccgatggaagatttatgagagagaactatgctaataatttatatgttacttgtaataatcagtcttagcagtagttaatttaattcatggtagagtgacacaaagcagaagcactaaacactctcataaatactaaaactaagctaactagagaaagaataagaaaagaattcatccctatacctctattatacataaaactttagtatgtactttctagtatacaatcatatagccaataccccatgtcgagttccttacgacaatcagtcatggccatccaaccgaggctaactacggaggagtaccctccctaggaaagtaacttcggattatatactaacgtggaggaatacccgtactgagctgtcatcatcagcggcccacctctactgtcccgcagtatataaccccaaataatagtattcaataatttaagcaccacacttaaattactaaatactacccgacaatcgccgtcaccacttagaccaatcattaacatgatcattatacacacactaatgcatttcgcaggtaagcgagctacacaattataacaagataaatatatcgtaaagtcggtactcgaatgattcaaatgaagtaaagtaccgcaattgtatacaaaagaatattctataaatcgtataagtcttacaaaagaacaaaaagctactagagccatacccaaattcttctcaagactccgaggactaagaaaactattctactcctactccactagctctagaacactaactaaacttgagagagagctttgatcttctttcttaagtgtgtgatggagtcaagaaggtgagctccttaaatagcctcccaatgacggttatgatggttggaaaggtaggaaatgccctccatccgtcattggagttgaatctttgccgtccacccaaaaccttgcatccagcggcacttagttcggccaaaccatgggctggcccaaccggcccagattttggttggtggatctcttgttgggctttattccttgtgctgtgaattttgggctcatttgcttgtgttaattctgtgttgtcagcccatcatccctcaagtctgattctcgacagcgtataattgattgtttgtccattttctgtcgatcctcctccattttgtgtagcattctctgcaagcaaatagaatacaagttcaagtggaaatacattattccaaaacaaatatgtattgcaggtatagctagttctcctttattttagtaatattgatggtcgaaattggtctataacgaccgtcaacactggcggcaacgcggttgggagcgacgaacgacgacaacgatggaggacggcgacgatgttgacggcgacagcgaccacgaggagggcggcggccgacggcggttagggttagggtttcgattttgagtactttttttgcgtgcaggcgacataagccacccgcacgcaaaaatcggcgtcacccgcacgaaaaaaccatgatttttgcagacacttcggtgtagacgggcgggagatccacacgcgaaaacccttttcgatcgcacggaaaaatcgtttttgtggtagtgttctttttaggaaaatgcatgtcgatcttattataggttatttagcacgctttgggtcctctaatgtataggtatgccctaagaggggtataaactttacaaatgtaacactactattaataataattaagcatttgagcatgcaaaataataagcttgtattgcacataatagatcactgcatatacacaaatttaggaaccacatagtataaatggcagcctgcatgcagcttaacagatagacggggagaggggggggttgtcttgagatgaaaagtgtggagaacattggagtcgttgattagttggccacataaggaaattaggggacgtgatcacaatttgagtgctaatcacttgttttaaaagggagtaaccatattatatttgacgatcatagttttagtgataagctttcaaatctagttgtattataatcactactggaaaaacacttcttccagacgggctaaacctattttcacaggcggaccggtccgcctccaaccctacgcttgtaaaaataagtgattttcacaggcagacaactggtccgcttgcgaaaatagtttgcagtgttaaaaaacaaattgggtaccctagcttcccattcccaatccagacccattcccaatccaatccaaccaaatcaaattcacagaggcatcacaaaatcaaattcacagaggcatcacaaatttgaagcatcatagttcacaatcagaggcatcacaaaatcaaattcacagaggcatcacaatgaaaacaaacgaatcacgaattaacattcacaaattaacaaattaacttcggtggaagccgctgaagtctccaccctccttgccggtagccgccaccgccctccatgcaggcggtgccactggatctaggaggagggaggggagccgtcgccgcatccaccctcctcgccagcgccggcgccaccgcaactgtcacgtcctgataaattcatcctgaattaaaaatcattctctaaaaggaataatagaattaattaaaattcgaaaagaaattggcaaacactaaaatacgtactagaaaattcgaatgttgtccggagattttttgttaaattctccatggtctaaaaagagccctaaaattttacttgaattttcagagcaccaaaaatatttattaagcaacaacaacaattaacaaagtttactaaaaagaaaaactaaaaataaatcctccttcctcctttggaccaagtctggcccaaaatcctcccactctctccctcggcccgcggccaaagtcctcccttcctccctctctttctcttcctctccttttctccctccttctcttgggcctccccttccccctcggcccagctccctcctcctccctctccttctgggccgcccctcccctccctccttccctctcggcccagccgcccggcccaaaccaggccgagccgagccagccgcgtgcacgcgcgccgcacgcgcgctgaccgcgcgccccgcatgggtcccacccccaggtcgtcttcctcctcccgcacggcctcctctctctctctctcccggaaacctagcgccattgctcccccaaatcagtctcattcaaaccaggaattccaaaattgattagggggaattaatcctatttccctcctctctctttcccccttaattcccccttgattcgtgcttttaatcacccggaacgcccgcgccaatcccggccgctttccatggccgccggccgacttttccgccgccgttcccacctctcccgtgcccggctccctcccctatcctataaaatggaaccccctcgctccgttctatcgttttagccccttctcgagctcccccgcggccacaccatctctccccgcctcctcctcctctttcctcggtgccggccaccctccagccgcccctaccgcctcgcccgcgcgccgtccggccgtgccgtcgcctccctcggctctgcaacgctgcccccttcaccggcctcaccatcccctctcctgaagctcgccggaacggtgtcctcgccgacgtctagtggtgtcgccaccactccaccgcctccggccagctactattccttatcggtgcggcagctgtcgtcatcttctccttccccggctccacggcatcaccctccaccccgaccgctgcccgtcttcgtctggagaccgccgaccgccgcgccggcctctccatcctcctcgtcgtcaacgtcgcctccggcagccccttccgccgtgcccgtgcgccggccgacgtcgccatctcctcctccggcatcgcagcgtcaaggttgccctcggccttgcctcccctccatctgaacccctccgctatccgtcgtcgtcgtcaccgttcgtcttcgccgatcgacgtcccatcggtcgcccggctcgtcgtctcgctgcgccgccacagtcatcgtcatcacagcggcgtgttccacgccgttctcgtctcagtgcagccgctgccggctgccctcgtcgcctcctcgccggccccggtcgtcgtcgtcgtcgtcctctcgtcgttcccggtcgtcgtggtgttcgtccctccgtcaagccgatcgcgttcgccgcccgcgtttcgtcaagtgtgcagcagccccgtcattgtcttcgtcctcggccccgcgtcgtcaagccttgtgccggccgcgtctcgccttcgtccaaggatcgcctccgaagttgtcttctcaccgttcgtctcagccgcgcccgttcgtcgtcgtcgttcgcacgcctcgtcgcgtggtggtaaggatcaatccttcgctgcccgcccttgtccttttggtgttgccaccatgcccgttgtgcggttgtcggccccggtacccgtgtaccggtgtcggtagtcgttcgtgtgtgcgtgtggtgaccgtgttagtgtgtccgctcggtagccgcgtggtgttacatgtgcagcccgcgtggtgtctagtggagtccacttgtcggccactcgcctcggttgacacacggggtctacttccgtcgacccgtggaccgtctctgtgtactcggtctaccgtgatcctttaggttgacatgtagagtctgcatgtcaacaagcgcagccttcctgtcttttccaggttagcgcttacacatgttttataattgcaaaacctaattataataatccgcaaatctccagataacagcattaaacttcggatgatcatatcttggtcatacgaaccccgaatcgacccgttcaagtctcttaatgtttgttataacctaaagaaccatgtgctttctttttatgtattgttatttcttctttataggcttgtagctttgcttgtgtgcttcgcatagcttttgtcgttccggaggttctcgaagcgtgggtcgcggtcgtcgccgaaggttcggaaggccgttatctctgagcaaggcaagtcgcatcacccttgagcatattgaatcccagtttatggctaggatgggttgggaactatgtcacgtattccgtctgtatgccatggtggtatgtggcatgtggttacacatgaggaagatgtgtcttgtgggtaaagatgtacacttctgatcagagtaaatctattcgaatagccgcgccctcggttatgggcaaacctagcaatgtacccaagttagtggtttacttcttaaaattttcttaacaactaaaatatggaatggttggcctgggttggcttgggacgagctgggacccaggtcgagttgccagttcggtctgaatcatcgtaggccttggattaaggcaggttcgtgtgggttcacggccttgattaataacactgtgtagctctaggatcgtctttataaatagctttgggcaactaagtgacttttaaatgccgtttactgcaaaacctaatcccctatattattaccccttgtacccccttacattaatcatgcatctgccggtgtggcttgctgagtacggtggttgtactcatttttgctctatctttccccccttcagtaagagaagctttggagaagaagtcttaaggtggagtactggcttataccccagttgagcgcctgtgaagatggagccgtaggcccgctagtccgctgctgtttatttctgtttgtcaggccttaagtgttttttaaataatgtaaacattattgatataataaagatgtgccttttgtatcatgtttgtttggtgtaccccggcttttcctgggacggggattaatacactagtgttcgggaaaatgcaaattttctcggtcgcgacagcaactgccctccctcggccacccttcggccagatctggaagggtggggcgctgccaccgacaccaccgccctcccacggcctccgtccggctggatttgaaagggaggggcgccgccgccactgccctcccccggcctcccctggcctccctccggccggatctgggagggaggggaggggagccgtgcagcgctgccgggggtgggggccgccgctgccgaccccgcgtgtcgccgtcgccattgttggttcccgccacctgagggagagagcgctggtggtgagggagctgagggagaggacaggtgaggagggagagagagcttcggtgagggagagaggagactgagacttagaaaaattttgatgcctatttatatgcacgctaatttttgcaggcagacaacgtaagaggtccacctgcaaaaataaagtggtccgcctgcgaaaattgatttttgcatgcagatagcgcgtttcaccagtttacatttttatatgcggccatttggctccgatgaccaaacttgcctgtgaaaaatatactcaacatcggtaaaaatgttttttctagtagtgaattataatgtttacatagctagtatagaatatagaatcaaccaaaaatcaaacatgcccagttagctagcctcacacactctcgcctgtcacccgagttggtggcttcgaagccccctcagagccaaaaaaaaaaattctcatgcccttgcaagaatctcactacaatccgatggttcacaaattgaaagttctagagtcaacattattttttagcaaatctggttttcaaatggccgcaattcataatctcttctcccaaaagaaaaggtattgataatatctcatctatctttttttagaagatcaatctctcataagtcatcctttttggggggcgatttgtcatctattaaattagcttgtatattggtcaccatttagggcccattttgtgaaatggatcccataatgtgttggccgggcccctgaacataagcattcccttaaccgtaacaccagaaatgttgaacctcaaatttgcaaaaccggattaaattaggtcctccgtcagtataagtatccggtttcgtagatgtggcaattttttcttgctagaaatatttgacgtgttaatttgacctggtccactcgtgctaactagacatgtggcaaaaagaaagtgggccccacgtgtcatcttcaccatcctcccttcacatctctctcctctgctttctctctctctcacctcttctcccttcattccagatgattcagatgcaatgtagtgatctgtggcggagccatcaagtgtgacggagggggccaacgccctcctatctgacccccccttctacgtatgaggccatgtaaacattcagtcagctcattagcaaatctagaaaaaggtcagccaagcaaaaaacatatctataaaattaattaatgggatagattagggaagcaacgatcaacgcatcatgctcaccacttcagtttctcacgcatatgcaacagcgatgcacgcgtgtctccgtcctcccatcgtgtcttgccgttgggcatgcaccgacgaatgtggcctgagggctgatctctcttgcaatatggcaatacctaaatacatgacttttagttttttttctatccttaatccattagattgtagtcagactgagtactcggtttgtaatttcccatcttttcaaaataaaatacaagattcttatttgtaagattactagtagtttacgttgaaacggtttagcaataactaaagactagtttcaaattgccagtgatattattaaggagatagaattgaagttttttataggaccagtttatgcattgattgttatcgacagtgaatatttggcctcctttgctgccgacactggttaggtcttatggcttatcctccaacacccccaacctcaaatcccggcttcgccactggctgtagtgcctcctgcacggcgccagatcagcgacgggacatggcaggcattcactggttgtcgaggtgaccgtggcgcagaacggcagcaacaattattggacgattgttgttgccttggccgcagcgcccaagagcaagaagaaggcaaggttgtcctacactatccgtatcggggaggggacgtacatcgagtggcggagccatcgggggtgccagagggagccagcatcaccatatccagtagcggagccatcgggggtggcggagggggccagcatcccctatccgaccccccccctctacatataaggccatgtaaacatttacaaaaacgtcagctaagaaaaaaacatatctataaaattaattaatgagagagattagggaagcaacgatcaacgcatcatgttcatcacttcaggttcgcacgcgtatgcaacaacgatgcacacgcgtcctcctatcgtgtcttgtcgttgagcatgcaccaacggatgtggcctgagggctgatctctctggcaatatggccataactaaatgcatgactttgagtttattttctatccttaatccatttaatccattagattgtagtcagactaagtactcagtttgtgatttcccatcttttcaaaataaaatagactattcttatttgtaagattactagtagtttacgttaaaacgatttggcaataactaaagactagtttcaaattgccaatgatattattaagtagctaaaattgaagttttttttataggactagtttatgcattaattgttatcgatagtgaatatttggcctcctttgctaccgacactgattaggtcttatggcttattctccaacacccccacctcaaatcctagcttcgcaactggctgtagcacctcctgcacggcaccagattagcggcggcgcacggcaggcgttcgctggttgtcaaggtgaccgtgtcgcacaacggcagtggcgattacaggacgattgctattgccttggccgcaacacccaagagcaagaagaaggcaagattgtcctacactatccgtatcgggtaggggacgtacatcgagtgatagagccatcgagggtgccggagggggccagcaccccctatccactggcggagccatcaggggtggcggatagggccagcaccccctatcccccccccctcttctacatataaggctatgtaaacatacggtcagcccattagcaaatctagaaaaacgtcacccaaacaaaaaaaacatatctataaaattaattaatgagagagattagggaagcaacgatcaacgcatcatgttcatcacttcagtttcgcatgcgtatgcgacagcaatgcacgcgcatctccatactcccattgtgtcttgccattgagcatgcaccgacggatgtggcctgagggctgatctctcttgccatatggcaatgcctaaatacatgactttagtttattttctatccttaatccattagattgtagtcagactgactactcagtttgtgatttctcatcttttcaaaataaaatagaagatgcttatttgtaagtacgttgaaacgatttagcaataactaaagactagttttaaatttccagtgatattattaaagagctaaaattgaagtttttataggactagtttatgcattgattgttatcaacagtgaatatttggcctcctttgctacagacactggttaggtcttatggcttattttccaacagccccccaacctcaaatcctcgccaactggcagtgataccagggcaaaatttgctacgggacacccaaaaatcgtgtaattggctgtgagacaccgcaaaatcgtgacactgctcacagacactacgaaagttgtgaaattagctgtaggacattggagacaatattttataattttcgagacaaaaaaggtcagagaaatttctaaaagaccggattgcccctacgcgccgtagcttgtaaacccgactgggtctagtcgtcgtgtccatctcccccacccgattttccctttcctccccaatccttaaccctagtcgatggtggcggcagcgccgacgccggcggcgacagattcggcgctggcgacagcggtgacggcggagacctcaatggtgcaagcctggtcgaaacagatgcagcagagctccatgtcgctcacctgagcccaaatgatcaacacagaaaactaaattacataatgtgtttatgggagcccaatctgaccgataacactgaaattgttcagcactcaagtacctctgagcatgcatcgtcattggtactgtcatcaccgggcaaaggggatggcagggagtactttgtgtcattcaggattttcttctccctctccctgttggcttccatcagagctgcttccaggcaggggcagatccaacgtgggtgcagaggggactcaagtcccccctacacccacaaaactcatggatacctccggagcacctccttcaattttttcaccatgaatgataaattaaaggttcctaaatggctggaggttgaagaaactatgtaattgagtcccccaattttttgttcctggatccgcccctgcttccaggagagccttagcttctgattcaagctcaccgatgaacttaagtggggatggccacaccggctgtgctgatgtaaggttcagtggcagagcatgggcaattcagcaaaatgacaagtcaagtttgagaaaaacagcaaacacctgtgaattcgcaaaatgtgttgatcatttgggcacaggtgagcgacatggaactctgctgcatctgcttcgaccaggcttgcaccattgaggttgtcgccgtccccgtcgtcctcaccgtcggcgcctgtgccgaatctgccgccgccaacaccgtcgactagggttagagattggggaggaatggggaagtcgggtgggggagatggacacgatgctgactgggtctggtctacaagctgcagcgtccaggggcaatatggtcttttagaaatttctctaacctcttttgcctcggaaattataaaatattgcctctggtgtcctacagccaatttcacaactttcatagtgttcgtgagcagtggcacgattttgcggtgtctcacagccaattacacgatttttggatgtcctgcagtaaattttgccaatgcggataaacattacctgcacgagctttctgttggaataaatgggctaggcccaatttaattcaattaaaatctcaagagcccacaagtaatgttagagagaataatactggcttgaaaatttaggtggaagaacctcaacttaaatagggtgatattagagattccctgttgaccggttgaggtgatggttggactgccacacgcatgcgcgcatgccaagtcggcctcggccgtgggcgtagcgaggcgaggcggccgaccgagccgagcctgcctgctgctcttccgttttgaaacagacgagaataaagtcaccattaacaaatgaaattcattgtgttgtaacctccacaacaaatgagagattcattgtgttgtaacatccacaacaaatgagagatttatttgttgtaaccttcacaacaaatgaaagattcattatgtggtaaccttcacaacaaatgagatttattttgtggtaaccttcacaacaaatgatatttatttgtgtggtaatggagatctctctctctctacatataacacaaggcagaggctctcaaagtatgtgtcttcctcctactattgttccttggcgatactctccttctgttcctacgctgtctctctgtttccccggttctgtttatcccacgtgcaagggtgatcggaacgagcaggtgcctccgaaactccgtccgcttgagaacctgcacgggtaggcgggcgatcaagtttttgggtggcgcttcaagcgcgactgctctgcatcatcttcaccaacatgtcgacaaccggtgacaacaccaacaatggagacaaggagaaggagcctctcgtcaacaccaacggaggcaatactgcctcaaactccagcggagggccattctcggggtataacgtttcactattaccgttcgttcttcgtttcctacaactgtctgtcgcagtattattgctttctcttatctatgttgttgcttattctatattaagcatgctcatgttgtacacatctagcactgtcactagatctactcaaattacaaatgtcatgtttattgtcttaatattttggattaaaatatgccgaattatgaccaaatttctaacaatccaaaaacttgataggtctttttcggtagttggctttgctgcattcctaaaaccacatgcttttgatggttcaaattataaaagatggaaagcacgtacacttttgtggttgacggcgatgcattgtttctttgtctcatggggcaaaccgagtgaaccgcctctctcacctaaggaggaggctatgttcgaggctgcggattgcttgttccatggagcattgatcagtgtgctcaccgacaatattgtggacgtgtatatgcacatgccttcagggaaggacatgtgggatgctcttgaggccaagttcggggtttccgatgccggcagcgagctgtatgtcatggagcagttctatgactataagatggttgatgatcgttctgtagtggaacaggctcatgagattcagatgttggcaaaggaacttgagaacaacaactgtgagttgccggacaagtttgtggcaggtggcattattgccaaactgccaccttcttggacggactttgctacttctctaaaacacaagaggcaagagttcagtattactgatcttattggctctttgagtgttgaggagaaggcgagggcaaaggacaactggggcaaaaagatcgagggaggttctagcgccaatttggtgcagaagaagaccctcacgcatcccacaacaacaacaagaaagtcaaacccgacgtcaaacccaaggctacaaccaattttaagaagaaaggcaagggaaagacaaaaggaggttgctttatgtgtggcaagtctgggcattgggccaaggattgtcctgagctcaaggacaagaagtctgcaaacatggttattagtgcgggctgaggaacatcgaggtatggtaaatttttacctacagttctctctgtctatcactcacctgattggtgggttgatactggtgctaatattcatgtgtgtgccgacatttccctattttcttcttatcaggtcgggagaggttcctccttgttgatgggaaatagatcgcttgcggctgttcatggtgttggtacggtcgatctgaagtttacttcgagaaagatcgtgcagctgaagaacgtgcagcatgtcccttcaataaagaagaatctagttagcggctctctattgtgtagagatggttttagacttgtgtttgaatccaataaatgtatcgtatctaaatatggaacgtttattgcaaaaggttatgacagcggaggcttgttccgcttttccttggatgatatgtgtaataaagttgtgaaccatgtaagcaatgatgatgatgagtctaatgtgtggcattcacgactctgtcatgtgaattttggttgtatgacacgcttagccaacatgagtttaattccaaaattcactttagtcaaaggctctaagtgccatacttgtgttcaatcgaaacaacctcgcaagcctcacaaggcatctgaggcgaggaatttggcaccactagaacttgttcattccgatctgtgcgaaatgaacggcgtgttgactaaagggggaaagaaatatttcatgacactgatagaagattgcactagattctgctatgtgtacctattaaaaacaaaggatgaaacattacattgcttcaagatctataaggctgaggtagaaaaccaattggaaaggaaaatcaaacggttgaggtctgataggggtggagagtatttttccaatgagtttatttctttctgcgaaaagtatggaattattcatgagaggatgcctccctattcaccccagtcaaacggggtagccgaaagaaagaaccgcactctaactgagatggtgaatgccatgttagacactgcaggactttccaaggaatggtggggtgaggcaatattgactgcgtgtcatgtcctgaatagaattcctactaagcataagaaagtaacaccattcaaggaatgggaaaggaagaaattaaatctctctcacctgcgcacatggggctgtttggccaaggtaaatgtacctataaccaaaaagcgtaaagttggaccaaagaccgtagattgtgtgttccttggttatgctatccatagtgtgggatataggttcttaatagtaaattctggagtacccgacatgcgtgttggtacaattactgagtccagagatgccacattttttgagaatgaatttcctatgaaaaatgcacctagcacttctagtcaagaacccattttatcccctaagcactttgtgccgatagaacatattgatcaaacgcttgaggaaaatcctgaggaggataacattgtagcaactcgaaagagtaagagacaaaggactacaaagtcttttggagatgactacattgtatatcttgtggatgatactccaagaaccattgaagagacatattcatctcctgacgctgactattggaaggaagcggtacgcagtgagatggactcaattatgtctaatggtacttgggaagtcgtcgagcgtccatatgggtgcaagcctgtaggatgcaaatgggttttcaagaaaaagcttaggcctgatggtacaattgaaaagtacaaggcaaggcttgtggccaagggttatacccaaaaagaaggcgaggactttttcgacacttattcaccggttgctcgcttgaccatgattcgagtactactcgctctggtagcctctcatggtctactcgtccatcagatggatgttaagacagctttcctcaatggagagttagaggaggagatctatatggatcaaccagatgggtatggactagaaggtcagaagggaatggtgtgcaagctgttgaagtccttgtatggtctcaaacaagcgcctaagcaatggcatgagaagtttgcaatacacttacatctgctggctttgttgtgaacgaagatgacaaatgtgtgtactatcgctatggtgggggagagggagtgatcttgtgtttatatgtcgatgacatattgatctttgggaccagcctc

SEQ ID NO: 59630 - DNA, 2370 bp, Oryza sativa
cgtgatgcacctcactaagaacctgtgcgtaatccttcttggcttcctaggtgtatacggaaagtcgaaagatacactggaagcacgtaatgatctgaagcatatggaacaacgtggcgaccttcacccggaaccaaagaagaaaggaagccattacttgagtccagtcagctacactcttagcaaggcagagaaggaaagtatgtttgaatgcttggaaagcataaaggtaccgtctggatactccacgaatatcaagcgaataataagcacgaaggagaagaagttcacaaacctaaagtctcatgactgtcacgtgttgatgacacaactgctaccagttgtaataaggggtatccttccagacaatgtccgggcaacaataacaaagatatgtgcattcatgaacgcaatttcgcagaaggtcatcgatccggatagattagaagcccttcagaatgaagtggtgcaatgtctcgtcagttttgagttgatatttccaccttcatttttcaatataatgacgcatctgctttgtcaccttgtgaaagagatccgtattctcgggcctatgtacctacacaacatgtttcctttcgagaggtacatgggcgttctgaagaagtatgttcgtaaccgtgctcgtccagaggcaagcatcgccaagggttatggaacagaggaggtcatcgaattttgcgtagaatttatcgaagaccttcgcccaatcggggtacctgaatcacgccatgaagggagactacggggaaagggaactctcggaaggaaagcaataacgacggtagacaacaatttattccgtaaagcccatttcactgttctgcaacactcttcattggtagctccttacatcgaggagcacttggctctagttcgcgccaggaacatcggtaagtccgatgcatggattacacggcatcacattgatactttccccgcgtggctacgacaacatctcatgggtaacgagtcgatcaaccaacaacttgccttcctggcgaggggaccgtctgggtcgatcgcgacattccagggatatgagatcaatgggtacacattctacacgagagcccaagacatgaagagcacgaaccaaaacagcgctgttcgtgtcgatgccatgggacacgatggaacaactgccacgtattacggtgccatcgaggacatatgggaacttgactatggtcctatcaaggttcctctgttccggtgccaatgggttaggttgactggtggaggcgtaatgattgatgacagtgggatgacaactgttgaccttaacaaggttggatactcggacgaatcttttgtccttgccaatgatgtaacgcaagtctttttcgtgaaggacatgtctaacaaaggaaagaagggcagggggcctgatgagcctaagcgtcaagtggttctcccaggcaaaagaaaaatcgtcggagttgaggacaagactgacgaggattacgatcagttggatgggcaaccccctttcacggtgacgattgaccctagcatcctcctatcaaatgaagacaccccttactcacgcagcgatcacaaggagggaacaatagtgaggagaaagtacgtgccgtaattattgtgtacacgatgtaaactattttggatgtattgattatccatataaatcacgcaagtggcaatttcatatgttaattagagtttttaacatttaatttactatcattcatatgctaattataattgactggagaatttttaaaagtattaaatttaatatatttttaaaactatcattcatatattagagtttttcacaatttaatttactatctttcatatgctacttatatatgactattcgaatttttaaaaggtttaaatcatgcatgtggcatttacatatgttaattagagtttttagcatttaatttaatataattcctacgctaagtacatatgatgattacaatttttattaattttaaatcatgcagtatgtacatacatatcttaattagagtttttaccaatataataatatcattcatatatatgctaagtatatatgattattggaatttttattaattatatttgcttattacgatttatccacttaatttattacagacaaaaataatttttcgaagtaattgtcattaatctttgtactttaaataatgttaatgcattaacttctattttataaacacatatgtaagcgaaaatcatatgcagtgctataatctttagtcccggttcttaaccctaaccgggtttaaaaagaatttcgaaatagcgggaaaagatatttagtcccggttgttgagaacaaccgggactgaagatagtctttagtcccgg

SEQ ID NO: 59631 - DNA, 5985 bp, Oryza sativa
gccaaccgcagccccgatgccgccacaccgccgttaacgaacgagaacgagaacgatcgaacgactgagagtgagaacgaacacgtcaacgtacgttgccgcgagaacgtgaacgagaacgagaacgatcgaacgaacgagaacgatcgaacgaagacaagcgagaacgagggaacgaacgtgaatgagaacaagcgaacgaacgtgaatgagaacgagcgaacgaacgtgaacgagcgaacgaacgaggacgaacgttaacgtgaaatgctatatatatatatatatatatatatatatatgttacttcgcatttatcctaatacattttttgtatcttgcagaaaagacgtgttgtcggagtcgtccgtcaagcctgagtggaagagctagccctagaaggaattggagcaggcaagtgacgtaataatataaatgatcgttatatttgtaatgcaattaattaagattattagacctgtaattagacttatcatataagattgtgtagtgttctaatattatttgagttttaatataagattattttattgcaaattagacttagtatgacattattgactacggaattggtgcgactcctagcaattgactattgtagtcttaattagacttagcatatacgcacgaaacacttagcatacatgactattttagtcttagcatgtaatattatttgagttttaatataatattactttatttgtaattagacttagtatgtaattattgactacggaattggtgcgacaagtagcaattgactattgtagtcttaattagacttagcatatacgcacgaaacacttagcatatacatgactattttagtcttagcatgtaatattatttgagttttaatataagattattttatttgtaattagacttagtatataattatttactagctagggttgtataatatacgtcacctagacttagcttatatcacgatttgtaattagacttagcacgtaaggttgtgtagggttctaatgtacgacatttacacttagcatacatgacttagattgttaaaacataaatgtctcgtgacttagcatatgtttcttgtatcaacagatggctgaccgcgatgaggaacagatattgtacgatacaatcgcggagggaagcagccagtactggaatgaagaagaggggaacgaggatccaaaccagtacttgaacgaggaagggaacgtggagagggatgcggaggggaaccagcaggggcacgtggaaagggatgtggaggggaaccaggaggaggaggctagtggtagtcagccctccgttggacagaagagggcacgcgggcaacgaggtgcagcgaagaagcttgagggtcggcacatcataacggaagtggaagaagatggacgtcctagtgccccggccgaagccgccaagaactatgtacgtcacagcggttgggttgtgcgggataacgtgcctgtcagtacggtgtactggcgaagaacaagggcacgcggagatcatgagagctttgtcccagattcggagaaagagatgctgtggaccacaatgctcgagacattcacccttcctgcgggtacagaggacaaagtgaaaaggtggactctgaagaaaatggcagaacagtttcagaggttcaagggagatctgtaccagaagtatatactgaaggggcagacaccaaacttcgacacattcccaaagctaagggatcactgggacgagttcgttgcatataagacaggcgaacaagggcaggcgatgatggaaagaaacaaagaaaatgccgccaagaagaagtaccatcactacttggggtcaggaggctatagcatcgcgatgccgaagtgggagcagatggaggctagcttgattgagaggggtatcgaaccggcaacagccaattggccggaacgatcgaagttctggtactatgctcacggtggaacgctcaacccagctgatggctcactggtcttcggcgatcagatacgagaggctgcgcgacgactaacagatgcagtggaagcctcctctcagggcacgttccgaccagacagagatagggacgagctgacactcgccctgcagactccagagcatccaggacgaacacgagggaaaggggtgattccttggaagattggtttcaaggaggacatccacacgtacaggagtcggatgaggagcaagagagataccgaggcgaagattgcagacctagagtttcgggtatcgagctacgaactcaacatgcaagaggaggtggcaaggaaggttgatgaacgcatggccgcacatcggtcccatgatccccagccgaccattcctcctgcaatggtgagcccgtcaggaaaccgtagcagctgcgcctcaacggggcaggtaggatcacagagcatggacgccatgcaaacacaggacgaatcgacctatcccgttgatgacatcactcagcggacaccatgtgagctgcatattcctttcaagaacttatcaataaaggtaagatttagccattccgctagttgctgcttatatatgttgattactaataaataatatctcacaacatgaaggtggcgtcgggcatggccatcccaacggacccttcaggtacttaccactgcaggccgattccagcaggatactcgaaggtcgaagttgagttggtcgaaggcgcgtacgaggacctcgagctggattaccctggaggagacggtgagacgcatctacgagacacatgccatgccattattctatggcgcaagcggtacatcatcctccctgggcgacaagcggcgtctcgtgcaccatctcctccggctccgccatctccttgtcaggatcctgcaccgtctcctcctcatgctccgccagcaccgtctccacctcaggctccagcatcgactcctcctctggatcctgcaccgactcctcctcgtgctcctacacctactcccccgcaagctcctcttccggcaccttcaaagtcaagggtccccccagctccaccgcctgcccacacaagggcaacgaagaaggcgaaagttgacgccgccaagaacaaggacccggggtacgattgcacgcaagaggagcttgacgcttacgttgcatcagaagtcaagagacaattcaagcctcgaagtccagaaaagaagattcctatagaccccagtgtcaggaacttcttcaggggtatgtctgcatctgtcaaggaggccatcaagctatcggactatgagcgaacgctgaagaaagcatcttctggaaagtccaaaccagtccctcagcttggagagcaatcaaaccaggagatcgagccgttggtgaccggtaaagaaatgacgatagaacaatttattactgacaccggtctaactacggatcaattgctaggagtcgcaccaatcgaaaaggcggaagtgaaatacatgtacgaactcggtaaaccgcttgtcaagcctgagctgctgcagtccctacccacacaaatgtacaagttccatcagctgtacatggagatgagcgccaccggtagagagatgatcggagcgaggatcagggacacggacttcttgcaaggagatgacattctctggatcaatttcaggggaatctacgaactataccagctagacgccctcgacgtctctattatgagttgctagattttgtaagtatatcgttcagttagatttcttactatacgtctcctttaattaattaggtccttgtatataagtagactatagaaaataatatactcccttttatcgttgtagaatggagattcaaagggcccgacggcggagggttttcgatactggattcatcgaccctcggaaagtaaacgtcgcaatgctcgaccaatatccacaagaaacagaggacaatctcgtccatctcctgaaggcgcagcattacaagacgttcatactgttgccatacaacacagagttagtttaattttactgtcttcctacataccaaatttcattcccgtacgaacttgctaagtgtttcatatgtaatgcatcccacgcacattgcagattccactgggtgcttttactcttcgacctggaggcctgcaccgtcgacgtatatgactcaatggataaaaaagagtctacgtttgacaaggttttcgaacttatagacaggtaccgtcataagttcctttgttaattaagaaaatcttgttatgttaattgctactacgaatcatagctttaaactccatgtagggcttggtattggttccgtcatttggtccgcggcaaatggagagaaagacttaggcgaaagttcaaatttcctgtgagtacacatgctctacatttatatttctccgattcaaatacatacaagtgtatattaattagatctctcgttgtttgtcatttatttgtagtgcgcaaagcaaaagcagggaactaacttgtgcggctattacgtgtgcgagtattgccactgccttgcagaccaaatcatcaccacaagagagctcgatgtacgtacaaataaattcaaaatttcattacgtagcgatttcttgtttaattactaatcaatttcatacattcatatagcttattcgcatgagggataacctgaccacacacaaggaatttatcgcggcggttcaagaacaactcatgggattcatcaacgaagaaatccttgatcccaagggtgaattctactacgacggaaacacaattcaccggtccttagcttctgagctagcagctagtactactacgtcgaaatcgtagctagctaggacatataatggattgtaattaatatatgactacatatgtttctatatgcatgtgtacacattttctataatgtaaatatattttggtcatatatatatctatatacatatgcatttgcataacatatatatgtataaatacatatatattatgcatgtatatacatataatataatataatatatatatatatacatatatatatgtatgcatatatatgtattgaaacatatatatgcatggtttatactagatacaggtacatatatatatatatatatatagaccgttcagcagcaggggcaagctcaaccagaaatggacagatcgatctttagtcccggattggtactcccggtttggaaaccgggactaaaggggggttacgaaccgggactacaaagggtttctccaccagtgaaatattaagatgattgcttaggtttcagtcaataatttaatttagcaaggtaaaacgaaaagacaactattccatctaagtctagatgtatgaaaaactacaaataaaacctatctcatttggaaaacccaagacataaaataggatcaagcttttttggatggagagggtatttacaccattgataaaattaatacatacttaattactccaaggttaatagtaaacccaacagttagctattcatttgttacaacattaataactagccttatcacattatccaacaaaatttcttagagtcttgtgtgcatctggctgcatatatgcaattaatccttttcccttcttcctcctctcctcttttcttcaactccacacaaaatataaggtggcaactcttaatcaactatagtttacttatatcacttattatgtatgctcttagttgtagctgggcatatagcactagtagcattaacgcactaaaatccaaggaacaaccttttcgatgttttcatcagcatgacctaattatattgtcaaccaacaatcttcaactggaggagtattagatttatattccttctgtctatattctggacaggtctttgtccaagactagaagcaacaatattagagtaacagtacctgaaggaaagaaaaagtatacattgcaaaacgacgaaatgaagatggatcgtcaattcatcatactcttgtctacaaggggatgagaaaggacat

SEQ ID NO: 59632 - DNA, 6651 bp, Oryza sativa
gcgtccgcgcgttcgcggcgtacaaggacgcgaaggtgatcgcggcgccggagtcgtggctggacctccgcatcaagggctcccagctcagccagtacttccgccgcaagtgcaagcacgcgcccaaggggctcttcgcctaccccgtcgtcgtctccggccccggcgacggctcggcggcggcggcggcggcgaggtactcgctgcactgggtgtcggaggcgcaccggaacgggtggcacgtgctgctggacgccacggggctcgccgccggggaccggctgccgctgtcgctgcaccggccggacttcgtgacgtgcgcgctggacgacgcgcgcgcgcagccgccgtcggcggcgacggcgacggttacgtgcctgctcgtcaggaggaggtcgttcgacgtcacctccttaaagggagataattgaaacgatatgcagagctaaattactttgtccgtttcaaattataaaaacattttaggttttgtttcatgtatgtgcttcatttatactatgtgtaaataatttaaacgagggataaagaagccgaaacttatctctatctctatctttactattataaaattaaagatgtttttgccatgcgctttggtacgtcgtgaatccgtagcttagtttctgcattttccgattatgtatatctttctttcgtgtttcttattctattttcttctaccgagcgcaacgcagatgatcgatgcaaccctggggttgttctaccacacagctgacctctgggccgagcgtcgcggccaccacgggcggaaaaagtacaccgaaggtccctcaacttgtcatcgggataaaaaatatcctcgaaccgcaaaaccagatatacgagatctcttaactatacaaaaccggtcacaataggtccctcgacggttttgatcccggttttgtcctacatggctgctgagtcagcgtgggacccacatgtcagcctcctctttctttcccctctctcctatcccttcctcttctctctctcactcttctctagctctgggtaggctggcgccgctggccgacgggtggggaggagattgacagggcgaggcgggagaggaggtccggcggccggcgacgtggtagcggagacgacgtgggatcaggggagcaaggtggcggcggcggcgatgacgcgggagcaggggaggggcgtcggcgacggcgaggggagcaaggcagtggctgcggcagcctccattgcgcaggcgcagaggagggcattggcgaccgacgaagggaagacggtctttcttttcagcacgtcgccccaaacctttctccgcgaccaacgattggtgacgcggcggcggtggcggcgacgcaggagaaggagaggtggcgactgccgccatgacctcgccctcctcgacaagttccccttcaatgttgacttcactagcggcagtgactttcgttggtggcggcggccgacgagcggagagaggagtggcggccgaagcaagaaggacattgccaggctcgctgcatccatgcgcagggtggggagaggagcagaggtggagatggacgcgacggcggtgctcaatcgaccaatcaaccaagctgccgccgacgccgactgccagcttcgcgtcaactccttcctgcgtccaccaccggccccgaggcgacgcccttccttgcaggccgccgctactcccccgctctccgccgctggcgcgccagggcaagcgccgccgccaggatgctgaccccagctgcggcctcctcaccctcatcgccttgctcccctcgctgccgccgatgcccctcccctgctcctgcgtcgccgccgccgccttgctcccctgatctcgcgtcgtctccgccaccgccgccacgtcgccagccgccggacctcctctcccgcgtcgccccgctggacctccctcgtctcgccctagcgtcggcctgcccagagctagagaagagtgagagagagaagaggaagggagagaagagggaaaagaaagagcaggctgatatgtgggtcccacgctgactcagcagccacgtaggataaaatcgggttcaaaactgccgagggacctattgtgaccggttttatatagttgagggacctcgtatatctggttttgcggttcgaggacgttttttatctcgatgacaagttgagggaccttgagtgtactttttcccaccacgggctgagtgtccctctttttaactgatgggcctcatctgtcttgggtcacataattcttagtaaattatttcttggtttttctttttctattggctcagttcggggtcctcccctaatttttctttattgcttcaccccgtttcttccgaatgcatgtacactttttaaaaaaaatcaaaagatattataaaaattgaaaatgtttcagctgatacattggtacgttgtttgtagttgagtcggttttcaagtttatattgacttttagaaatacataagaaatcttttaaaaaaatacatgctaacttgggacgagattcggataactaattgtttcataattcttgccagaccattagaaagcaacatacaggatatggcaagcgtcctaataagaattccaaattagatataaatactatcaaaataaaaaaccccatagactttttaaatagaaaaaaaatcctaataatagtacgattaaaatagttttgacccgttgcaacgcacggatatttttttctagtaatatgaaatattgaaacggacggagtaagcactgattgccaagggacataagtgatcactagaatttgtgtgtatttatagatgatttatggagagaactgcagtgatgttttagactattcccaactcaatgactaggatggtgtatacaatattaaataagctgccacttaggataaaaaataatgtgacaaatgaataaatgaaaaaagagaagaaaaccctgtcttgcatgagacatggtttctacacaacatccaagacatcatgtgagataagtagcattaaatttaagtatagaatagtggtgtttgcattggaaaagtagtgtctagtactagtttcttgatgatgtggagtttatgaaactacgtctagtgtcttgggttgagactggcgttagagttcaattgcgagtctgtgagtggcaaaagagaaaatttatttgctttgatatctactctcttcatccataaaagcaaccatggctatctatctggatatgtaactcatgtccatatacatacccattgttgttttttttttctttttttttacgggtggaaaatgcaattaatttgggtgaattagtaagcttggagctttgctagtacatcacagatggttatgttggacgtcacatgtatacacggatgccggtgtaattagttaagatagttaaacatgatagcttacttgccatgttaagatcatagtactaataattaaaacttgtgttttgagtttaattcggtttgatatatagatcctggcaatggcattgaacgaagttggcgaccgaactggctcttgaaaagctgtctgatttcggcgacatacgacggaagaaacacaggccacatacattgcagggctgattttaggcgaggaaattaagttggaataagtccacattacgtccctcaccttcccatcgagttcaaatcacattcacctccaacttacaaaggccttgtttagttccaaattttttcttcaaactttcaacttttctattacatcaaaacttttctacacacatgaacttccaattttttcgtcacattgtttcaatttcaaccaaacttttaattttgacgtgaactaaacacaccctaaaccggtttaaatcagtagtatgcatggccagtttcgctgacgttacaagtttaccgagtctacctgtacgtgctgaataggtatttacgtgacaaataaaactaaaactgggacccacatcaatcggccggcttcggcgccgtgcactttgagaatgagcgcgcgctgccgcgccggaccacctcagctcgtcggcgacgagcggaggatcttccatgtcctgctgcacatggtcggcgaccctgattggccagaggtgggatcggattcatggcgtcctactcctccccagttggcaaatcctcagtggagtttgccattggtgtcagtctagcggcagcagaacggcgacaccgctctcgccgagaccaagtggaaaagggccattgattgatctcagacttagcttcagcatgtgcagagagtgttaaaagaaatttggtcataattcggcatatttaaatctaaaatattaagacaattaacatgacatttgtaatttgagtagatctagtgacagtgctagatgtgtacaacataagcatgcttaatatagaataagcatcaacatagacaagagaacgcaataatattgcgacagacagttgtagaaaacgaagaataaacggtaatagtaaaacgttataccccgagaatggccctccgctagagtttgaggcagtattgcctccgttggtgttgacgagaggctccttctccttgtttccagtgttgttgttgtcaccggttgtcgacatgttggtgaagatgatgcagagcagtcgcgcttgaagcgctatctaaaacttgatcgctcgcctacccgtgcatgttctcaagcggacggagtttcggaggcacttgctcgttccgatcacccgtgcgcgcgggatgaacagaaccggggaaacagagagacagcgcaggaacagaaggagagtatcgccaaggaacaatagtaggaggaagatacacactttgagagcctctgccttgcgttatatgtagagagagagatctccattaccacacaaataaatatcatctgttgtgatggttaccacaaaataaatctcatttgttgtgaaggttaccacataatgaatctttcatttgttgtgaaggttacaacaaataaatctctcatttgttgtggatgttacaatataatgaatctctcatttgttgtggaggttacaacacaatgaatttcatttgttaatggtgactttattctcatctgtttcaaaacggaagagcagcaggcaggctcggctcggtcggccgccttgcctcgctacgcccacggccgaggccgactcggcatgcgcgcatgcgtgtggcagtccaaccatcacctcaactggtcaacagggaatctctaatatcaccctatttaatttgaggttcttccacctaaattttcaagccagtgttattctctctaacattacttgtgggctcttgagatattaattgaattaaattgggcctagcccatttattccaacaatccccaccaaatttcatggctcacaggaaatgttctcaaaactgaacctgttagttataccggtgtttcgatggagactgttaagttgaacttccacctaggaaaagagctacaccagatcacaactgaacaatggactatgccttgaattatcagtcttgtgcgattcaggtttcactcaaacccttaactggtactaggctgtcgtttgcatcccctctgtttggagcgtataagtcatactcctggccttttcatgagtatctagagatcacccagatctcatagactgtgactaacagtcggactcatataagtgtgttccttctaaaatgttctgtaggccaacatctctgctttatgaaaagccactcggatcacattaaggtgtataccatcctaccatacagattagaagtgaagtgcatcatgaagataggctcattttagggtctcttctctcagctacacaatagtttgttttgccatctaaattcacgggatctccgatcacaatggacaggtttccactattgtgcaactctaagtgggtctcaagcccatctccctcgatgcacagtctatcacattacgtggtagccccttggtaaactgatctgccagatttttagccgtctggacatagtccaatgctatcactccggagtttttctgctttctgatagacttcagtcttcttttaacatgcctggatgacttcatgttatccttcgaactgttcactttaataaccactgtttgattatcacagttcatcaggattgctggtactggtttttcaaccaccggcaagtccatcaggagctcacgaagccattcggcctcaactgtggcagtatctaaagatgtgagttctacttccattgttgacctcgttaagatggtctgcttgcaagacttccaggaaacagcgccccctccaagtgtgaacacatacccacttgtggcctttatctcatcagcatcagatatccagtttgaatcactatagccctccagcacttttgggtacccggcgtagtgaattccatagctcattgtcccttttagatagtgcattactctttcaagagcatgccaatgatcatctcccagatttgaaacaaaccggctcaacttgcttacagcaaatgagatgtcaggcctcgttgcactagctaagtacatcaatgaaccaatgatctgagagtatctcaattgatcccttgctattcttcggtttttccttaataacacactgggatcataaggagtaggagctgcct

SEQ ID NO: 59633 - DNA, 12261 bp, Oryza sativa
tcctgcacccctgtccagtgattatatacatattgcatgcaatggacgataggatcggctctctgtcacgtctgatctcgatcttgttgttacaaattattctcaacacccagagaagtagaggtaaattcgactttaatgttcacttgattgaagcaagttacaattcgtcatgtagggttataatatctaccatcctagctagcttctcttcgtcaattcttcttccttgtttgaacattggatcttgaaacgaagataaattagttgagaaacatgactagaagcccaattatatccatacatttgacccgctggatagttttgtttggaagcaatgatatgatatgcaacatgtgggatccaatcattatttgattttatagaaaaacatctcaattgactatatatattgatattattcaactttcatatggtttaaacagttacatgctaaatctttggatattaatttgtcttcccaattactacataatcaattattagtaattatgacaggaatactcggtgaaactaattacctggccatttagtttcattgaaattagttaaattagataatgccccgcgttttgttgtgggatatatgttagataatggagaaatgatgaaatgatttggattgaaatattatgaaaatgatttgagaatgatgatttaccatatgtatgtttagttttagaatgaagtaaattatagatgtaattactatatgcttgcatgttgagctttgtattcttaatgggttgatgtggtatgcttgcatgtaggttttatgagtgctaataaatactatgcttccatattgagctttaggtgtttagtggaacataaggtttatagaacgaagagatatagattgtatcgatagccatggagccagctagctaagtaatttgatttctctatgttcatcctagtgaattcaaattatgtcatttggagctagctttcaagttaaggatgctgacctagttaaggcaatcctttaaaacttattgcttaattgtgatgtcattgggagaccaaaatatgtaatcttggtttacatgtgcatatatatagtaagcagtttaaaactcaattttagggttgatttcgaggtttttttttctattatagtttatttttcagtattgacttttacactgctaagaacatagatacataagttttccccactaattatttcttgttgtttaactccaatttcaaccgcttctcagcatagatgaattaatccaagcatttttttaaaaaaaacatccttcatatgccttatacctttttttggaatgttgcaattttttatgattttaggaaaaaaaatccatacttgagcaaaaacataaaatatatatactccttttctctgcatatcatcaatcaatcaatcgtcactctatctcagtggctgtcctgatagctgattgggccacatggcgcccttaagtttgcaaatagatccaaaggaaaaaaaatgctaagaggaaataaacacttggtaccagaaggggctagaagagggttaggagggtgaccaggttttataaaatcacgtggttattatgcagttatcgagattattacatgcgataaccttctcaatttttgaaaccacatggtatatctcacagtaaccgccgaactgtgaagggggggggtggtaatcccatcgaaagcggtttggtaaaaaccctagaggcgacatagataaattgatatagacaaactaaatactgcatcaatatttttgttttagaaagtgtgttgcatgatataacgttgtaatagaaaattaattagattataaaggaaaaggtacgaattacccccctcccaaacttttgcggtcatccgaattaccccccgaaccacaaaaccggatatttttcacccccaactatgcataccggacgaaatacccccctcaatccaatccgcggtggttttagcctacgtggcgtacacgtggcagtccagtcagcattctattttaaaaaaattgtgggacccacatgccatactcctcctccactcttcctctctcttctttctctcactctggtcagcggcagccgggggacggtgacgcgggggcggcggctgagggcggcggcctgggcgcggagctgcggcgccgccgtgctggtcacccacgacccggcgctccggccccacgccaagatggagctcggctgcctcgtgcacgccaacatcgctgccaacgacgacgcccacgcctgcacgctgcagcgggaggacgacgacggcagcggtggacggtgacgcgggggcggcggctaagggcggcggcgtcggcacagaggtgtgcgttggcgaggtggacgaggcccgcgcggccgcggacggcgtgcccgcgcgccacgagcgcacggttgtagcatcggagctgcctggcgcgcgtgcggagctcgtcggcgtcggcctccctctccggcggttgcagcggcggagccgcccggcgcgcgcggagctcgtcggcgtcggcctccctctctggtggggcagggcggcgcagaggcaggggggcacgaagcgtcggcggcggtgtacgcgtcgcgctcttcgccgaagctgtcgtgctggtccactggtccgcatccgcctcgtctcgcaccgccgctcaccacccgcctccgcacgacgcatccgccttgtctcgcgtcgccgcctcgctcgcaccgcccgcctcccccacgcgccgccaccatcgcccgccctccccgcgtgccgcccacccatcccccgcgcgccgcccgtccatcgcccgccccgcgcgtcgccgcctcgctcacgccgccgcccatcgcccgcctccacgcgccgcatcggcctagtctcgcgccgccgctcaccgcccgcctccgcacgccgccacccatcgccagccctctccgcacgccgcctccgtctcgctcgccccctgcctcgctcaccatgagacggtgatagtgagagaggaagagtgagagtgagaagtgagagagagtagtgtatgacatgcgggtcccataaatttttttaaatagaatgctgactggactgccacgtgtatgccacgtataccaaaaccaccatggattgggtcgaggggggtatttcgtctggtatgcatagttggggggtgaagaacatccggttttgtggtttgagggggtaattcggacgaccgcaaaagttcatggggtaattcgtactttttccaataaatgaccgttcaactttatggaccatgacatttctaatcgtgtctagcatattattaaaaccaaaagagggcatattattcaggttgagttgaacattttagagtagccaaattgaaagtgattgcataatcctcactaaggtacgaaattgtttgtcaaccaattaatataccatacaatatattaatattataaggtagatgtaactatgtaagaaaccgtgggtcatgtactgtgtgcgtacatcgtcactgatacagataacaggtacatttctccatgtatggccataatataataaaccataattgacctggtaaaactatagagtttaaccacagaagcttaattagctgaactctatctctgattagttggggtagttggtttctttacttgcaagttcagtaagtgacactcctgtgaagtaagtaagtatagtggatatatccatatcatgcagatgcaccttaatccaatgtaatagtgtcaagaaagacattgccataaataaataaatattattaagcagcataattaatcaattggactgcatctgcttaagctggtcaacgcgataattaattgatccatgtctgtctgtcgtttttccacaaccaggcaaagatttctggagatcttgtccctccattcctctcacgttgatttggacagaattcatgaagtgagtaaattaacatgattaaattagcttattgacaacgctagcttctcgttaaaaataactctccgaagcatgcttggtcgacagtaacatgcaagaatagacagttaaaatagacattcatccatccttgcatgcatgcgtttgggatttgcaagtttccttcttgaaaatgatttatttatcatgatcatgaacacttgttgattttctattgtagtagtagttttttttttaccactagtagttttactattgtaatttgaccacaagtttatttatgacaattgacaaataatatatatataataatcttacaattttccaccttttatcattgtatatatgcatatgacaattagtccaatatttagttatctgaatgacagcaatttccatagaatttcctagctagtccaacatacacgctgccggatcagatcattaactgcttctagagagtttttgtctatttaattttctttgggccagaagtctaccagctgtaattatggtacatcagcctgcaagacttcaattatatgcatataggtatcgtcatggagagttgaataaatgaacataactgtatatatatgttacaaatgaaaaagaaaagtatatgttacaccatataaatgtatgctcgagtagaagaattttatctttttttcctcatggttttgtatcaaagcaaaggtcaacaccatgacaagttacttaaccaaaatgacaaggaaaataattcaattaagaaattaattaatttgtggtagaagtccattattaacgttaattgtggcaacttgcttttttttaattatttgagatgtatatatctgaaactgagtaaatcactggtgtcctagcattgttgctgcttcatatagcatatccagactaagtaaatttaagctgagttctaacttctaagttcaggctggggtgggctatcatatcatttttcattagcaccattaccaaactactaaacgctgcaatttttttaaaaatcaaataaatatattttcaaattataataactaatacttaattaattatgtgataattactcatttcatttcccgtatcaaattttttttaaaaaatcaaataaattatgtgataattaattatgcgccacgtatcaattttttttaaaaaatcaaataaatatattttcaaattataataactaatacttaattaattatgtgataattactcatttcatttcccgtatcaggaaaaaaaaactcacctctaaactcacatttagctttagaggagcaagtttgttaggttgaactctttctagcaactcaaaatagcatcttcctcatttcccattagcacaattcctaaattaccaaatgacatgttttgtgtcgttaaaaaaaaagacatgttttgtgaaaaatttcaacatagaagttcttttttaaaaaaaaatcaaataaacagtttttcaagttaatacttaattatccatacgcaaattattattcttgttttgttttgtgtgtagggaaagatcaacccaatttgccttgtcgaacatacccctgatcaagccacacgaaaaaagagaggaggtcatgctaatttggccaatcttctacttgtcataggaggtcatgattaatgatcattttcttttctgattaatgaccctaatattaatatactagtattttagaacaagctaagcttagtcagacggaaaaaaaaaaggaagaatctggaagatatttgtacttacagtgggacccacatggtgacgtgtacgcagtaactccaccacagcaacttgcagtccaagatgggccaagctgccgtcgccgagggagcacggcaacctgcagctgaaggaatagtccaacgtacgtggcgctgacgtggacgtttgccagcacaagaggctggcagcttggcagctgacgtcatgtaatctaatggaaaatttcatctttgtactgtagaacttaagtagcttcaattttattaaccaccttgagattataaacattgtctccctctatttaaaattatttgttattctaaatttgtttttaagtcaaacatttttgacaaacaatttctataaacttatataatttaacatcgtaaaatttatttttttaccataagaaatattttcataacataaattgaaatattggtaactacatggatttctaaaaattaatcatcaacgataaacatggttgattaacaaaactagaacggcaatcaatttgaaacggaacaagtagaatgcttgcgtgtcttgtttcacttgtacgtcagtgaatttaatcaaacaagtgatgatgggattgtttgatcttattggcgatactgttgttaattacttggctatctcgaattctagatacattttttcttatactactactagctctgtccgtatcactccactacgatgtcatttctaatggatgaaatctttacctacgaactttggcgggttgagggcccccgtgccgctccaggcgcaggggcgacacgggcggcgaccaccgccgccttcctccctcctccgcctcgccgccgcccgagcagaccaccggaaaccgcgcggctgcgaggaaggcggcggcggggccttccttctccctcgaaggcgtgggtcggcgcccacgaccctgaccagatgggagcgacgacggtgcggcggtatcggtgtcggtatcggggcgtcgggctgggcgcgcggaggcgactgggtgcggaacgggggtggcggcgacggtgccggatttggcgtccctcacaagatccagcggtttggccccctcccgagacgacggcggcacccaaggaggtggggaagggagatggcatgcggtggccggggaaggtggagcagcagcaacggcgctcccttgcgtcgcccacccagggcggctctctagatccgggctgggggagaggtcggtgccggggcggcgcggagaccggcagggggcggcatcgcggtgggcgggcgacggcagtggccatcgatcaagtcgaagctgctcgctgatgggggtgcggcgatgcttggcaacgatgatatgttgtagtctctttcaaggagttatggtgctggccatgtgaaggaagtggctcctcggtggcttggctgatgtccattgttggacgtcggagccgcttttcgctttggcaactttcgtcttcagtgtcgctacggttgtgaagtcgacgctgctgggtcgctagggtgggtagctcggcaacgataacacctcttctgcgatgtgggagttgttgtgtcgcttttgtatttagcttggcattgacgtcctgtgattgggctcctccgtcattgttagttgtgtagcggtgggtttataattaaccgtgcagttgtatggttttcaggcctggttttccttataaagtgggtcaattctcttgttttaaatataaaagatgaacaaagttccgccttaggtttcaaaaaaaaatctttacctacttaaaaaagcgaaatctgcttccaaccaaaatttcatccgtccatcaaatccaagcgccgcttggtgattcattcgcgtcactctgtgtgcatgcatccactaacacccgattcaaactcccacgtgtgtgtttctattccgagttatacagaaatggattgcgacattttggatgtggattcagtccgattttgggggaaactgaaagaggagattgagtgaatcaaaagccctccactaattttggaagattgagaaagattcgacctgatttgatagggagcatcggctccagtatcgtacgggtacgagactgtcgttcggaggttgaagacgctggtgtagcgcgtgggtatagtttggcaacgagaggaggtagccgagtatgctagctgggtctgcggctccacttgttggctgaaccggagaggcagactgagcggaagtaagagttgttataccgctgagaaaacgtttttacttgttgcaacacactgacattttttctagttaaataaaacaagaaaaatacaattaccttggtatccaattattcatgctttaggtgcatggtattactctctccgatgagaaaatacatgacatatgggtttttcccccatggtctttgatgtgcgactttgctaacaattttatattaaagtaagcttacataatctaataaacttaacaggttgtaaaagtatatttcaaggaagatctacaatcaccatttttatgttttggttaaaattaatttactaacgaccaagtttcaaaatttaacctgatattaccaaagcatcgaatatttattaccggatggggtgcatataggagtattgatttctgcgttactttgctgtatgaactcctctatgtgtactaatgtctgactttatattttaaatgtgggctttaatgcttatcacaagaactggtggtatatgtgactcttgttttaattagaaccaccaaatagtactacttcacacgtgtttgatatgtcttcgtgaagttagtgggaaatccaaaaatcaaataattacctttatctgcaatatgctaggtcttagactcagtagaaatatgtttttgacaaagctccaattaagtctcacatgcgagtgctctttagacctaccgattggtgctgacattggtcgttattgcaaagttgtgaagatgataaggacaagatgaagcatgtcgaactttagagacaatggcgacacaaagttttgcgctctaaggtttaataataggctagacttatttgagcaggtttaatagcagagcttgtcgcctgcagtaaatttggccatgtcatctagagctttagtttataatacttcatgcagtagggagctgcactatatggtctgattatttgtcagtactttggatacaccaattagtttgccttctcttgaagttcacgtatagccagcgacaatataagcgttcattcacactctctttctagctcattgcttttgctagactcgatattttaccaccagtttaattattctattgtacctgctctattatattaccaaattttattcgtagccttatgtcccgcaaaaattgtaataattggtcgtgaaattctcaaaagttttgctcatagaattttcgtgaaacatgctaaattgcagtctaataaaactagacaacataacgggctttcacggcccagcccacgacatacccaccattggccatttgggcctggattgggcatctccgaatgacccactcacagtctcgctcgtcggagcagaagcagccaagaaaagcggcggccatggcggcggcggcggcggcggcgagcaccacgagcatgatgacgaggccgcagctgctccacctcttctcccgcttctccttcctcacctccctcccaggtcagcctcctggcctcttcttcttctactacttcttcacctcctaatcctgtgtccccttttctctaacctgttgtttttttctcttcctcgcctccggcttgcttgcagaggtcaaggcacggatcgccgacgccgtcagggacaagcaggtgggggatttgctcgccgattcttgaacgaacggcattcgatgccttttagctgttgggggaatttatcggatgggggtttctttgtgttcttggaataaatgaattcatgacatgctggattttatgaaccagtcttctttgggggtgcgattggaacagatgagcttagctagatatgtgagtccgtggattgccagagattttgcagaaattgttgtacttgactgtgtgaaattagcttagctgcacttattagtgaaaattacagaatgttttgatgttcctgtaggaggctgtagcggtgaccaccgagatacaggaggagattctccgcgagatgggaatcggtaatgctagtgtgcgttgtgtttgagaaatatgttgcaacaatctctgatgcaaattagaggttgatacactttgtgatgaaattgaaaacgttggaacttcattcattagaagctctttttctttttttggttaagtagctacttatatttgttgagttaattcacttgcttgaattgtcgatttcttgtatgttgtaacctgtaagaggcactggaagaagtgttcatataataattattacagactttagggtaatagagtggttcaattacataggatgcagacctaggaagagaacatctgttattgcgataattattcgttctaaatagcactgttgtcacttgacgtgatattttgaacatcagatccaagttttggtattggctgccttggaaaggtgaacgttatgtatgaggatgacatggaattgatggttaagttctatcagtttgttgccaagtaagcacattccaagcctctcgataattttagatgtgtggtttcatgtattagttatatgtttccatggtatttaataatatcggatatactaattttgttaaataatcaaccatctgcatactagagatatatttgaacatggttcaaattgatgaatctatctggtgttacttcaagttttcttgtagaaagagaaatttgatcaatcaattagggcacaaatcataatgaacagctagcataataagaaactgtagcaatacaccaatgcctgccatatggcaattggcaagaatagttagtggatggcatgtttgacttcaactgttgtcaactactctagactcatgttaatttctatcattcaatttgatagagaagagatggctattgatgaagctgagcttgaccctatagagtttgctgaaaaaatacatgctcagcataaattacaggaacaggtaaggcaaattcttattacgaagattttcaggaaaaagaaatgtctgtcatgtttgtttcagggagctaatgtcatggtggattactattacagcaactgaagatgttgattcagatgagaaaatataacccagagagccaatccgtcatactcgaaactgtatgtgctcttactactctccctagccgttttccatccctcaccgaaacatatctcagttggacaaatttatgaatttcgtccaagttcattatcagaagcaatttatgcttatttgtatctaatcatcgatgcagttgcgcaaacagttggagagtgctaatttcgataccgacgcgtcgatcttgactccggagcagatccaagagattgttgagaactagatcaaaaaaccatatcaacagctattgtgcatatgttctgtttaaatctgattgctgtacatttctattgctcatacaagatataccagcttaattaagtgttactcagctctcgccatggtttatggcatccattgtgttatcgtgttaacttttgtccacgtatagtactttctatacataattcaagattttataccccccaaaaaagatcaatcactgaaacaccactaagcgcatacttgtcttctgatcccattgacaagatcatggctactaacaagataaagctccaggaaggcacatgtgcttactgctagctcattgtgtgtattttcataacattttactgtatctaagattgacattatgatccacattacagtaaaattataacgagagttttttctttcatcacctagatgagcatgcaggtgcaggtaggcccaaagtgtgaccagcaacaacatgcattttttcccctcgaatctcttttaatttttgtttctttttatggtttaacatcgttgcaagaagcatcaaatcgacacacaacgaacctagaaacagcataaactcgttattttggaagtgcaatgcaggtgtaaaactgtccagtgggtaacttctgagctatcacgcaataactcgataactaacttgcaaatgtcttgcattagcaggaaaaatctgagggaaacatcaagctggagttgagacaggtcacattggccaatccattagtaaagcctgctccagggtaatcagtgatcaaacaaacaacttgtcctaagagacccttttgatggtcaaagaatctttttcatggttagtttggacataagggattaaactgtaaaatggatccaaaactttcctatctttccacaaccggtctactccaactccagaggcaatcaatcagactatcgcactatgtgagttgatctggggaggcagcagaaaggcagcattttacaacacattctcttaactgtaacaaaagaattgactgatcagtagacttgtctgatgttgatatttatccttgaattttgaatgtagtttaagagggctgcagga

SEQ ID NO: 59634 - DNA, 14249 bp, Oryza sativa
  unsure (1)..(14249): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaactgattaacttaaaagtctgtgcgattcaaggcatgtgagaaattaagcgtcttgatgcaattgaacttgataagattgtaacatcaaattttcttcatgctttaaggaaattccatattacagtagagatagacaacggcgccgacggggatagttagaggcgcatgaatcaggaggggaagggcggccaaagcgcttccatcactcttcatcgatccaatcgatctttggggtcttggccgagcatctgggtttaggattgatcggatttgttgaattcgtagacaccgcgtgcttgcctgcttagtccttgaattcattgaagtgccggaccatgtcgttgcggtcacacttcacgccataaaacttgcaccacctctcgtgtgtacgtaacagatgaagcttacaattacatgcatttttattagaaggtttacatgaattttataaataaataactcgttttaaaagtataggaccgtagtaaattttttgcctaataattttttttagcatgaccaaatttacttaagaatagagtatatacacatatacagaattcaggcttcgacaagaggctgctgaagtgaatggaggttgccacaatagcaactttcagaaagaaagacgggttacaataagatgttactcacctaaatctttgaaaaccctagcttcggctctgattctggaaacacacgcacgtttctcttcttccaaaccatccaacaaaccggcagtataagagtgtcgaaagcccttatgtagtcggtccgaaaaccctaccgcatcgttagcataataaatttcatacctaaagttaatgcgcgattgctatttggcacgcgcgcgccagctggcagcctccacgcgacgccttttttttcgattttcctttttctttttcgattttctcctatttgtagccttttattttcacattttttttgactttttttaatcttaaacatatgtgttttcaaaattttgagttgaaagtttttaaattttgatttgaaaagtttcaaatcttgacttgaaagtttttcaatccaaattgaaagtttcaaatctcgagttgaaagttttcaaatctgagtcgaaagtttttaaatatgggtcgaaagttttcaaatctgggttgaaagttttcaaatctgggttgaaagttttcaaatatgggttaaaagtttcaaatttgagttgaaagtttttcaaatttgagatgaaaagttgaaagttttcaaaatctgacttgaatttttttttcaaatttcgagttgaaagtttttcaaaattggacttcacgtatagatttcttatcaatctattagtaaaaagaaaaccttccagaaaaggaaaatattgctaattaccatcattaccgctaattacgatgctgcagggcgttgaggggggtacggctgcgtgctacttccgtagccagcgcgcgcgtaaaataggaatccccaagttaatgagaaaagcttataaacccattgacgatgatcaacttccattagaagattataagatgttactagaacatataaaccgttttatgaaactaaggagtggcagggaacaagattgctctattttttaactcgatggagataaatattattataccaatagaagataaaggacttatttgatacatgtaaactaagcataattttattgtcaacaaagaaatttttaactgtttactttctactaccaacactttgaagtcaatataaaaaaaatatgtaacgtgagagaattaacaggggaaaacatacatgtagttctaccactaatataggtgattatgcacattgaagatagtgcctatgtactccacctcatttcttacacttagaacaagtttacttataaagccataattctaaaaattaatacgtcatatgtaaccaatttaacaatctttccataaaatagttacatataaatatatactcatacacatatggttttaacccatgatatattaactctgtagctcacttttttctctcgctccttcacctaagcacaaatataatgtgacaatttttagagcccacttgcatcactaactgtactcgttcttagccaatttcagttccgcaaatttctgtttcatcagacactacgtgcttgtgtagttcccaacttttttattcaaacttctaacttttccatcatatcaaaactttcctacacacataaacttttaacttttttcttcaaactttcaattttgacgtggaactaaacctaaatcgtatctcgttatctagtgttagtttataattttggtagtttgaccgaagacaaacatacatcctccaaacatctagaggagagtaatttatagaggggagaatagtagaagtagctgattaaggtcctccaagcgaaatcggagtcgagtcttgcaagtggcagcatatttttgagatagaaaaacttgaaatgatgtacacagccagattttacacggtggccgccgcgctaaatccttttcccttcccgtagaactaacacagtactccgctccgcgtctagccgcgggtgacgtcagcaccaccaccatctgcttccccctccctccctccctcccgtctcctcccccattccatcgcatccgcatacaaaccccaaccctagccgtctccgtgctagggccgccgccgccgccgcgcgccgcgacccgagcgtcgccgcatcgctcgcttcccacccactcccccgagatcggcggcgttcctggtgtttggcggaggaatctgaggaggcggcgggggcgcggggggcatatggggctccatggctgaggatgcctgtgctgcgtagcgcggcgaggagggcccgagaggcgcaggagaatccggcggcggcggcggcggcggcaccggccccaccgccggcgaggaggcgaagggcggcgaggaggaaggagccagaagtcgccgtcgaggctgctccggaggcggaagaggggagggaggaggagatcgaggtcgcggatttggggagggaaggcggcggagagaagaagatggaaggcccggacagcggggcgcgcagcgccgacaagcaggccgtcgaggacgaggggaataccactccagtacctgatacggtgagatgttctcttatttgatacttgtgcttactaggcctgtgcgtggactggatgcagcaatcatcaaccaggcctgtgcgtggactggatacaacaatcatacaacatttattctatagatgcacccgtcatccgtgaagctaatttgttttcatcttgtaaagccggaggctaagcaagggttatgattgggaatttgggattgatagctgttccgaacacgtagatgcacccgtcagccgtgaagctaatttgtttccatcttgtaaagccggaggttgagcgacggttcacggttatgattgggattggtagccgttttgaacatttattcagtagattcacccgtcatccacgaagctaaattgttttcatcttgtaaagccagaggttaagcgacagttatgattgggatcggtagccatttcgtgtttgtatcccaaaagatcctagcttcagttgtctccatttattcaaaacgatttttttttctaatctgtttgttttggctttgtgcaggtccaggtgggcagttcaccaaagtatagagttgataaaaagcttggtaaaggaggatttggccaagtatatgttggccgccgcatgttagctaacggtccaggtgcttctgaggtatttagtgccagcctatttgtaaaactgtacttgtaaccgtggatggtattaacggttgaaaataaatatcgtgctttcgaatggtaggtggcgctaaagtttgaacatagaaccagtaaaggatgcaaccatgggcctccttacgaatggcaggtttacaagtatgtgcctcatgatctgccattatgcatagcaagttgcatgctatatataggtacctgacttttatcatggccatcgtatatacagcgccatcggtggcattcatggggttcctcgagtccactataaaggacgtcaaggcgaatactatgttatagtaatgacacctcattttgactactacgagagaaactgttttctttttgccctttccaaaattttaattaacttggtttatgaaaaatgtaggttatggatatgctgggacccagtctttgggatgtttggaataataattctcacacgtgagttttccaatttagctaacatttatgtagacttctaatttatcactaacatagtttgttttggttttcagaatgtctgttgagatggttgcgtgcatcgctattgaagctatctccatacttgagaaaatgcattcaaaagggttggttgccatctctctaattattattatcccctccccaccaaaatacattttatttcctctgttgtaatagaaaatgttttgcaatcgcagatatgttcatggggatgtgaaacctgaaaatttcttgctagggcctattggaactcctgaagaaaagagactcttccttgtcgatcttggtttaggtaactaaatcttcacagattaaccaactgctcgatcattgtctattcaattgttttaaggtagcagcagattgaggagtctgaattaattgagtttaatctatctttaaatggcagctaccaagtggagagatgcttcaactggcctccacgttgactatgaccagcgacctgatgttttcaggtgaccagatggaaattttatgataatcaataggcatcatttacattgtcgctagtgcttttatggataatattgaatgctctgtggcatttccttcgtaggttctgtttcctgtttttggttgagtcctaggatgcagccaaatcaggtcaccctttgtactggtttctggccaacaattattttcattcacttaaattttgttttatcttttttttccccgcattctgcttgttcctgtacaaccattattcattacttctcaacagcactaaatgcggctggcactggtgctggtcaatcactcctcactattatgtttggtgactggctgtttctgcatggaaatagagccctaatttctgtcttgaatgccaactcattcttcatgttgtaggcttatagcaaatcagtaactctgccttgcttttgctgctatttcagggggacagttcgctatgctagtgttcatgcacatctagggagaatcggtagccgaagggatgatttagaatctctagcttacacactagtttttcttctacgggggcgtctaccttggcaaggttatcaggtaattcgccggacccaccattccatttattctgattgtagtaatacatttaaataattgatagtgtgtgcctgcagggtgaaaacaagggtttccttgtgtgcaaaaagaaaatggctacgtctccagaatcattgtgctgcttttgcccacaaccctttagggagtttgtagagtatgtggtcaacttgaagtttgatgaagaacctaactatgcaaagtgtatatcccttttcgatactgtagtgggcccaaatccagatatcaggccaattaacaccgatggtgctcagaaggtacaatacaatcatatattgcaatctgttatactgcttaaaaatcatgactttggttgcactaatcttccttgtaatttctctaaagcttatacatctagttggccaaaagagaggtcgcttattgatggaagagacagatgaacaaccaaagaagaagatcaggatgggtatgcctgcaacacagtggattagtgtttataatgccagacggcctatgaaacaaaggtactttttcttatgaggcccgaaagttttagtttatagttagctatatgatccacctttgttaatgcagtacaatgcaacatacatgttctatattttgcaggtatcactacaacgttgcagattcaaggcttgtacaacacattgacaaagggaatgaagatggtctgtttatcagttgcataacatcttgctcaaatctgtgggctctaatcatggatgctggcactgggttcacttcccaggtttatgaactttcaccacattttcttcacaaggtgagtagcttgctccttgtttaactggtggaaaatcttagcaaactaatcacataacttttcaaggcaaagttacatataaggaagctcttgtatacattgtcaaatgtgattccatggttttctggtcatttgaaggaatggattatggaccaatgggaaaggaactactatataactgcacttgctggagcaaataatgggagttccctggtagtgatgtcaaaaggtaaccagttaaagcatgctgtttcagtgctattcctgtcttataatgtataaattattctttgactaacttagcatgcttttttaggaacaatgtatacacaacaatcctacaaagtaagtgatactttccctttcaaatggataaacaagaaatggagggacggtttttatgtgacttccatggcaacagctggaagtagatgggcagttgttatgtcgcgtaatgctggattttctgatcaggtagcattctttctgctgcaatggtgttcatcaatatttacatttgtttgacaatatgcatttgcatttattttacaggttgtcgaactggacttcctataccccagtgagggaattcaccagagatgggacaatggttaccggataactgcaactgctgcaacctgggatcaggctgcattcgttttaagcgtcccaagaaggaagcctacagatgaaactcaagagacgctgagaacatctgctttccctagtcaacatgtcaaggttcgtctgcttcatatactagtaacgtacttggcagtttttgccgttagtactttgctctgacagagtgatgcttgtctcgttccaggagaaatggtccaagaatctctaccttgcatcagtatgctatggacgtactgtatcctagaaatctggccatctagttgaagccatttcgagttctaggcttctagcattggtctctgctcagagtgcagcggcttatgtgatgctggcaagttctgaatgcgacttagcgtaccctgactatcgtgctgtcgtgaagatatttaatggctatcgttcttaattatagaagagcttgtacagtagtaaatgtttttgtagttcgtgtaatcgttcatgtagtgtactgttaattgtagtgcaaggcgttgtcagatgtgtacacctgtccgatatgattgaactcctatctaatcgtgtgaaagcatgaggttcctgctcgccaccttatgagctacttactgttaccatctcctcacctcacctgtgcgcaatgcgctattgctggcttgccgaaaacctcttcagaatacaaggttctctttcaacattgaattgattttctcctcgcaaaattaaagaaatcttttttgaaaatggtgtgttcgaaacgagacaaacgaccatgcataatatgtaactctaggctgttgctggcttgccgaaaacctcttcagattaaaaggtttgttctctttctacatcgaattgattttctcctcgcaaaattaaagaaatctttttcgaaaatggtatgttccaaatgagacaaacgaccgtgcataatactatatactctaggctagtggaacctgggatgccaggttgtttaaaatttctacattagactgaacataactacggagtagtactttccatttaggatctgggtccctctgaacttggggctcgtgaatagtcgtgacaattttatcgattatgcatgttgcatcaaggccttgcaccaccaatcaactagagtattcagttttactaacatcggaaggtcgttaccgtgtattatcaatctaccatctagggaaaggacctgtacagtactttatttgttaaacatcttcggtctaatctgcgtccttcagcagctccagcggtgaaacataagggcctgtttaggtcgtgaaatgaaaaattttatgtcacatcagatgtttgaccggatgtcggaaggggttttcggacacgaatgaaaaaactaattttataactcgcctggaaaccgcgagacgaatcttttgagcctaattaatccgtcattagcatatatgagttactgtagcacttatggctaatcatggcctaattaggctcaaaagtttcgtctcgcgatttccatgcaaactgtgcaattagcttttctttttatctatatttaatgttttatatatgtgtccaaagattcgatgtgatgtttttgggaaaagttttagcacttttttggttgttttactggactggtaactttgatgccttcatctcggcttggactacgaaagccttgagctttcaaatctatgatattttcatgacatgcgtactgaactcatcttactcttgagtttgattcccagagtccagaaaggtagatcgatcattttccaggcaccaagtttatagtgagcagtagtgactgacaaaaactgtacagacaaagccgagttgcatattcagagaacaggtcctgtatttcacaaatcacaacaaccaagtcgaatgcaagcttgacaggagaaagtggtatccaagcacaaggcaagcagccaccatgaactgcaggttcaacgggatgatcttgccggcatccgcgctcaacacctcgctcgccttgccagccgccgtgccggccgaagggaagcagtagaacaactccgcggaggcgacaccggtgtcgccgccgtttcctcggaggtcgtcattgctgtacgctggcttcccggccacgctcttgtagagcccaccgttgcatgcctgcatacacgcagccggaggaggagacaggtaagtaacgagagaacgaatcatggcgacgaaatgattgcagatgcgacgcgacggcgggcaatgtccacatggcagctctgctagttcagtcagtttcttgtttgcagacaatagaggcgtcgtcaactcgtcgcaggtagaaacttaagatttgagaaacggtttggagctgtaagagatcggacgcgtgacctggagctggtcgccgacggtgacgacgacggcgccgtccatgggcctgaatctggaccagcctcgccgggagaagatgtggaacgccgaggcgccggggcagaggtggagggcgagggcccgcgagcaccgcgagctccggaccagcatcctcaggatgtcgtcgtggcggatcgggccagaggcgccgccgctgcggtcgtcttgcctgcggcggtgcttgcggatgcagaggagcgagccgtttgtgtcagctccggcgatggattgcgtggcaacggcgccgcctcgctgcaggacgtccattattttggttgcggtttgctccagctgaatgaacaaagcgtctgctgtgttcctgggcacaaaaaaaatcaaatggttagtgttgtgagtttggactagacaaattatacaacgatcttagctcgttcttttggtccaaattctgacaatcacatcgactgtttgatctaaactatgtgacgaattctgcaaaattatcaaacctcgcatgtagatcgacatgctagattacgagttttttatatacatattatttctgaggaagacatgatcacatgagtacacagtaacagactaacagtgaagtacctgaagtggctggcgccactttggagcgcccaatttcccgccatttcttggcctccgtcaccaggcgaccaccacatctcctcaccgttctcatcgtctccgttgacctccacctcctccggctccggcgtcgctgcccttgcagttgcagctgccacatgacgcaacgctgctgagaccaagctccggtcgaccccatggccgaccacctggaagcagccaaacgcgacggctgccgacctcagcgcctccgccaccggaccgccggcctccggcaaggccagcaggcgcacgtcgatgaccggaggtgcccacgccgctttcttcttccgcgggacggccctctccggcagccgcagcaccgggactctggcggagcggcgcaagaacctgccgatctcgtcgtcttcgttgctatcggggcactcgccgtatgcaagagagccggagctactgctcgtgaggacgccggtgaccggagacggcggcggtgcccggaactccggcaccggaagctctctcggcctctgaagataggtaaccaccgatgcagtagccatagctgatctcatggcctcttagctttggcttgaactcttatgtgattcgcgttggcatggagaaatggtgcttgagttcttgtgttcttgtagggccatggattttaagcttctttttctttgtggaaaaggggaaatgataagaggagccagatgccagctagaaagagggagagggtggaaggcatgatgctgcatcagccatcattgtgtcagaggtgcaagtagatacactgtgtaccttcgaaatatcattctgcgttctttttaaggatattctggaacagcaaagcgctttgctttgtttcaactgctttaaatcaggcaggtttagcgtccttttgtcaggtcagtcctttattcttgcggttgcacaggtttcgttgaatgagaggatcagttcatcagtcacggtagaagtactccattttaccaactttgggctttcactttcatcagttcactcatatacttgtcagaactcaggagtaccgttgtaaaggagttatgagcattgcgtgcgatgtccataggcatgttttttctcagataatacagtacaaataaatgcgcaatctaccatgttagtggggatagctcagttgggagagcgccagactgaagatctgaaggtcgcgtgttcgatccacgctcaccgcaaatttaatcttctcattttttttcacagaggatttcctttttgctgcggatgtgttttgctaatcttctcattttatttttcacaggatttcctttttgcacagaggatttcctttttgcaggatgtgttttgctaatcttctcattttatttttcacaggatttcctttttgcaggatgtgttttgctaatcttctcgtttttttcacagggtttcctttttgcaggatgtgttttgctaatcttctcacttttttttcacagaggatttcctttttgcaggatgtgttttgctaatcttctcgtttttttcacagggtttcctttttgcaggatgtgttttgctaatcttctcacttttttttcacagaggatttcctttttgcaggatgtgttttgctaatcttctcatttttgatatttcctttttgcaggtgtgtttttgcagggtgtgttctgccaatcttctcattttttatatttcctttttgcaggatgtgttttgccaatcttctccattttacaggatttcctttttgcaagatgtgttttgctaataatttttttccacaatatttcctttttgcaggatgtgttttgctaatcttctcattttttatatttcctttttgcaggtgttttttttttggctattcttctcatttttgatatttttccccatgatttcccttttgcatgatgatctcttttttgcttatttttcttcttctcacaggttttgcctttattccccttccttttgctctcagggactaaaatttgtctcacagatgtccaggccactcactgacacacagggtaacttcttttcttctcacaggattacttttttcccctaacccacagcgcgcaaagaaaaacggaattaccgcatgaaagccgtgacaaaaatggtacaaatgttcgctgctcatcatgaatctttaaccaagatacgttgttgagtcgaccagcgaaacttatacagatacacagaaaacaccagtagcacctcctaaactaccccccgtgtgtttcagcgcaaaagttgagttacatcacagttgccaaacttgcatggatgcttcgtcagattctatttctaccgtcttttggaaggcttggctaaggatcctcctgtcgcctgcgcagttccaggtctcatgctacctgtttaatgaatacaagcttatcagtagaatgttgtttgtgggttccatttctaggtgttctcatagcaattattaaattttggcaaataccgagtactggtgacccagcatgccgaatatttttgggatatatacataccttgagttttcggaacaacctcccttggttttggtctagaagttgatggctgcccgttcttcgtgagaaagaatctggttattcttgatggcgctttatgcctgttatcatagagctcacccattaaacagtggacgtcattgttttcttaaaaataaaaacgaagtgtttttggtaatgcatatggagcaaaagaatgttgaagccctacatattttgcttgcattgtatgctgtttaagtcagtaaatgatgagaagaaaaaagttcatcacactgctagagaaacggtttttactcccggttatagcaaccaggacatctttagtcctggttgagagaaccggtactaaagttgcatagcaaatgaaaaatatatgtgggatgtgggatttgaactcaagatctctcgcctcagccctcactaaccatcccacctactacacacatctgacttgaatagagatgcttttttttttaactaaccctagaggcatcttaccaaccaggactaaagattattttttagtcccgattggtaataccaacccagactaaaaatgtttcgagggacttggagcatcttaagtaccggttcttaatctaaccgggacaatcattagttctccactagtgtcacaagcgcacgatggtttagcacaggagataaaggaaaacaggatgagtacatacgctcgttctgctgatgtttctgaagcaccagcaggagaatactcagtttcccccactgagcaaccatcgtcagatgcattatcttcagcttcagcttcaacggatcctgcaagcccagtatcagctagtggagtcagtgtgaccactattattttcatcgacaagcgtataattttgagtatctggtaagagctctatcactagagttcaacgctacttcacctgatagctgttggttctgttggcttgccacgggaagtgatgacaaaccagtagaggaagtagattgtctcagcaagttactgccatttctgtctgtcattgaattgggagatttggatttaaggagctgaagctgttcgatttccatatcttttcgtgctattgtatctttcaaagatgcaacctggacaataacacaattatgaaatcgaggcaggataatattaataaccaaaggtgaacggagaagctactgacaaaagtatattaacaagttaacaagtactccttattagcaatacgtgctatcaaaatacataataatgttatttttactcctattaaagtctaataatgtatgctcaccttttatttcagttcaacagaagaaacgtttcagttcatctttgaaactgaatattaagtgcttgctagggattataattcaagtaagtggcacacgaactttatatgattaatcagaggctgatgtgccaaaaaaaatacctgttccagcagctcttttatgtctttcccctctctgttacttctcgcagcacctaactcaactccagaaaccctttcagcaaattttaaagtacttatggtttctgaatatgattcaatatcagggtttatttgaacaaacattagtgtctttgcttgtccacctacaagaaagcgcataagttaggcaaactagtaagcctatccacgtacacatctatcaacaactatatgttacctaaagaactctgaagaacttgagttagcttgctgtttctatatggcacatgggcattcttctgggccaaagaaaaaatgacatctccaagagcag

SEQ ID NO: 59635 - DNA, 16678 bp, Oryza sativa
  unsure (1)..(16678): unsure at all n locations
atacatcataagactttctgtgtggggtgaaatctattagtagtttatcatgtatacctgtgggagcgactgctcctttcatttagagctgttgatccaactgctctatttgactgtccaatttccatcaagtctagtacgtctgatgttgatttgacagggtgtaaacttgcatcaggaactacaaggccattaggctgagaagtactccaaattccaagtgtttatatatgttaaggataacatgttagaccttgttttcacatgtttatccatgtcaatattaatagctcaatgaggatagatttgtcgactggaaatagaatatataaaaaggatatcttttttgtgcaatgtcatttgacagaagatcgcgaacttgctcattgtatatttcaaccatctgcactcccacctcatatgagaatgcatttttcctacttagagaaatatcaaacagatcatttaaagcacgatagttaacaccccagtcttctcttgatgtccctggtccactctaaagggtaaaagataagagagtcaatttacaatatccccaatgatagttagcagagcaagtttgctgtcttgaattaattaaacagtagtaaataccattgtgtatgtttntcctgaaccagtttgtccatatgcaaaaatgcaaacattgaatccatcaagaactgatctaatcaaaggttggatatcggagaaaacttcagctgtgagttatcaaataaaagcttgtgagcaatgttcaactgtatgccaaatttttttttctttaattaaattcctgctcttactaatatataccttgagaggaatgtgtaccgaacactttgttaaacttaaacattcgatacccttcctttccttgcttggaggggtttgcaataagaatctcgccattttcaccaatatagtcaattgcagttaatttcccatcttggccagggagaaatggtctaacacgacagtatactctgatgttgcctgataagtcatagcaaacattagagtgcagacaagggtgctatatccatagaatttgttccaatgccaataatactataatggtgtaacagaaatagaaattacctttcaattcctgcacttcattaaataacttctggttttcagcaagaaccttatggtaattttcagcagcatctactaaaccttttaggtcatgtcctatacaagattgaaaattaagactgagcacaagataatgtgtttatatggaacaatacaaatacaactatcatgaggatcagtgcaagtaccaatatttgatatttcatccctccatgtcatttgaagggcatacatttcttgtttaatggattgagatgatatctttatatcctacaatagtttgacaataaaaaacgtcaataaaccaaaatacaatgaaacataattaagaacacaaagttaagcagaccttgatagaaagtttctgattattcataaaactctgaaaaatgtttgcttttttgctccagagttgtgactttaattgggaagtagcctcaacttcttcaactttctttttggactgcataagacaaaactcagcctccttagctcttagtgtcaagtgttcctccatctgcctagcttttgtttccatttgctcacggaattgttcatgcatcctattcatgacttgcatctcttgatggaggctagcaattatattctccgcattctccttttcacggatcagccgaatcatgtcttgctctcctagttttcttttctcatcaatttttgacttctctacctataagaaaaacacataacatattaccagtaaataataataatgcatgcagtgtaaaagatttatttgagacaacatgtagtacaaaataacataagtaaacttaggtttatacagtacaaatgtgtgatgccaatacttttattaagtaaggtatttaactatttatgaatacttactgaagaaagaaaagtgcttgaaagaaaaaaaaaacgagctaaaacatatagcaaatgaatgaagacattttggataccttaactacctcaagccgatttattgccatctgaagaaggaaccacatagttatagtcagtattacaacaaaggattaactctgacaagcatttagaactctcagcaactttggtgtttacctcgttttcttcatttgttccatttactaatgtctcaagtgctttaatttttgaacgatacttatcctcccgtgtcttgatgatgctattttgctgcgacacaagtggtttgattcaggaattaaacacgcgtgggaaaaaagagagatagttcaaaactaatattttttagatcaaatgttgatccgatgatcagcccagctttactaacaaagaccaaaggttcaatcaaaactaatattatccttacatttctaatgtgatctgcttgaataccaatgcggtgctcaatctcctgaataacattccttagtaaatgaacaacacgctgagacaagcaagtcaaaccatcagtaacaaaagataaaaagacactagtatttcattaaaaaaacgaaaatcaaaagaagtacacatacatgtggtatttctcctcttttcctctcaatactttcatccagaatgccattaacaactctaagaagggattgggtaggggcattctgagataagaacatatataatcattaggtaaggagccagtgaaaagaaaaagaaaaaggttgcagtgttaggatacactatgctaaagattttacatctaaactatttgaatgcagcatctctgagatcttagcagcaggaagatctgtgtaggttccatgcttaaattggacaacctcattgatcttttgtcctgcaaaggaaggaaaacataactatatattaacatcacaaggctcctaagtcaaaattggagagaaagagaacttgaaagttataaatgttattcgattcacaaaataacacaagttaagaacattatatgtatggaattataagaaggtatggaagtcaagctgaagtcatgggacttgttagataagttttaatcagtatatcaatatgtaaaattcaaggattaatagaatatgctcccattagcaggagaaaaactcatgataatattgtttctttggacttccgaataccaagtcaatacagcattgatgctcaatattatctgacacctgatgcaaaaaaaacaaaggacataatatgtgtacctgaaagaagagggcttctttgctgggacttagggtatcttttccctggtgtggcaactgaaagcaccggtccatcagtttctcgaagttccagtttccttctgattggagtcttagcagtgctgttagaaatatgaccacccaattgtgtagccacattatcctttaaagccaagagacactccactatagaagacattgatccctgtaatcaccaaaaagaccagagttgacaaaaactactggcacaattgacaatcataacatgaatctgattcaatcaaagctttctgtccctgcctcttacgaatatctgagtacatcaataaccataagcactaggagcaagcatctgagaatgaggcacattttagtgaatactcttgcaactttcttcctaggctaaataggactccatagcagagtctaagatccagctatccaaggccactccggttctgcaaatttcttgtactggtgcaacacttttcagcctttctaatagtctcagattcagtgctgatgttcaaatcaacagtcagaaaacttaaaaggacagttcataaaaaaatatgtggaaataatcatcttggtgaagtcatagactcatcatcactattccatgccaacaagattagagtacttattttctttccaataaggcactagtactgacaccaactatgttaattatattgtcctacaccttgacaaggagatgacatcattaagttggaagttggaacatatgctagtatcataattctactgtatactaacaactacttcacattactggagcaacctcacctcctcaagatccttcacgccaaagcctggcagccccatctctgcaacaacagagaggaacttcttcacatttgaccgttggtccgatgcataaccaccccacgtcccctgcaaacgaagccatatcagcaagagcagcttgcagaaacatatgtatcagttcagttagctcacctccagaacaccgggcatgagcttgtccgcaacatagcatagcgcttctccgttaatgaggtaatcccgcagctcctcgtccgaagaatccaacggcaaatcgaactccggcagtaacccgccgagccaatctatcacctccgcacgccgattggctagaatttgaagaaaaaaaaggtgtcaaccaaggaaacaaccgtgagatgcgtagagatctcaaattgagctctcacattacagtttactgtcacaaaacaacattttaggaacaaaagatctcattttgacctcccaggcaaagaaaagaaggcaagcgagatgcagggaaaaaaaaggggggcttcatcacactgcactggcaaaataggcaacccaaaacgatttaaacgccgcgcaaacttgactccataagcgccaaacctggagcataacatgaaccgaatagcaccggcctcccatttcgcgaaatttttcaaaagcattcattaaactctgaaagatccaaactttgtaggtccgcggctcgaattcgagccacttccccgcagcgagaagagaagcgagaaaccccagatcgacggcctcacccgcatcgaagtcctcgtactcgccgttcaccgtccccatgcctcaccgcccggggccggagcgcgcgcggggcggggaatgccggccgatccgggcccagatcgagccctccgaccgggtcagcgtcggcgcgaccccggatcgagcggcgccgaggcaatgcgggaggcgagccggcgcgagctccggggattttggtttgggttttcctcctcctcttcttccccgtgctgctgggtgtactgcgcttttgctcagcttcccctgctgtcgtttttgttctctttctccggtggttagttggggggtttgatttttttggctttcgcttgcgcgttaagcccgggcatgctcgagtactgtactgccatctcacgctttaactcgcgtcaccttaccggtcgtaggagtaacgaggttttttaaccctcgtgattttactgacaagcttttgactagtggaaatggtcaaacttttataacttagactatcaataactttaaaaatatttagttttaaaaaactagaacaacatatatatttgtcttttaaagtactaaacatgtatttatttattatatatattataatagaaaaataaggtcaaagatgtatattgtagaccgtgttattatttaaaacgttaattaaaatgaaaccagagggattatactggatagacgtaatcacatcagagttggtgccgcaggtatgctggagtattgcatgcaagatccaagatccaacatcgcaacgtgtacaaaagagaaaggagggaggcgtatgcagatgacgggcacgctggggaattctgcaagacagcaacagggcacagggcggaggcttttttttggtgctttctcgggacgcggcgctcccaacagacacgagacggacagcatcagtgtactgtctacaccagtacaccgctgccataggattgatgcgatgccgcgatcttaagtttaagatatgacccttttgcccgggtgatggccggcatcgtcagcggctgggtcgtcacgtcgcgcggggcgggggggtggtggggggttgttgtacacgccccactcggtctgcggcgctccccgtgatctcgtcccgctgcgtgcgtgcgtgctcgcacggctctccctgctcggctgctcctcctcgcggtcgcggcccaggtaggccgtgttcctttttaaaaaggatctgttgcgtctggcgtggtcgtgttgatgggcagccactactttttttttcttcaatgaatcagaaagaaagagattgtgctatttcgttatatataggaggaaaatacaatccctataaataaggtgaaaagactgtacagagctataaggatgtcgagaggagctcctgaagcttttttttctcctgtcagtgcctatacgtcattttccaagaaactaagtctacggggatacgtttatatattttttatatattagaaatatagaaaattaaggagtttttgtacgaaaatagcaatataatactagtattagagcagtccgttccatgacaatcttctccaattctctattctatttgacgaagggattataaattgggtgtaatcaagtgtaagactacaaattaatagtacacaaagcacaaattaatagtccaatcatatgtagttgctcctgatgaatgtgcgtcaacattaggagccgcatggggattgctagatgtcctagctgcacagaagcacttggatgtaacaaaaacgagaatatttgtcctaaactaatacaagcattgcagatcaagcaaggtacgttagaacactagagaagtggatttgcctaagataagatggtcaggagaacaaagaaaaatatgctcggtgcttcgatgctggatgttgtgcctgccttgggcggtggtggccctgataacctggccggttggcctccgcctcttaagactagcgatggaggtgctgcgcctgtgtggatgtgcacccatcagcgggaacttaggccggccatctcacggaggaggcctgtgccgccgggcgcggcggtgatgcagctgcacgcctgcacccggcatgtggcggcgacatcgctagggcgcatgatgcaacagtgcccgacggacggcggttctgtgcaacaacggcgaacagtgtagaggacgaggctgcagcgagcaaccgaacatgagttggggaaggtggcactgtgggagcgtagatttggctcggtactgggtggatttgatcgaaggagggttaaaacatatcaaacatgtatctgaattgttttaattatctgaaaatcaggaaattgctcgatacgtatccagacatatccgatatcgtatttggtacgaataaatggcctgtaagccatatccaggtaacgtaggtcagtgcccaagttcttgcttcctcctttatttttgccacaaggctaggtgtcgtaacttccttgtgttcaaacactcattggttcctttctttccagatttcccagaccaccagaagaatcaagctacgcagccctttcttaggaacctctcttttgttagcaagcatctcccaccagccttgtacagataggcaaggctcccattggcttgggtccaactgctggtaagccacccaggaggctaggagcgtccatactcttttggtgtatctacattgggaaagaaggtggagtgccgattcattcgttgttcggcagagggggcaatgggcgctgtgtggccatcctcttgttgcaagtctatatgaggtctagactctattttgaatgactacctaagcagtgggcagccactactcgtacgccgttctctcaatgcctgagaaataggccaatggagaagctcgacgtcacgcgatggacccaagccgtggatccttgtcgtgccgtgatcatctttggcgagcccccaatgcctgacgccacttcgcccctttgctcccttggttttcgatggctcgccatcctccatcctaatatcttcgattttcagtgcatcacctccgggtctctctgtgaatcgagctccctcacgtccgttccactccacggtgattgccatcgttcggcaccgaaagacgtttcggtcttccgggtgacttcgccgggagaattgcacaatttcatagggtcccttttcttagacctgacaaatcaccagttggatcgtaaattaggtggtgtttgaatcacctgaagatgaagatgaagataaagattaaatgtttcacataaaacgaggtggtaataacgtgtgattaattgagttttaattattacaaacttgaaaaatggattaatcttatattttagaacaactttcatatagaaagttgtcacacgaaacacaccgtttagtagtttaaaaaagtgacacttttatccaaaagtttatccagtttttgttggagaaaagaacacggcctgacactagatcctattcagggtcggctatcacggcatagatcgaggtaggaaaatgcacactgcacttttgcaaaagaggccctaattatcgaaggacgtatggcgaaaaaaaactatcaacggccgcgatcctattctctaggttcgcgtgaaccgtcggatctgatctcgatccaaaacggcgcaagggagatgcactttcacaaatactctctccatccataaaagtcacatttgattttttttttataaataagttgtacctatttatagcttttatgcattcaagacttaaatgaagagataaattaaatattttattagaatccaaggagccatctaaatacttattggttgcatatttacattcacttctttattttataacatatgatttaattttaataggtgtaacttggatggagggagtacaatcctcgaacgatagattatcgtatcacgctcatatcatcctcccctcgtctccgtcccgctgtgccaagtgcaaacgccggggcccgggtttcgccgtggcgcaggaacacggcggccgccggcgacgtgacccaagtttcgtcgacgctcaggctcctgcctcctagtacacggataggttgcctcgaaggctctggatcaggccgtgcgccggcgcgtcgcgtgccgttccgggtgttgcgcgcgtggcaggggctcctccgccgcgcgcggcgcatcgcgtcactcatggccgccgccgatcgaaaatccgggatggctcggttcgtagcggagcctttttccatggaatactgacgtgacggcttctttgcgaggcggtcgtcggcaaggatgcctttctgttcttccgcccatgtacacgaacacaactgtgcaaatgaacgatagattgattgaaagatccattttgatcccagaatctgaatgctttgtaaatcgggaaacaatttcagcatgcttcagagaagagaaacagggttggcagaacagaaccagaggcatggccaatatgagccctgaagaaaatgcattatgcacccatcatcactcagaccccgtaattcacagcctagagtgaaaagcttccgcatccgccacatgacgggcataagcaaaagtatcagtccaacacaaaacactggccactcgttatgtgatacgctctctgataaccgaaaaagcaccgaaatacacaggcacacgacgacgacgtttgctcaagactacatagatatcacaattcacacgctcagaacactgaagctatactgtaaaccagtaagtgatatcatgtttcatgctcgtattacttacacgatagtacatccagtctgtcatctcttcttatttcactttaatacttatacaagcgtatttaagtgtggcacatccattggctattgccgtagaggcgtcgggtaccgacaggctacaaacttatatgctggcctagttataatgtcagcaggaccagcatatcgaagatgctggaagagcagcagtgcgccttgcagaatgcgaatagccggttcttacatgacaggcctagtggcagctccagcggggccagcttgtcttagcagctgaaacacatatcaacacattcagagatactacaactatactagaggtaatgataaattttcatggcacagcaacggagcaggtgaagggtgaaggttacctggaaataggattctagtttctgcctcaggacagcatgctcccgcttcactttctggaaagacctcatgcaactgcatcacaaaatatggaaggcgtatagatattaaacagtgactgttttcaccgtgggaacataattgttcaatttcaaaaataacaatagtgtgaagtgacatatataagagagaccctacccttcaacatttccttggccacaactatccctgaacgacatgcactcattcttcatcctagaagcgccgatgctgcaccaagttgtgtaatgtcaatgatagatcaatgatacatcgaattaaaaacagtctcgtgctttctatacatcatgccaaatgagatcagaagcatgagatgcttcaaaaaggtcgatacacttcgagtttttagttggcaacagtatgcatatttagcggtcaattggccgattaaagcagatggatttctctgcagtatgaggtctcctcaaaacattattttaacttcagtggacatgcattaatgcatacagagcttttatgagcaagacacttaactgggtggtttcactttcatataaaccaaaagggagatggaaagctgaccaattaactgtgatatgcaagactttagatagaaagagatggtgcaaaagagagtgccttggcttcccaagatgcttaactaaactctgtatcatgtcagttcccatggttcatgccacaatgaactaaaggttggcgctgctgaatctgacaccctttgtgcatcatatgcactacaacaaagatattacatagaactagaagcaaatcaggaactacctggaacagctgccttttagttgctgcatatatgtatcccacctgttgaaatctcttgggtacttctccctgcagtgttttcaaatctcagttagtcagcccctcttagcaacatttcctgtgtagcctaaaccctacagatcatattttcagaaaaaatgtctcatgctgcatatggaacttcaagtactttttattacttacagagcttgctcaatgtttgacattagcctgcccgagtccttaaaaaacaaagtaacaacttcttccacaaaattaggactagcttcatcctgcaaatcttccacctgacaaaattgctcatctaggtatccctgccatcaaaatataatttgctgaatcagcacatctgtcaaagaattacatgaaagagcagtagaatactgaaaatgggatcagatgtggacacttccagcataagacctaatatggtcgacacaccctgagcacacataagattactgttgaaagggaaaaaaaagaactccagagaataggatactagcctgatcaaagaggctctttttcatggatgcagcttggcgacgcaaattagaataatccatttatatgaatgaatgaggaaatatgtgacaaagtgaagccgttacaggttggaacacacttaatgatgaacatatgacttgtgggagctatggatatacaaagtcgaacatgggatgagtttatatagtagagggaacataagaaaaagtgcagatattctaacttctggatagcaaaggttggcatcttgcatgcacaggtgatttgattgccacggtgtgcataagctatccatatttgttatccatattttggagaatgacttgaatagatacagatacctgtaggctgtagctctttataagatgtatgatgtgtaagtatgcatatgcatgaagaaaccattaacggttctgatatggatcacactcttcataatagtatatgtcactgcatcaactgatcaactgcccaaaggtagttatgttcctaatgtatcacatggaaaaaagtcatggttcagaagtaaattaatcatacacgtgattgttctaccattaaataagatgaaatccctacaattggggaactcataacagaacaatggtttggacataattctgttaccagccaaccacagggcctggaaggctgaatggagtctgtagatggtaggctgaatggagtctgcagatggtagtgttacattaactcctcaaaatgtttttgaagtagggctgttcattcccagttttgaatttaccattcaaaatcggtggtagtctgttttctggcatgctcaactagaagctaaggtaatcactgcctaaactcattgatttccagtttcgagcgggctgagtaaactagtaacacccctatttgatgatttagtacaaccaacgaggtattttgcacaaatgtagaaaaataatgctctcattctgttccaataaatactaaattgtagttcaattaatatctactaggaactgaagttaaaactacaaataaaactagtaactttacaccaatctcttctttggctattgattaacagctttgtaggtgaagaataccatcagctttaagtgaaaacttatcctaatatttcaaaagaaattatcttatgtaaccagacaaggaggggaaagatagaacaatatatctttttgtgcccctcaaagttcaaacaaaatgtggagataaaatctgagagaacgatggggaattagaataggcccactgatgcttactttgagccccagcaaaagaaaagtagacagagaaacaggcaccaacagttccttccaattgttaaaaaaccaagactctctcaacacattggaccacgtgtcagaaccaacaaactttcacaaaaggagtaaaagagattcattcaatcattgatccgatgattgctcctgacctccaatcaacatcacaacttgataagagaatctgacatggattaaaaaatatcgaaataaccaaaacacctatacagggaatggatcagaaaagacgcattctggatgagtcactgctgaggccacgaatgcgtgaactacatatcttgtctacatacaatctgcacagtcaataccttccctacttgatgtgtacatttataaaaggataaaaaagcatagcggtccatcattcatcactacagaaaaacatgccttctctttctatactgaacattcttatgacaacattgttcctttctgcaagatcattcttgtggcaaacatcacaaaacatcctttttacaaagcacggtgagggattgtattctcacataacataagacatatttcagtatttttttaaaatcttaacagcatgcttacaggtaaccatggtaacactctaaaagttgatacagataagacgtaggtatatagatggtaatgtttccctatgagttcatgcgtgacaagtccaatactccaatagtacttatggctccaaagttcatcaaaatgtaaatcagaaaattcctgtggtcattattttaggtataataccatgttgatataaacattagtttcagttgaaaaaaacaaatatgatactcaaactgctatatcatgcatatagatgagtgaggtgcaaataagtctcaagacaaagctataagggatttggcctttctcataaatgaaattatcatactatagcatttgctatagccttatgcccctctgcaaatggattaggcaaatggaaatgggagagatcaaagacaattttatatccatgcatcacatatctgcttccacgcatcaaggttattgacactccatggcttgtgcgtgaccacgttgtcaacaatccttttatagcatcaacacatgcactttcaacaatctaaaaccagtatcgtgtgcccaacatgacctagattttctcccagtaccctccaaaagtgtatatgtagctttatcatctacggttccccaaaaagagagatgcttctatggttgcgttttgtacgtatagtctaatgctccaatgcttttgtcaccttagaattggtttccatacgtgtgcgtctatttgcctcatatcctgctcactttcgaaacacatttggaaatcgcgaaaaatatgcatttaaaaacaaactatgataatcaattagattaacctccgccgtatacctcatagaagctcaggtagatctagaggtcaggctataactgagattatcaactagaaaatctcccaacttctcatgatgtataacatagcactggagtagagccacatgcagtgagctccaatagagcaaggagacactggagtagcttcatcaccagaaccaaaaaccagtgactcctttccataaaggaatacatgatgtgcgaaagaacccaacactaaagtctcgaagttcgatcaaatatccaagtttgcgcagcctttatcgttccagtactagaaaataaaaataacacggtatttagctataccggccagcttccttgattgattcgaggtcacacgagaaacgattctctcgagcgacatccgcgagggatccagcaaaggaagcaaggtataccgaccaatggggagccgaggggccgacacgattgattcctcgaaagcaaaccctatagttggcatccacccacgacaggatgagcgcgccggcctgatcccctccgctctcgcctcgacgtcgaccggagcgcagccgcaggctccgcatccgggggattagaccaaagggtggagaggccgaaaagacgcgcggggaaaaaagaagcggcggggggggggggggggggggggcattgcngtncctccnntgaaattgggagtgagatgaggggatagcccaggaccgcgagagtgattcgatgatgcgatcagctgtggtgtaaggggagttaccgcgagggagggagagacgacgacgactcgccgggcggaggagacggcggcggcgggggcctcgcgggtggcagcgttgggctggccggcgacgccgccgcgcgcggggaggtttggagagagggcgagctcgcggcgaaggctcgccgtgggtggtggcactggtgcggtggtgcccgtgccgcaggcccgcagtggcaagactggcaactttgcggcgaccgtggttaagtcaagtggctcggctaggcgttcgggccgggcctatggtgtgtggtttggagtcctaggacccgatgggtggaagaggattggcccgtgtaatttctatgcgaagctaggctgaattcagtccggccacccaggccattcaaggcctcttacaaatctcaaagcacgaatctgtcgtgcgacgccccgtaaatttttttttcatttaaggccctttaaatcgtagaattgagaaaacattggaatagaaaaaacatagaattttgatagaaatagaagtgtaaattagaggattgcaaaacataagaaaaaacacatgaatgaccatttgattgaaccgcagaaaaaacgtaggaattggatgagaaagatagactcaaaggaaagttaccaagaagttgaagctcttgctaaattttctctaaaatctctatatggttatccattccataggaattttaaaggattgaatatgattcaatcctttatttcaaagggcatcataggaaattttcctataggattgaaatcctcttaaatttctatgtttttcctccaattcaaaagggccctaaagaaacttaaaattgtgagaagcaaactgtttgatagttaacttgtaagaatttggtttctagttcattttctgaattctacaactataatttatcagaatctaaaccaaaagctgaaagagagtttctggttatgggataagctacaacagttagaagcttcccctctcttcctccccgaacaagccatttgattaccagacaaatagtatatcgtaatgaatcaggttcacagagttaaaatagactgcgggcctgtttagttcataccaaacttcttcccaactcccaactttccatcacatcacatccaaaactttcctacacacataaactcctaactttttttcaaactaccaaatttctccaaacttctccccaattttagaaactaaacacagcctacgtcatatatttggatatagactacgtgtccgtatgttaacagattaggtccatataaatagaaaggaactgtgattatttttcacatacgaacatactgcgcatgttgggatgagaggacggaagaagaactactccacttttaaactagtagatatatccatatctaaacgttaagattatagcaactatttaatctaaaaattgcctgttttgtatctttttatttttattttttatccttttttctataataaagatgaaagtgtaaaaactgaaagtatattgaatggggagagaacaataatgtctttacagtgaactgaaatttataatgaaatttcaacccctttaccttttgtttgttttaacatctcctaaattttactgtcctcgtggagtatctgaacttgaaaattcaaatgcctatgcatgtgaaaaaaaaataagaaaaatcaaccacttgctttttcccaactatatacagtttctaacccttgttttttagcttcatcccatcccaccatagtatccctaaaatttctcaaaccaaaaacactgtatttgaatccgggcgaagcgaaagcccgggaggaggtggaggccggaaaactctttcgccgaccttccccacacggcttcaccctaagccagtgagcccaggcggcggcggcggcggggcggaatggcggagccggactggatcctggagagggagcggaggcaggtggagcagatcctggagcttgacatggaggagctccaggtcgaggaggtcgacgacgcc

SEQ ID NO: 59636 - DNA, 16020 bp, Oryza sativa
gaggaggtcgacgacgccggctcatcctcctcctccgaagtcgacacctttctcaggtccaaacgctaaactcgcttctcctttgccatttccgctatccacccatggtttgcttaaaccgtgccttacactgttacacatttcggtgcgggagttggctttcgcgttgatacggcgagaggattgacgccgcgagagctgctcgttgctagcaactattctgaaatgaaatcaaatgttaagttgcgccttcccaaagtagcctgaatccagacagaggccatggaggttagggttggggaattttccacaggttaggatgaaaacagattagacaaccgcttgctaggatgtagaagttagacccggtttgtttaatgcttgtggctttccccaagttaatttgttcatcccatagggcatttccacactatttgaatagattgcacaaaatctactcagtttggcatcgtatggtacttagattttgctgatataactcagcaattcatgattttgctgacatgttttgggttttatggagtgatgaggtagtttacatgttacttacgttttcgcttaactaccattaatggtattcatgatggaatgtgcctttccccaacataccatacagtctaaatttttcacccctcaagttcgttggtaatcaacagatgtaattttttgccacttatttaattcttatttttacagaaacactcatggggatggaggatctagaacttctgaagcacttgcattcaatacgtctgtggtttcgctgcccacctgtgatggtggtaagcattcatgcttatgttagtatatttcctgattctagctgcaacacttacaagtttgtttccgcaccagaggttcatgatgccccaggcagatttgctttcttggatggtggtgtggttctctgtttaccaatgttttatcttcaaggtagcattcctataaccctgtgttccaacataatagtatagagcttatctcaatctaagctttaaacacccaattcaatctcaagtgttgttagctgatccatgtcgtgcctaatattgaatgctgaacttgctaaagttgtgtcctattgcaaaccaacaaagtatacatgacatgtacgcatccttgccattctttcatcttactcttgaacagtcacacatttagttggcatctgtaaacatagctgcctgtattaaaggctaatagtttgcaacttttgcaggtgttgttttgtttcctgaagctatcctgcctattagagtagttcagcctagatctttgacagctgttgacaaggctgtcaatcatgttgacgctccatgcatgataggtgtggtgcgtgtcacttgtccttgttctgctgcctttgttctagctttgtttttaatggcaattctccaatgtcaggttcatgtttatcaacacactaatgatggacaccatgctattgcttcagttgggacaacagcggaggtgtatttttcataaagctcattcaaactagaatgatatctgtgccttgaagtttcatcttgcatatttgctcatttctgaatttctgttgtctgtgttatgtttcccttttgcattttaatcttctgatcctccttttggtttcttttgtgacctattttgctgcaaaaacaccaaactaagatagagtttgcagtggtcaggtagtaaggtcggacaaaaaaaaaactaaaaaagagaaaagttatatgcttgtctgagatagcgtttgcaaatacccatgccattgaaaagatatacatcaattctgcagaaagagacgatgaattatcacaggacctgtccattcatttctagatatcacgtagtatgcacagctatagttgactgcagtcacaaatgtcttactaggacatcatgatcaccatatttgatcttatctgtgcggttatatgttgttccttctagttctatgctgcacaataatacaatatccttgggcacaaatatgcactacacacatgatcttcatattatagatatgaacttctataaattttataaatgagcccaacagatatgaacttgatcatttgaaatatggctgaagttatctttttccttaaatcatttatcttcaactgaactgtgaagcagtgaaattaataatttcttctggatagtcacatcagcttttgattttgttttatgtcatagatacatcacattaaacaacttgatgatggctcatcaaatgttgtcacacgtggtcagaaccgttttcgccttagacgccgttggatcgatgctgatgacgttgtaagttctaacatttggttgagaaataagatgttctgaactgcaaatgattgtcctatgaagtagtggtaagagagcatataattccattttattaaccatgggcagcaatggggtgaagtacaaattatcgaagaagatacacctcagagaactccaagagatgcatttggccagttagctacaaattatattttcaaccagtgtggcacatcgttactcagtttgggtacatcttgtttcagacaagatgatcatgtgaactctgatcaagattgggattctctatcatccactagtacttcaagtgaacattcagtaacagatgcaagaacatactgttcctcaaatgaagatgaagatctcatgcttgaacagtcttggcagaagtatgattctgtgaaaagaaatgctgaattagagaatccagtcaagcatagcaacacaagaggcaagggtgaaccttgctttcaatccccaaaatctttaccaacaaaaaacaaaggtgctgaacaacgcaggcggttctgtgctgcttatagttcaaagctggcattgcaggctccattgtcattttggcctcgctgggcttatgaaatgtacgattcatattcccttgctcgcagagtggcaggtattgaattatttcactacagctatttcaatccgttttgtcttgtattcatgcattctttagccaaataatattctttcccactggctaacatgtcatttgttactatgattaagatgtgatgtatgcatgacattaaattggttttgtggcagatttgtggagacaaatagttgtaaatccaagcatggatgattatgtgagaaaaccagatattttgtcatatcacattggaagcaaacttcccatgtcatgttctgtgagacaagaattgcttgagatcgatggtatctcatatcggctacagaaagagatccagctactcaaggcctttaacatcataagatgcagaaattgcctggtaatgattaattattttttaaaatgtgattccactgaagttctgatcataattcaagcttatttttccaattatccggtgttttaatcttgattgctgcagtttcacacttgcacttggctataacttgtgggcttacctgtctttggttgctgtcgcaaacatatggtagagttgtagttggtttgctacaccataccatggctgcaggataagcaatagtaacgatatttaatcataccgcttcatccagatatctgttggttgttgcctgtgttttaaacaaccatggtaccatactaccaggatttccgagagacagggttttgatcatcaaagcacactagtattctgatttacaggtgatatctaagtcatgattcagttctctgaatcattatgtaaatgacaaagggacatgttcttttaatcgcttcttctctacctctaaagggctggatctcactggttgatttaaactggatttgtaacagaacttcttggaatactttcaagttttgactaatatggcaacaattccatttcttgtcgcaggctcttatctcaagacgtagtgatggccctgtcggtgcttatgtcaagcagttcagctgtgggcaagagatgatgacagtgtacaatgcaactggtcttgcactccgtggcgctccttccaaagctcacagtttgtttccagggtatgattctaatatattctactaaactctattactcaaaaaaggtttgaaatccagcctatcattaacagaagaaatgaacattgttattcgttctgtttgatcccgttgttacttgcaaatcacaggtgttcagttagcagcaatttcctgtgttcttccatacgcaactatcatacctgcactctgttattacctccattctaaaatataaaagttttagggttaggcacatgcattaagaaagtggatgaaattaaatgaggaaagattgtgtttggttaagaaaataaagtaggtggtgatattaaaaggtgaaaagttgtaattggttgataagataatgtagttaaggaattatattttggaataaattttgaatgttagaagttatacttttagatggggagagtatacgctgctaacacaaagacctgtattttttgcagttatacgtggacgattgctctctgtgctgcctgtgagtccaacataggctggctgttcagggcggagaagacaaatctgcttccaaaatccttctggggattacgcagctcccaagtttcagatgacacacaatcaggacataactgaaccttaacagtaagtcagggccccattttgtaattcgtataggtctgcctttaatttccttataagattcttttttttttcaccgggaaggccgaaggaggccaaccgaatatattaacaagaaataaaagttacaagagaaaaaacatcaaaatgcaccaaggtgcattgccacacaccacgcgctaccacccaagcacaaaccgctgagggtgaaacctagcaccaaacgaccctcgctgagcgtggccgaacgccgctaggcctacggcaacaccacagagacgaggcttcgaaaaacgatgccaccatggtggtcacgacatccaggatgccgccatcgcccatctaaaaagatgtggtttttacctagagaagctcgccaagaaagggagagggtaaccctcgacaacgctccaaggagattacgacgcccgaagacgtagccgctgccggcccggtgaaccaccggactaagctttcgcctgggaccctacgaccttgactgcagatcgccgtccaccaactcagaaccaccacacggacaaatggcagcacgtggcatccaccacaccgcaccgacacccctccgtcggtcgacttcaacgaaccaccacccctgaaaactggcccaggactcctccgttccaccacccgccggccgcctcgccatatttggccgaaggagaacccgggactaggtggcattgcttcggcagcctgagcttcccccactgacgagctgccgcctcaatccaacctagaaactccccgcaaagaaggggaggagctccacgaaggctgagggtgccgaccggcaacgaggaagacgacccaccgccgctagctccctttgcactgccacttggccgccagtggtgctgctgcttcggaccggcgccacccgccggcgcccgcgaagtccggccgccgcgcctcacctggccaccgcgacggcatcccggctgcccagccaccacgccgagtcgccaccgaggcctggatgacccaccgcgccatgggctggcgccgggcggccaggccgagcgagtgagcgggggcgccgccgccgctccgggcaggcttagctgcccgccgcctccgagcgcccgccacctccgcgacccggccggccacgacgagccgcggccatccgccgcctgcgcccgccgctgacgaaccgcctctacgccgagccgcagctgtccgccgcctccgcgcccgtgccgggccggcctagccgcagccggccgccgcctcgccgccttgccaccggccgccaccacgaccgcatgccgtcgcgccacctcaggccttctcgcgccgccgccgggcagatccaggcgagggagggccggatccggccatgggggctccggatccgccgcctcctccccaccttgccgccgtagccgccatggaccacaccggtggggagcttcgtcgtcttcgtccttcgcgccgaggagggagacgctacgaagagaagaaagcctcgccgccaccttccctgcccgctgctggcttcgccgctggcgggctccagcggcggcgaggtggggagagggagggagagaaggcgcgggcggctagggtttttcgcccccgagccgcccgacgcgagagcgacgcggggatcaggtttttcccttggctcttttctcccctccttataagattcggtatgctagctttgctaatcgtgcggctttcttgtattagacgcgagagtttgtcaataacatagatgcctgcgtattaccccacttatcgtgccccagctgccatggtccagcatctggcacatgcccagaaaattgtacatatatcacagaatgtgccttgatgctttcgttaaaaaatgcaaaaacaaacatgttcatccgtgtgtggatagtgtatacacctttgttgcaatcgtacgagcaatgccatatacaaagtaaaatcatactgaaccaaattctgcaatagcagacttgggttatttattacatgatgacagggcaaatatgtacaagcacagttcagggataaaatgctactgccgtacgatataggtccaaccgcaaattattactgtaatacaagacagcatgctgtagccaaatgaagctgtacactaaggtgagcatcacttcatctataagaacggtaaatggggctgtacatgcagctctcagcgtacttcaccaagtcttttgggcgagggagatggctagccaatcctgcatacagaagtgcgaaataactgttggtatgcgagcatcttgttttagctagcgtgctaatgaaccacatcaaaaggaacaaatattaccaaggtcataggcttttgcagcaacgcgggctgcgatgttggctgatatcttcctgatgcaggaaaagggtggataaataaggcctttgtcaacatgctctggggtcacctggtcagctaagccttcagctgtccaatgccatgaaggcaaaaacaaaacaagcaagaaaacaacaatagcgtggttagcacattagtaaagtggatgggaaaaaaaactcttgggctcatatagaatgcatttaccagcagcaaggatcatttcatctttcacccttatcgctcctgaaatcactacgcctaggccaaatcctgggaatatatatgcattgtttgcctattcaaagggtaaagagtatgtttaaattgtcaaaaacctgagaactaaaattcaggtggggaatctctcccctccagtgatttatcaaaaaaataataataattgagaactgcacatgtcgtgcgcaaaggtaatatccctaacctgtgcaggcacgaaaagcttgtcattgtatttaactggatcaaatggacttccactcccaaatattgcacggccctgcatgatgtatcatttgataagttataaagcataaatgcttgtgacataatttacagaagtttatagttcatatatgtgttgatctcaatgggatagatcatagatggcgtgaggttgcacatggaatatcaccttactccatgaatatgcctgttcagcagtacattcagattgtgatgttggattggatagtgcgaggatgattggtctctgcattatattggaaccaagctttcagttcttgaatgtgtcattaatgtgacttattatgagtcaattatctgaagaggtcaatgattttattgttacctcattaattgaactcatagcctcaatcacctcttttgtgaaactttgacccacaccagctgaacctatcaatgcagtcggtttgataacctaaaaagatacaaatcagtctagtgtggtggtgcctgaaagaaaaatgtatactgatataatatgcatctcttatggttcaagttttgcaccttaacagcatccagtagatctttgactggttcatgctcatgggcatatcgcttcttaaagggctgaagagaatctttacgtgaactgacaatcaacccctgcaatgcataaatcaactctcaatggtccaattaccaaaggatgcaagttaacactgcgatatcattattatattaacctttgaatcaagtagccagatctttttgcgagcatcttccactggaactttggactgaaaaaaaatcatagctaacgattaattgagccatcatagacaaattaccaaaaatcaaattaggtgaagctagcaatcgagttacctgatttgatatctcgagagccactagttcagcaatgcctgtaccagcctgcaagaacaggtaatctatttggaacaatctataggttttacatgatagaacaaatttttgctcgtcggtgattaagagtcaaatcactaatttactggtggcatgcttagattattcactattcaagcaaaaaaaaaaacttttttgcatctcaactagcaagaaacagaaaaggtttctgaacaactgaagttttgaattgtgataagtcctattcctatggctaaccaactctactgataggataatcagtccaactatttatgttttttttttgttactgactatcttcaattattcattgctacagttatgacaggaatgtaaaagcaatactcaatgtatattcttataatacaatacgcgatgtatagatggatgttcagagttcagacatgttgcagcagtctaaagtaaatgtgagcaatgcagaatgcaccctccatatcactgaaagggaaggtcagcttacctctcctgcgccaaagaataagaatgtgtgatcagctaaagtcccactgacaaatttctgagcagcaatgaggcctgcaagcactacagcagccgttccctgtttacaccacagtttcatggtttactcctattgttgtgaaacccagtataaatgcacattcactagttcgctttcatttaggaactgtaacgagaccaatacgaagagtaaaaaagtgagatctgaacctactacctgaatatcatcattgaagacaagattgtttgcacggtacttctcaagaagggtaaatgcattgtaatttgcgaagtcttcaaactgtaaaataaaacaaattgaacaattgcccataggaacagctcatttacagaccaaagttttcctctttccttttaacatttccatacctggactagcaccttctgtccatagttctgcttaatagcagccatgaattcatccagaagatcactatattcctaattaaagaaataaaaaccaactttcatgactgaaatcacaaccatattgttacatatcattcatgaaaactgaatgagcatatccaagaaataagcatgaaacctggccagtggctcgtttttgtcttaatccaatgtagaactcgtccttcagtaaatcctcattgtttgttcccacatcaatggtgataggtaagcactggaatgcaaaatggtgggaaaatgctacatcaatctgctattctgctcattgctgaagaaaacaattgaaatgaaaataacttacagcagaaggccggacacctccaagggctgtgtatagtgcaagctttcccacagggattcccataccctatatatgttgcaattttcaacgaacatggaaaaaaaagtcatgttaagcagcaaagtaatagcactttaaacaatccaaatgcatgaaggatccttatcaaagcacaaatgtcaggactaatttactgacctggcaaccaagatccccgagacctaaaatgcgctcaccatcagtaacaacaataacctgaatgctcttctctggccagttcctcagtaactccaatattctccccctggtacaaaagcacctcattttagaaaattgaagatgatttacacctcaaacttctgccatcagtttgttcaaaataagtaaaaattaacataaggtgaaggggcaaactaccaacagaaatgagcaacagatacaaatgatggaagaaacatacttctctttaagactgatgtacagaccctgtggtcgtctaaagattgacccgtacttctggcaagcctcgcccaccgtcggcgtgtacacaacggggagcaattcctcaacgttgtcgatcaggagcttgtagaaaagcctctcattcctctcctgcaaaccaaccgtccaccggaacaacatgacatccgtgcctagtaaactgcaaccgatatctagttttcttctacccttctgacgctttctctaaacaagatgaagccagagcacacctgaaggtccatcagagccatgtaacgttgcagaggaacctgaaactgccgcacattttgcagaagcctcttctcctgcaggtgatgcacgcttcagtgagaaacgtctaccgacaatgttatcagatgaatcgagcgctggggaagtggaagggagcaaacctgaagttcttgggagagcacgactggaggcagcaaaccccgcaggtagtgggcgtctcgctctttctccgtgaatgatagccccttgttgtgccgtggatccctcagcagagagtgaccgctaaaaaaccaagtagcaatcacaaaattaacaccagatcacatatgtgtagactggtcgtttactttcttagtttagagctggactgggcttatcatggtctggttagtggttgattgctcatagttcaaacgaattcatgaagtaactaggaatatgttgaaatgactatgcgagatcgtgtgataggaaaatctcaaattgagcccagataagctcaaagctactagtactagtgaaatcactaatcacttaatcaataatcattagttcagtactgaaagtctgatacgttggcaaagcttcttcaaatggcgcatgcacacatgtaaaaccattttgtcccgacgcaagaacagaagatcacaaggcacaagccatgcatacctggcgacgcagacggcccacggcgtgatgggctggtcctcggtggcgcggtcctcgccgtaggcgtcctccacgccaccggtggccacccccgccatcgtcgcagcgccgttcccctctcctcgccccgccatgccgctcaccgtcctcgcgccttgcctgcagcgccgccgccaccaccaccaccgcttcgtcgtctctcggaatgcagcgcgagaagccacgacgcgtagtagctggaggcctggaggagccccgtgccagcagcgtacataggagcgcgcccgcgcgccgcgcggcgggcgccgaggccacgatgacgccgccgcccgcttgtccggggacacgtcgcaggagaggtggcgccacgtaacccccgcggttaggccggtttctggagagttacacggggccgggccggccagtccgggccgcacctgtggctggattggcaaaatcgtgggccttttttcctccaccgagccggcccgagcgatctccggcctcaaaacccgaccaacctcagttcggctcgcggctcgtcgtctccttcgtcctccacttccccctcccacccaaagacgcgcagccaaatccgacgcgtgcggcggtgcgacgccggccggggtgggggacgccatgagccgcacgctcctctcccacatcctccaccgcccgccgccgctcctcgcgtacgccgcgcgctccgccgtgctccgagacctagcggctgcttctgctttgcttccgagtccctaactttcctccctgttgtttggcttcgcaggtcgaggggtggtgggcgaggaggagcgctcccgtcccgcctccgcactctccgactcaactgcagcgtggctgaagcgactgcctccggcgacgaggcgcctgctcctccggctaggaagtaagcccctggccgcctagtgttcggcgtaatgcgtctggtaggaagaggattgcggcaggtttctgtggtattttgttgttatgcgatggcgtagcctatgatgtataagtaagcgtttgctctggttcaaggctagtatgcgtgagaagtcacggatgaaattctgtaaggcttgtagcttgactgtggtaggaccagcttgtgatgtaatgcgcctgtagggtgttgtaatgagtgagtacagaattactgaggtgttgggaggggctaagaatggcaatgcaggaattgaattgctgttgaagcctgcagttcacttgctgctcttagtgtatatacttgtttgttagaatacttaactggtgttggatgaagcaagctacccataccatttgatctgaattcatttatttttctctactagacactagttgttaaattaaccgtcacttaatttttttcgtgcttgaaatgactcgatgataaattccacagaaaaattgtacatatcctagtatccaacaggctaaagtgaacttattttttgcgcaccaaggaagagagcatgccatcacagctcgcttctcttggtgtgcacaaaatgaaggtgtactcagttgactgattgtttttgtatttacaacttccacaattggtgcctcatatacaaattcagtgttcatttcatgtagtatcaagaaacaatgacattttttcagtccgatgaatatcttgatcctaagttagtttacactgtcaaattaattagtttcttcatgatcttatatatacacttgtttgcactgctcaaagtcatgaaaatattattgatggctagtgtgaagccagaatagcaaaaatagctattttggatatgtttctcatagggaatatttttagcaagtatgaacatataatgcataaggtaatcaagaacttttgattacattgcatttttttcatgatgcatcttttttcatgttggctgtttaattgtatttggatcaaatttattactcttattttatagttattattatagtcatccgtttgcagtgtgcttccaaagcaattgtttttatgtattataaggtttcatgagaaagaatgcagtttctttgcccaagttccatagtagcatctattcccacgggtctactagtcgtagttgtgattttcttcttcttttttttttcagataacaaagttctggcctagtcctgattaaaatatttatacgcgtttcactaatttgaacatctatatttatctctactgactgcaggaaaagagtagtttctggtgtacagccaacaggattggtacaccttggaaattatcttggtgctattaagaattgggtttcacttcaggtagtggtttgagaactgcatcttattattctttaattttgatggtaataatctcaaaagaaaatttttcagaaaccatgaagctagtgataaataatcaatctgtagctcagtaacaaggcaacctcaaattctgacattgttcatctaattgagatgcatttgagagctaagctaacttattgactgataatacacactttatctgtgatacttgacatcttatgcatagaaattccttgcaggatctatacgagacattatttttcattgtggacttgcatgcggtaagttctatctgacctcttggcatcctaccaaaaaaataatatttatattgtttgtacaaggtgtcacttattttgtacttttatcttttccttggtcaaattagtatgtttcattttcctttaacacaagctgctacatatttgtgtaatatgtggtgtccatctttcaccaatgttatttatggtaaccaaagtgttcatgatgtatatccaaattgccgagttaccttgcaggatcaagcaagtggttcatgctcatgtctgatttgtttgtagttcatattgcaattttttttttgtctttacgattcattttgtggtcctttgtaagcttatcacgttgtttaaaatgtctgcagattacgttaccatatgaagcaccacagttgtcaaaagcaacaagaagcactgctgcaatatatctggcttgtggcattgacagttcaaaggtctgcttcacatatttacattatatgatgatgtttgttgcaggtgcccttgtggagctgaatgttttatgttgttttgtgtctttacaggcttctatatttgtacagtctcatgtccgtgctcatgttgagttgatgtggcttctgagttcttctactcctattggttggctcaacagaatgatccaattcaaagagaagtcacgcaaggcggtgcgtcattcgctgtatgacagcttcaccatcatcttttgtttgagctgaattccttttcatattacataagggtctagaaaatgcaacagctcaattcacaagagcacatgttttcaacatttccgagattgaatatttgatgattccataacactgcctgctcaacagatatgatatcatgtagttaaaaaactgttctgcaccagtaatattcacatggtgtgttccctacttaattttaataccctatcaaaccagaggaagggaaagcattacataaaaatatcttttagtgtatgccttctacttgtacaccactaccatatgattagcgtaacagcatttttgaggcagtagtcatgtgaagatcgtccatagttctagtttgtaactttcacactggacgcattaactcttattaatagatcataggcacagataaataccattctaacattagattctttgcttgggtgtaacatcacttatctatcagttggctttcctatgttctgaacaatgtttggtcctcaagattgcttacctgattcagttaaaaaaaaaaagattgcttacctgactgacaccaaatgatattcatgcatctcccctgatttctaaattactagtagaccacctctgtcattcctgaatgtgatgtgtagtgcttctaaaagtttgaacctctggcattgccattttactggagcatttattccacaatattaggaatcatgtggtgcagtttcttttttctgcgtgcaaaaccctcaactccttatatcatggtgttgtactgtttaatccgtcctattttggcaaatttttattttgttgggtttatttttttcttatttatagggtgatgaaaatgttggagtggcacttttgacttatcctgttttaatggcttctgacattctcctgtaccaggtaaatattactcgtggctattatttttctgggttgtattctcagtgatgtgtagaagctaatattaatagatgtagtttaacaattcaactttgttatggttctgtttctctcctttctatgatgccaataatagctaatgattgcagtccgatctggtgcctgttggtgaagatcagacacaacatttggaattaactcgcgaaatcgctgagcgtgtaaataatctatacggtggaaggaaatggaagaaaatgggagggtgagaaaattatattattttattccacttttttgtgtaaataatctattgtaacgattcttttttgtatttgttcttgcaggagaggtggttcactatttaaggtgtgtgccatattatttatatatggttcagcatccattttataccctcggaagtcagaactgaactttgttttgcttattatactttctttttgtttattaggttcctgaagcccttatacctccagcaggggctcgtgttatgtccttaaccgacggtctctccaaggtagttagccatactcattatcattttaatcctgatcacaaaaaatgaaactactaggacttttttgttattaaattacttattgaagtgtcattacaccactagtattgatgctcattcattaacatataaacaataacttgcagagctgattccaggcatctatattttatactttctgctcagtgtgctgtatatctctgccatactgacctttgttctgtttattcatgttagatgtcgaagtctgctccttcagatcagtctcgtattaaccttcttgatccaaaagatgtaagggcaccaagaattgaattccctgatg

SEQ ID NO: 59637 - DNA, 2170 bp, Oryza sativa
ggaatttgacaacccagagaggcctgaatgcaacaatcttctctcgatctaccagattattacagggaaaactaaagaggtggccaatctttacatgcatgctttgcaaacctaaccaaccagagcgtgaagcagggtcacctgcacatgatggtttctttcgtgtccagtccagcgtcatgttttcttgttgacgatgacaagataattttcctagttcactatccaagaagttgatcgtttcaataattttattttgacaggaagttatcagagaatgcgaaaatatgaactgggggtcgttcaaaacaactcttacagatgcattgattgatcatctgcaacctatccaggtattccaatcccaggaaacgttctgatagcacagctcattgcttaccataattattgtacttgataccgtggtctgctaatcatttttttctgggtcgagtaatcaatttcgtttctacatctccctcttttcacccgtctaggtccgctacgaggagataatgtctgatcctggttatttggatggtgttctcttagaaggatcaggaaaagctgctgagatagcagacatcaccctcaacaacgtataccaagccatgggtttcttgcgcagatagcatgcgcttcaaccatccggaacatttcaaagattttttacgaggtcaaaaagttttgttcggtctgtgttactttgttccccttaccattggccttaagattgtttttatgcacatattggccttactagatttacaagagctccattctccaaattttataggaatatcaatcgttttgcttgatgttacgtagtagcctctttgtttctggctctacaaaaacctgtatggtccattaaatttctcatcttaatgacactgatttctttgaagttttgagttcaatgttggctccatgactgaatggtatttggacgtaaaaagtaacatgtttacgtggactgttttgacattttgcacccattgaagtgtagctaacaaaaggtgaaagcacataacacaaactaaaatgtcgaaattttgttttatctttgtttactgttcctatttgatacagtttactttccactctgtagctatcaaaggtacatgtaccctttattccctcgagtcctattttgatacagtttactttccaaagctttgctcttcacccttcgctctttggatttaaaacccacaaattcctctatttttcttccttttttttgttccaaataagtgacatgaacatttcatttatcgcagtcaacgattaccagtcccccgagtagaaagcatagttccatttccaccgcttccccaacagttgtttatgttaaccctccacttaggactagcgaggcctggttgatgaccctagcaatcctgtaaatctcatgctgcacagatcgccaggattcggacgtattcgtcctctctgccatctgaatggcatcatcaacacctggatacacctgcgctccgtaatcatcatgcagtgatggtgcataaatctgcgttgttttgttccccataagtaaagcactcagcagttttttaaaaaaaaataaagaaaaggaaaaaactacagcagttcatcaaccaacaatattggcacaaaaaacttaccaggtgtttgtaccatggcctcccagatagtccttctcgatcggtgaatgctcgctccgtcatcatcaaccgctcattgagatctctgaccttcaggggattgtttctccaggggttccaaactttccttgtctgtaaggcctaataggaaagggaaacaggaagcttaaagttttttccttttgagcggagagcttaaagttgaaactatggatcaggcaacagcatgcaacaaacataagaaaagacaccttcatttcagaatccatttgtagagctgcccttttgaactcggcgattgacttttgcaggggagatgagctgacaggcactcccagcaatctcttatttatatcgattgcacccttctgcgaattgagagcaaccattatgacactagatttggacttctcataatgcatagaagttgcatggttttgaaaaagaaaatcattaaatttgtttgagaacagaacgataagttacctcaagctctacagcataagtgctgtagttgaagggta

SEQ ID NO: 59638 - DNA, 21006 bp, Oryza sativa
attagctgtgtaattaacgagcaatatgctgaatgccatggagtaatacgctgctgcaggtctaggagcccgggcacctgcccatgctggccgggccctggctccaccactgcatctaataaatattctcaatttgcctaaaaacactcaatcttgaaaggaatgaatagtgtagttgattaagaaacataggataaacctgatcccatagaaatgtcaattgaagggataccaatgtgttgaacaaaggcagaataatctgatcctccacctcctattcttccaatcttaatctgcatgtgtatcatcagcatatggttaagagggatagagactagtataggctatacatgcatctactctttacgcgagcatgtgtaacaacaattgctctagctgaacttgaaatgcttaccatggaagaactatcagaagccatccataagtcatacagactttgtgtctcattatctggattttgaaccttcccaagtaagatacgagacgtagcatatttagagaaccgatatagttgatagcgaaaaaagtcaaactaacaataaaactatagttgattgatattcataccaacagaaaaaataaattagatatctgtatcagtaaccaaaaaaaattgcagcaaagatcacttgtaactttttgtcatgcaacattctgttattgactaaaggaaattcatctaaaactggaatacctgtttactcgcctccttaagcaactcatcaagttgaggagtagctgatgcataaaaccctgcaccatacactgcagaatcaacattcaggtaagcaacagttcttgaagttagcatagccctgttctcttcaacccattcagtggatccaaccttcattttcaaacaaaagaaataagaatatagattgacatgtgaattacttctgataatagtcacagagagagagagaggtaccagtccatactcttcggcatcccagttacacaagatgatggtccgtcgaggcctccaacccttcttttgtagctcagagaacctttgagctaactaaatagccacagatcataagttcaatgaaataaaaagtgtcaatagggtaaccagatattgcatacctcaagcaaggctgctgttccactgttcggatcaactgccccaaaagtccatgcatcacgatgattaccaaggattatatagctgcgtgagtttcataattattttactgcattgttttcttattgactcataaattcatcactactaggcacttattcagaatggtgatttttttttttggactgaagaaggtagagaggctctaccttgtaaccattttattaatggtagtcaaggtgttacagcaagagtacattagagtggaaaaacaacggaagacaatgaaaggaaacagaagaaggaaaaaggaaacagaagaagaaaaaaagaagaggaagaaaaataataataagaagaagaagaataggaagaagtaggaaataaatgttgattttttgatgaaaattcagaatggtgatcaacaacgaaatgtaaaacagttctctttcagtttctatggttccgctttattaaatgagtagggcatgaactttacactcttcaaggcgaacactgaacagtggccgagttggggatattgaactctccggacagaaaatatgggcagtacagtattagagcataaagtttaccgttcaggttcttctttcccttcgatcactgagatgacattctgaatagtagccattgtctcgttcccctgcaaacagtgccacccaaatatcatcactacctcgagccataaaaggattataaagcatctcacctttacagtccaattcatcgacagcaacttacaatgtaggtgagattgagcaccgccggcccgggcccgagccggtaaaccggcgagccatctccgccttgccaatccttgggcgcgacatcaccgccgataagctgtagtatagcctccccatctcttcccgacacaggcagcgccggtatccccggcatgtcgtcggtggccatcgcctccgggatgctcacgcgctcgcacccttcggacgacgcccacatcggcgtcgtgggatcccccacccccttgaacgtgctcccgacctgcacaccggtgggcggcatccatggaccatccgggaaggcctcccccgccgcgtagtccttggcatcggtgtatatgaccgccgccgccgcgccagctttccgggcgtttatcacgatgtcgccgcggtacaccttgccgtagcgcgcgaggacgaccttcccggtgacgtctacgccgcgggcggcgaggtaggcgaaatcctccgggcggccgtagttagcgtagacggcctcggcggcgaccgagccggacgcggcgtaggcgaggaaggtggggacggcctccgcggagaccgcggcatagggatcaccggggtatgtgtcctgcaccagcgcaaagggggtggtggcgtggcctggcgccgagagggagagggagcggtggaccgggtaggcgaggaggacggagtagggcacgacgcgggtggggaaggagagggaggagagcgcggagacgacgtgctcggcggcgcgggcgttggcctcggtgcccgcgaggtgggggcggagggtgagcgcgtggaggtgggctgccgcggtgtcgttggatccgagggagaggaagagcgagcggtagtacgacggcgcgggcgcgacgaggaggtggtacgatgcggcgaaggccgccgcaacgaggagcgggagagggtggagccgcgccaccgctcggccgggaggaggaggtgtggggggtatgagcggcgtccgcgcggaggaggacccgtcgtcttcgggcggcggcggcatggccgcgtcgggcaacgcggcggtagactcgccgttacactagcttgagtgcttgactaccaccagggtggatggagacgccgagcagagtgagccgaggtgattcaggtgacaggtcaggtgagccgtgaggccggccgctgggaggagctgagcgcgtgtgccgctgacggtgtggggcctaccactaccagggtggatgctttatccttcgccttttccgacggcgtgggcctagatgaacggtggagacgtggattgattcgagttgggctattttttacgttttctttgtgggagtgggtttcatgtgacgtgtgcaaagcatcttggataaaactatagataagtatatttacatcccttaactcttgctctttattgaatctcatctcccaatcggcaataccgaaattgtggtcgagggatgcgattcaatcaggagcaagaattaaaagaggtaaaatagacttatttctaaaactattgggctttcaatgtctcgtttgaatggaataagttcgtctgaggtcccttaacttgtcaacgaattcgattttcgtccctccctcgactatcaaaaccggtgtaaattaagtccctcgacgggtttaagggtggttttggctgacgtggcgcctacgtggctaatttgactcggtcttcatctgacgtggcgcttacgtggcaattcgatctagaaaaaataataaaactcatgagacccacatgtcagtttcacacgcaaattaataaaaaatggtgggggcccacacgggacccacatgtcatcctcgcccctcctcttcttcctcctctctctccccgactccccttcatctctctcccctctcctttgtcctctctccaggcgtgagtgaggaggggcggcgcgcggcggccgacgggtgaggagggagcgacgcgcggcgccggtgggagacggaagagttggcagcggcgcggcaccggtgggagaggagggagtgacgcgcggtggtcgacgagatacaggagagaagggagcggctagaacgagcaagctcctcgccctctccaccgcggcggtgctccacgcgcagctccagcaagcggaggccgcggcacaggcgagaggcaaggcggtggaggacgacgacaacgacgctggcgccgcggacgacgtcgagcaaccggcggccagcccacaaacgacggcacctccttctcccttttcccctctcctctcgtcgccgtggatccaaagggaggacacggcagcctcgctccccagatcagcgtcggcgactcggcggagctcggcctaggcgtcgaagacgccgcgtggccatgatcctagcatttgggatggcatccgctgagaaaggatcgtgtccacgtaagttgggtcatcgtgcccacgttctgtaatcgcgtatggataaaagggaaagaaacagaaaatgtcacaagcaagtaatatgcagcgccaaaaagactttcccaattggtttgttcttctcgcgtccaagcgtgtgtgtgttgcaggtttcactgcagttgctggagtttagctaacatcgtcccccacctcttcatcgacggtggtggggattgagacgacgacgacaatggcgacggccgtgaggcggtgccgtggcgcgaggagaagcacccaaagacacggccaatacccatatctacaccaccattgacgcaatcccggcgctgttcaacggtttccccctcctcaagggtgtggacaagccatactggtttgaggacaccgacgacgacggtggcgtccttttagcctcatcccgttgccatctccaagagctcgcctgccactcgccccctctctgcccgccgcccctctgctgcgcccaccacctttcggcgccgcagtgccgccgccctttcccgtcgcttgtgccggcttgctccagccgccgccgcttagctctgccggccggccactccgctcagacctgctccgcccaggtgagagagagagaggatggagaggagagggatgacatgtggggccaaataggtcccaccatttattattattttgtgagtttttttacagtccatcaggacttttggtacctctaggtacctacaatcacagccatccattgaggtagatccaacggctatcagtccttggtactgctaggcacaataattccctcgatggtacctccccttcgtcgaacaagtggaagggtaaaactgggatttcgcatagttcgttcgctgattccgcaccgcacgctcctcccaatcgccagcaagctgccaccctcgaggcgcctcctctgcatccttcctccatggcggcggcgcggctaaactcgtggccaaatctaagctatcgggacacctccgccaccctcgctgcaacctgcggccacgacgacgacctcaatacgacaacgaaaagacggccacagtgatgtgctcagcgccacagacgcagcggtgcagccttctccccggcgctagtacagctgaggcggctgttgggcgacggcggcgacttcaggggaacctcctgactgccctccccataccctcccaacggcgccgttcctgcttcctccctcctcccttctcccttctcccgatccaatctcaacccattaggaacaaaaccgaggtcagcaatagatgcaaatccagcttcatctcaatccatcagcaacaaagccgagatcagcaacagctaagttataagcctcttattacgatgtgattcctgacttggtgatcgatgtgattcctgacttggatcttcctctcatccaaaatcataagaagccaatcgtggagaccatgatcaggggctggacgaaatcgaaatcgagggcttctgctcctctgcaggactgcagccacagtcgggtcctggcggtgccgccgccgtcgcgcgaggatagtaggaggtcgcgagtcacttgattcctttttttttcctatcgtgcccttgcttattcaacggttggatttcgtttgatacctggtggtaccaggaccttgaggtaccacttgttggaccgtagcaaaactcttattttgtatgtagctgatatgtgggtcccatgttttttatttttctaaattaaattgccacataaacaccacgtcaatgccacgtaggacgaagatctagtcaaaagagccacgcaagcgccacgtcagccaaaaccgggcataatattgccgagggacctcttttgcacggttttataagttaaaaggatgtgttgtacctggttttgcacttaaggaatgaatttcaaactcggcgacaaattgagggacctagaatgaacttattcccgttcgaatctggcagtaggttgatacgggccttatttgggctttattacgttagttggcctgcacggcctggttgctaaggttgctaacaagcgtgtccgatactcgcttctgcaggccacacactaatccctatacgcaactgatatggttgatcattcgtccgtaaataatcagatcggttttgccgatcattaaccatgtatacagctattacggttgccgagagcttgaagatagaaaggctgtgaaaattttctactgcaacggaaattgcatggccagggtcgccatggcgcacataaaagctgcatgggtcatgctcatgcactccattcatgaaaccgatcactatggccggtgagacataaaggaaggcgaaaggagaaagatttgcaacgtcatccgtcgcccatttatgatttgttgccgccatccgtttcaagctttcaacgctagcttcttcttgtcagtcgtgcaattaaaaacagcactgacgtcgcactgaatcgcttgcaactttcagtcctggagggatctgcattaccagaagcacccaagacggagaggtgtatggcggctttgattaccctaatcatccagacccattcgaatgatgacagaaagcaaacatcagtttttgttggagccaccaaatccacttgtgtacttctagagttgcaccaaattcagagcgcgcgcttcattacgtgcaagctgatgatcatctaattgtcatcattttgctctagtggattctgatgatctgatcaacctgtgaaatagcatcacaccgccaccacgaactgatgcacttttattttcttgtggttgggaaggtacttacgaagtccggaaacagtcctaacgctcttaagttaacgcaagtactcattggcaggcgaaaataaaaaatagaatgaaatagcaatgctactccatgcttaagagacaaacaaaggatccagtctattctggccctaaaccatgaagcagaaaacaagtacaggaaacacaaagcgttcaaaccatcatgggcaaattaaattagccacacagttaggtacgttttctggagttacatgtttagccatttaggtacgttttttaggtgcaaactcgaagacaagtatctaaaaaaaccattagagctaatatgttgtatgaaaatatttccaaatacgaatctagtgacactgtgtgcaaacgtatatattttaaatttagattagtcaaataaatagttgttgactttaggggaaaaggtattatattttcaaacaggcgcagtatacggttatatcgatttctaccaccctctctctattttctctcacctatatgtttaattaatgcatatctcttatagcatttgcgaagaatagactttttttgcgaaaattgcaaaaatcgcctcataaatcatttgaagtttgacattccacccccataagtcattttgttgcaaatacccatctcctatttaggtttgttgcaaaaaccaccctaacacgcatgtacttaatcaaatcagtttgtttattgttgatgtacggttatcacaggttaaattagtcaagtcaatattatcctagtgtttgcattagacttattttctatatttgattgaactttttttttcatatatagcgaaactcagtgtgacaacgtttaagctctcgtctgtaattttatttgtggaatctcaccaaaagagtatcaagaatactctgtaagtatttaattttggtaaaggccatattaactgttcacactttatgaaaacatattgattcggttacgcatgtatttattggggtggtttttttaacaaaaatatgtaggtggatggacatttgcaacaaaataacttacgaggtggaatgccaaattttaagtaactttatgtgatggtttttgcaattttcttttttttttcattccctcctttttcacatgtggaacaaaaaaggatcatcttacgcagtgtgacaacacacgcgcgtggcgtactggaatctgggcgtagaaacggcgtccgccgtacgcgcgccgccgttccggccgcgaggcccgcggcgtcgtgtaaagccagatggtttggctggtaccgcggccgtgtcgccaaaagccgcgagcagctgcggcggcagcgcagcgctgccgttatcagagcgccccgccgctccgggagccgcgccgttttcgttctagtactagcacagagaaggcgggcgctcacggagtcgcggtcacgggccggcggcgtgcaaagcggcaaaataacgtacagggagaaacagaacggcgcagcggacgcattagcgctttgccaggacaggatggcgggagaaacaatagatggaggaataatcaggggatccacctaccgtttactattagtgttgtagagtcttcaacgtgtcccaaaaaaactactactagaaaagaacggaagcgattttgtcagatatgttggacagttcatatttcaagttggaatagtaagtgtaaaattggaccacgggcataagctgaaagtagcatggatggcaaaccatgccagtttagtagtttacattagtatcaaactatcaatcagcctatgaacttgtcatgtgtatacaacatgcacccacggttcgtatgctggctaaacaaggtttgacaagtcaaactacacttctctacgtgacaaattacagttacgaatgaaaagatcacactcgtcacatggtgacatggaaaaggaacatacatatccattatcctgcaacaaattaaacttcttttcctccctgccgtgtagatttcgaaccaacgccatttgcaaacttcatttccccacgcacgctggcgtagttcatcccaacgtcatggccgaaccggggacggtacaagagtacccctccaactaaaacaataaacccattcaatcacaaggagaaaataacactctaatacacaaaacgaagcaaggacaacgtaccgaagcccccaaaacgaaccgtatccgcactcgcgagcccaagaaaatcctctgctacgctgcgaatttagcgcgcagaagtcgccatcagtcgccgggatgcgcgcgggctcgagtcgcgcgacgccaagagcaagagcacgagagctgtgacgaacgcatgcatgcacgcgcgcgtacgtggtgggtacgggctcgcgtagcttgggcggcgctgccatgccaacacgcggcgccagcgaccagcgcaccaaccgcacttccgcagctcgtgaacccgcggccttgctctcgtctcgccctggcgtacgttgtttgtgtcacgcttctcaaatcccttggtgttctcctcttgtccctcccttgccccgtgaaccgtgatcgatcggtcggtagagccgcgagctccttaaatttccccctctcgtttcgcctgcctccatcaccgaacccgcccggccgccacacacgcctctctagctacccggcgcccgttcgagtagcctgtaggcgcgtggcgtcgtaatggccgtggcgcccgtccggctcgtggcgtgcattgtcgccctggccgccgtggcgccgggcggagtggcggggcacacacggggcgtgcggccagggagggcggcggggaagcagcagccgtcgttcccggagaacgcgacgcgggtggaggcgatcgagcggcagttcatggagtgggtacggtacatgggcgggctggagcacagcacggtccaccacgcgctcgcccgggcgttcccctcctactcgctcgtcgtcgacaagaacccggcgttcggcgacttcaccaccatccaggccgccgtcgactcgctcccgatcatcaacctcgtccgcgtcgtcatcaaggtcaacgccggcacctacacgtacgtgcacgcgcgcgcattgggactctgatcttgttggtgcttacgagagagtactgaccatgcacaacgacgatctcgcagggagaaggtgaacatatcgccgatgcgcgcgttcatcaccctcgagggcgccggcgccgacaagacgatcgtgcagtggggtgacaccgcggacagtccgtccggccgggcgggacggccgctcggcacatacagctccgcgtcgttcgccgtgaacgcgcagtacttcctcgccaggaacatcactttcaaggtaacaaatccaccgccgtaattctgtcggggctgtatggcttcgttctcctcaattcgcggtcatgatattgagcagaacacgtcgccggtgccgaagccgggggcgtcggggaagcaggcggtggcgctgcgggtgtcggcggacaacgcggcgttcgtggggtgcaggttcctgggcgcgcaggacacgctgtacgatcactcgggccggcactactacaaggaatgctacatcgaaggctccgtggatttcatctttggcaatgcgctctctctgtttgaggtaaccctgtctcctctgctgttctcccgtgaaccctcccccccccccccccccctccattttgtgcgaaatcactacgttgtgttttatgtcatcctgtatcatactgtcatatgtcatgcatgcgccgaggtgcaaatatggaattcatatgcaaatgtttcgggaaaggttcccaggcgttaaatttttttttatcgccatagagtatacagagcaaccaaaacagagcacgtcagagtggcatccaaaaggagtgttccttataggagtgatctgaaatttacgccagtttcctaaaaaaaaaaatttacgccagcacgtttaaatactaccaacacgaagtacgaaccagcttaactggagttcttttcgtacgccatgacgacttgacatgtcgttgttaattatgcgctgaccaaattaggatgtaccgtgtcaattcccgtacatccccgtttaaacacatcaaagtacgtatttttagcctcggttttcctggcgtgcacgctggaccatgtgtcaggtttcaaccaacgccaatgtagcaacacgtgcacctcgaagcggtttggttcggtgttcggcccagcacaccccacaactgacgcgacagctaaccgcgttctctttgccggtgtccgcttctgtttctgccgccgacctcgcggctggccgccggccctacacccacgggcgtgcagagtgggggacgctaatgaacaacctctcgtcgtatgcctactaggcttggctgttatttgagttccgttattttgcactttttttttccttttggcttcggttcgatgcatgtggtgatcggaggtatatgtgtatgccctgcactgcaggattgccacgtgcatgcgatcgcgcgggactacggcgcgctgacagcgcagaaccggcagagcatgctggaggacacggggttctcgttcgtcaactgccgggtgacgggatccggcgcgctctacctcggccgcgcctggggcaccttctcccgcgtcgtcttcgcctacacctacatggacgacatcatcatcccccgtggctggtacaactggggcgaccccaaccgcgagctgtaagacatctcatcgctctctccgaacttatctgtgaagctgctagcctgttacgtgcgatcagagtgaagtttgtagaaacagttttgtatgtacagaagcaaagtcactttaattccctagccaaccgaaagccgcatcggtgttgcactgttggtctgttgctgtttgcaaaagctcggtgtagctaggcgcatggccgtgtgcgcagagaagaatcgtagacatagcttccatatcaataatttgccagtgcacgggaaaagggagagcactctccccttctcggtgcatggcgttgcacgggtgcatctcccccttttgatctctttggaactgaatcatacagcttttgagattcgatgctctgttactaaacaggatcggcaaaaggcagtgacagtctgacagatatatcggtaaaactcagtagtttcctgatgctgtacgcaccactgaccgttgttgctgtattgctcctgctgctgttgcaggacggtgttctacgggcagtacaagtgcacgggccccggcgcgagcttctccggcagggtgtcgtggtcacgcgagctcaccgacgaggaggccaagcccttcatctcgctcaccttcatcgacggcacggaatgggtcaggttgtgagagatcgatccatcggtcgatcgagttcattgtagcacaccgcacacggcatcatagcgtcacacgatgtaaaaagaaaaacagacgaatatatatacagattcatttgcagtctcgttggagattgtcttctttcagtttggtgtgagtttgggtgcaccggcttgcatttactatcagctagtagctgcgaggctctcagcatgtggtgagcgtgtacggcgtttcctgattctccaccgaaagaaggtaattaggctgctagtaatcggggacttataaacgccgccgtactatcgcactctcttacctaaacacgcgactgcaccgttctatactcgcgagcccttgttggtgagaaatcaagtactcaactggcaccactgcctgacgcgacaaagtaatacaagagcaaagccaacgctgctattagaactagcaagttgcaactcaactaatcacgactcgattgaatgcttagggagcgttctttctagtgagttaggatgagaaagcacatcgtaagtccgtgcgcacgcttaccaaactactaaacggtacgtttttgataaaaaaaattatataggaaagttgctttaaaaaattatattaatccatttttgaaatttaaaatagtttatactcaattaatcatgcgctaatgactcacctcgttttacgtatcttcccaatcttctcaatcacctatccctcaaactcacccttagtcgattcatggatgtaacagatcgtatcacagtatgggcctctgacaagaattgtgggctacagatgggccttgtaatagcccaataacgtaaacactgccagctactggttttcaggctctattggctatttcagttagcgtaatcatctgtagactaccaataaaatcaataaaatcgatcattttagtgctttactaacctgattagaggtaaggttagttagtatttaggttattttccgttgttcattggaaaaaggtttttatatcgattcagatcatatcgcttggctactcgacggcgcatccttccgctgctggtcggcaactcatcccgtcgggtgccgacggctccggtggctgcgttcacaaggccgttctcttcccgcctcttcttcgcctctatttgttgcccggtttcagatacgaacagagaatactccctccgtctaaaaaaacaaacatataataatatagtacaacaaatctaaacattaagttatttttttttggaacggagggaatatagaagacatgtagtcgttggcaggaaatttcgtcccttatcggcaagcacatatctcactcgaaaatttcgggtttttccattttccagaatttgatcaaagtttatttaaattcattaaaaaatcatcaaattttcaaaaaaaaaaaattgaaacttcggttcccccacccccaacccgggccgcgccaaaaatacaatttcgagattgctaacccatgtcgttggttaatcgtaaagcatgtgctttgaattataacagtggggactctattagatgtctcgtagtttagagttgtgctccatctttttcatattacaaggcctggtttagttcccaatttttttccctaaaaacatcacatcgaatctttggacatatgcatggagcattaaatatagataaaaaaactaattgcacaattgggggaaatcgcgagacgaatcttttaagcctaattagtccatgattagtcataagtgctacagtaacccacatgtgctaatgacggattaattagtctcaaaagattcgtcttgcggtttacagacgagttatgaaattagtttttttattcgtgtccaaaaaccccttccgacatccggtcaaacatccgatgtgacacccaaaaacattcttttcgcaaactaaatatgccctaagttatttgacttttttcttagtcaaaattctctaagtttgatcaaacttataaaaaaaattagcaatatctacaacaccaaattagttttattaattaacattaaatatgtttgttttttattgcaaatcttattatatttttctataaacatggtcaaatctaaagaaatttaactaataaaaaataaagtgacttataatatgaaacggtgggagtatttaattgaagctgttgagcaagagagtagaaacttcgctatgatatagcagtagcagtaaagggcagagctagagtattcccatgaaccgggtcaagaaaaaattatagctatacctgacctatttttaccatatgtacacccctctcaatataaatttagacacccgtattagcttaaacttgatataaaacagagtaaattaaacaagtggcaacccctctttctcgctatagctccacccgctgcagtttaccacgtcaagttcaaacttttacctttatctcttggtaaattttgggtgtgtttagttcacaccaaaactaaaagtttggttgaaattgaaacaatgtgatgtaaaagttggaagtttatgtgtgtagaaaagttttaatgtgatgaaaaagttagaaatttgaagaaaaaatttgaatctaaacaagagcggctttataatgtttagtcctgattctttccgcaggctggagatggccaaccaaagaaataagctatctatcgctaatcagctgtcggcgacgggcagcggcaactatgccagccacctccgctcctagctctgtgtagtgacgccaccccgcaccgcatggtcgcccttgcgaggcgcaaaacttggagggtttccaactgatgtgtaaatttaaaaattatcatctcatgtttctactaccgttacgttaaatatagtgatagtacgaataggtcttatcaatcaatctatctattatataataaaaaatcattaaacttcctataaacgctactaggccgccacgtggcatcctataaacgctcataagccaccacgtgacactctaataaattagagaaattcttaaaatgacacaacatctaaccgttgattttttttattaaatttagtggaccaattatttataaccattagatttattagaaaaaaatcatctccttatccctaggcccacttcggcctgttggcaattgcaagtacgtacgtacttctgctcagaaaacccacctcccttttcatctattttttcttctattttcgtgcttttagaaaagcataattttaagtcaaacaattaaccaaatgtaacatctaaattagaatactaatatttgatctgcttatatcgttagatattttacatttaaaaacttatatccactttaattcaacttcaaagagaaatatgtcatattaattggggctatattttctaacttttgtgtgccatttaagtaattataaaatataaaatataatgatatatattttatcatcgtatataacttggtgataattaaattatatctaataaaagtaaaatgaacatatctttgagtaatattaaaaaacagcccccccaaacattgtaacacaataaaaagtacacatcttataaaagctcctaaaatattatgtcattctcttaaatcggaaaaaatatactcttaaatcggaaaaaatatactcttaagatattacgttgttctcttaaataagagaaaatcctaaaaattctaacaagaaaacaaaacattcgaccatcagcttcgacttaaatatctgacacattattttagtttgttagattaattatttagaaaaaaaatcccaaacctccattcctccttgccgtgtacagcgtgcgtcattcttctctctattttctatctccttatcaactgaaatgaaaattatatatatgaaaaaaaacacaaataaacctccatctattacttatatcccattaggcgtctaacgactttctaccaacttaattaatttcacttaacatgcatatgagggctatgtacctatacaaattggccttgatacttttaaaatgattttttaggagataaataaatattcataagaaagatgatcatagcatcccaattacacatatgatctatgaagtcactaatattcatttagcaatatagacaataggttgaaaataaaggcgtggctggttgaacattataccgataagcatgtgaggtgcacataggaatcttaacagtgaaacaaccttgaggtggcctttacaataaatcgagtcaattccatataagaattaaagatcatgcccttttttaaaattttatgataaattctgctacagtatattgtaaaaatcttgatgcacaccaatctagaaatgtgtgtatttgttataagacactccactttagtgatgattcgctaaacacactatacactatgaccattacttcaatatttcttgagagaattttagaacgcatgcctttaccccatgccatgttatatgcacttatattttcgtcccaaattgcaaaaatcaaatcatttcaaggatgattcatagaatgaaaatctcaaaaagaaaatatgaacatgaaataaattaaaaattaaataaatgttgctagatttaaaacctattctaaatagaaaaattcaaatatcctactgtggagttaaaatatctaaattttcttataggaacaacctcctttgtttcgacacaatattttctcatcaattcaaaaccgcatgttctcaagtaattttatttttgaatttatatgttgcaatggtaattatgagaaaataaccaacgttcaaaggacacaaaataaatttaattttagtttagaatataataaaaatattttagtaaaaagccacccacacataaatatttataataaaatttcatttacattatataagaaggtgcccacgtatacgcgggctacttttctagttgaataaaaaagaatcaacaatttagatttatttgtactactagtagataacactgtactaggattcttcggttaagagtttgttttgaccctgatttttctttgcattttgcaacagacatcgaacatcgataagaggttggtcgactatatcattattaagaaggaataactgttcttcctccaacagctatcaaaattaactagggtaagtgccggagcgagatatgaaaacgaagaatggaacaaagcaatcaagggagtggacaagttattttgatttttgaaacatgttttattccgatctttcctctgtgctgcattaacccgtgactagtattagcagcaagtagcacttaatgccaagtaaacgccaccgtacttaaagttcagatctagatctatcaccgggaaagaacaaaatctccatcccttggtttggatccgccaatcagctgcagaatatgcaacaaatggacaaaaataagaagcaaaaacttcatcgctgagcagtaaacgtaggactaacacttggtgtccaaaagggtcgtttccaaacgaaaaaacttgtcggttaatgtccaatccatgtacacagaagcagaacagttccgtttaaacgacctgctcagtcacgagacgccttacctaacaatgcaacgatatagttgtctccacgtcttaaacaaagccttaaagtacctgaaatgtaaacatccggttggaattgcaccgacctcaatagcctcgaagggtaaagattgatggcgtatctgtattacagtaatagtacaattaacagtatcgaaggtttatgacacgacgagcatataaaaaaacaagatatgtatattgtatagtacaatgctcctgttgttgggagcaatttttccaagatacgaccaacacaactacttcactgctcacaactcaagtgacaaaaccgtcaatgtgactggcgagtattacacttgaccttactcctagacccaccagctcgtgactgttccaagagtcttgtaaacgttcatgaccaaagtacgaaatgaacgtgacaatgatagcaacggctgccggatcatgagacagaacttcttatttgaaacgaaggatcgtgagacagaactagcttgatgcttcacatcagtcgcttgcttggggtctagccaatccgaaggacaacgtagcacgcaactacagattttgtcttcactgaggcagtaaaagaactccacaagtgacaggactactaaggtcatttgttggcttaagtagagaatttcattccctcatatgccataaaacattttcattgattcaaacttgtattatgccttgacctaagcacatttggattagtatgtacgaaattttggagactctagattttgagcactagtaacatgacatccaaggcaaaacagtcttgcatctggtcaccacattctgtccaagtagtaatctctggccgcctcgtcgctgagctcctcggagtagccggggcgggagtcctcggagcactcgaagcagaagccgctgtcctgcgtcgtccgcgagcacgatctcctcgacctcgccggcgcctcggcggcctgtcgctgcctgggcgcgctctggcaccgcgtcctcgccgctgacgaggccgtgccggccatgtagcgcgggctgccgagcgcgtcccggtgcgagagccgcgccctcgccatgccgtcgacgctcttgttggcgggcgagctgccgtacggcggggcgccgaggcgcggggtgttgtgcgccgtcttggcgtgccgggtgtcgcgctcgtggtgctggctccgctggatcgacaggcgtgggggctgcttgatggagatcggcgacgagcacgacagcggcgccggcggcatgggcgccggggtgaggcagtccgacgagtgatcgcgggagtgccggatggctatccgggaggaccgagagcggcggtggcacgtgtccatctcgacgatccgcgggctgcgctcgtagttggagtccgcgctgtcggagagcctccggcggtgccccggcgtcgtcgtcttcaaccgggtctcctccacagagatcctctcctacacgttgcaataaaacgtaccaaacgaaacgatcagattcattctgcattggctgcattgcgagatggaatgcaaaagcttgacatatcggcacgaccatcacctgctccatggatttccggtaggaagctctcgtggcggcgcgggaggaggcctgctgccgcatgagcgcctgcagcctgtgcagagtcgtggcagcctgcttcctcacgaggtagccacggaccagagcctgcagcttgacgagagacctgagagcgcgaagcgctttcctagcctacggtgtaagattcaaaaattaaacaaacacaaatatttcactaaacaatttgcattaaagaatcgcggtttaggtgacaaggcttatgtcacgctacgtaattaactgctctgacagcaaacaggaactttattataggcagaaggtcaccgctaacgcagagtaaacaattgtgtagccgatcaacgtgcagattttgtatgcaatgcaagcagagtaagagagctactccaatagtctagtagactagttctaacgaccggagtatccattattatggaacggaacattagaggtagtgacatcatatacaggcatatagcaatgcctagcctactttacatactagtagccaaatagagtaacaaaaaagaagtagaagaatctaacaaaaatacggtgcaactgtgcgagcagtgtgcaacttctgactgaccaaaacttttcaaagataaaaaaaaaacgatggatctacaccgtcacaactaacttctactgtgcattagaactctgtctctcggtcaaaagaaaaaaaaaatgaagaaagaagactgagcagcagagccaacaagaaaccatgaacagatcaagtttgaagaacatagtctgatattcagtatacgtggatcataccaggtagcctctgtaagctttctggatcaccatggccgccttctcccgccgagctatggcattttccacctcgccacaatggcacggccgcctcacttccgaaggctctactgctactgcggcgacggcggctaaggcggcctccgatggccgcctgccgctgtctaccccactcctcctgtgcttcgcgaagctccacctgctcttctccttctccgccccgtcgctcacggcgtggttctccttgaggcctttgtgtgcttccttccggccagtcagtagcttcttgagccatctaatgatacgacccatgccgctatgattcctctctacaaacaaaaacacgagaaaaaagagttaaggaacgcgtcgcaaccagatgaacaaatgttacagagagagaagctgagcaagtggtgctgtggtggggtagtactaacttcagaagaagcaaatgtgaagaaagagcttctggccggacaagcgaaggagaagaggcctagagcaagaaacgctgcataaagcttttctcttgtaccgtagcccagggctcccggcagaaaaggaatggcgaattgtacgtgcaatccaggaccgagagacttaaaaaagaaatcccaaacgcgattctcggaaaggcacgggattaaagcgagagactttgcaggacaagcagcatgcaagcttgagtattctatagtg

SEQ ID NO: 59639 - DNA, 969 bp, Oryza sativa
  unsure (1)..(969): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgacagcagcaagtgagctcacagagacatccagagctattctatagctgtaccaaagccacacgacaggatgaggatgatctcaccatgagtcggccaccggcgtggtctgcgcggcggcgaggatggcctgcaggcagtcgacgtggccgtagtacgccgcgtggtggaggcaggtcctcgcgtgcaccgagtcgaacatcaagatctggtgcgaaatcgtaactgttactgattttttcaaacagaattactacagtattatcagtatactgattttgcagttcttttctctcacatttgcgtcggcctggaggagcttgagcacgcagtcgatcttgccgtgcatggccgcgagcatcagcggcgtctgcagcataagcagaagaagagcaaagcaaggtgagaaaacaaaaggacaagacgagatctttctttttcattcaaaatcaaaatatgatattttcaagcagatactagtaattcgaaaaacagtagcaaaaaagaagagagattttggtggggatctcgcacctgcttgtgccgattcaccgcgtccggcggcgccccgcgatccaagaacatggagagcacctggaagaagaagaagaaagaaaacaagagagaaagggtgagacaagcaagtcccggagaccgagggaagaagaagaagaagaagcagtgaggtgagcgacctcgatgcggccattggcggcggcgatgtg

SEQ ID NO: 59640 - DNA, 4287 bp, Oryza sativa
taaggtaattggtgaaatctttcgcacttgtgccgcagacatgttccgccaatcaaggcctcctcatttttcatccctaccatgtcatattctgccccatgttcacactaattgctcattttatacccatgggggagaaatcgctgtttggtgtaaactgtcagactaatgtagttacctgttatactgtaaatatattttacatttcaattggtaactcaagaagaagtcagcttggaataggacaaacaaatggtccactatttttgctctctaaaagtcattcaaactaggagtacagcctaactcgatgatgtcaaatcatacaactctgaaagagtctgctctggaagaaccttctaatctcacatttaaacaaccacctactgtgcgctctttttctacgatattgccatgctgcatcaggttcatcataacttatgttccatttcttttttcttcaaggctttttatagtttctgtctgattttctacgattgctctggtcgaacctattcgtttggtaatgatgtgattacgtctgtctaaatagctgggatatttatatccatggaatacaaaatattgacaatgatttctagtgttgccaattcttattgatttttggtgggccaattgggtcctatgatctcttttgtgcagttaatcattttttaccttcaaaatttgacattttttcagcttgttcctggatttctgatttcattaactggacttatattgaaacggaattaattacgaacctttgtactccatcacaggttgttgccatggctcccgctgttgaagccgtggagaagaagacaggctcagcccccgtcaaggcccctgctctgaatgaaaggatactgtcatctatgtcccggagatctattgcagcacatccatggcatgatcttgagattggtacatgacatttcatcttgacaaaccatcaattttctatatttctctcataacttacttataggttcctgacttcttcctgcaggacctggtgcaccaactatattcaactgcgtaaggccaccataacagattcacatttgttttttctcccagatttagtttgatacatgttcttattggaaacttatgtcaatagcatagcccttttgaagcgcctctcattttgaacttttagagttaatgtgctggctggtatttcacattacaccaagaatttctcgaccaaaagaaaaaagaaaagagaggaaaaactctaacaaattgtgtctcttttctgtcacttgtcaggtcattgagattcctaggggcagcaaggttaaatatgaacttgacaagaaaactggactgatagtggtaaaacaaggcgattcaattgattcatcattttttttagtgaaaccatatttttccagtgactctaaaatgttttgtacatcatttggttgtatgcacatgtaaaggtggaccgtgtgctctattcatcagttgtgtaccctcacaactatggattcattcctcgcacgctgtgtgaagacagtgatccgttggatgtgctggttataatgcaggtatgtctttgtattttagttggtactagaatcctattgcttgtactcttaagaaaaacagtgcacaagtttcttttcccttcagccattatgtaaattctggtttacttttcttgatatagccatgtgaaatcatgggctttggcttacctcttgtccaataatagtatcattctattaggttatattcacatctcactccttttgtttggggaaccatattaaattctaatttttgttcaaacaggagcccgttataccaggatgcttcctacgagcaaaggccattggtctcatgcctatgattgaccaggtttggcttcattccaacatttacaaagtccagcgaaatgctattctgatccccatgtttctattctgaccccatgtttgtttgaacagggagaggcagatgacaagattattgccgtttgtgctgatgatcctgagtacaagcattacaatgatatcaaggagctcccacctcaccgcttggctgaaatcaggcgcttttttgaggactgtatccttttttatcaacttaatatcaagttctgcattctaaatgaattctaggcaataactcatgtcctaaccttgaactccaccaatatgttgttcccatatgtgcattttctgaaagccatttggcactattttatatctcaactgtcttgtatcatatgcacacatggtcaaccacacaccaacttaaatactcttgggagtcccaggatcatgctaatttcaaaacacttgtcacctcttagaccgaatggtttctttaaccgagacattcagacaagaagaatgagaacaaggaggttgctgtcaatgacttcctgcctgcaagtgctgcttatgaggccataaagcactccatgtgagtacttcacttgcataagtactacaacatactgtacatgtttgtgtaaaatcacatcaagctgactcttaaccatgttgatgttgccattcagggatctctatgctacttacatcgtggagggcttgaggaggtagacttgtgccgcttcctggaccgagaggatggatgttgacgaaaattgtggagatattatcaccttatgaacaaatactattattttgttggtgtgtgatatacaccggtattattcacatttcaagtagtaacagcacaagtagaaactactagtagcacaacaaagagtgatattccttttatggccctcggtgccactacgatatggagtattggtgaatgatgatactttatgctgattctattgatatggttcgagcaaagatttgcatatttttttcatttattatcaagtactacatctgtttcaggttataaaactttctagcattgcccacatccatatatatgtctagattcattaacatatatatggatgtgggcaatgttagaaagtcttataacctaaaacggaggaagtaatttgttatttatagttattacaaatgtgcctggtcatatgtgaaccgaaggaagaaacagcaaaacttggacccatttgattgcatgcatgtatggaacagtttatgatttgttcacttcattgccaaaataaaccttaccatttgttggtaaagcaaaagtggcaatgccaaattttgatacttaccaagtgttgatgaagttttgtgagtggaagactctacaattatcaaattctgtttaagtttggaatagtaaaaacttgtttagtttgttactctacaaaaaaaaagactaaaattaggtaaagttcattttggaatgaacaagtcctcaattcccaaaatgatgggaaatctcatagtatcccagaagggcacatcaaagtaactgcggtagcaatatcatcaagagttaatgcttttagatcagattcacaatcaggctattaaacttactgaacacaaacaaatttcaattgagaaaccacatattgaagcacatgggatccagaagacaaagcgagacacttcatcttctcattagaactaccctagtgtcttgcaagctaaaatcgaaaacatccagttaaatgcctagtgatacgaactaatctcgaatcgaacaaactaagtactgcatatacagtgaccaatgaatggaaggacatgaagctaggagcgcgcctgcttcttgggggacttggcggctttgtccttggacgccttggccggcttgtcggccttctccgcggtcttcttcgggagcagcaccgggttgatgttcggcagcacgccgccgtgcgcgatggtgaccccggcgagcagcttcccgagctcctcgtcgttgcggatcgccagcagcacgtgcctcgggatgatccggttcttcttgttgtcccgcgccgcgttcccggcgagctccagcacctgcatcaacaacacgatcccggtcaaccatgctgggtttggaaggatttgggagaggaagggataaacagtggcttgcctctgcggcgaggtactcgaggacggcggcgaggtagacgggggcgccggtgccgacgcgctgggcgtagcggcccttcttgaggtagcggccgatgcggccgacggggaactggagcccggccttgacggagcgcgacaccggcttcttcttcggcccgcccagcttccgccccaccgccttcttcgccgccttgccgccgacgccgacgtccatctccgggaaacgtgagggtgaaatggagcggaattcgggggggatttgaagggattt

SEQ ID NO: 59641 - DNA, 16771 bp, Oryza sativa
tcctgcagcccttccggcgccgatttggatttaggattttgaatctggcgcttggtggttttttatataggcgcgggggtttggcgatccgcgtgatgtggggtgcgcgccgtcggatcgagatgggagggaacggtggggattcgttttgggggggcgatccgtgggagcacgcgacggaccaatcaggtgcgcctgtttcgtgttggtgtctcaaaatggaccctcggtgttggttgggccatgcgactgaattaggaataagttcaccggaggaccctcaatttaacagcgagattttttgaggccttcaaccataaaatcagaaatgttcacccctaaactcattcaaaccgttcaaagaaggtcccatgacaatatttgcgcccggttttgctgacgtggcatcctagtcagcaaaaaatataaaaaaaatatgtagggcctacatgtaagtgagagaaaatggtgtaggccccacatctctcctttcttttctttttctcttctcttctctcctcctctcaagcaggcaaggcggccagcggcggagcaggggcggcggcggcgggagagggggagagagacggctggcacgatggcgagctcagcggcggagagtagcggtggttggggagaggagcggcaggaaagggggcgccggcagtagcagttggtgtcggcggcggcggcggccggcggcgagaagagtgtgcagccgctgcggggggcagtcgaacgaccaccgcgacgaccttgcccggggtatctactgcgctgtaggattgagatgtcgactagaggggggtaaataggcgatttaaaactaaatgacacctaatcaaaactaacctaagttgctaggcttagtgagggtgaactctaactaagcaactgagttatgttttgcaaacctagagtgatagtggctcaactatatctctaggaaagtaaatcacactcctatgtcaatgtttagcaatcctagggtgatacgatctcaagtatgtctctagaaatgtaaattgcacaaatgtaaatgcgacaatcaaatgagacaaggagacaagagatttttcaccgaggttcgaaaactcgtcggtttcctactccccgttgaggcgagcccaactccaccgctcaaccacgaagccaccgcacgcccccttcgtcaaggggtgggcaaggcgggagctggcccacggagaggactacccaagcctcgatcactagggttgttcttccttcactccgaaggtggtgaactccaaaccactcacaaaccggcgccgcgcctcctccacaatcttctcggagaggtcaccaagcaactcctccacaagccgtctaggagacggcaacctccaagagtaacaagcaatgacccgacgtggagatgatcaatcaagtgccacactagctctacaaatggaagcaatgcacttgactcttggctaactaacccactaacacactagatggatgaacacaaagctcaagtgggtgtgagaaaggtgcaaggggtgtatgcaattgaattgggtgccaagagagaacccttgctgctggagggggagtatttatactcccaccaaccaaaactagctgttgggggcgaaatcctccaactttgtgctctgccggtctgaccggaggtatgcggccggtcagaccgtgctactctgcaacggctagaaaactagccgttgtagtgctgtcagagggccccatcggcctggccggtcagaccggcgttgagtgggcggtcagaccggccttggctcggtcagaccgccatcggctcggtctgaccgaatacggctccgccggctctgtatcggccaccccgagcagcaccatcccggcctccagggggccggtctgaccgcggatgtgccgccggtcagaccggccttatgcgccggtcagaccgccgtcttgcggccggtcagaccggccagggcatgccggtcagaccgccactatgtggccagtctgactgcccctggtcacgccgaaaccagtgaaatcccaagtgattgtgtgtgtgatgaaaaacgagcacaagtctaaatgcacaatgacctaatgtggcaattaaaatcatctctttgctaggtcattacccctcttaatagtacggcgaaactaaaaataaactagcaaatttgatcgccctacacctcgatcaattctacattaaagcactagttttactgtcttctttctctttgctttgcgccgtcaattttaatccatcgatagtcatccatgtgcacacatgacgtggacctaacttaaaatattatctcaatagcaacggttagtccacaattagcgtttgtcattaattaccaaaattaacaacgggggacttgatgcttcaatcttcccctttttggtaattgatgacaaacaccacaaatatatatataatcaaacatagatcacatggacatatattgcaatggaaatcaaaagctccccctaaacatatgcatattaatcattgacaacaaatatggagccaatgcacatttcaatttcacattccaataagcacaaacacataagcaatatttcaatgtgaacttcaagaaatattcattcatgagcataagatggtcacatatatagcaatatcgcatacaccatccatcatcgcacaagttcacatcacttaaccaatcaaatcacaaaagtcacaaatcatcctaaaagggctcacaaataaacataggctattacaagaccacgaagggtccaaatgacatagagtttaacaaaacgacaaagaacacacaatatagagtaatagcccatacccatacaaaatatagcccaaaacaccttagcctattagaaatgagggcactatcctcactactactagtcccaacccacaaaacataaatcactcttttctcccccttttggcatcaagcaccaaaaaggtcttcactcttgtggaggagaaggagtacgtgccgaagtggaaggatgaggagcatcacgacgacgatgatacacaaatgcttgggagctctccaacatttggactcgagaatccaatgtacccactctagtgtgcaatctccccacggaagcattcaagtctccaacatccgtgtgcaagccacgaacatcctcatgtaaagcttcatgcctggtagacaagcgttgaatgctttcacttagggtattaatagccccaagtaccgggttgaagtattcgttgggttgcattccaaaataagcatactgtggatggaagaaagcatttggatcatgcccaagaggaggaggaggtgctgagcttgagctagctccaggatgagaggaggacgccgccctaggagcacggggagctccaagctgaaggcggggcttgtactgcttgtgcttcttcaaattttgcccagcagccccaagcttgtcttgaatcaacctcatgatgtaaggggcataatagattccctgagtaaaggtctccttggagatggcaatctcttgcatcatgagagacacaatatcgaactgacggccctgaatgatggcatcgatgacgtgccaagccacccccctaatatcatcattgttatcaaggcgagggaggatggtagctctcacaatcctgttaaccacactggggatagtcctcagaccggcaaccttcccatgtgtgtaccgcactccatcttcataaaactgagatagatagtctatggagagcggattatgggtgtgctcctcatgcaagtcatttccaaagtccaagcgaatattgaggagccgccggaattgcctcctggagatagaacactgaagggtgtcggacatccacttcatctcactatagtctcagccacccacactgtagcatagaactgccggatcaaatcttcattgtagtcttgtttgagagtcacaattcggtcaatgccaacagtcttgaagagatcctgcaagcattcaaactctagagtctcattgatgtctctccaagaaatccacttatgctctgcaaaagctttccctgcataaacctgctcatacacactcttctagaaagcggtgtgaaaacggggatccggggtgtcccgaggactaaaaaactgatcatggtgcctcaagatggtgtactgcgatagattcctcatgttcacaacaaactggatggagagatcaatgtgcatatcatcacttccttcatcctcatcctctccacttccactgtcatcatctccactagcctcctcactagccccttcaacattggcctcaacctcttcatcactttgagcgtactcatctccgctcgattcctcaggctcactcacgggatccggagtgggtgcacgacgaccatggcgagtgcggggaggcatcactgtcaaagagcaaaggatgatagatattagcaataattctagaaacaatttggagaggtgaaaatttgcctatatcctatggaggggtggtcagaccacagccagtaggacggtcagaccgacagcatcaggccggtcagaccacccatggggtcggtcagaccaacggcatcaggccggccagaccgcccgctggtggccggtcagaccgacggctgccggccggtcagaccgggcgcacacaccggtcagaccggtggctgacccacggtcagactgcctgtggctctgggcagacctcctcccacaagttcaagcatccaaaaattttcacatcttcacatttgagtctaaaaattgctagaacaatatagctcaagattggaactagaacatcaaatggtatggcctagttcatcaagattggaataactacccatagccctagggtgaaatagattgatttgagagaatgcacaagagagagagtgatttaccggttgaaggggatgaatcacaccaagaaactaccctctactggtgcaaatcaaagaacacctcgtgcttcacctagggttccatgccatggatcaaaaactcaacaaaaacacgaactaatccatggaatagagagaggaagcggaggagaatcacttacggtataaccggagagaaatccgcggtcaaaccgaggggatttggtggaggaaagagttagggtttgagggaaggtgagagagagagagagagtttttcgagttggggatgaatggggatgagatgggagagggtaggtgcgggatggagaagaaaaggggcaaaaatgcctgggtccacctcggccagtcagaccggccctattcgaccagtcagaccgctgcacctgccggtcagaccgtgcatatagcgccggtcagaccgccaggcccccgccggctgtgcacagcccttgcacaagccggcaacccccacacaataaaattcaacaaaaatttgatttttggagcaattttgaaatgtgtgaggtgaaatattgccaaccattcataacatttgaaaattatgaagatttgcaacaaaactcacttaagtgctaggaggtgaccttttatggtctataggggtttttgggcgaatttgattttcaaataacttttgaatgattaggattttgaaataggtttgaataccaaaaacatatcaaatcttcttctctaccaatttgttttgaaacttttctcaaattccttctcaatctcattttggggataaatctcattttggccaaaactaagaatctagtttcttcaaaatagggccaaaatggcatttttattcaaaaattatttttcttgcaatgtgaggcttggaaaacatataggaaaccttttgaaacattttccaagaaatagttttcaaattacattgattttgcaaaagttttgacttatgttgacttgggcattttgaaaatactactagcaccactagttgatttgctcacatataaaaggaagtagagcacatgtaagagtgcaaaactcccccttaatgtgacatgctccattttcgcaatgaagaaccaaatggcaataaatccaaagcataagagcaaatgagagcaaatatacataatgcaaaaagaagcaaccatggtgcaccatctcaagccacattagagaaatctatgacatttaactcatttctcaatttgaaaaagcgggtttcatcaagtggcttggtaaagatgtcggttagttgatcatcggttcttatgtggctaatgactatgtcacacttggcagcatggtcttttaggaagtgatggcgtatgtcaatatgcttggttctagaatgttggaccgggttattggctatctttatggcactatcattgtcacataggagtgggatttttgtgaaggatatgccatagtccaacaatgtttgtttcatccaaagcaattgggcacaacaactacccgccgaaacatattccgcctcggcggtagagagggctacggagttttgtttcttggatgaccatgacacaagggatctaccaagcatttggcaactaccggatgtgctctttctatccactttgcaaccggcataatccgaatcggaatagccaacaagcttaaacttagcaccttttgggtaccacaagccaatagtagaggaatgctttaaatatcttagaatccttttcacggccactaagtgacactccttaggagcagcttgaaaccatgcacacatgcaaacactaaccatgatatccggcctagatgcggtaaggtaaagcaagctaccaatcatagaacgataaaactttaaatctaccggtttacctccctcatcaaggtcgagatgcccgttggttgccataggtgtcttgatgggcttcgcatcctctaagccaaacctattgagtacatccttgatatacttggtttggctcacgaacgtcccgtccttgagttgctttatttgaagtccaaggaagaagctcaactcagacatctcaaattccctagacatcatatcaccaaattccatgcaaaatatctcattagtagaaccgaatatgatgtcatcaatataaatttgacacacaaagaaattatcaccaatgatttttgtgaaaagggtggtgtcaacttttccaattttgaaatcctttgacaaaagaaaatttctcaatctttcataccaagccctaggagcttgttttaaaccataaagagcttttgagagtttataaacatggttaggaaatatgcaacatttggcttcctcccaacaattagctcataagaagtctttttcaagagacgatgcaaataaagcctattggttgcatggcaagcggtgtttatggcttccgcccaaaaggaatcggaaacaccatattcatcaagcatagtccttgccatctcaatcaatgtacgatttttcctctccactacaccattttgttgaggtgagtaggtagcggaaagttcgtgtttgataccaagatcatcacaatagtcatcgatattggtattcttaaactcggaaccattgtcaattctaattttcacaagagtgcaattaaattcattttgggccctttttgtaaatttttgaaaagctcagcaacaatagacttatcatgcaaaaagaacacctaagtatagcaagaataatcatcaacaatcacaagacaatgactattaccaccaatgctcttataggttgttgggccaaacaaatccatatgcaatagctccaatggtctagatgtggacatgatactcttagtaggatgagaacatgcaacttacttgccggcttgacaagcactacaaagcttatctttctcaaacttcacatctttcaagcccacaactagatcacgttttgaaagtttgctcaattgattcatgccaacatgtgctagcctcctatgccaaagccaacccaatgaagtttttgcaactaaacaagttttcaaatttgcttcactagaattgaaatcaaccaaataaagatttccatatctaaaacctttgaacacacaagacttgtcaagaaggctagaaacaataacttcttgcgggaagaaagcacatgacaagctaagatcacaaatttgagcaaccgaaagcaaattgaaatttagagatttaacaagagagacattatcaattgacaaatcattggagatagcaattttacctaacccaattacctttcctttgctattgtctccaaatgtcactttctcttgttctttccctcctacttcaaatgtggtgaacatagccctatcacaggtcatgtgttgagtgcatccactatcaagcacccaatgggtcccaccggtgcggtagttcacctacaaaagaagatcaagctcttttaggtacccaaacttgtttgggtccttggaggttagagaccaaagctttgggcacccaaatggcattctttttaccatcgagtataggggaacccacatatctagcaacaatgctaccatcatgagccttcctaagcatataatgagaatcaaacatgcatgtcttaggaggcttaccaccagggcaatcattcaccaaatgcccaacctcacggcacttggagcaatacttaccattgctcttgacaaaacgagtggcacggtgagaaggtttcttacccttctttggaatgaatccaagtccctccttgttaaggatgcaccgttgctcactcaaaatcttgtcaagagtgttcttacccttgaagcacctctccaaactcttattgagcttggccacttgctacttaagctcattgttctcaacaacaagtgaggcatcacaaatggaaatacaagagctagagctagagctaggcatatctacaagatcatcacaagaggtagaaatgctagatgatgcaacatgagcaatatggcaagtagcactatcatcaagcaaatcacaagatatgccaacatcaatgagagctctatgttaagtagtggaaaggaggttgtcatgagcttccttaagcttctcatgagaaatggtgagtctctcatgagaagtctttagctcctcatacaaagcctcaaaagaagcatgatccttctttagggccttgaacttgacaatctccttctcactataagcatagagctcctcaaacatactcacaagctcatcataggaaacatcatcacaatcatcatcactctcactatcactaagagatgttaccttagaggagccctttgccatgagacaaagtggagagaagagtgatggagcctccttgatggcaacaacggccatcttcttcttcttggagcttgcatcatcaccaccttcttcctcagacccggatgaggcggagctctcctcatttgagtcccattccccgatgaatgcctcaatcttcttgccttctttcttaagcttcttcatgagcttgtagcctccactcttcttcttggatgacttgtctccatcatcatccttggaagggcacttggaagcaaagtgtcccttctcaccacactcaaagcacctcaagttggagagagtcttgttgggtcttctatttcttctcctatttgagttggagccactttctctctcctttctccttcccaagagatcattgaaccttctagcaagaagggaaatctcttcctccaagtcctcattgacttcattcaccttgcccttgcccttatcttcaacttcggcttggagagcaatgcacttcttggaaggtgaggcttcctccatctccttcttcttcaacttgtacatgtcattggtgttgatcttccccaagaggcttgcgggtgtcatccttgacatatcggagttgatgagcatggtgacaagggtctcatatttctccggtagagccctaagcatcttttgggcaacctcaagatcggtgtagtttgccccaaaccccttgagaccattcacaatgacattgagcctcccatacatgtcattcacactctcatgaggcaacatggagaatgtctcatattggatattgaggaaatgaagcttggcatccttgtactcgcttgtgccctcatggatctccgtcaacttgttctaaatctcatatgcggtctcaaggttgctcactctatcgaactcctcttggctcaaagagttgaacaaagcattcatggcttgggcattgagtttgaggttgcagtgatcaatctccgtcaagggcgtgccggtgatagcaaagcctacatccacaatactccaaatatggaagctcatagctttgaggtgagtagacattttaattttccaagtggagtagtttgtgtcattaaacatgggagccttccctacatggttcacctcgttcgacatcttctctctaggcggtgaagcctaatcaagagagatcaagctccgataccacttgtaggatcgagatgtcgactagagggggggtgaataggcgatttaaaactaaatgacacctaatcaaaactaacctaagttgctaggctttgtgagggtgaactctaactaagcaactaagttatgttttgcaaacctagggtgataatggctcaattatatctctaggaaagtaaatcacactcctatgtcaatgtttagcaatcctagggtgatatgatctcaagtatatctctagaaatgtaaattgcacaaatgtaaatgcgacaatcaaatgagacaaggagacaagagatttttcaccgaggttcggaaactcgtcggtttcctactccccgttgaggcgagcccaactccaccgctcaaccacgaagccaccgcacgcccccttcgtcaaggggtgggcaaggcgggagccggcccacggagaggactacccaagcctcgatcactagggttgttcttccttcactccgaagatggtgaactccaaaccactcacaaaccggcgccgggcctcctccacaatcttctcggagaggttaccgggcaactcctccacaagccgtctaggaggcggcaacctccaagagtaacaagcaatgacccggcgtggagatgatcaatcaagtgccacactagctctacaaatggaagcaatgcacttgactcttggctaattaaccctctaacacactagatagatgaacacaaagctcaagtgggtgtgagaaaggtgcaaggggtgtatgcaattgaattggatgccaagagagaccccttgctgctggagggggagtatttatactcccaccaaccaaaactagccgttgggggcgaaatcccccaactttgtgctctgccggtctaaccggaggtatgcggccggtcagaccgtgctactctgcaatggctagaaaactagccgttgtagtgctgtcagagggccccatcggcctggccggtcagaccggcgttgagtgggcggtcagaccggcctcggctcggtcagaccgccatcggctcggtctgaccgaatacggctccgtcggctctgtatcggccaccccgagcagcaccatcccggcctccagggggccggtctgaccgcgcatgtgccgccggtcagaccggccttatgcaccagtcagaccaccgtctcgtggccggtcagatcggccagggcacgccggtcagaccgccactatgtggccggtctgaccgcccctggtcaggccgaaaccagtgaaatcccaagtgattgtgtgtgtgatgaaaagcgagcacaagtctaaatgcacaatgacctaatgtggcaattaaaatcatctctttgctaggtcattacctctcttaatagtacggcgaaactaaaaaataaactagcaaatttgatcgccctacacctcgatcaattctaaattaaagcactagttttaccgtcttctttctctttgctttgcgccgtcaattttaatccatcgatagtcatccatgcgcacacatgacatggacctaacttaaaatattatctcaatagcaatggttagtccacaattagcgtttgtcattaattaccaaaattaacaacgggggcctagatgcttcatgcgccgacctgcgctctcctcctcttcgtccgctttgtcttctccttgcactttaaccatttgtctaatgcagtgatgttgtttccctcatcttctgtgatgcatgcgcgcacttggaagaactttgtgatgttaattcttctaaattttcctctatggttccgatccagtagtagagttcttgttcatgaaggattgtgttcctctgaattagttcctgtaagcattattcctctggaaggaaatccgaagcaaaatttcacaaatatggccatggaaatgaccgagattaggaaaaattgcatcacgggcagtcagatctaagaacctgggaaagaatagaacttgacggagtggtcgatggagccggacgctagcgacgcgactgaattgatgtggaagggtgacccagcccaccaactaatctggcccacgaaattcatggcggtggcacacaggcaaaaatacagtccattttgcctccctcgaacatccattatattgcattttgccttctgagcggttttgacgatggaatccaatgagggctttgtacagttttggagtttcctttaattctaattcaggtggggagtccccccccctccccgcgcggtggtggcattcaaaaaaaaatccagtgagggcacgatgtcttgcaagtagatcgcagctgcacgaatctaacggtgaagacaacactgtcaaaggtgctctggttgaatcaagaacgtgatgatgatatgtgaacaacggtacacaagaagaggctcgtcttcccgatgaaccgttgcactactgttgagggtaaagattatgtgtaccatggtagttctgcaagaaactcaccgtatagagagagccacgagggtggagtttgggatggcgtcaatggtgaccacaatagtttgggcgttcctggctgaccatgtaccatgtgctccaacagccaagcctttcctctacaagtggtgaagaacctctcgagaatgaactcctcgagttggtcgggttgaacaccacgaaccctgtcaaacagcttggagcagagcttcaggacaatgtggcccggagagccactttcatgaggtaagacacgaatatcctgaatctaccacaggtgttgaagatgccgccaaacacataggtgttaatatatacgacaaaatagaggaggggatatagagaagatggaggagaaactaagatgttttttcctgagtggaccgtcaacataataccatgcacgacaaaatcgctttcaaaagcgtttgaggatataaattaatctcgtagttgagggagcttttatactgtgttttgtggttgtgggatatgaattagaacgtatatatagctaattgagtcaaaatggactttttcccaacatgcaatggtttgtcaatttcatgccgtgttcgaggaaccaattgtaggggtgtggaaaaataactaatacgaaccaactaagaccaatactgcaatgactaagaccaaaaatttcaatcattaactctaacttaagtagagatatacgaaatgtaaacataagtttttcaaaagaaggcaaaaagaaaaaaaatgatataagctatctagttatatgtttttcattcatgtccagtaaaggtgagaccaccaaaggagagaaaaccgataagtgagacgacaaaagtaaggagcgattcactcaagacattttataaacggttcaaggtagttatattttttttctttttccactattatcttactggcataagtaacatagacaattagtttgagagtcaaatagggaagggaggtaaaaaaaaccaattttatataaaatagtaaaagaagaaggttcaggcttgcgttattacatatctgttaacgacttaacaaatttggtaagtaatggaccaggttcggcattggaatcgaagtggattcggcaaaggattgtgatcgaagaacagagtgcgtatcggctgcggaggcattggctagagtctgcatcggttgagatagatcggacaagggatagccgatacaaccgattctattaagatggctgtgggaccgtgtttgaagtcgatcaaagtgttacgaaaggattgccacgatggggataagctctcagataaggcaattgtatctattaattagaatattttgaatagtttctttagagatatgtttgggcaaaagtctaccgtaaagacttgtatcttagaatttgttagagataaggaacttgtccggcatggacttatcatgtatctcgggtataaatataacccgaccccatgtaatttacaacaacagttcaataacactttcggcgcatcgccacccttttcactttcttctatttcgacgagttcttactttcgggttgagctgcatcgattccgatcttcaactagaggtaaacttgtcatgacggcttgcgttcttgggattagtgcttccatctttatgacactctaatcctgtttatgtaattcgtcgagttatcttatacactttgcaatctctgttagttgcgctatataacttgttatcggttgttttatactactagaaagtagtcaatagagttatgtctcgttattaatctagattatatcgtgtatcaaccatcttttagaggttttcatcatcctgcctagatctcatatttatctttatgcttaatgctgcatcggttggattcgatctattaagtaatatccataattataatatctggcttgttttaagattatcgatagagatagtgtcggggtttcagccgatcttacctgatttagcaactttatatctcatatgcttgattgatatgctaggtctgccctttatgttaatatcttattgcattaaggtatattaggcttcttgtttaatatattttgcatgttttaatatcttagtataaagtggtatcggagtattagccgatacatgctagatctatctgatcggctatgctattaaacgtctatataatcattgctttaatgtatctttcgacttaagtgatttatactgtctcggcatggtgaccgatctatcccaatcacttagtctaaatatacatcgaaggaatgattatatgtcgttaatatctacagccgatcgagtagatttagtcttatcttatttattcatgactgtcgatcaattccaaacatgacatcggcttgaagataaatgatatatcatcggcaactagccgatcggctatcgtttatggatttaaccgtgtttctcttgtctttctttcttgttgattgcaggatcaaatcaactggcacgctcacgaacctaaaagcgaaattttggacctgcacaagagttaagcagatcttccaggccagtgtgtgttttttgcatcaacaatatcctatcgaataagtgttagggaaatctttcaaaagaacttttccatagataggtgtactatggatgaattcccacctccttggaggagtgaatgcaaggaccactaaaaaatggatactttactgaaaggcaagtgcttatttatgctttatgtagtggtcagccttcctaccttcatgcctctagaagcttctacaaagctttgcttccggtagaagctagtcgcttcggtagcttgcctgccaagccacctataggcgaagggccgaagcattgattttgcaaaccattagtttatatttaattttctcgattcccttccgacggactaagaatatgagaaagttaccagccgagacaccaaaggcgcgttgcaaaggattcatttgaaacttatactgcgaacgctttcctcagattcaggagatgttgtttctcgggctgagggataataacaatatcatcaatgtacaccaccaattctcgcgtacctaatcgcacttatcgccattctggttgcccttcggtttggcctaagagttgggtccctgtctgtaattatgtgggtaggtaacccatttatgacttgtagtctttctgcttatgacgtagcactattctggcaatgcatcatgaaccgatatatatattgtttgctaatacacgaccaattaatgtttataaaaaaaagtttttcagtcatcccattttaaggactcacagaaatagcttggatagtatcacaatctcttctatactgtagtactggtaattcacgttaactgaagaggagttattgaaacaaaaaataggattaaaaaggtactcactacaatagtcgttctattttttgcacaatcatctcatcggagtggatagtatagccttttttaagtaaagattttctttaagacagtgtaaaaaattcctggacagggccttacagacaagcgcgtgcacacgtgtccccttatccacccggatgtcatggagtatatataaccccctccctccacacactgcgtcaaccgtcaagagagaagtattcggaaagaagagaaggaaaaaaagaatttttagagagaggaggaaaaaaaatatccccaatcccatcatcccttcacccacccgcacgcgtctcctccgactccgatccgagctccagatctgcggcgccggcgaccaacctctccggcggcgggggcggcggcggagatccacgatgccttcgtcggagcagggggcctcgcccctgcgccgcctcctccgcgtcgacgccctcgtcctcccctccgcttgctcccaccgccttaagccttggtctctccatccccacctcctctcatcctcctaacgccatccaatctctcttctccccgtctctttctcctgctccccgttgccctcccatttcttccccttttcttct

SEQ ID NO: 59642 - DNA, 14212 bp, Oryza sativa
ctcggtgtggtttggtttggattgtattgggttggatcggatcggattagccgcgctatagcgtcaggggatcagctcggctcactgtggtttttgaggtgttagggtttgagtgctaggttgtttgcttgatggatggtcattcctgtggtgatctcgggagagtgtcggaagtgatatccgacggcacctcatcgggtagcgcagacggcggcaagagcctgcctgagaagcattctgcgctggctgatgctacttctggagtggcggcggagaatgccgataatttgtcacaagctgggaagtacatggatttctccagtaccaccagcttgggggtgaagaaaggcttccagaagtgcatgacgtttccgccctctagcggcgaggcacaacagcagcagggttcatgctgtgatgcagataagaatcccaaggatgtgccaacctatgagcgctccgtgtcactgcccgtgagtatctaatcttcataaacagcatatcatatataagaaattggttatatgttcggactaatagttatcttcttaaccttcattaagtgtatttgaactcaattctaggatgttgttcttatagtgatagttgctgcaaaatggtttccagctgctgtctgggagtagcttatgtctactttaacttaccaaatttatgtttgatttatattcattctgaacacatggtttgatcgaaacgcttcaatatcgttaatatccatacattattatcttttggttttattctcctgtcatctaaaagcaacaatatattgaaccacttgaaaaaattattggaaaaagctctggttgtttttgcactatccgtagagtgtctcaagtccaagacttggaattgcatagctggtctatattagcaaatgccttctttaaatgacaccaataacagtaggattgatgttaacactgatcaatttgttgcatgtcataataatataaatttggacttaattgcctgagttgatatttcttgtggtaatgtaaatttatcgcttattatttatgctatatttagaaagcgtgcatcagatatgaatgctatgatattcttccattctttcctgttgctcttattataggtaagagatcaaataagcataatgttattggtatattgctgagatgaataaattgctatgcttgtccttttgatgttaccacatccatagtactgctgaaggcatgcgtggtatacatctctatgcatatatatggttatagttgggatttgatggtgcaagcaaccaaaccaacatttcttttgcatttgaaattgattagtatattcttctcctcacgttggcctatttctatttgtctcgtggaaccttgtggctattaggaacgcttttgttgttattctgttattaacgttgcctcattttccttcgcaacagccaactttgaagatcatatctgctatgaaaggaagccgccaaaagaatgggatggcttcatcaactgaaagtcgccacgtcaaatgggcccctgacgtgtatgaccccccagtgacatctgtatgtcattcagtgaataacagctaccagcgtcggtccaaatcccggaagaaggacaagaataagcagaagcagaaacaaaagcaaaagggtaggtccaagaaaaaccaccagaatgctatccagagttcagcagtgctccaagctcctgggtaaaattgctttcttcactgctattttgtcatcatcacaaaacatgcaagtaaattctaactgattcatgcacagcgaatttgataggctcaaggatgctgaaaccacaagtagtaattcagcaccagacgatctcaacaaacatgagaccgatatattggattatggcatcagcagtcaagacgccaaatgtggaagcagctttttgcgtgaatcggctgctaaaatgcatttctccactgctgaggcttcctgaaagaaaggaaaatgagtcctgcggattctcccttggtatgtaaatatgatggatgtgtagataaataaaatccagtttgttgttgtgtttcctgctgtgtgaggcgttaagagaacttctggcgtgctttgatttggagcagttaccatgactgttggactggtttttgtatgtattgatggacaaagctagtaagcattaatctatgagctgcagttgttttccttgatcaatgattatatatcagctgctgttgtattggttatagtggattctgactttctgataccatttcagtcttcaccaaaacagcaggctcaactacacttctcctgccatttcatcatcagaggaaaaagggggaactatattctccctgctttatcgttacaattgacccacaaggttggcacgcttccgagttctcgttgatgatcagacaaaattatctcaaatagatccgtatgttcaaagaggatccgtactccaatttaaatttgatactagagatatttcggtaaaggcggaatcttacagaagaattgcatcattcaacataacagacgccagcgagaaagaatcgaacagcgatgagatgtcatgatcaaacgcagaaaggatagccttatcattgcaccgcacatagattacagccttacaccgtcccttagataggagtagtactaagatgataacaaagtcataacccattgcctcaggggagctctctaaattctcatctgaagctcatacttttataggtagcagcatcaaaacaatgctcagtttgcacggcctctgatcacgtcgaggccaacctcagttggatcggtcgcctggagctccacctgaatgccgtcgagctccctcttgaacctgtccttggagctcgcgtagatcatcttgcttctcacgcgcgatgtatcaggagacctttgcattggcatataaaatcaatcagcgagagtttctactacatttcaggtgatgttgtaatattgtgagaagccgataagagagatgcggaagtagtaccatgcaatgaagaatatcttgctcttctggcagttctcctcggtcacgaaatcgtagtcgaatatggcgtatctgcattcgttggcagggaggctagcggcaaaatcgtcgtagttcagtacgggctcgccaaccttctccacgacaaccatcttcttcttctcgtctatcttgtaaatgatgaagcggtaggtcctctttgccttcagctccaggaacttgagcttgcactcatcgtccacagccatcccagatgctgcattcgcctacaggtaacaacaaggcagacagtcaagctaaataaattcaacattgctcgttacatatattaatattgcagttgatacatttgtggaagtacatgatgtgagagcaactaattaaaaacaggggaggatgcagaaagcagtaaatgatttgtccatgactatttatagtaagattggctgtaattggttggctgaaatattcaatctgaattaaaacacaattcactgcaaatgcctggcaggataaaggctgtctaacaaactgaattccgtgacaggatctactatgttgatcgcaagctcggctggcgagatgtccatatatcacagcctgataagtaatgaacacttcacaggtccacatcagacaatgataataatgcttatggagaacaaaaggttgataacgtgactgaggaccaaacatcagggtgaaaatcgcataaatagttaataacaacatgatgactggtcatgcatattccctttcacacatctcgtcatcagttaattaagcaagcctttttaggcatgtcgtatgagcaacaatcaatagagacatgcgattcacatacgactagtaggcaagatcccgattcttgcttgtggactttccatacctgattactagagcaatgctgtgtgacaaaacaaacataactccttcaaataaaaccaataagcttttcaagaatgttaggtgccctgacacctacggcccgtttggttggggggagtttttagaagggattgggagtttagagggatgaggctattaactgttttgtttgattgggagacatgggaattttggtgggatggggatggggaattgaggaaggaactccctccttttcaattcctgggtaggggcaggtaattgggagggaattcctcctttacttcgcctaaacaaatctcagccatccgttttcactaatgacctaatctccaactaaactccctgtcaatttccaccacctctaccaaacaagagactgggatgaaaaatcaaatttccatcttaatctcaccatcaattccctcgtgtaaactcccaatcccctttcctcaagatgccaaacaagccactaagggtttcctgaagaagcaatgggagccacaagccaggtagtcgccaactacggccgccccccatatacaaaatctttgaaggaccagctaaaggttaggctcagctaaggctggatataatccaactatatactctacccaacaaaaataataatcaagaactctagctgtacggcctgtaccatccatggcaaaattgaaggcacctgcttacaactccacatgttcattcatcactatgacaccgaatcgatactaaacttcgcgcatttggaacagatctttgttgctagggaaaaactgccaacactctagccgaatagtagcactaaacggatgcaaggaaagtacccaggcagcaataatttttcttttttttttgaaaaaaaagcaagaacacttgtggtattgtgaatatctcaccaacgaacacacactaagatctacaacaaacgtgtgacgaacagattacgaatctaagatagaaactactgtgcgcatacgcatcaagaaccagcaggcgggcaaacagtcctactatgtacaagatgactagctggtagatgagatgagatgagatgaggccggagggggtataccattgcgggcggcgcgaaggggacggattcgccggcgacgaaggaatctaagcaaagcgctcgcgcgtcgatggatcccttctctctctctggagctctgcgcttggtgtgggtgtgggaggtggtggtggtatttgtgttggggagtcgcgtggaatggacgctcgcttgctcgccgcatctccttttctttctcctcttctattattttcttttcggtggcaccgaccgaccgcgggcccacctgtcatccactcaccacataacctacccgtgtgttgggccccaccgcatcttttcatgggccgccctttcttccatcgggcctccccaatacaatccactcatttcggcccatggtggtggtctcatgttacatactatacgagtatgagagtatcccaatttcaaaagcaaagtacacagttcaaattaatttttgaaagtaatttgaagaacgttatatacaaattacaaacgtgtaaagtacttaagcttgcatgatactactagcaaatctggcttattttaaatttttttctgccattcgattacaagctagctaattaaacaggagtaatttatctttatcaccatcgtcgtcatcatcctagctagtgaatgatttttctgtgtttttatggctcggccatgtccttgttgccgccgagctcgccgtcgtcgtgggcgtggccgtcgacgacgatggacaccggcagctcgtcggcgttgctcatgtcatgctgctgcaccaccagcaccgacgacgtcaccccgtgccccgccgacgccagcgcgtcgccgatgggccccagctccgggtgctccgccgcccggacggccagctccgccaccatcgccgacggcagccgccccttgccgaccaccaccaggccgtactcccggctcttcccgatcgacaccacctcctcgatcacgttccccaccaccaccctctcctcgtacctcaccatggcccccatcctctgccggaattccgccaccgccgcctcgtccagctcctgcaccgccgtgtaatttcatcaacctcattagctgttcatgatcatggctgcgccatggatgatgatgggatgtacctaccttctccttgtgggtgtcgacgatggccgttgagaaggtgtagctcttgtcggcgttcttggtgttcgacgggcgcagcgtcacctcggcgtgctcctcgctaccttccttgccgtcgacgaaccgcacgacggtgacctgcacgccggggtgctcggccatcctcccggcgagctcgagcgcctcgcggtcgtccggcccgccgaagaagacgacgcagacgccgtgcgcgacctgctccgagctgacctgctcgccgccgccgaagccgcggtcgacgaggacggcgaccgagcagggcgcctcgcgcaggatcctccggttgacggcgcgccactcggggccgaggtcgtcgccatggccgtggcccgggtggcgcttgtggaacgggagcacgacgagggagacgcgcttgtcctcggcgacggcggcgacgtcgtcgtggatggtgtggagcgcggagacggcggtcatggggcggacgtggacgtggccgagctgcgcgtaggtgtcgaaggcgacgtcgacctggtcgccgccgccgcggcgagggcggaggaaggggacgccgttgcggcgcgcggcgcgggccatgaggatggaggaggtgcgctcggtgagctcgaccatgcggaggatgtagagcttgacgaggcggcgcggctgggtgtggccgcggatggtctcgatgaggttgatcagcgccggcacgtcgtggccgccgtgtatgcaggccagcacgcgcagctccttggcgccggcggtggcagccgcggacggtgaggacggcgcggaggggccatgcagcttgcggtggtgcaggcggcggcggccggcgttgcgcgccggcttgtagatggccatgactgtgggggtggtgatgaaggtggtgaccagcgccattagcaccaggatcgcaaacgtctcctcgtccagcacctgtgttacaccaacacacaaaacattactcattactctctccattttttattgtaagacgttttaactatgattaagatcaaattgttttaattttaactaaatttatgaacaaatatagtattatttataataataaaatagtttcatcagatcaataattaaatatattttcataataaatttgtcttaggttgaaaatattactacttttttctataacttggttaaactaaaagctatttgactttaaccaaagttaaaacgtcttataaattgaaacggatgggtaataattttgcactcgttttggatgcatttttattggttcaaaatccatatcttggatggagccaaaatcaaaatcaaaatgcatagttcccaaaaaaaaaatcaaaatgcatggcattgacttatttagtgctacgtcgccctcggttgcatgactgacagatggacggcggagccctcaagccctgaatggagcccacctgtcagcgacttcacgccgctcatcttcaagctctgaatggtgcagtttgaagaagaggctgcttttttactgcacctatacattgcaactctggatggtctacggatggcaagcatcatcaaatgcaacattgaactttgaactcttgacaacagtgtggtcagtgtgtcccacttccctatgcactctattcagaaaccagaagagaagattcatgtggatcagactacctttgttgtttgcatctgtgaaattcattcatacttccaaaaccaagaaaatttctcaaaagtcacaggaaacagcacgtctcaaaaaaagaaaagaaaaagaaaatgaggaaaaaaacagtgtagaacagcaacaggaagcatgtaacaggtgacctctgcttttgtcctcacaagagcctttcttttggctccttccatttctcattgcagggcaactcaacaataactttgactctaaaaatggagaactaattcaacaaaaatacctcctctaaaaagatacttcctgtggttctatattaattgacgttttgaacaagattgaggtcatttttttataactttgaccatcaataactttaaaaatatttagtttaaaaaaactaaaacaacatataaaaatttctctttcaaagcactacaataaaagtaaaaatgcatttatttattatatatattataatagaaaaataaggtcaaaaatatatcttgtagaccgtgtcattatccaaaacgtcaattaaaatgaaactggagggagtacggagtatgtaattcagctaaaacacctctaaaaaaatcaataaaaaaccctctaaatttaaaatcaacaaaaatatctgtaaaaataaaatcaacaaaaatacatggtacttactgctagtatttttttagataattgtattatacttggtattataccagtaggtaaatttgtacatgtatgagtagaagaagaggaaaattagaggcaccttgcgttctctgccaatgttgaggacgatgagctcgacgaggcccttggtgttcatgacgacgccgagcaccagcgcctcgcgcgccgacatcccgcacgccatggccaccgcgaacgtcccgacgatcttcccggcgcacgccgtcccgatgacgagcgccagcatcccccacgccccgccgccccggatggtggcgacgtccgtcttgaggccgctcgacgcgaagtagagcggcagcagcagctccgacaccaggtcctccaccctctccgtcaccctccccgcgaactccccctccttgggcaccgtcagcccgaacacgaacgccccgaagatggcgtggatcccgatcatgtccgtggcgagccccgacgccagaacgcccgccagcgtcgccgccacccacacctcgccgccgccctgcccgtccgaccgccgcgccacccacgccatggccggcttgacgaacaccatccatattgtgacgaacgccgcgcccgacaggagcacccagagggagacgatggggctccggtggtcgccgctgcccgagatggccacggccagagcgagcagcacccacgccgccacgtcgttgaacgccgccgccgccagcgccgtctcgccgatgggggtggtgagcagcttcagctcggcgaggatgcgcgcgaggacggggaacgcggtgatggagagcgcgacgcccatgaagacgaggaacggcgcgtagcccgcccgcgcggcgcccgggagctcgccgcggaggacgaaggcgacgccgacgccgcacgcgaacgggagcgagatccccgcggcggcgatggcgaaggcgcggcggccgctacggcgcacggagcggaggtcgagctcgaggccgacgaggaagaggaagaagaggaggccgaggctggcgactgactcgagcacgggcgcgctccagggcgggaagagcgcgcggaggtaggccttgttgcggccgagcgcggaggggccgaggaggatgccggcgacgatctcggcgatgaccttgggctggcggagcgggcggagcaggagggcgaggaggcggctgaggaggaggatgaggagagcttggaggatgaggagcgggaaggcgaagtggagcgggtcgtccccctgccacacgccgttggacgacgtcttcaccgtcgccatctccgcctccgtcaccggcgaggacatccccatcggcgaaatgcggcggcggcggcggaggaggaggcgaggtcgaagaagaggaggatttgagtttgtatgtagttgaaaaaaaaatgagagcgcgcgggtgtctcgtgcatgtgatgtgacaatcactgcctctgggccatatatatgtaagcgactctgtttttttttttcttttttttaatctatacggtaggagcttgtcgaaagtcaaaaaaaataacttaaaaatggagagatcaaaatcagatagctttttttttcgttagagtttttacttgtttatttaaaattaagagtacttgcgttgaaagtaagtgccacatcgaatgataaaagcttattataaatcgtaacgactaaatcattttttatctcttaaaaagttaataatgaaaaaaatcacattaaaaacatcaaaattgctaaatgttagcttttacttatttttatttctttatatggcaatcgactagccctaattctacggggctgttcaacgatatatttaaccatattattttttttgacaaaattattaaaaaattcttacatttagtttgttgttaaatttttttaaacacataataaattatgttaaaattttaatgatattgtcaacttataaaaatttaataagatttattttgacaataatatgaacaaccttctccaactttctcaggagtcaaccacaaacaagcaacaggttaataatctagtattctagtaataggtaaaatgggacacgtggcacgccgctatagctctctagactagagttggagacgttgcccagttcccctgcaccaccggcgccacctcctgcttgaattttttcgtcgccatcgcagtgcgccatctatccatctatcgctagccattgcttttttttctttcaaaaataatagaatagaataaacctacagcctattattataacgtagcactctaaacaagtgtattttaaataaaattaaaaacacccaactaaaataacaaataaccaatataggataaggagtatatatttattgaagtatatttgtgaatctctattcataattagcaaaagttgtataatcgctatctcaatcttatgacatacaatcatagacaattatgtagatttgtagcttagaaatgcttatagttttagaaaagatgagtagtggctgactttatttttttttctaaatagttaaatgggtatacataaatggatgatttgtgatcattgttcaaggggttaaacgaatgaattacttcttataaagtttttctttaacaatggcacaatttaaaagggaagcatgtttcagacgttcaataatccagtattatatttgctcgaaaagaacatatacctggaaagcctgggtttaaatcctagtacctaaaatatcacacttatatgtggacttttagcagaatttaaattttactaatattgattaaggatatgccactgatttccgtctttttgaacatgtgttgaaaggtgcgagcgtagtgttacggtgtaatggtttgcgtgagtcggtgagtgtgcgtctatcatgtaactgggaaaagaaaatgcaccgatgattcctttggaatacgttggttttacaagattttcattttcgtaaagtttactagtccaaatctcagaaaatctgttctagatgacgccttggttcacgtaggagagcatcatcaccaaactgttagtattaatctagttaactatatctgccaccaacagtgaactatatccgcttgtatctgaaaagtaatttatcctgcatcatggagcagattgtatactaatattgctcaccgataagattatccgattcccgaaattaagtaagattaaactagccatgttattctggcgtcgatcgaccaattaaggcgtgattaccaaattgttgagtgacgatcgaacacgagaagcatctgtccacttccaaaatctattcattcaaccatatattcatgattgtttcacttcaattttcttttgacctcccataaaattaattaaagcgcagcaccattcaccaaaagcaacatgacagggctctcttccacagtaaacttcagactttcagactataccatgattccctcaaactgcgtcatcacaataattaataaataagaataacaagactaagcactaactagcatgaagtatcttgatcgatgaacacttgtcatctttctcagccttgcaatgtgggacaaaataatcgtgccttggaagttaattactttggaaattactactttatagctagtagatgctaatagcatttgacttcacttccaattttgttgtagaagcaagattctagctagctagctggagcatccaacttgatttttacacacatgatgtatttaatttcttgaagacataatcaaactgattaacactgcctgagatcgataagcaacagattcagattggtgagcaaagagattcatgttaacagtgaaataccaattataattttgtgaattagcctagcttaatcaagagtccttgcaagtattgatgaagtacaaacacttgatgcacatgaagaagcatgcatgtggcgttgaacaactttattaagctagcacgagatcgaggtgagatgccacggaaaaggggtcggatcagagagattacaagttgagtagcagtaaagcaaaatctagctacttatgtgaattaataagctccatggaatcaatcaacatctcaattacctgcctaatcaacacatatatctgtcgattgtcttaagcccatttcagctgcagctaactgttgttacatgtgatcattcacgggatagatcaaattaaacgtcgacatactgcctacgctccaaccatcttagagttcatgagattcaattgattgttcgtcttccacggaatgcttttcccatgattccatctcgactgattcctaaaaaagacaaggaatcaaggatataaaaatcatagatcatgcatatgctggatatcatatctaaactctgtatgccatgctgcatatgcatggtcaactgctctctctgatgaacacttgtgcattccggtttcagacaagcatggcacagcagaatcaacaatgagtgaacaataatgtggcatgtttatttcagcagagggaccaaatcaatgagttgaacccatgtttctcccatctgtatataaattggaatgcacgagtgaaatgtattatgcatattaagtgctaatctaattggttgtgtttaaattttctgaagaatttgttgctgcagtagaaaactactgagtattggggtttggagctcaaaattattcatagacgtgaaaaacaaggggagctttaacactaaccaaatcctttccaatgatattttttttatataattatcatttccgacagctagtttgtgctgaggggctctatatttctggatcatcgtagcaagcgaataactgacaccagtttcatgattaatggcggccatcttgtcctcaaaagctttaaactctcagactcagcacaacacctgtaaaacaaacgaacaaaaaccagcatgttaaggggaggaaacacaattagtgcaaaaattatccataattcactccagcgctcttgattttgtttccttaagatgcatatgcatggaggccacaaaatcaaactcgaattaaaaaaagaaaagaaaaacagcggaagctcgagtttgctccttttgccgatcaccttgcttgatctctcactctactgaacaaaaatgggggaaaaaatattggagatggttaggaacagaagctaatgaatgtattaatgggctaaattaattaaggaataagttcactttgggtccctctatttgtcgcctagtccaattttcgtcccttgaccgcaaaaccggatacaacgggtcccccaacttacgaaaccgtttaaattaggtccctcggtagtattgtgtccggtttttgctgaggtggcgcctacgtggctccttttgattaggtttttgtccaacgtgtcattgacgtggcgcttatgtggcattaactagataaaaaaactgtgggacccacatgtcagtcacacacaaacaataaaaaatggtgggcccatgaggacccacacgccatcctcccatttctctatccctctctatcctctccctccctcttctctcgctctccaaactggcggagcggcatgggcggcggccggagcggacgacggcagggtggagcggcagtcggagcgggcgacggcggggcggatccgaggggcgaagtgggtcgggcggcggctgatcctcgccggcacctcgatcagcagggcgggagagtggaggcggccgttccgcgatctgccgaaaccagcctggcggcggcgacggcgccaccgcggagggcgatgccaagggggaggacgatgaggaggacatcgccggctccgcgtggttcccctgacctgcgctggcccccgccgcacggaggatgggggc

SEQ ID NO: 59643 - DNA, 4519 bp, Oryza sativa
cattaattaattgtgcggctgacgtgcggcccattttagttggccgggatgggcttctggcgcaatcgaggcccactttactttgcttttcgttgggccgaaacgggagcccgttgtaatcatcattgatgcatcttactagtagtacctcgttaatacactactccctccgtcccataatataagggattttgagttttacttttactgtttgaccactcgtcttatttaaaaaatttgtgcaaatataaaaaactaaaagttgtgcttaaaatactttggataataaagtaagtcaaaaaaataaataataattttaatttttttttgaataagacgagtggtcaaacagtacaaacaaaaacttaaaatcccttatattatgaaacggagagagtactatcttgccttagccatgtctaatcctcacttcctcgcccaaatatcacgaaataaagagcaagcatgcacctacaccacacttgatcttgaaccacttgattatcaaactagtagtactattttttttattaatagtttcaggaaacaaggacagtactaatcgtcatgaactagaagtccttttgttcttcatcttagtattatattaggtccacggataatcatatctatataggatattgccgacttttgtcttggataatcccaataatagaacaactctggcccagctgcaacacgctagtagatatagagtcgcggctccattcctaccctctcccatattaatcccaaattaaggatatatacgcatccaaattccaattatggatgcaacttggccagcaatttgcctttttttgtaaacaacaacaaatgatggcccgtccacggttcaggtatcgccgtctgttcgtctttcaaaaccaccagctgctaaacaaattgttacatgaatcatatatctatttactctcacatcaccattataccaatatgacattgaacacaatgatatcactaaacctgattgattatccaaaacagattaacattactacaaagcggtccggatgaacaaagtctctcaccagacaagacgggccagaattacagaacaaggcaatcattcggtggatcatagatatccagtggcagctgcgaatgattaattactgatcaaattattcaggtgtttggttcaaaacaatgtacacgagaatagtggtcactagagaatttcatcgagtcatttacaaccagatggtacatatatttataatatgcttttgcattaacaaactagggctctaagctctagaaactagcatgaatgctgacaaagtgacaagtacaaaccccacatcagggaacagggttaatctactcaagaaatagcaatcatacaggaaggtaggaaggaggcaggaaagcaaggcaggtgaggcagatggcacatcttgcactactttacaacaagctcatgtatctgtgtcagcatccagtaataccctggccaaaacaaagcacaataattgaagctccgatttgctcctcccaccaaacatatgcctttttcctctctttctttctctcttcatgacataacatgtgagcaacgtgaaaatggattggaattgggagacggagatgcaattatgctcatttgtcattttcagaaaccatttacaacagtgctcagagtatgtaactccaaataacatattctgggtatgtcatccgctcctttgttacacatattgccagctctttctgaagatgacaagcaggcgaccttcataaagatactttcttccatcaccactgaacacgatgagttggtcacaaacccgtaacatatccttcaatgacatgatgacatgaacagaaaactggcaattgtaggcagtgataccagccagttatggcagcaagtttatcaccggcagtgacaaacctggagtagtcctagtctgagcgttcgcctggtaattaactggaacagtttggatactgactgtatcagttgtctttgagctttggattggtggagatagaaaccaagtctcagttgtaacagcccagcagcgttttccttaccctgtcgacaatacggttcctattgacaaggctgtttgacaatgggaactcactgctatcatccaggaggaatctgtagacctcccattgacgctctgatgctgcctgcctcccaatttcagcctgaaatgcataagcaagagagtaaatacaaattcattttgaaccctctctgaatattctgtgattcttacagagaaaatgcagatcccaagcgctttcagagcaaatgtagcatcgtagaatacacgtggtcgtcccttcccggatagctcaacagggttagcaacaaggagttctacatcgggaccccggttgacaatcatcaccctgagaggatggagcatctctgacctcaggcgtgagctgagaacatcctgtttctcaggatcaataatcttctttccatccgcttgcttgataaaaagatccacctctcgaaaacctttcttgtctgaccagaatcggccatatgttacctgaaaaggtattgagttatggtacattcaaactatatactagcgacagctttgataaacaactattgtcccctgtaagccatgactagataacagataacagatcattatgtagcatttgatggttataaactttcttaacaagaaggtgggaaacttgtttgttaatatatcttagtaatttctaaggtgacagtaccctcagatgtccagaacatctaaatcccccagtcttacttttgcaaaattatctgaatgttacagattaataagcattcatggcattagttatatactacaatacaggcaatatatctccgtgtacctgaatgctgcagtccttcattgttctcaaaatatcataaaggagccccttttgatcagcacagttaatttggagcagtgtgtgtgcggggctcagggtattgtcaaagttgatggttgctttctgcactcttttcatctccgcacaaattgaccttgaacagttgtcaccatcagccagttccaacctgaacagctcctcagagattgtcggtgggagagaagagaatccttgctggaacccttctgctaataggatttcacagcttatggaaggacctaaggtagcaatcagcatcgaacaagtctcttcttgtctttcctttgtgtgcaataattcccttcacatataagtatcaacagtcatataatagaattattatgtgttgcagctcggcagcatattgcacaagcagcttgttcaaagtggcaacataaccaaaggacctaaactttaacaatgacaacttacatgccgtcggtgatgaagaagaggtcaataactctgccatctggcgtggttgacaccttcactctgtggattataagctctagttccgataatatatgcgtaacatctgcatatcatatggcacttgtaattatatcacagcttggtctacttcaaacattgaagtttggaaggtagaaagagatgctcaggttctcaccgtgcaatagccctttgcgatcagctgagaaaagcttgagaaggtagaactgggaggggcctggctgggtgatctcagggtagaaagtcattgggtaatttgacgggcacattgacatgaggcggttcttgagattcgcccaccggaccttgattgatggcgtgcggggcacgacccagaacacaacgaagcaccattgcccatccgtagacacatctgctaaaattgccaaagaaacgaatttcagatgttgacggaaggattaaaagaaggattgaagaacatagttttgatgaagcagttgaaacagtgcacagcacttgcaagtacatagtacatagtttttttgaaactaaataaaagaagtttacttatcatgagtaagtactagtagttgcaagttgcagtggttcgtcaggttatgatgcagtacagaattaatgttttaagatggaagctccaatgattagtaaggccgacatgaatctgaaatgcagtgagcacacagcaacagcgacatgaacctagacggggacttggcgtaggtaaatccgataacgatgagattaaacaaaacaaattggaactgagctgtgtctaactaatcgatacatatcttggaacggaaacagctaaaaagtttaactgatcgatatatatcttggaacggaaacagctaaaaagttggaaatcttttccgagaaagacggcaccgcacagaaaaaagaaaagaaaaagataaaaagagcaaactgatcatccagattccaaagacagagaaagagaagcagtcgggcaacactaaaactcaaaaaaaaaaaaatctctcacgctcaagaacaccagcaagccccccaaaaaaaacgaaacatcatgctaaaataaataaataaaaaatctaatgtctccaattctttgactgcaattcagattttggtaaaacctaggctcgaacaagcagccctaattaagacaggaggagaa

SEQ ID NO: 59644 - DNA, 12583 bp, Oryza sativa
  unsure (1)..(12583): unsure at all n locations
cctcgaggctagtttcctcttaagaaaactcgattttattttcgctttcttttttcagttggagaagaaatcggggggcgtttgcgatgcgagcggcgggggaggagggggtgttatctgaggaatgcaggtggggcccacatgctgactcagcttaggtatcaagggggtggttgggcccacttgccattgaccgttcgccgcctaggcgggaacgaaaccaccgggtgcttttctctctctctcttggtccccccctcctctcgcatttttggtccccgtttagtcaaccttattagcgagaaaaatagaaaaatactagctatggacagcattaaagctattactactatgttattatccagcataacattttctcaagcagctctatttttcaaacaatttactattggcatcccttttaacggtaaatcgattttatatttacgatgctaaaaaaaagaaacaatttcctaggtataaatttgagcatgagactgttcaagatatagttagaagtcttttttttaagacaaagaaggtacttatattcatataaatacatcttttttatggggaaaacatcaatattgttatgatagagttatagttgtatcactcgattcactacaaataacatgtttatttttaatagaattttaccaagactatagattcaccgttggtcttcgtctatttaagcgtatgctacatatgtgttcatagatgtgcgagtgtatattacgctggagtggtgcgcatgcgtatacgtcttctacgttatcgtaaagaaaaggtattatgtaattttatttgttaaaaagatgtagttaatagtgccaatgtaaattggagtaagtggttaacataaagatgtggcgagaattgtccagaaaacaaaactactccatccggttccatattaattgacgttttagacaagattaaggttaaacttttataattttgaccatcagtaacttaaaaaaatattaaatttaaaagaaatagaacaacgatttgtcttttaaagcactataataaaagtaaacatacatttatttattatatatattataatagaaaaataaggttaaagacatattttgtagaccgtgttattatccaaaacatcaattaaaatgaaaccggagaaagtactcgatactacaaagtggatccctagatgttgtgtgctactgcttcgctgtcaggtctcgaagccacacgttggggtgggttccgttcgaccagtagtagacagggtttcccttaccgccggtaaccgcacggttaccgggcttaccgtggggtacggtaatataaatactgcggtaacctccttaaattcaaataaatttaaaaaataatttaaatttttgataaattttgcacggttttatacggtttttcacggttaccgcgataaccgtgcttaccgctggggcgcggtaaccccggccctggcggtttgggaaaccctggtagtagaccgatcgctacgcaaccgatactcacctttctctctctctcgtcttgtgtgtccctgttgctcggccaagaattactcacctttccttttctcctcggacagccttgcaattctcgggatgcatcatcaggcggccaaccttgttgtcatcagctggtacctgctccagattttgcacgcatggcaaacagtgagtcattaatgctactaattgtgtgtgtgtgtgcccctaattaggcacagtttaggacagaagatggcgtgtagccaaatttaacaggggccggattgaaccggcatatgttgtttttgttatcccttgtcagacatctggggaggataagatagagatatgtcaatcatcggcctgatattttgaagtactcccaggagctagcatgcagaagctgctggaggctaccttagctagcttctgctaattgattgaataaatacaagaaaaaccatgtgttgaatttacagtggagtgcaatgctcttgtttctatggattcaatatttgattaggagtaaggtactatgtaatatttcatttagattattgagtgcagtatctacttaatggtaaataaatcaattttaaaaacaagtgatctgagtaatgcggtagaagtttcatcagaaaacatatttttctaaatgtgaagtaaataatctgttttactaacacgatgaataaaccgaaaagaacacggcctaaaacacacggcgtgtcgctatctgattgttaattattgtctgtgacaaactagtccctgtagaggtatcctgcgtgcaatcagggcagatggttaccttggattggaaaggggcctctcccagcatagctgcctcttgctgctcctcagctcttcatcatcccatccccagatctatctatccatccgtctatcctgttacatgatcatggccttgttagctactactccacttttcataagaataaagccatgcatcatggagagcattaggataacaacagtagtgctgaaaatatacggttgttatcacgattagagagagcagcacccctcaagtaacagtattcctgaccaatgcaaccagtagccacactgaaacgcaacaaaaaaggccccctgaaatcaacctttctttttcgaaatctaatacagtagtagagatgaacattctgcatggatggaatccacagattgcattctgaacatcaagcaagataaggtttggattctcgattctcttttcagatatacatgagcactgctatgaaaacagctggcggcataaaggaggttctgacttctgacgcgcctccagcctcctcatatctgcactgatacaacatgacgaacaaatttcagtgagttaatacagtgttcatacagatgtccatgattgtgtaattcattttcaaaatatctggcattggaaatacaagaaaaaaaaggaagagaaaataaatcgcaatgatgtaactgagaaacttctgaagcatacatttcttaagaccatcaggtcagaagcaccgctgaaagcgaatatcatgaaggatggagggaatttacaggagcatgatgaattcaagcttcttcacacaaacagttcagcatgatgttgatcaccaccctacttcagcttccagttaaacgccaccttagtgcttgctgacctcctttttgaacaaaattattgcttgcctgacctcatagatctgtttgcataccatttgcttgcttactgaatttagtcgttgcaatagaaagaatcctgaatgtcttacgataacaacttctactgctcatttggttgtcttacagaagggcataatcctggatgggattccaagataaacccaatcagaaaaaaaaaaaaaactaaccagatcaatacatcgtggatagctacactgtctgatcactaaaaagaattgaggtaagtaactaaggagaaaaaaaatcctaattgactaaaactaaaacccacgtgcctatacttttcgtatatcttattagggcaagttgcaagttgcttatggcaacaaaggaaagttgtacttattgcaagctgacatgaccagacaatttgcagggtgccctgtcaccatttgcgataagatctaaacatagatcatgcaaattacttatcacaaaaatcgctttcatatattaccaaaggtattccatgatcacgctagaaaatgtatcccgtgtggcctcctgatccataaaacttctgggatccagcgacaggtgcatatagttggtcatggctaaaccatatactgctgcctaaccccctaaaaaaacatctagggatcagtgaacaattgtgcccaagcctaatccaaggaaacaaaatagggatcagtgaaacttacaggctcatggaatgtaccatcttctgtatctcagaacagacgcctttatgtgaatgtgacctgtaccctcggtatttggtgnnnnnnnnnnnnnnnnnnnnnnnnnngaacataacaagcagtatcaacatagacatgactccaataataacaatcagaagctagcttagattaaactgagtaccaaaattcacaggcaaacacaaccagtctagaatatggagtaaacaaaattgcagccgcaaattaatgaatcaaacttagtctgttttacagaaccggtgagcagtttacctactagataacaaagccaaaaactgtatgtttcctacaaaaataatgaattgtatagctggtttctctaagagaagaaaatagtcagaatttcataggtatgaaggtgcaagagctcattgcaagaccatcagtttattataatattttagggtattatctatggaaaaatcaaaaccataaacctgggaacagcataagtgtatctcagaataagtaactgaaattactctgacataaaattatttgaaaatgtaactgaagcatcaaaatataaaacagacattatttattactacatcagttttgaaatgaagttccttttcttttctaagtagaccaaaaacgaactcactacataaacattgtgtgcaggttgctgttcgataatgcaaaaaaccgaagggaaagctacttaaatatgcaaatagatacatcacgaaagaatccttagaagaaatgtgctacattggaatatcaagttatcaccccgggtagactcctgaatatgatggtattaaccttttctgtcctgcctaaaataattaacagccccatcaaggtaacataaacctttggatatctgtcagccgggctagtctatatcattcttacatgatcagatcaactctcgataacctacttaaccttttttgggtggtgggagggtgtgtgtgtgttgggagggcggggataacatgcaaaaacttgcatatcatgtcattagaaagagagctgtccccaaacaaagtctggttacatagctacccaacccaagcggtgaaacagcagcacacaggctctgaggaaaaaaaaatcaaaggctaatatttcacaaagaagttttgaacttccatgccactttgtctcgccacgcttgcagcttctgtagcccagaagtgagcatggaagacgacctgttttcgaacacctttgccttgcttctttccatactagccagaggatgaatatcaggattgtactgatagccttttgggcttgactctaaagcatatagtaaatcattttgatcagtagaaatcagttcctagacttgatgaacccttcatctgagggacaagcctactatttagcatctcataaatttctgtacgttgtgaatgcatctggtcccttgagtagaaaacatggttccttgcgtttacttcaatctggctaaaaccaggagtcttcttgactttgcttcccttcataatcttccacacacttgccacctcattccacatcccaccagatgcaaaaacattggccaaaagcgtatagcctcctgaaccagaggggtcaattttgacaagatcctcacccacagctcttcctacctccacctcattatgtgtcatgcaagatcccagaagcgtccctagaatggcctcatcacacatatcccgctgcataccgtcaaccacttccttggcttccctcacgtaccctgctcgacctaggagatccacaaggcaagagtagtgctcaatggttggccctagtccataaacatggctaattgatttgaatatttttcggcctttctccactaatccaacatggttacaagctgacaacacagcagtaaaggtagttgagctgggcttatatccacaccttaacatttgggcaaagccctgcaaggcgcaaggtgcacacccatggtttgctaaagcttgtatcatcgatgtccatgttatggcatccttctcgttcaatctcctgaaagcaagccatgcagatgacagatcgccacttctagaatacattgaaaccagagtatttcctaagttagtttcgggctggtaccccagttttgtggacaacccatgaatttgtctaacctccattgtgctctcagatactactaagacactaattaatgtagtgctgtcaggagatactgctgagcggagcataagaagaaacaacctcaaagcttcgtccttcagattattcatggaatacccatcaatgatgatattccaagtcaccaggttctttgaaggcataatatcaaacaacctttgtgcatcattcacttggccatcattggtataagcagtgatcattgaattccatgccggaatatccttctttggcattctgtcaaagaactctcttgccctagaaacaaaaccattctgtgccaagccagtgaccattatagtccaagagactacattcttatgtggcatcttatcaaacaactgaaccgcgtcatccactttcccagcactcataagaccggttgccatggcattccaagaatatgaattcatctgaggcatcctgttgaacaactccaaagcctcctgaatacaaccattatcaacataggctttaaccatcactgtccaagcaaccacgttcctctctggcatcttatcaaacatctccctcgcttcccgtagcatcccattgtgtgcataaccctgcaccattgtcgtccacgaaaaaacattcctgtatggcatcaaatcaaacaggcggcgcgcttcgtccacaaggcccgcacggcaatatccagagaccatgcatgtccaggcgaccacgttcttcaccgccattccgtcgaacagcctgcgggcacggtcgacctggcctgccttgacgtacccatcgagcatgacagtgtcaagatggatcccccggcaatccggtggcgccgcacggtagagcgcctccgcgtggggaaggtcccggtcccagaggtggattccgaccatcgcggcgtacgcgacggcatcgtcccggcgcggcattccgtcgaacatggcgcgagcggccgccgccccacgctgccgcgcgagggagacgagtttgctctcatcagaatcggggtcccgacggaagcgtccccgccgcggaggatgagtgctctccgcggtgctgagacggcggcggcggcggaggaggaatgcggtgcggagaaggggacggaggaaagcatcggagacgccgcgccggagagcgaatcgaggaaggcgtttgatacaggaaagcctccccattgctaggtcgtggcagcggtcatgggcgggagtaccgagaggcaacgacgatggccgccggccgccggagaggatgttcggagtcggagacgacggaaggaatatgggttttttttaactatttgccactcttacgagtggcactatcgagataccactcttctaatttttttattacggaaacaccatgggagagatagcttttttcctatttagagtgtcatgtcagcgagagtgacttaaaatgactttttcacctctagtttgagaaatatgagagattatatacaaacctatgtaagaaaatattatatattatatctaaaaagagttattacaggcaagtgaacttggtcaacgtgtatttccaagtttgtgcggccttttctcagaaatagccctcgtatttatgtttcattcgaaagacagcccctaggtggatcgctaccaatccaactcgggaaccaatgtgagtaatccgattgagtacgcgcaacgccaattgggtgggaaacaattgtctgtgagacttttcgctggaggaattttttttttcagataatataaaaaaatttcggcatttacttcaaaagaagctacaaccgcttaatacaaaattctctcaagagagcataacaatccgacaacatcgaaacaaaaccaacacataaggagtaaacaattattgaagtctatttgtaaatcttcatccgtagttaacgaaaatatgtatgaccataacctttaagcttcgacatgcaaatagtatgaactccttactctcttcacactttttcgctgggagaataggaacaggcaagatttgaattgaaaatttcttcctcgttcgatcaacacatacttctggaactggaacgatcaagataacatcaaccaaactttcacacacatatatgttcagagaattacagattaagagaactgtgtgcattaggctcccacttttgatttcagagcccaaatgttcagaaattaagagagttgtgctatcgatcagttacagtgttgcatatttgatctcagcaatattggctgtcttttgcaagccccttctcctccacacgcgcgtgcaattatgttcatatcaagccctgcaaataatctcacctagacttatctatcaataatacagcattcagattatttccccccatatatgtaaactttgctcgtttgtttcttcagacatatatactgtgcatgaaggtaatgcaaatatcttacctgaagaaatccagccagcaccaccagttcttcagagaaatcaaggcctttctgcgtgcagaacaaaatagcagcaacgcaaactaagagcatacattgcagaacactgcaggcagctaagatcaaactaccatgctagtaacttgaaatgaaatgaaaatctccccgggtcagtgaggaacttcagtgttgctgtcatacacaaaaggtgagagagtgtttttcccccctattgacagttagattaattttgttcctacgaaaacagattgaagcttcttgcttccagaaggagtaattatcctgcgatctgtttgagacagagagattaagatagtgacttgagcgagtgagtggcagactggtaaaactggcgacctaacaaatgtctccatcgctcgttagcacatgcaattaagcgggatagtctccacatatatccactaattaattaataaacgttgaccagtatgatgtcgccaccgatatggacacagatcggcgtcgtaactggtcagagcaagcactaataattacgtcctaattaagtgtcaacaaatgctgcattatttacttggtcagtagaccactagaagccccggcctaagtactactggtactagtagaaccaaggtaacaaaattcttgaaattaatatcaaggtaacgaaaatggtgatcaatgatcaagtgccagcatgaatggttcgtacaacacttgcacctgctacgtatatactccattttgtagagttgcttgcagtttatagttcctctagaaatgcagacctggttggtcgagttgaatgtgtacaagtgttaattacctagagatcttgttgctagagaagaggtcgtcagagatatactactgcaacaataaatgtacatctttttgaagagaaaattagttttatatattcacgctagcaactgaagtctaaaatgtttgaccaaacatatatactctagatgtatatatagtagccaaactatttgagataaggatatacttacttggcaatgcataatttgctctactagttactctctttcttaaaaaaaaacttaattaatttgctagttgaccatgtatgtcgatggagaccaaaatgagtgagggatctagaagatgacacatgtgcatctctgattaatttcagcatgcatccaatgggtcgaaatgaaatggttcgtcagtttgtgcatgagcctgcgttgtcgcagccaaaaaatcgacgaggcaggcccatgcactagctaccttggtcaaccatggctgcagcttcaccttcactagcttggaccaagctaagcacagccatccattccattccatataacaagctagcgatcgaggccactcaaatccaccaacaagctagctgacaatcaagtcatcagtccatcaatggcgatggcgtcgtcgtgttcaccactagtagccgtgctggtggcgctgctgctcgtggcggcgactgtgccggcgccgtgcgccgccgtggacccggtgaacacgtactgcgccaggaacctgagcggcgcgccggcgcaggcgagcgtggcgcaggtgctctccgagctggtgccgcgcgcctccgccggctactacgccacggccaccgccggccgcggcggcgacggctccgccatctggggcctcgcgcagtgccgcggcgacatcccggcccccgactgcgcgctctgcgcctccgccgccgccaggcagctcgccggggcctgccgcggcagggccgacgcgcgcgtctggtacgactactgcttcgcgcgctacgacgacgccgacttcgtcggcctcccggacaccggctacgcgctcatcctcctcaacacgcagaacgccaccgacccggaggcgttcgagaaggcgcagaggaaggtgatggcgcgcgtggcggcggacgccggcgacgcggggggcggcgggctggcgagggagaccgcgaggttcaaggacggggtgaccatctacgggctcgggtggtgcacgcgcgacatcacggcggcggactgcgggctgtgcgtggcgcaggcggtggcggagatgcccaactactgccgattccggcgaggatgccgcgtgctgtacagcagctgcatggcgcgctacgagacctacccattcttcttcccgctcgacggcggccagagcgccgacgcctccgcctccgccgccggcgactacgacagggtcgtcttgaatccgtagattatttcaactctctataatggccatatatataataagggtatcaaaaaatcccatatattactactaggagacgcattgcaggtttatatgtttacggttgtaatccaatttatctcataattaactaaataaataattcgccagatgaacgaaaaagtctacttcctctattttttttaaatagatgattcaattgacttttagcatcatacttgattatttgtcttattcaaacaaatttatattttaacatatttatattaatgttttaaatagcatgaatgatccaacgttatttcaaaagttaatggtgccatcgccctactctaaactgaataaaaaatcgttgcaacgtggacgtgcctatagctgagggaggtaaaatatactttttgttgatgaataatctgcttcacaaggcccacaaataaatcagatggaaatgtgcctcgatgaggtccaacccactaccaccggcccaagtttggtacgtaggcccaagacgaaacgtcagcgtctcagcgaggtgcccttaggtcgggagttcaccagcgccgctgccgccgccgcttccctccgcctggagcgccgctcccaacgacggcgacgacggtcagtatatctccgacctcacctcgccgcacgccgccttctcgtatctacctctccgccgcttggcgccagcggattctggttccgagtccggccttgcgagcacgccgccgcttccggttttttttttttttttactcataaatcagctctccccctgcaggatcgccggcgggtctctcatttcatctcctcccatcttccgacgccgccgtcggtcgtctgctggtggcacgcgggttctgttccgctcgctactgaccggtgcggcaccaacctattccccttctctttctttctttcttttttctttttctaaattagcagtttgacattaattagatgcgctaattcatagaagaaacttgaatttgatgcactattacatgtactgtgttcaaattccgatcgaaatcatctcgtgtacggagtaaattctcggtgcctttcggcctcttcgtgctttttttgcctactaaacttctgctcgatcttgacaatataagtttgagcaatgatcctattttgcttctgacatgggttcctatgtttttagctttaatggtgctaatgtgatatgtatgtatatttctacacgaatatttccctgcttttgacatgggttgttcaaggaaatcaatgccacattgcatgactgagcactatagcttctatgctgtatatatatgctccctataattgtgtcaattttgtatattctagttctaacaaaacatttctgcctcttgaataaaaatatagggctagttctacatgctgttactgaaactaaaactttgactaggtagttaactagtactggtaccaacatatatgactgatagtataagtttccaatcatttgttagcaaataattcttgtgcgcgtggttcatttctttcttgttctgttgagtcagcgcatggtggagttagttggttgtgcacatttgtagctcgaagcatgcatgttcatgctggaatgggtcattagttagtgcatggtgcagcacaccccgacgtttgggatggcagaagaagtggatgggcgtggcactcgtggcatcaaggacatgatctagtttctgttttgtctatttaagttgcaatataaggtcaagaaaagctgctgctttgcagcaccaaaaactctccttgtgttcaattcttttcatcaggtgttccactgatcactatgtgtagttttctctgacatcattgtgactcttgagtttttctgtgttgaatcattgtgaggtgttttacaaggcgagaagctcatgaggagaaataaaatgtgaatgtggaacatgct

SEQ ID NO: 59645 - DNA, 6045 bp, Oryza sativa
ggatactagatagtttttgaagatttaaatgttaacaagttgtctctgtacctttcctctagcacagcttgatgaattgctagctccctagtcactttacatgctgaaatcttggtcggctttggcatttcataccaattccaccttgcattttttaaatgtctgatgtctcatgttagaatctagaacacatgggagctaaaaaatttatggtgaacctttcattgtgctgcaggttaatctgttgtcagaccacacaaaggagagaggcactgcagtaccaatgggcatgaagttcagagttgtttgcaggaagttgtatgattacgtcagatatgatctcaaggagattgcttttccttcatccttgccagatcctccacacatcaagaagcggccaaagctcaccttgaaagacaagtggtgtattctgaaggaggcaaccaggctgtacggggcttcttgggtcagagacattggccctgatctcagaccgaatgactacaagaaggtcaaagaggaacccgacatcaagactgaggagggaagcagcgagcctaccacggttgaggaccttctcggcgcattaaagggtggagcagagaaagccaagcctgcgttacagcggatgtacatggctcgcgcctcaaactacacagatgcactgaagaactatgtcgagtcctacaaagaaggtctgaaagagcacttggaggaagaagctatgggtaaaggacatcggcaaggcaatgacgcaacaaagccaccacagtcaccgtcatcatgattttgtctgaacatcttaggtgtgataccacatagaagtttcagcatatcttgtgtatgtaatcaacctgagttgatacattgccttctattgtagtaagagggctctctaggctgtagactgaaaaacggcaaatggacaaatggtgcctttgtctttgccaaaaagaaaggaagaagagagttcttcatcatttggttgtctgatattttttgcctgctgaatttggtgatgtgtagtgtaaatatgggctatgggctaagtatgtttctatggagatttttatttttcctgtttcaattgttgttattggttgctacgtgctgattgtctgtaaacttatatggatgtcgtgcagttgctggaaacacaggattatctcctctatttccatgcttatacggtctgtttggttggagagagtttctaggagggattgggagtttaaaaggatgaggctattaactgttttgtttggttgggggacatgggaattttggtgggatggggatggggaattgaggaatgaactccctccttttcaatacctgggtaggggcaggtaattaggagggaattcctcctttacttcgcctaaacaaatctcaaccatccattttcattaatgatctaatctccaactaaactccctatcaatttccaccacctctaccaaacaagagactgagatgaaaaatcaaattcccatcttaatctcaccatcaattttctcgtgtaaactcccaatcctcttccctcaagttgccaaacaagccgataaggttatgtaccattaccaactgtggtacacctgtcaatgcaacctttctaagtatctacctctgctctgttctgcagattgctatgtcattaattgaaaacgaaactggagcaatgccattggaacctttagtatttttattcaattgattgaaacgttctgactagcaatttttgttcccctttaccagctgattgaacaaactagcattccatcatacttctaaaaatgtgttttgtactcaagtccgaaactactttcaattaaagtttaggagtcttaaacagctttcactactatcagtgtcaagagactatacaccagccgaaaggttcagttcaaaacaaattcgatgacaagacactgcagtatcagagggagaagttgtatacatgaggcctgcaaatctgaacctcttaacatgctttctttatatcatcaggtctgttattctgctgtgcttataattatattagtcaggtagtattagctagctcgttgagatagatgtttgcttgcctgagttgagtcgaaaaaatgtaactagttgcattgtagcaactgagtctgagaactggttgatgaatggctttgacgatgtttaccgtagttcaaaagtaataactgatgaacaagtaattaactaatgctgtacattgcacaaatttgattactgaaaagaaaatttgatgtcagtaaatttgtttaaaatgcagaccaggaaaccttgatgagcagcttaattccgcagatgctgacttcaaggctctctgaaccacagatccttggagtgaattcgacatttgtgcgataatgtggcagtcagcatcgcctgcagcagcaatgagcgtcaagacgagctcgtcggccgcacggacggccatgacgcggcgggcaagatcgacggcgacgtctccggcggcgcctccagctgaagaattgctggtcgcgttcactttgctgctgtcgtagagcacaatggatgcatccgggatgctgctgctgcacgcagtgatctgtccatggaagcagcgacgatggcggccggcgccggcggcggcaggcaggcgcagggtgacgtcgacggcggcctcgacggcgcctccgatgtaggcgtaggagagctcgaccgtgctgagcctgctatccagcgtgctgcagcttccgacgaccacatcctcgacacctcttggcatgctcaggcttctaaattcgattagccctttgctgaattctctgtcgtcgacgacgacatcgccgtcatcctcctcctccttcaacttgagattcacctcgaagaaccggagtcggacacctcgattgatcgagttggtccggtcaaaaccaacgtttcatcctatataatcatcatcatcatcatgcaatattgcaattatgcaagaacaagaagtgatcaatcgatcgatcagctagattagataatgatgatgacgtacttgccttggaggtgatgagctggggattgtcggtggtgcggcggaagaggtagaggcactttcgatcgatgacatccctggcgatgacggtgccgtagacgagcacggggtagccgacgtcggaggagacgatgttcacggcgaggacgttcaacgacatgcgcagcctgctgtcgccggctcggtggaggggcggctggccgcggtcgacggttcggcacaaggggccgatcggcgactcctcgtcgaggttgaagaggatggagctgcagaaccacaagcgggtgtaggtgcggcagccatgcttggggtcgtactcgaggatcttgtccctggcggcgtcgcaggcttcccgccacgcctggtgctccgcctccttccgctccttctcccgctgcctctccagcgctcgctcgccgtccgctctcgccaccgcctcgtcgtagaagaagggctctaggccgctccactcgtcgccgccgccgtcgtcctccgccatgagaaccagtacgtcaactaattttattaccgaactaacggatgttacgcacatatatttctttatctttacccatgtaatatatatcggatctaagagttcttattattcgtagcgacgtacgatgcgtggacgttacttttaattatatatctatctctatctctactattataaaaattaaatatgtttccgctgatattttgataaattatttgtatttgagtcggttttcaagatcgtttacttttaaaaatacataaggagtcgtataataattcttttaaaattctaattgctttagaattcttgtcagagcataagatagcaacatacaagatataaccatcatgccaataaaagttccaaattagatatcaatactattaaagtaaaaaaccggagaaggctacagctcggacgtccgataaaactcaaaagatcggaagccctacccgttgcaattctgagcagataacaggattcacgcaaaccatgcactatgcaccatctctttcctactatatacatgtacactctttagcaatttttgaaatgatttttctcctaacctatctatatgatctatgatctaattatatcgttgtaattaaatttttataacaagatctcacatgagtatattacgttgaaaaaacatatgaaacatttttataccataaataaaacagttgagttataagtactgaaacatcatacctatttactgaaacatcaaaagaacgctattgcaacatttgcaaataaactagtgaaacatttgaaaaaacttattgaaatacctagataataggatgtgcaacatttaataatctgttgcaacacaaaactttaaatgtgcaacaaagtcgaattaaaaattgagacatttgtttctcatgcgtgaaacatttgattttaacggttgaaacatatgtatttttttatcgaaatatattcatatgaggtcttgttaagaagatttaattgccataaatacaacagatcagattacagactagataaatagtttaagagaaaaggaaattttaatgtttcaaatggttgttggttgttggctttggttgaaaaaataactattctattgtgtgagtcctttacacatgcgtaactaaaaagtttgctgatgtatgcttctatcgagtactactttgtttctctgcttagttaaatgtgagggtcccgtccggtatattcttccgggtcggacgtcttaaataaagcatttctggtaaaaatcgtcgtcgtcgtcgtcgtggtggtcagttcatgtggatggatggatagatctaagcgctcgcccaattccaactcaccggatgcactctgcttttttttttcctccctttcttcctctgttttttcttgatgaatcagaggagcagagcacaaggtggcacagacacgcgcacacacacaccacgcccacccacccctctctcggctcgggttaccttgctaaacccaaaacctctgcccttgtgtcactgacaatgtgggcctccttgaactacagtggacaactttttacctcccctagttgagtttggatggtattaattagccacataaatgaatacactacttaataatactaaaaaaatagtattaaggaagcaagcagcaacactaaccgtattactccactagttaattaatcaatcaaaagcaggaagaattaaatgtcctgatggaatattatgacgtcagccgcgcgtcactttacgtgcccggccgatcacatgcatgcaagcatgcacacacggcgcttgtaataatatactagtccgtcaagtgcttttttttttccttttaaggggggacgtcactagttttgtgcatgtcatttaaaaattatcaaaaaattcttaaaaaaattatcaaaatagatcaatatatgatatatcttttcgcaaacatacaaggcaacattctacttatacaattcgaaacaaaaataacaaatttgaccgtgaactacacgttctattcacggtcaattttattgtttttgtttatacttgtacaagttgaatttgaatatgcatgcttgcgaagttaaatatcacatattgatctatcatactaaattttttttaaattttttttgataacttttaagtgacatgaaaaaagaggggatatcccctaaggatgaatagagttttcctactagtccttcgtttcatattgcaagtcataatttgattaggtttgacaagatttatagaaaaattagcaaaatctaaaatattaaattagtttaattaaatacaacattaaatatatttataatatatttgttttgtgttgaaaatactgctatgttttttttatataaatttggtcaaaccaagtttgattagaaaaggatgaaagagacagagagagagtagctggatttttcacattttgatccttttaaaaaacttatttcgcaaatagacccctgaaaaaacttatcccagaaatggtccttttttgggcgccagagtggctg

SEQ ID NO: 59646 - DNA, 10637 bp, Oryza sativa
ttaattaatgccagcgcatatatgcatgcatgtcctggtcctggacacgtacgcccggaacgtacacgatcgagcagtgcatgcgcgccggcgacgtactggctttcgttctgcacgcgtccggaacgagattgctgagggacgatcgatcgcccctagcgatcagtccgtctcccctccctttcctccacctgattttcttttttatcaagtttacacatctaaagtttaaaaacccaaagtttataagtcaaaggtttatatattcgattcaaatttaaatttgaattaaaatgtttttttacatagtatttctatacatctaaagtttataaacccaaagtttataagtcaaaagtttatatacccgtttcaaatttgaattggaatttgaattcaaatattagtttatagacccaaactttataagtcaaaagtttacaaacccgtttcaaatttaaatttaaatttaaatattttttatatacagtatttgtatttctatacataaattttttcaactttgtctttttattttttttaatttttatggtgtactgtggtaggaagagaagaaggggaggaggaagggggagaggagggagcgtacaggggaggggcgggcggtgatcgctaggagcggtcacccgcctattagcctcccccgtgcggaatgcgatagatcagtgcgttcggccggcatggcggcgacgacggcggcagcatctcctcaacacacgaacgcatgtagagctgggacttgaactagcaccatagttattaagaccggaccggtaattgaaccagcgaggacgtcggttcactggttcattggttcaaccgccaaaaaccggttcgattgttttgaaccggtcaaattgaaccggccacaaaccatgtcacagtacatgcatttgatcttttttcccctccctgagtaatatgcgtgcaataggcccaagcaatgtcagtctttcttcttgtctttggttctgatgctgattcttgagcagtagatgtaggtgtactcccatcaacaggagttggagtatctgaagaatccattgctgtcaaaaatacaaataattactaatattgatttatctaaaaaaaatcaaagcttcagtaaaacaagtatatatgcattatatttcttcagtacaactagcaaagtaacaaatttgtgtcttctaaaaaatcaagatctgaaataaaatcgtcacaatagatcttaactagttcactaccaacggaactggcaatagcatagtagcaatttcagtagcaagttaggaacgtaccatctgccatggatgaagcttgcgtcgatggagagttggagactggatttggagcttggaagagctgagcgctactcgatggagattggagactgcagaacaggagaagtggagatggtgccgccgctcgccggagctggactgccgtgcgcccgtgctgcggtgctggtacagcagttcgtcgccgccgccgccaccgaaggtgaagggacgagaagtcgagaagaatacgccaatgtgaatctaatcctattccccacgggctgtaaccctaaaaattgcgtgtttacaatcttaccctttgcctttgttgtgtcacactgagaaagatgaggggtaactggtccaaatgcaaaaaccgcctggttcagttaaaaccgtccggttcgccggttccgtaaaaaaccggccggttcgagcgttttttagcggttcgattgcacagacggtctttgaagtgaaccgagccgctgcactctctggttccggttattagcggtcgaaccgccggtccgatccggtcctaataactatggctagcacgacgcggcacagcgtgcttcgtgccaaatagagccgtgccgccccgacatggccagcacggggggcgctgatacgtgatcagccgcgtgctcccgcgcgcttgcggtcagtcagccccctctagtctctagtctatatgtatctatacatcatatgcatatactatatatatatatacatacgtatatacatataattttttatgaatatgtttttaacacataaaaaatatatacacatatatgaagtttatatacgacgtatataaagtttatataggatatatacaaactttgtatacgatatatacaaattttatatacatacgtattaaaaaaaatacatcacgtatacaaagtttgtatatgcttatacaaactttacatacgcgtatacaaactttgcatacgtacgaatacaaattttgtattcatgcatcttaaaaaaggggaaaaaaaccgaacagaagagaaaccagaaaaaaaaaagaaaaaaccaaaccgaacagaaacgagaaaaatgaagaaaaaaagggaaaaaaaaagaaaaagctaaccgaacagaaacgaaaaaaggggggacaggaaaactcgctactccctcctctcgcgcggcgcgtctcgtgccaggccgcctcttcagcgacgcggcccaagcacggcccagtggtctgatgggcctattcgtgccgggccggcacaagcacggcccaaaagaagggagcaggccgtggtggcgtgcggcttcgtcgtcccgtcgcggcagtgacggccgcgcccaccctgctcgtcgcggcgatgcggcccaccgcgcggcggcgtcaatcagcgaacagttttgccaacggctggtgctggccttgctgctaccagctagctaccgatgaggcaatgaataagacgagcaagatgacaatttctctctcccttcatggcatcatcatctccatcccattgttgcaggcgtaacgacggcggcggctgcggcgccgcgaccttccagtgcctgccgtccgcagtggctagctagcaggcgtccgtcatccctgcaagttagttaattgcagcggcatcaacatgcttggtgatcatcactactgtaacttgccctgactttaacatgggggtgcaagtatgattgctaggggatgtctctaaggattatgatctggaagtttgtcttgttcaaagtgattattttaaatattgttctcgctctttagtcagtataacatcagtcatatggctcttcattgcaacagattacagactgtacaatgatctttactagtcagtgtacgattaattgtctaacttatgttatttggaatttaatcttaagtctaacgatcgtctgcttggtgctagctagctgatgagcatgtagacgacgaatgtgatgcaaagtgaaacaagaccttgattatacaggactccatcgtaatggcattgtgatccagggctttccacggatctcttcaatggtatagtatgggcggcacggcccaggcccggccgttcctgggccgagggtagtcgggccggatgccggcccggcagccatgcttggggtcgtactcgagcgaggatcttgtccctggcggcgtcgcaggcttcccgccacgccttgtgctccgcctccttccgctccttctcccgcggaataagtccactttccctccctcaacttatggccgtgtatgaatagcatccctcaaccgcaaaaccgggtataacccatcccccaaccccgaaaaccgttgcaaatcaactccccgaacggttttagaggcggttttgtcctatgtggcaattgacttgcttatgtggcagttgacttgctgagtcatcaagcgggacccacatgtcagcagtctccacctcatctcatcttctccctcaccagtcaccatgattcccttcaagaaacgggaaaggaaaaaatcaagaagcggaggcgaggcgacagaatcgagcagcaagatcaacggcaagacaagtagcatatgatggttgccgaattcagagaagacgctggcgatcacgcgaaacaagaaaggggaacgaacagaacaaatcagagaccatgaaatcgtcgaagaacatgagcaagcagcaaacaagctagcggagttcttctagcgtgcacgcgacacggagcgggtgtccgccatgcgcagctgctggcaatgccaccgtcgtccccgtgccggagcctctccgtcctcatgctgcagcacaacccggcgctcggcgacatccccagtggcttccttctcggacggccggcaagcttctcccgcgcgcggacggccggcgagctatttccccgtgcgcggacggccggcgagctactcccccgcgcgaggacggttggcaagatcctccccgcgcgcggacggccggcgagctcctccctcgcgcgcggccggctgacgagatcctcccagcgcgagcactgccggcgagatcctccacacgcgcggacggccggcgacttggaggggttgcctcgtcctccacgaccccctcttagacgatgccccggcgccctcccgcctcctctgcgtgctcgagctgggccactccccgcgcgcggcgtggccaaccgacgagctcgtcccccttgcgccgtcgtcgccgccctgctgatagaaggtgagaggaggaagatatgaaagagaaagaggggaagagatgagatgaggtggagactgctgacatgtgggtcccgtttgatgactcagcaaatcaactgccacgtaatcaagtcaattgccacgtaggacaaaaccgcctccaaaaccgtccggggagttgatttgcaacggtgtttagagttgggggatgagttatacccggttttgcggttgagggatgatattcatacacggccatgagttgagggaggtaaagtggacttattccttctcccgctgcctctccagcgctcgctcgccgtccgctctcgccgccgcctcgtcgtagaagaagggatctaggccgctccactcgtcgccgccgccgacgccgccgtcgtcctccgccatggtgacggctaaaattaaaaccagctaggttaattaattacctgattagttaatttcttcgtaattaaacaatgttttatatggttacatatgaccttatacgtttataggttggtgaaaatgatttttttagctgggctgacttgggccagaaattactttttattcgggttgaaattgaattgtttatcaagcaaacgagatgcaggttctgatttgattttcagcgtgatactggtttatggtttgtgtgaattctatagttttttacttattattgtttaatgaaaaaagtccgaattacacccttgaactattaggtgagtacgaattacccctcagacctaaaaaccagatatttttcactctcaactattaataccggacgaattacgtccttgacttaaaccgtagtggttttggtcctatatgccagtccgatcagcaattcattttttaaattgatagacctcacctgtcaatctcatcctctatctctccttctctttccctaatcatctctcttctctccttctctcaatcagagcagccggtggacggggagccgtggacggtagcgacagacggggatggtggcggaggcaacggcggagagggagcggagtaggtggtaggcggggacggggacaggagggggaagcagcaatggggtaatggagcacaagcgacggtcgatggcggaggtagttgggagtggcgagcgtcggacgcgccgctgcacagcgacggggcgacggaactcgagcggcggaggcggaggacctattgggctcccgttccccgccgccatggacgcctcccagcgagctcccccgccaccacgagcgcctcctgtctcccctgccaccgtgatgcatcctcgcgaactcccattcggtcgtcgccgtggacgcctcccagcgagctcccccgccgctgtgtacacctccctgagagagagcaggggagagacgttaggggaggggatatgttgagggagagatgacaagtgggtccatgtttttttttctgtattttttagttgactggattgtcacgttgacgtcatgtgtgcaatctcatatcaaaatcgcgcttagggaaagggcgaaagatatctggttttcgggtcgaggaggtaattgtacccactcgatagttcaggggtgtaattcggacttttacctggtttaatcctctgtttggaggactggtcgatctatcttatcctattgaaaaagatgtgagttgctcgatccatttttttcagtattaattactgcattgatactgtaattttgggaagaaaatggtatgctgttcttgacctactgtcgcttaattttcctatttttcttagcgttgagcactactacaaaacatcaaataggcgtcgggactataagtgccggaagtgttaaaaccggcacttataggtctttttccacttcggcgggttgaaatcgtaaaaaaccggcacctttatcaattataggtgccggttttaaagaaaaactgacacctataggtgtccgttttttaaacaaaccggtgtcgattttgttaaaacccaaccctataataaattataggtgtcggtttttgtaaaactagcacttataccaagccgagccgagccgatcgagtggtcttatccatatgaccgcacccttatctgtcacgcccagaaatttagcccaaatttccagactattttgtttattaaatccctatccaggaccagccagggcacacaaaacgacaagtaatatacagttccaaacgtaaatacttacagaagaggcacttagtcctcacaccgaaagagaacggcagcagcggaaaaaggcgatcctagcggggcttcagcttcagcttcactccacaggcaaaactcaactggggtctgagccttggtcttctaacttcgtcttcagctcagaagcactacacttctgaaaagggggaataatagcaagactgagtacaaccaccgtactgagcaagccacaccaacgatgcagacgtgcaaggggatacaaggaggggtttgtggctatttgcataaaggcagttgtaaaacattttattgagcaaaacagtaaaacaattgagtaattaaagtaatattgaatctccactgatcaacaggcccaaccaacccacctggactacagtgcattgagtcgatttattaaggtgggactaatcacggtgaatctggtcgaccgcctataattgcgggcacggctattcgaatagttttactctgatcagaggtgtacaactgtacccacaagacacagccccacgacacgttaccgtgcgccgacatgtcaccacgacataccggaaagaggccgtgacaggacccttcgcataaccccctctaaccaagcacaccacacctcaggtttcacccccgttcccagcgggcaacgggcagtcccctctcgtgcctaggtgaatccggaagcgacagaggccgtcgcagggcccgccccgctccatcacgcccacccttgcctggatgcgtcagctagaggaaagctacactacaagcccagccgttgcccacgctggcttgtggtaagtacgataagttcttccagggcatcccgcgagccggtccttaattgccatgggtgcgactagcaaaaccatgcacccacagcccaccattcagtcgcattttagttggataattacgaccatgaagcatggccagatgtctcgagcacgcagctcattctgatactaaaaaggtctaatactgtaattatcccatcaactgagctagtggtaattaagcatggctaagcatatagttctagctaggttacataagcaacatgagctagtcgattcattacccaaggttgacaaagaacagatatcaagtaaacatggcacaagcgagcagataggtaatacccggatcccatgtaattagcaaaacatgcatatttatttgtaacgagtaaaacatttataaattggtatcaacatgctcaaggggaatgtgtgacttgccttgcttcttcacttggagcttctgaactcttatccttgcgaacgcgatcttccgaaacgacaggaactacacgctggcacgcaaaacgaggaaaaactctaataaaaaccaaggaaacagtacataaaaagtaaacaaacatgtagagctcaattttagatgaattttgcaagttgaacggctcaattcggagttcgaatgaattagatatgaattttagaagttttgagccatttaaatgaatttctagaattattaacgaattatgacgcaattatcatttatttttccaaaggaaaagagggttgctgacgtcatcaaaggggaggggcggcgccggcaagtgggccccaccggtcagcggcacaagggcgccggtccaccgtggaccgggaccaccgaggcggtccaccgccggtccacgggaaccgacggtccggatcggcccaagccgatcgggcggccacggggtggcgcggctgggcacgggcacggcttaggccggcccgacctagcgatggcgcgcggcaacgcgaccaccggcggcgacggcgcggggagtggcggcgcacgcgagggaggcgcggcaaaggggaccgatcggcccgggcgagcagggcagcggcagccggccggtcgagcacacggcgcggcggcgacgcaccggcgacgcacgcacagaagcggcagcgcacggcgctaggagggagaggaggaggaaaccggggtgctcaccacggggcgacgccggagagaggcggccgacggagggaggcgagatggcggcagcgcgagagaggtggtgcgcgaggcggcgatgttccggaggcggagaggggagatggagtatgggtcggggtagagctcggcacagcgatgccgacgacacaaacggcacggcgcggcgacccctagggcggcagtagcgggcggctggaggcggtgaatggcggtggtttcggcttgcacggtgggaatggtgctgcgggggtggaaggggaggacggagtggatgccggggtgcggtgtgacgcggcgaagccgttggaggcaaaagcacggccgggcgagcggcgctcgccggcggggagcggatggaggcggctaaaggcgaaggtggctcggggtggcggtggaagcggcgttgcggcggtggattggggaagaggagcggtggacggggtgcgcacggcgactgcggtaacggggaggcgacggcgcagtgcggggtggacgggagcggcggcgcggcgcggctggagttcgccggagagcggcagcgcgtgggctcggcgcggggagagcgagagagggcgcagcggcttggggaaaatgggggaaacggatgagggaaggcgggatcgagcccgggagaggcggcaaccggcgacggagtggggcggcatcgtggcgggtgtggcggctcggcgtggcgtcgattccctcggggagagagggggagtggggcgggatgtggtcgcgaggtggaaggggtctcgagtccacgccggttgggacgaggggaggtgcgggatcggcggagggagtgggtggcgtggccgacggttggagctggccggaggttggggatgacaggtggggtccacgggtcccacctgtcggagagagagagggagggagaggccggctggggaggcggaacagacttgagggagggagagagctgagcgggccgagggaggaggccggcccgagagggagagaaagggggcgcgcgggccgcgggagagaaggaagacttgggccgaaaatggcccaaagagaggaagggggattttctttgttttctttttattttaattgattcaatgatctttgtgctattaaaattatttctcgagctccgaaaattcgcgggaaatttcagagagtattttagggcacaaagaatattacaaaatattctcggccaatgatttttaaaggaaaattttaaattccctcattatttcacttgataaaattgctttagcttttatttaatttctagaaaatgcattattaaatgatttttaatcccgaacgagaatcggggcattacattatcctctcgatctctctcgctctccgtctctctctctcgctcgctcgctccctatcgtctctctctcgtccgacggagtggcggtagcggcggcggccccgcggagggggccgcggcctcccctccaccagatccgaccggataggaggcggcacacctcggcaacagtagcggcagcggcagcccgacggaagcggtagcggctgctgtgcccctccatcctcctcgcagcctcctcgccgcaccacgctggatccggctgcctagatgtcaggggctgctggatccggcctcctagaggcggcgtcggcggcaatttgatggtgagtcttcaatttctgtgatttgtgtggggatgctgtggttgatgaatcgatggtgatgttgatgaattaatgctgatgttgaatttatgtgatggtgagaagtgagatgttgatattgatattgatattgatgaattgatgttgatgaatttttgtgatgatgaatcatgatttcttgtatatgggatggggagctgctcgatccagagccgatgcatcgagctggttttttttggctcctgtgcgtctcaaaggtgccggttatggaatcggcacctttgaccctggctaatcagtgccgccttccgggtgccggttg

SEQ ID NO: 59647 - DNA, 3881 bp, Oryza sativa
cggcaccatttaggatttctgtagtagtggaggcactgcagcgggccatgaatgcatggccagcatatcaaggtcaccacgaacctgagcaccggccgagcctcgcgccacctaactccggcggtagcaacaaggtgcgggcgttgcacgcagcgttggcaaagacagcggtgcaagtccggcaaccacggcgagcttagcacaaggtcgaccggcggcacaccaagcatgacgatgagcagcggggcgacaaaggtggcctgttgaaactaactgaggtgtttaacaaaattcatgacggatggcattgttctaattttgaaatagtacagtggcatccacccaatttcacgaacagtaatgacgtattcttaattgaacaaatttgcaatggcatccatcaaattaaccctatcaataataaagagccaacttaagagactattctttgtatgagtgctgtttttctctgatgtgaagtatttgagagcccctctacctttaaacatgtcctaaatactgaatcacaacttcacaagtttctaaaaaaaaaagttaagcaattctaggaatgtgccatatgatcgatgtggactagagagcttccagccctgtcctttcttaaatatttgaaagtatgtgaggcttttgtaaaacacttgctcccaagtctaataattaaatagtttctgtggggtataagaaaactgtataatattacttttataactattaagaaagcaacatgtttgtcgtttagaaagcaatcatttaattttaagtagcaaaggtttctttcaactggagttagttggagcacggtgtatgtctcgaattgtaccatgcctgtacacgtgctctttcgaaacatcaacattttggaattatgagcattaattaatttttcaggtgtgtacaatatgaggtactgcaacttcataattagcactaattaaaatatcagtgttaattaatcgcgagtctcggttaactaacgtacgctagtggtgcactacagtaggaaaaaaaaaatctaatcttggatagcatagaccttgtgaaaaattaattccatcgctagctcttcaaaaatcggtgctcatgatattatatataccaaaacgctgttgataatatatttagtcattttttggtgtgtatttttttaaagaaaatctaacatgtatatcacgatccttcttgatctgcatcttgtataatcatacaaatttaaattgaaaatatggacgctgtctaaactgaaattaaactgaaaacatgcatgcatataattataattaataagcagtgccttctttttatagaacaccatcgtttaatatattccacaaagaacatagtaaatacaaatactcgtacattaatttctttgtggaatatattttgagttgaaactgtcgatgatctgtgcatatatacatcagtcgctttaattaaacttttttagattcaaataaatttatacaaaaatatgacaatctttttagaaaaacaaacatattatcaaaatttaatcataaacatatattataggttagttttaatggaactaatttagtgttatagccattgttaaaaatttattaaaatcgatcaaacataagaaaaggttataaaaaaaaatcaattgaagcgatttataatatgaaacaaagagatgatattaattgcatatctcatactccatccatccgttctaaaatataactatttttagcatagtgtcaagtcaaatatttgcacttggactattaatagcaaaaaaaaaaaagatcaatcacctaaaattgagttactagatttattattaaacaaactattattgtatgcaactctttttatttaaaatatcttacttttatagatatcattagtcaaagtagcatttcgaagaccatgtcaaaatccaaaaatgtttatattttagaacggagagaatacttctttttctgcaatgtaaaatgatcattcaagtgcatatatcgatctttgtgtgctatgggatcgagtacgatcgaggtactcaaatgggcagcaggtctactatgtttttggatcagttcgatcgattgccctggtcggacggttgtgagtgacatataaaacctgcaagttttcaacgacattctcacgtgtgcatctggagatcacttacacgagcaagcaatatatataactatgctcctacaattattgcaaacatatgtgcgtgcacacacatatatatatatcctgccgatcagggaatcaacattatcatatgtgtatgattggtcgttggtttttctctatatatttgtcggcaggtgtggggatatatatccaatggattaattcatcgagtaaactagaattaaccatgcattgcatgcatcttaattttaattacttgcattgcattgtatataataattgggtcttcaaatactaccttattactccctccatccgtgaatataagggattttgactttttacttgcactatttgaccattcgtcttattcaaaaatttttgaaattattattatttttatttgtgacttactttattatccaaagtactttaagcataacttttagttttttatatttgcacatttttttgaataagacgagtggtcaaaccgttacacgtgaatagtgaaaatcccttatattttcggatggagggaatactagctagtgacagagtcattggtgggggcaacttgtcagtgactctgccctgtgggccggtcgagccagcccagttgggtgatgcatgcattgggcccatgacacaattaatacgtacgtacaacacagtacgtactccactatactcaaatgggccgggaccaactccatatctgtaacccactttaatttaattcagatttataggaccgcaagttattgatccattcactgttaaatataatccttgtcgatcttgaaaaggaaataacaataattaatggtacggttattaattatcttgtgcgtgatgattgcttttttggagtgaaacaacaaggctgaattgggcaataagctagctcgatggtagtttagctgctacaggattgcaaattgacaatctatagctgctacaggattgcaattgacaatatatagtaatccctccgttttgaaatgtttaacaccgttaactttttagcacatgtttaaccgttcatcttatttaaaaaaaattataaaatatataaaactatatgtgtacatgaaagcatatttaacaatgaattaaatgatatgaaaagaataaataattacttaaatcttttgaataagatgaatggtcaaacacgtactaaaaagtcaacggtgtcaaatattttgaaacggagggagtaagaaagaagaagcgacagatcgatatatatcgatcgatggctacagtttataatgtgcagatttatcgctgataataatagagggaggcaaagagagacgatcgatcaaccttagcttttccttttccacaaacactggggaccagaaggaatgcacaatgcatgcattgctttctttgttcttcaagcaatcatcgtatcatctctttacaatgatcgatccatcgatcaatcaatatgtagtgtgcacaatgctcaccacatagtgacaggagattattctaaagaacacggaatgacgccctttttttttttgccaagccagcctatatatatatatatatatacactggtggagaaaggggctttactcccggttcgtaacccccctatagtcccggttttcaaaccgggactaccaatccgggactaaagatcactatctttagtcccgggtgaaaaaaccgggagtaaaaatccatttttagtcccggttggtgtt

SEQ ID NO: 59648 - DNA, 8747 bp, Oryza sativa
ccaaccgggactaaagataaaaaaaaaactctatccttttgaaccgggactaaagatatctttagtcccggtttttattgcaaccgggactattgtgtattttggccgaccgaccaaagatggtttctccaccagtgatatatatatatatatatatatatatatatatatatatatatatatatatatatatatatatatatatattagtagtatatatgttgttaagggactgctaaattaaaaggggacaggagaaggcctagagattaccacatcaataaagaaagaaagatctatactatttgatcatgatggtgatcaggttcgtattatatataatttaatacaaaataggggtatgttggtactccctctagttctataataattgacgttttggacaaggttgaggtcaaacttttataactttgaccatcaataacttaaaaaatatttagtttaaagaaactaggacaacatatatagatttgtctttcaaagcactataataaaagtaaacatgtatttatttattgtgtatattataatagaaaaataaggtcaaagatatattttgtagaccgtgccatgcattgtccaaaacgttaattaaaatgaaaccggaggaagtatctttcatgtcactgagacttccccaaatctcagtcaccttctctcagctaggggtgggcatttggtctgactgcaaattcagtctcggtctttgttcttttagaaaacttcggtcctgtaatactgaagaccgatcgatttgcattgcaaaataatgaacgccgaaattcggtctcagtctcggtcatgaccaaaatttaagcagatccaaaaaacacatagatcacatataaacagcatgtccaaaaaatcacacaaaataaaaaaaaatgtcaaatcggccagcggcttggtatgtgcatgtgggacatggggatttagtgcttcctctctgggcctattgggctaaactcattcaattcggtcatcttgattagctgaggcctatgaccgaattgaccaagcaaaattcagttagttgagtatgaagaccgaaattcattgcctcgattagttcggtctcagtctcggttatttcggttcggtcttttctgtccacccctactctcagccaacaacaagggagtcatcttcgacatctagccaagggagaggttaggaaaagcgggattcacatgaaggactcactagcaatggcgatgacaacttcatggtggtggcaacaatatcgaaactctaatagattagggtttcaggatcagaaggtggtgcaggaaggtagggccagacgactttagaaggatggccatgaagtcagtgtcaaggtggtttgtggtggtacaacgacagatatgggtgagcagtgtcggatttgctggtggtgtggggctggaggagagcggtgggcgacaaggtaggtggcgaggggagggagatggaagagagtggtgctgcttgggcatcgggaggagggagatggcatgggaatgagtggtggagagaagaagataaggtgagggatgacgtgatgggaagggtggttccggagaggctcatcaatgctagcaaaagggggtcttgccgggacgggaaggagtggcggcggagctcaatacgttaggctgctcgatctggccagtgtcataggtgggggggggggagagagagagagagagagaggaggaggaggttacgcattaatcttgcctcgacctaggttgtccaaaagtgactgaaatttgtgggtattttcaggtgatagaaattactagacaatcctacaaaatatgtacagctatatatatatatatatatatatatatatatatatatatatatatatatatatatatatatatattataaacaagacatgcacatacaaaaatgaattatacttttaaataagatttaatctagctcaatgcaattgcatgggaaatataggctattcctctatttctataaatatagttatatcccactaattataattactcctgtaaagaagcacatatttaagtccacatcatcctcaagtttgtatagaagcacaatacaaacgcatgcactctgtcggtgatatgggcccgggggtaccgggagtaccgaacttagaagggaggagccgcccttggcatccacgtggcgctcaccccaaggggtcgcgcccgtggacgagtggaagccgcccgtacctaacccgaggggtcgggctgccccgacccctcagggtggtaaacacgtggtcaccatgcaaaaatgattcgtggatacccctccgcgcccacctaaccgcatttaatgtgggcagagtgggccgggcaagcgtgcctcgccgcattaaatgtggcgtgccgctcgcctgaccgaatcttgaccggacgtgatcggttgaaacaacggacgggacagcggcaagccacgcgcggtcgcacaggtgtcaggcgaagtgcggttggtatgccctgtcccatcaagatgacaggaggtgcagcgcccgggatggcgtttccagcgcatacgagcctcaaatctacatccattaaacgaagaacgacagggatcctcctccatgtcggcttgcgtcagtcggcataatttggtggggcccgctcgactactgatgtagggaatttccaagctgtagcgcatgcagcgcgagacacgcgttcaatctagaggatgtttcttctcttactagaggacgcatagaactcatgtaataaccccttaaagtataaaaggggagtggacgtccagtgaggaaaaaaaagaagggagagtaaggacacccaaccctagcttgtacaccagagattcagagacttccaaagctcaaaaaaatcatcatacacaggagtagagtattacgcttgttagcggcccgaaactatataaaccccttgtgtctcaccctaagtaagggggcccaaccccccctctttttctcccaatctttccagttcctcgacctccacctgttgcccccggccgaaccaaaaaaggagtgctctcatggtcccccgccggaggagttcatcctccgacacactcataagtcataacacacacacacacacacacacacacacacacacacacactcactcacactcaccctctatgagcgtatacacgtactcctcgacctctataagtatcctggaagactaggccaacggtatcgtgagggttgacgaagtcatcatagacgcttcactgtcaaaggggtgcatatcaaatctaagagttgaatccgggtgggctggctccatcaccaggaatctaaccagttaagttatgctgcttaagataagccgatcgatatgacggttcctatagcaacttacctacagtatgttgaaaggacgtctatactagtatttgattgaaatagtaattttcactaaaattctaggtttccaattatggtacaacagctaaaaaggaaaaaattagggaaatcatatttagttttgcaattaaatattgtaccgctgaatctcaaagcaaatggtccaaattattaaccgcacgtgagttaacgaatgattggcatatcctacctgtaaacataaaaatgactgcaagtttgtcaaaaatctgggcccattttatacagtgatttcttcgtacgtgcagttgattgctggtgcgactatatatttgatcaagttgcattgtacgtacgtccttattagttataggccacgatcaaaatgcacaattttagttaaacaattgattaatttcttgttggaactgtagttgctaagcgaccctatttttttcctaacaagcaattaattttacgtactaattgctagctaatcgctcctgtgcaaagcttaattttacgtacctggtatatagtacctagctaacaagcaattagcgacgtacgagcagacgaatcaacttgttatcactgttctcattaataagaacaataaggcttagttcgaataaacttttaatttgttagatttccggcagcaggcaaaacaagatgtattaacactatactacaaacttaaaaattgaatcttattcacctggtgatcctataacattgtgtacataaaaatagtgcaagtataatactcaagctatagtaagctagttagattaaggcccaagactatttctctccccagttgcttggagttgcatgcaaaatgtcacaaaaatgttggatgtactgtggggtctagacatggtagctagctagccggccaacatgagattgaggctctgaagttggtagttgcatgtgtcctgtctcttggacatcctgtagaacttgaagagagttagtaaaattccccccttttttttcctttacttgagagggggaagagagggaggaaagagaaaaagttatctagagagaggatgaggggttgtatgtattagttactatgtatattttcttttatgactcatatagttatattttgtaattaaccatctccatatgcacttgcttgcgaggtactccttccatttcaggttataagacgttttgactttaatcaaagtcaaactgctttaaatttgactaagtttgtagaaaaaagtagtagcattttcaaccaagacaaatttattatgaaaatatattcaattattgatatgacgaaactaatttagtattataaatattgctgtatttgtctataaacttagtcaaatttaaaatagtttgactttgaccaaagacaaaacatcttataacctgaaacggagaaagtactaattaatatctagtaaatggaggattgcatgttggtatatatgtatttgatttgagatttgtgtcgccaattaaatgacaataattattgaggaagtttgaacatgatatgtcatgtataagacaaaaccaatcaattaagatgtagtcctccggtgctctccggcagtccccctccaaactatcaaaagtacatgattataaaaaaaaaagtctcaaacattttaaggaacgatcgatggaaataaagaaaaaatctctatgtaaacatcgagctatgattttgtctcttttactagccaaaatttgacatatttcttgttaagttctcctatatttagatatgcatcacaataatttgtaaaatgtttgaggacaataatttactacactataaactactttacttgaaaagcctttatggctatttgtgtacttcctaaatatagtttagagcattttaacaaaggccctacatatctcgatctactccttgaaaatagaaggaattaatggcgactgtgttagcgtgctctacgtattcgcgatagacttatataagaattacagtggcttgtatttgcatatatgtgtgtgtacactagctgtttttaatttggtcaatacatgattgagtttgaattaataacttttaaatttaaattcagtttaaatttattgacaatgaggtgggcatattcctagatctctaaaagctcacataagtcatcgccggccttccatccacttggagtcggatctctacgggtagctgtcatcacttgcacggtggtgtccctcttcctgagaaaaccagagagagagagagagcagcagtcagcatagcaaagaagaaagcccacaagatcacaaaaaataaggatggatacatggaaggaaggatggtggtacatgacatgttcaccttttttttttcctctctctctctctctctctctttcctttctttccctgctaattgctacctcatctatcccttccacctcactctcactgatcttgtctctctttctctttctctctctctcacctgttattagtcttggctagctttcttctcttctgattccctccactatctctccaactttggccacatacaccacaaacaaaatacaaggtagctagctatagctgcagaagagaagggaaagcaatcaggcatcagcagctagggagagagagaaaagaaaaacacaaggccttgccaaaccctagcactttaattctctatcttctctccagagtcaccagacctcagctcagctcagctcagcatcacttgctacccaccaccatgatcttcccccctgccttcctggattcctcgagctggaatgataacaacaacaacaaccacaaccagcagcagcagcaggtaataatcaatttccagtcatcatcttcttcctagctcatcccctttctttctttctttctctttcttttccgtcaagagattttattcattctcttttgcgcaagagcacaaataaaagctacaaagttgtggcgatatatatatattaaaatttggaaaagaaaaatttaaagagatgtgagaatacttgctagggctagctcaatattccgatccggagcactgtcttggtatatacttactgcccaaataatcgtcttcttcttccatctttcttgctagctagatgcttctcttgtcgatctctagctaatatatatatacaattaagcttgtgtttaattgatttggtttgattcattaattcagcaacatgctcacggccaccaccagcatcatcaggtcgccgccggttgtggaggcggcggcggcggcggcgacggcaatagccatgagcttctgcagcagcagtcaatgattccgggcacgcttgccgatggcggcggcggaggcggcgcggtggggccggcgaagccgatgtcgatgtcggagagggcgcggctggcgaggatcccgctgccggagccggggctcaagtgcccgcgctgcgactccaccaacaccaagttctgctacttcaacaactactccctctcccagccccgccacttctgccgcgcctgccgccgctactggacccgcggcggcgcgctccgcaacgtccccgtcggcggcggctaccgccgccacgccaagcgcgccaagcccaagccggcgtccgcggcgggctccgcctcagccgccaccaccaccgccggctcgacgccagcggggtcgacgacgacgacgacgacgtcctccacctgcgccacgcccaacgcgcccgccctcccggcgatgctgggcggcaacctctccatcctgccgccgctgctccgcctcgccgacttcgacgccatgagcctcggctccaccttctctggcatggcggcggccgccggcaagccaccgcccgtcgacgcggccggctgctactccgtcggcgccgccaccggcctcgagcaatggagactacagcagatgcagagcttcccgttcttccacgccatggatcaccaggcggcgatggcggcgccaccgccggcaatggcaatgccggggatgttccagctaggcctagacggcgacggccatggcagcggcggcggcgaagacggtggagagctccaccatgcgatgccatcatcgaagagagaaggctacccaaggggcatgtatggcgatcatcacctcgctggaggatacacctcctactccagtgcaaccacaggtaaccatctcttgtaatgatcgagagctagcctataactaatcacaatctagctagctaatggcagagatctgcaaatataatgcagactctctacgattagctagctagatatatattcataatagggcgtgtgatcgatcatatcgatggtgatggtgatggtggtgtgagatatagaaccaaattaagtttaaggatggttgatctcgatcgatcgagatcgagatcgaggcatttgcattttttgcacttgcaattaggtgatgtgtcccaatgaagactggaggagtgtgtgtttaattttgatcatgcaaaagtagtactagtattttctagctagtttagctttgcatgcatgatctaatctcacttgatgtgtttcttcttcttcttcttttcttttaaatgttagggtttttttttctctctcgtgcatttggggccacgtacgttatgtgtaccactactgttgttcattttgttaatggaaactcctattatatgtcaattaattctcctatatattacgtgtgatgatcgatgccttctctctcaattcttaattttgctattggtgcaacaatcagtataaatttatgtctttgtaatgacctgaggatcagaaatatattagaagctatagctaagctagctactgcatgaattcgtctctaagtaagatatatgcaactatttcaaacatgcaataccacctatatcgcataaggtctattaacaaatttgtagtctatttcgcatatgccctattaattttaattacacgcacattttgaacataacgtatatatgtaaatctctacggtgtatagtacacgtagtacggcttggcaataggattgcaatgttaattgcgactacaaattaaagggtgtagtcaaagagggctgagaaggcccattcaaaagcaaggctcttttgttttttttacctttaccttttgctccttttacagtgatagaacgtactaaagtgtgaagatatcccacagattgatctttagtgtttcatgagggccattttgatttgatcagctcaaatcatatactactcctatctagctaagctaagttggtctcagttgccttcatatatatgctactttttaatataatatccaacctatatatatattattttcctatatatttgagatcaatgtaaatgacaaaaagctacatacatatattctagctggg

SEQ ID NO: 59649 - DNA, 11748 bp, Oryza sativa
tgtagtcaaagagggctgagaaggcccattcaaaagcaaggctcttttgttttttttacctttacgcttttgctccttttacagtgatagaacgtactaaagtgtgaagatatcccacagattgatctttagtgtttcatgagggccattttgatttgatcagctcaaatcatatactactcctatctagctaagctaagttggtctcagttgccttcatatatatgctactttttaatataatatccaacctatatatatatatatatatatatatatatatatatatatatatatatatatatatatatatatatatatatatatattattttcctatatatttgagatcaatgtaaatgacaaaaagctacatacatatattctagcttagttttagtaattaataagcataccacacagataattaagcttctgagctcaatcaatcaccacaaatgcacctgaaattcactgcatgcatgcattctagtaactactccgtacacagtatgtatagatagcagatagctaggcaagcatgcagtagtgtccaatagagtactatgtaaatggaaggaagagaagtatatgtaatgtagctagggcgagtttcatggaggacattgcatgagatgagatgagagagtatatataatattattcagtcttcgtcgttgtgttggtgatggtgtgtgcatggaagtttgagaagtgcactgagaaagaggaagaagatgagctgaagaaggaagtgcatgctctggttcagtggtactacactgctactgctatagctcttgtgtgtttgtgtggccagctagccggccgggtgttttttcagggactacgtgtgtactctctcatcgtctcaacgacgacgatgtctatggctctagcacacacacaacacaagcagctaaggaagagctgcctatagagagagagagagatagcagatgatggaatgctgtgcccaaaagcacaagctgctgccaacaagactggcacagaaaagtgaatggagcgtacgaaagaatgtgtgtgtgtctctgtgtgtgcctgtgtgccacgcaaaagagatagtgaaagagagagagaagatagatcatactactactactctctatcatgcatgaatcagtactatattctgaggatatcattatcatgcatcatgttgctagctagcttagcttaggttaactaatactatatatatggagatataaagtagctagtactggagctagctaagctaagctaaggttagcatgcattgttaagttaggtaagagcgagactgatcagtactgagtagtgattaataacaggagagatagtaacagtactcgtactgatgagagacgatgtaatcctagattggttggtagctagctggtccaagatagatagatctggaattagcagcatgcatgatcgatagtgaattgaagggaaaaatatagctagggactgggagggacgcatgcatggcatgttactcgcaggaggggaggggcagggaatcagattctcgctgctgctgctgcctgcactgcctttgctttgatagctttgttttgggtttgctttggctttgctttctcgaaggcctaggcccccctctcctctcctctccccagttctctcttcatttctgttctcccctttgggagaataaagtcaccatgcacatgcaactactcatccaacaccatactattgcatgctactgatcctctcatctcatctctactactacaagctaattaagtagtagttagctagtctaagaacaagtacaatagcaggctataagccagctataatcacatatcgagaagaaaatagaaatagggaagaaaacgggctacagatttgtagccagctgcaacacggactctaagacgttatgtgtgtgtatgaaaggtggaaccgggtattattggtgtagtatatttttatagatacataatgtatgaatgggctattatattagttatagatgatttggagttaacagttagctataatattctaatgcatctatcgatagagagagagacgatcgatgtacatataattagtagttcctttttggattcttgaggaataatgatgatttaacccatgcatccaagatactagatgtcacacacacacacacatatattctttatggtatctcgattcatgcatgcatgcatagattgtgttggaatgtgccagctgcagctgctgctggttcgttaagtatatatatctagggaaactaaaaatgacatctctagagagaggatgcaggtacggtggatgtaaaatcactgggaatataatcaatcagtctggaatacagtgttctctgtcttgatcaacatctctggggttgtgtccccgcgtctttagttcattcaaggaatcagggttcacttttggggaaaaatcatttttcctcaagtatcttccttgtaatataatctcttaaagaaagtgtagtgtattacaagctaaaatgtagggtattagttttataaataaactgttgttagttagctagtaagctaactaataagggtatgtacaatggtgtttattagtggtctctctctattgccatgcaagtaaatttggtgacatgaaagaaagaggaaggagtatagttgttatgcatgacaacggctaagagtcgactcttagcatttattagagcaaattttgttgcatagtggtgaaagaaaggaaagaaaagtaataaaaagtattttgatacattaatgattagagaccatattgtctctaactgttgtaggatgctagtctctagataacgtagagctcatatccgactctacctttgtacatgccctatctatgtctaaattagtttgatatatatatttaggagaagagcatgcatgagaggtatatgcaaataccaatttcaaatgttatcccctctacgctttggctatcgacccagtgtttatcgggtacattagagatatggtccttcctagtcctttttcactaggaaaagattatctcaatgttttaagagcatgtttgagcttaacattacaagaagcatctagttggttgctaccatatgagaatatgaaaaaaaataggttttctagctagcttctgttttctagtttattttctagattatacaactacaacgatagttttttagaatctgtataaaaagctgtactgtttggggagtttctaattctggaaaaagctgttgtaactagaagcttcctcaaacatgccctgaattatattactacttggtaagtactaattgtagtattaaaacaccacttaaaattggctcagtactgaggccatctgccatacaagtcgttcatagaatattaatgaacgctcatcatcaaaattagatagctgtttaattttcttcgggatacaagaggtgctaatatatcctaaaatatcaaattatattttttaagagaaaaaccttcgggagcccggcttttactgaaatcttaacaagtcaaattatgtttagaacgtgagtaattaattttgcttgtaacgtaccttcatgtgtagatacttgtgttaattaattaatcggaggaaaaaaaacctcacataatggtatctgatcgataatatatatgggcatattctttcgccttaagcaccattacatcaggcttgcagcgcgcgcaatacattggttgaaatcagtaatggatagtaataaatataattaataaatatgtgtttaatttggagatctaaaaacagttcaagaagctagtcctactcatccatcatcaaattaactattatgctttaaagttagtgtaaatcactttgggaagatcaagtatatatatactccctttgtcctaaaatataagcatttttgatctcgatacggtcttcgagatgctactttaaccaataatatctacaaaagtaaaatattttaaattaaagagttgtatattaagatagttcgtttaatgataaatataataatatcaaatttatatgattaatcttttttaatattttgctattaatagttaaaatttaaaaaatttgactttgcactattctaaaagtacttatattttagaacggatagagtaaaagcgtatctctttaattcttaccctattatatactagtaatatgcccgtgctaaacgctacggtgtattatatttgtctttaataaaactttaaaatagattcagatgtcacgaatagaaaaattatataaaggcatgtcacgaattcgaattttcccttaggtcatttccattcatttttcttgtcttatgcacttaaaacatattgatttttctatttgttatatctttggcggcaaagcgaccttcattagcagaagcattttgatccatatctaacagacaaaatataaacaaacattagttgaaaccaattcacaatgctgcgatcttatattgaaattatggaaatcatatacatcattttgatatctcaatagcagcatgaaaacatatacatcattttgatttctcaatcgcaccatgccaatttggaaaacatagtggaatattgaaagtaataaactctatggtttaaaatttagaccataacttgttgatcctcaagcattgataaacttcgagagcattgattgtgttatgcagtatacaataatacatttgcccttcaagtacacagcggataagaccgaacaaaaaccctcaagggtggaaggactatttagcaaaaggattcccaaaaatagaagcatatgaaggtgaaatgctgagcatacgtttgctattttgtagctgggccaaaaggaggaggagtcgcagacaggccgcagcgtcgcgtcgacggaggtgctgggtgtcggcgacccgcctccgcaggtacgggagaaacgaacgcgggcgaaggtgatgcagcgccgtgctctgcggggggctccggctgcgccgcgtcaaccggcggcgcgaggtggggagggagtggaggggcccgatgaggcgatggatgcccgcgtccgtctctgcctggtcgccgtgggggggacctaggtcggcagcggcgcggcggcggacctgcgaggcagcgcgagcgcgagggagtgagcggcaggcggcgattagggtaggcgatgcgcgagggagaggtgcggtggggcgtggttaggtggagagattatagggagagagatcgcggtttagagggagaatcgcggatgggagaaggtgggagcgacgtgaggcgttggatctgtgagagggcatcctgaccgatcaacgaggaatgaggaatgtaatactgtgttggtaaattatagggtagatggatgcatgaatgtattgtttgttagtccaaattagcgttaagttttccctgaaaactctctcctgtttcaatttacccgattgatacatatatctttctcatggcgctagctaatatatttaggcaggagtatggagtagtattaattattccctcagtataaaaaaaacctataactaattaattaatatgatatattctagtacaatgaatttaacagaaatatgtctaaattcgcatggtactcggttgatttttttagtacagagcggtatgtcactaccccattaattaattaaattaaactaatgctcacgataagtgacatatgatcagggtgtagtttaagggcccactcgaggccttgtcattcctgggctgcaatttagcagaatgaggcccacaaaaattaggatcaagacctacatatatacacaacaatataactataaaattgtttctacgaatttagtcaaacttaacaaagttttataattgcgctgttgtgcatgtaggtcttgatcatggaatgctgactagtaaaaaatacaaatgacttataatatgaaatagagggagtagctaataagaatttagagaaacatcacgtttggctactagtttgtttatgtgaagtacagttacgagccttttcaatctagactgtttggctaataagattttttgaagtggatatagctatagctttgccaaaaaaaactccttgaagaggaccaccgaccatagaccttgtactgttcaaaaaacttcttaccttccctagctgaaggtaagaatttaagttttagtagtgcaaacatttcttaccttcccaggcaggctctaaaatttcttaccttccctagctgaaggattaaacgctaactaaagtaactagctagacaatcgattatacgattaattatcgtgtgatgtatgatatggccaaattaattaataaatgctcttttatccaactatacatgcgagagtgctgtgggcccactggaggcccatcccattactgggccgcacggcccttcatcagaatgaaacgtccgatcaatttcattcgtaattgaaacttctcgatcagtttccatgtgaatgtttttatttgtttttttagtggaaatgttttgcattttgtgaatgcatgcctggccacaaatccatagtatgtaatacgcacatttcgaatatggaatcgtatcatctgattgatccatatatgctatcttgataaaaactaaaaattcccacccatcaactcgtttgattctccaagttttttttttcctggtactttctctaccttcctttcgaaggcacctcacaaagaagaaatccatcaaacaaaatgacaagaaatcgaaattagaaaaaagaaaacgtgtacttttccggtccaaacgagtgaagacaacacgagttttaattcctcaagaagaaatcaaatagtattcatatttttccaactaaattcccagcgaaccaacgatggggcccagtgtcagcgcccgccggccacgcctttgacttgtgccccctccactcctacgtgccacccactctccgaatccatctcgtccgtccatctccacccttcctcccatctcagccgtccgatcttctgctgaccaattccctcctcttcaaaaaccgcgtcctcctacgtcgtcaagaaccggatgaacacctcgtcgcgagctcgccattgccactgcccattgctctgctcgctgctccatcgccggcgccatgtcgatccgcaaggcgctgggcgccgtcaaggaccagacctccatcggcatcgccaaggtctccgccgccatcgcgccggagcttgacgtcgccatcgtccgcgcgacgtcgcacgaggacgcccccgcggaggaccgccatgtccgcgaggtggtcaccctcaccgcgcactcccgcccctacaccgccgcctgcgccgcctccctctcgcgccgcctctccaggacgcgcgactacgtcgtcgccgccaagtgcctcgcgctcgcccaccgcctcgtcgccgacggcgacccgcacttccgccacgagctcgtccgccccgcgggccgccgcggcgagccgatgctcgcgctcctcgccgagttccgcgacgaagcgcactccgcgtcgtgggaccactccgccttcgtccgcgcctacgcgctctacctcgaccaccgcgcccgcttcctcatatccctcctccccgcgccgcgcaccgtgcgcttcgccgacgagacgggatcgccgccgcgggggtcgacggcggcgacggtgcaagagatggacaccgaggcgctcctgggccgggcgctgcagctccgccagctgctcgaccgcgtcctcgcgtgccgcccatccggcggcgcgaggcaaagccgcgtcgtgctcgccacgctctacccggtggtcaaggagagcacgcagctctgctccgacgtcgccgtcgtgctcgccgtcctccttgaccgcttcttcgacatggactaccccgactgcgtcaaggtcttcgaggcacacgtcagcaccgccaagcaaaccgacgacctcctcgccttctacggctggtgcgacgacgtccgcctcgcccgcccggccgacttcgccgacgtcaagcgcatcgacgacaagctcctcgagacgctcgagcagttcgtgcgagagcgcggcagggcgggtcacagctcgccgcctccatggcagcagcagcagcagcaaactgcccagagcgacgagctcgacatgaacggcatcaaggcgctcccggcgccggagcatcacgccgctgagccatcgcgatcggcgccggagaaagttgcaccagaacaaatggcgccgccgccgccgccgccgcagactggcgacctcgtcgacctcagggaacccgtggtggaagacgagcaggagaacaagctcgcgctggcgctcttctccggcacggagaacggcgggtgggtggccttcccgtcggacgacgcggccgaggtgacgtcggcgtggcagacgccggcggcggaggccggcaaggcggagtgggagctcgccctggtggagacggcgagcaagctgtcgcggcagaaggcgtccatgggcggcgggctggacccgctgctgctgcacgggatgtacgaccagggcgccgtccggcagcaggtgggcgcgcacgaggcggcgacggggagcgcgagcagcgtggcggcgccgcgccgcgcgcccgtgctggcgctgccggcgcccgacggcacggcgcgaaccaccggcggcgacccgttcgcagcgtcgatgggcgtgccgccgccggcgtacgtgcagatggcggagatggagaggaagcagcagctgctggtgcaggagcagcagatgtgggcgcagtacaggcagggcggcatgcagggtcaggtcgccatggacaggctcgccgccggcgccatgccggtgcagtacgggatgcccatggcgtcggcgtacggtggctactactgagcaagatggcatgatccgcgcgccattgatgagagttcaagttcgatcaagttgtgaataagaagtagtaatccgctcttgcgagattgattgggtttgattgattcgtaaagagaagcgatgagcgcttgtatacgtatactacgtttgcgatcgattatacagtgtacatgaaaacattactgataaaagattcagttttgattatcgagttcgatcgcgttcgcgatttgcattctctaactgaaaaattcagagattcagtcaggggttcaggaaatacgccattggagaaatgtttcttttccctgatggcctgatcataaattcattcgtgatgcagctcaatgtttacaacggatcatgggatgcctccatatgctatatttttacttctacattgcaattttgctgtctacacatattctcaaatgataaaaattcagttatgattattgaacacgaacgcatttgcgatttgtattctgcagcaatggttggttggttctttttgcaactttggcattgcattaatttcttttaaactgaacaattcagagattcagtcaagggttcaggaaaatgccattggagaatgtcttttctttgtctgaagggatcgtggattcttgatacggaacagtgtttaattactagaacgggtcatggaggagcacaaatgatcctagtggttgcagtgagctaattagcaccctcaaagtcttgagctcaaatcttcatatgagcgaatttgggttgtttgtggggctaagtttctaatttaaatggctgcatatatccggttggatatagaggttgggtaaaaaatacatttctctgaaaaaaaaaatttttaaaaaaagaggagcgcgtatgatgccatatgctattcttgagaattttgatttcgttctgatcactcattcagaggtgacaatgctgctgtttgctcatatgttcaaatgggccgaatttcctatccgtctttcatgggctgggctcaattggtaaccaatgatttgcacaagggattggagcttgatagcccgatctcctgaatggaacttgaaattttcaatgtgttagctagctttgttgtttattttttaagatccataaactatgcgggatttgatagaaatgctacgaacgatcaatattcctgttatttctgtgattttcaaatggaatgctagctcagattcagattatcagagtatgcaaaattgagtaaaaattcagagatttcacctatgtaaaaccatattcctgtttcagagatgtcagcatcgaaacctaccaatgtttggtgagccgaagccattagcaccaattctttcaactttagcatccaaactacagtgattagtgagtcataattgataattacaagtagatctagcaaccaccataatcacgcttcattggattcgattcgccaatccttgtgaacagaacaacattaacatcagtaacaaccaatggtccgtccggtaatggacgtgtcagtctctcgagcatctcatgtcatcaacctgattgcgaaaccattactactaattaacagaaagcattgggcaatatataaggatgttattatatattctaatcccgggtttacttttaattaaaccaaaagtttgtttggttgtgactgtctttgctaatgaaacatccatcagcattatgcatgccacgcgtactacccgggcgaagatattttcctctgactttagttttttcataaaagatcaaaagcaaactttattgaggaaaacttaaatggtaaatctcccccaccaaatcattgtccatgttttcagagagactccgaaaattggtaggttttgtttttgttgagatcatactatattatttctactttattttttagccatctttcgccaaccctaatttgcatagaaaactgagaaatcaatattatttttttagaggaaatgcatacgcccagctttcattaaaaagccaaatagttcacaaaatcaatattaatttcagaagtccatataaaaactaagacaatattaatgtaaaacatgtattatgtgcttaattttctaatctctatttgactaatcagtactaccaaaatagaaatgtgatgagataaaacgtgccacatacatatataattgggatcgatgatcagtggaatcagtgcaagagagatggggggccacagtaacaataaccagtggttggaactgattctatatatcagcaagagaccacactaggcaagcttaggtccaccctaatagtggcccaattggaacagtagtgttctgctaattgacattacgtacactactcacaagtggctgtgatcgatgcatctctgatctgcagttaatttgacgacaatttgattatatctctcttttatcattcactgttgcacggtcatggagctagctaggctctcgtcagcaagttaagctaaggttaatccatttgagttaaagcagctaactttaacggcgcaactgctcaagatttaataataagattggttgggtagtttgggtaaataagaaatatgcttatcatctatggctacatgtgatcatagtactagtgaatcatttagaccatgcatccatcagctcaaaaataacttaagtagatggtgtcagtaaactaacctggctcatccaagtaggatggattatgtaacacagcatgtgcattaagcaagtagctaggcaggaaaatgatgtggggccagtggttcatctgtccaggtacatgccacagtgatgtgtgtacccattaattaattactcctacttacccttctgaaccgtgcgaaccaattaatcaataagaaatgagaaatgggtgtgtacatgacatgtgc

SEQ ID NO: 59650 - DNA, 1042 bp, Oryza sativa
ccccccccccccccgaaattttttatttttgttttatttgtttgatatttttttcacgcttagggacacacaagaaccaaccatacaaaaattgaactcaaatggacgtaatatgtgacatgtagaatttttcctctcctctcctctctccgaactagtgcaaaggagagagatgtgcaacttttttatttttattttatttttttgatatttttttcacacttaggaactcacaggaaccaaccacgtaaaaaataaactcaaacggacgaaatatgtggcatgtggaattttccaaagctccaccgaaaaacttctctcctcgaaaacacaatcttgcaagcggaatttggaggttttaatatcgccgaacccggcaaagctggggagaatcggatgtaacagaatcggatgtaactttttctgtagatgtccgtgcatatattatttgcctgattccgagtccgtatgagaaagttacgcctattttaatacatggcatattttgtccgtttcggtagagttttggaaaattctacatgtcacatattttgttcgtttgagtttattttttatacggttggttcctatgttctcctaagtgtgaaaaaaatatcaaaaaatgaaataaaaataaaaaaaattacatctctatgtactgtttaacttatatatgtcatttcatgtggttatattttgaattagattaagtaatttcatatagtggtagagtgcattatgtttaacatgctgatcaaagggttttactaaaggagttatggtctaattttagtgaaggtgcaaagtagactaagtggtatgctagatattttcagacttagctaagtggtagttcgagtttaaattttttttgtggttggttgtatcgtgatcctaagtgtgaaaaaacatccgaaaaaataaaataaaaatgacaccgttgcaactccatacagagaaacaggaatggaggcggcggcgccagccatgctggcgccctcctccctagggcggcgccagcatggctggcgccctcctcctg

SEQ ID NO: 59651 - DNA, 2121 bp, Oryza sativa
atgtgaataaggaaaaaaattgacaaaatttatccaacatagaaggaaatgtttgtatcaactatctatctggaaagcacccaacttcttttctcagagaatgttccccaagctccatcttccttgctctgattgaagacaaaaacaaaaatatgctgactgagcagagctagataatgaacaattgttgcaaagaaatatgcatttatgggatgtccttacagggatttccaccaaacaagttcacacggtacatctttcttaaggacctgtctatgcacccaaaacaacattctccatgtactgaattgcatgttttgactggccttcatcaaatcccttaaacaaggcattatgtgtgcagtgatctggatggataccatgctgatgcatttcagaatacagccttatagcctcttcccagttaccttctttacagttcccatcaatcagcaaagtgtacgtgtatttgtttggcgacaatcctctttccagcatctcatgaaaatgctgataagctaagttagttctccccatcctgcaaagtgcatgtatgagcacattatatgttacttcattaggtcgcactccttcctccagcatcttttgaaaccaaccatatgctgagtaaagatttcctcttctacagtatgcatgaatgaaaacagtataggtcacagccgaaggtggcaacccacttacaagcattccatcaaaaatatcccttgcttctctcagacgccccctttcacaatgtgcgtgaatcaagcatgtgtacgtgatgcagtcaggctgtaaaccgtcactgaccatcttcatccacaacacataggcatctttcaagttaccagatttgcacaatccatcaaggaaaatattgtatgttactgtatcagaagaaattcctcttgaaatcatcacctctgtcagctgaaatgcctcagaagtagaacctagaatcagctctgcagaaatccttgtattataggcaaagcaatctggctgcaaacctttgctcaacatttcatcaaagaactctcttaccatcgcaagattcctcaccttacgagacccattcatgagaatcgtgtatgtagaaacatcaggctgacagccctgctctaccatttcctgcttgaatctcctagcttcctctaaatcacctaatctacaataaccatctaaaagaatgttatatgtcaaaactgatggggctaaccccgcacgcttcaaatcagcaaatggaccaaagtgcctccttcaaattccctgccttacaatacccatttattaaagaattgtatgtaatcaaatctggaagtaatccattgctctcatttccacaaacttcatccgagctgcctccacattaccacttctaaacattccatgaataattgtgttatatgtcaccaccgtgggtacaatgccctcattctccatctccaactgcaatgctccagccttttcaacagaaccccttgcaaaatacccagtaataagtggattaaacgtgaaagctgacgccttcttggacatccgcattctgtcaaccagctgagctgccttctccagctcacctttcctggccaacccattaatcaccacattgtatgtgacatcactcggcaagcatccaccaggccgggcctccatctctctgagcaacttggcagcctgatccaccctaccctccctgaagaaagaatccaacaacgtgttgtatgtgacaatgctcggctcgattccaagctgaagcatctctgcatacaccgagcgcatgtcatcccacctggcttcatcacgcagcgcacggagcacgaggttgcattccttgatgaaagggggaactccgtggtgcgccatctcacggaaagcggcaaggcatagcgtcgaacaggtggagggcgcagggttgcgagctcgggtattgaacttggtggacaggcgcaggaggaggttgaggaggtagtggagggagacggtggtaggaaaggagaggaggagggagacaagggggaggagaaggccgaggtggatggcgcggacggagacggggtgggcggcgtggaggtgcttggcctcggcgagcgggacgaggacggcggcgtacgcggaggc

SEQ ID NO: 59652 - DNA, 13162 bp, Oryza sativa
aacgggctctcctctgtccgaggcgggggaatcagcgccggcgacgacgacgacgacgacgaggagacgaagcggaggccggagatggcggcggcggcggcggatgcggcaggagcttgggatttgcaggggtggatggagaagagcatgggttaatgttcgagtcctccccggcggcgcctcgccatgaatggctgcggcggcgggcggaggcggcgccggcggcggggaggaggaggggagaggagggagttcgatgcggtttgtaagatggtcgcgtggccttctccttcgcacacgacttaacccagaaaattttcttgtaataattcacttctctttgggcttttctgtaaatggcgcaaacgcacgttactctttagctgctccctttgtaatacttggttctttttcactttgtttttacttcaatcatctgtttttttaatggagttttatggctatatttaggatgcaggactttaggaaactttacgaacttgtatttctctttttttagggaaataggacaagtggccaaagttgaagaataaacacttcgtttcaaaatataaagaattttgttagtacaagcttaaaatctcttttatattgcttatatattgggatggttgtagaagtactctagggtcaagtagctagtttttttttttcgtagatacgttagcgttggtagacgaatggataggatagtatcccagtggatgtattgtaagctcaagttgtgtttattgattggaagttgctaagataccttgaactacaataatatgcgggcacattacacgctgaactgtactccaaaatcgatatagacatcaggatttgagccgtagtttccagctttcaatcgcaatctggcatggaccaagactaaaaccacgaacccacaaagccatgtaatgtatgcatatccttgtgatttcgacaggttcaagcgaattataggaaattacagacagcatccatcaggtgatggcctcccagtcccaatgtgattcctctactactgtaggaaccaatggtgatgataacgggccatattgagctgaatctcccggatctggcccgattttaaatgcatcctacgtaaagcataatatacggatgcattttgaggacaaatgtaccacgttttttgttcactacaaccgaaaaatcagcacaatgggcttgcagaaaggaactcaaagcccgggttttcataagaatcagtagctgtcttcatctgtctcgggcctccggagataataacgcaagcaattcacgagcacctatatgatggcatgttaagagatatataagtatgatgttgctgagatgaccaaagattttaacagaaagtagtaatcaaggcattgcaatacctgagataatgagctgttcaattttgcacctctgtaactcacatggaatttgtcctttgcaaccaagccctgaataaaacatcacatatgaagtaaggaagggagttgacagaacaaggggatttcataacaaagaaataggaacatggcatacttcagtatctatctcagctgattccacatcaacgttcacgtcagtgatgatcttcactatttccagaagtagaccaggccgatcagctgtctctatgtacagcatgctgcacatgtttaactaatatcaatgaggaagacggatgatgaacatcatatggagcaaacagagaagtaaggcacatgttatatcagatgtgatattgagaaacaatacatgcattactaataatatgtagacatgtatcaagcatgaactattaaatgatgtgcatagaaattcaatgatttacagactcaaattaccatgaaaaaaattatacctgtataaaactagggagggttggggtcacagtgttatataatgcaaaacttcaaacatcttataatagattcaatgtctttgcacaaatcttggtggactttggattgataggataggcatgaacatacatgtatatgtagttgtgtttctcaagttacttctaccggttgcattcgtaaagtatgctatcaggtccttgttttgtggagaaatcagtaacgataatatgaatcaagagtccttgtgtgcctttttttcctctaacacataggagagctgcgcatcattctattaagaagagagggagtctaggaagactcgtacaagcccttaaggaccagggttaaacacaccaaacaaaaactagaagaaaatgtgtgcctatttttaaggtaactatctagccgtgcacttgtaatgccccataagtgttcaattatacaatctgtggacatgtcacatcccactcctaagcaaggcatactgaaataaggaatcacgctaaaattgtatataatcattatggcttagttggatcaaaccttcttttaggtccatcatcttcaacaattacatgtgttacaacatcaacatcaacctgagagtttaaagaacaaataaatcacgttcatgctaaagttaatggaatacaaaattaacagcataacaaaacactcaggaacctaacttttttactgtgttaaaattgaggaaaacacacaactttaaaattgagaagatgcttgataacagagcatgggtggtgaacaagcagaatgagaacatccaatgaactcaccttcttctcaggagcttttattccaaaaaattcacccatggctaaattctcacttgattcctacatgcatatcaaccagacaaatgagttagtttgatactttgattcataaaaacaagaacggatccaaaattactaacggtagaagttctaaacacaagtaaaaggatgtgacgctcggaacatacaggatgatactgcagaaggttgttaataactgttagccgtatcttttccaatgtgtcagggtcctcaactttgcgccccctagatacagacagaagagggggaaaaagataatattagacatgaaattatccaaatcaccaaaacaatataagaagcatgatagttgctaaatgttttaatctcgtattgtgtttagtgcacatgtaaactattagtatggtactttgataaatatgtggattcaatgagaaaatacaccctctacttcaaatataaactaaacagcatgacaaaatgcagcacacagaaagtggcgtgcacccacgatcgcatgatgtggaactttgtttgtgtgacagctgattcagttgacacacttcctttcgtcacatcaaggcccaggtccttgagtgccttcatctgcaaacagtgaataccaggacaaaataatttactgatacaacaaaaattactaattacgaaatatatcttaaacaagatcagatcaaatagagcacccatagcataggaaaattataccgtgtcaagtagtgcccccagacggtctccaaaactcagctgcactatggttgcatcacggtctgagtcttgatctatcagaacaactggctgtggaattgcatcatcagatgtctgcaatatttttggggggagaaaaggtacatggtagaaaaatatcattagctaaatatgttctaaaatattttaatggtagtaagcaattaaaaatagcatacacgaagcaaaaaaaaagtaatgtcaaaacaaaaaaaataataatcggactaaatggaaacaatataagttctcatgcagatattgaaatgtgaagcaactcttcccgcggaccatgtctacaactgaactgacttcacacatgtcctcagatgaataattgcactgtggacctaatttgcaggctgggttgttactccagatctccactgtttaggaagacaactctatccttcatcacttgatttttttttaagtggaacaacaaagctgaaggacgtgtcgctgtgaaatgtgtgtttccatatggtgacatgaatggaaaatcaatatgtacataccgttgaagaagcacccaagacatcagccgagttgatagattggcaaaaaatcctacagtgatggcattgagaaaaatgatttagaggagggaatgagcttagttcaggacactgatgtactacaaataaccgcagaattaaatagcaacactagaaatagaatcacgttatgcatttcaaagttagcactcagccactcagtagccattggactgacatacatgaacaaaagtaacaaagggaaaataaggattgcacagttgactgcaactaagtactgattctgtccctttactgatgcaccagcattcaacagaaaatccttagatggctcctaattataaagcacacagatttctttaaaacgatcatatagtgtttacagacggacacgttgaatagaaaatatagttttagaaagctttatgccacaattccagtgctaaagcccacagaatccaacacatgtaacaataggccttcacgagttagtaaatgaaaagcccatcgtgtagcaaatcggtcttctcatgttgtttattcatttatgacttgtgagaaatgagaatcaaagtgtaggtagagttgtaacttgtgtcaatatggccttgaaacaaatccgcacaccgtggcacgagctctctatgtaaagtttctttcgagtgaactaaggatttgaagcatgaaagtaatttttttttcttgttcattccattcattttccaactcctattagtactccaatcaactgatagagaccttctccaacattcatgttcacctaaacatgaacctcactaccttagtgaaactgagactaacatggatatttccacaccgggtgaaactgcacctaagtaacgcaagatatacaagtgagataataataaaacgattgcatctcaagatactagaatttaggataatcgttcttgccagctgacaattacaacgttttaggcaaaaaaaaaacgtaaatagtgtaatccgtgtacaaacaaccgcaggacaatatctgtactaggtaaggaatctatcaagatactattagtacaaccgcgatttctccaagccaatccaaaacaatatcaactaattcagtctaccgacacgacactccaatagtccaatcctaccgcacatctcccgacacggcgaaccacccctccctcgtcatcgattcgaatcaaacagccagacgcaacgcggagatgcctagatcgctcacctcggggccgcggtggcggccaggccgacggatcgggggaagtcgtggaggcggaggaaccccggcgacacgcgagccgagtagtacggcgacacggcggcgggcgcgacgaggtggtgggcggcggcggcggcggcgagagccatggctggttggtggtgacactcgctgcgcgcactgcggcgaggcgaggtgaggtgaggcggtttctctctgtgtgtgtcttttctgtcgcttgctctggtcggggcggttgggcgaggaagtggatcttttttgcttatttttatttttttaatctgccacttggctgcattattggattggatgtgccctttttcttttcttttttcatttttttcccctgctgttgtgttgttcgtcagctaggattttttggacagtggttgttgcagttgtcaaaattttcattgaaatagttttattttaattattggttgccttgtctggcatgagagtatgaagtgtctcttttttttctctctctttctaggtgacgccagatgagggtgatgattcattcactcattcgttgattcccaagagttgcaaacgaaattggcatgcttactgccagtaataaagttgaagacgtgtcgatgaaacggaagtggctcgttctctgtttgtttaggaagatgggccgggctgaatcacacgttagttggaggcccgtcggggcatgtagtccatgtactccctcctactcagaactactcagaataagtttatttgctccttccgtttatctcaaaataagtttacttttaaaaaagtattacatcctagcttataaaagaaaagaataaatgcatttcttatgtatttactgaagtttggtaaaaaaactaaatgtatgtaaatatttggtaactttataaaaaaaagtatggtttaaaatgacatcaatccgaacagcccatgaattttaaggaactgtctatgtaacatccagctgaaatttttttgtcttttcagctggatttctagccgtcggatagacctcttgccagcatcccaacctcgccttgcgctccctgcctgcgcggccgcgcctcgagcgcttctcatttttatgtcttgttggattgggtacgggcttcaagcacgtctgtgttttgtctattataaaaggtccaacaaacaaacgggcttgaaaaacactggcccaatcactgtccacgtaacagaacatatcaggctttgcaacgaaagctctgtttaatagctaacattctctgaacatacgtcgggctatgaaaaacatgtaatctactgtgttcaaattttggttctctgaaccaaaacccttgaaaagaaagcaaagcactagagccacctaattactagtgcctaactagattgaccattatctccactggaagatcagccagaaaacatcacaagattgactttatctgttagcttcctagtcatccatagcgcaatattagaccctgcaaaaatttgtacattttacttagttacttcgtaccaagatgcagatatttctattccaatctgtgacagaaggaaaatcttgtacatcttcatgttgaattttgtagtcccaaaattcagaatgagtattagcttagaaaattatggatagaattttaccccaaaatcaaaatgagtactcattttaccccaacatgagtactagattgaatcattcctgcactttaagaaattcaacagtaattataccccaaaaaaaaagcatttgtggcatatactagcaccataaaaggagaacattaattaaggatggagaagtggatagcaggatgtcatcgaacagatgtaaactgtggaaaagaagttctcataacaaatactcatttctcaatatcaaaaccacactgtccaaacagcacagatcaggtaactaaagatgcaaaccgtggggtttaccgtggctgcctcactgataaccgttttgggatgccatgaccgacacactaacaaccgctggagaggtataggccatttcacccagcgccaataggatacacaatacaatggatgccttgctgacctccgaggaagacgttgtagccatctcgccaaccttgtctcgcgaacaaaaacacggcgcatatccttggccacgggctccgtcgtgacccggcggaacggacgccgacatcatcgcggatgctgctgccgcttcgccgcctcctcccccatcgacgacttctctctctcgctgacaacttgtcgggttgctctctctttcatcccgtgcgtggaggagagaccggcgaggtgggcgcgtgtgtggctgaagagaggacacgacgacgcaacggggtcgcatctccctgatttgggctggccttgtgcacgaatcttgaacaaaaaatcaatggccacaaattcagctgacaaagacaaataaatcagcaggcagccagttatcaattcccttctgggagtactaaaaaaattagtgacaaataaaaaaatatatacggtgaatggccaagatgcctttcttcctcctccatcgattcctcccttggcaaatgaatggcacaccactcttcacgcacctctgctcccctctgttggtttccatcagaaagaaggaaacaagtttctctgcgtctccgatctgcagtgcgagccacgaaggttggcgtcgtctcctcctccctctcctcctcgcgcgcggctgccgtcgagaagacgctcggcctcccttgtgcggcctcacctcctcgcgctgaatcccctactccccgtgttaggtccgctcctgcttgcctgatgctgcccgttgctggttcttgatccgtcatgtttgttacatgttccagttttatggatgggtttttttggttggctgattcgttgttggtgccttcaattaatcagtactactacattgtcatgccctggtagtgatgcgaaatggcattttttttctgttttcaattttgcgtaataacatgattgatgctagctagaacattttatctaggggtgaaaacggagcggatattacccgatccactctgtatccgtccgaaataaagatatgataagggtttttagatatccggcggatgcggattttaacatgtggatgcggagccgtatgtgatatcaacaatatccgacagatgtggattatccaatattttaatcggattatttggcggataatccgcatttctcatgccatagcccattttatatgggcagcccatgtagcccatctaccgttaacctaatccaatccccaacatgcctgacggcgcgtcgtcttcctaggtgcgccaccacttctcctcctagcgcgccgctgcagcctgctgcttctagcgccgccgccgcatccaaccaaaagcagcctttctactatttctagcaccgcctctgcccttgccgacgccgtcgcctgccgtcccccattccccgcgtcagcgcctcctccagtggagtccccgtccaccgttggcccgtcgcggagtcgccagcgcccagcgcctccaccgtcaggtactattgttttcttgtgatgatgaataatgactgaatgagaagtgaagtctggatccttgcatgttggcgtgtgcagtgtgttgtatggaactagttcatattagttcgtatttgcaacttactaaattgcaagagtaatggtagtactgtatggaacggaactttgttaatgtactgaagacttatatttttaagcaacgccgcaatgaactgaagacttgtattatgtatttgctggatgtattttggattattcaagctcttaagcacttgacaatctgctgtatgtgttatatatcaattatgcaagctgcactttactagttaagcaaaattatattattgatgtgttttgcctggtttttcctagagagctgagatcataaatcatgttcagatgttttgtcatcgtattgctgccctcttgttgtatggattgaatacaaacttaatatccgacaattttattccattttcgaaccgagtccgcaccaactccgtaccgaatccgacgtccgaaataatctgcatccgcacgtcatccgcacccgcttcgcatccactttaaaaatatggattaggatatggtatagaaactatccgtccgaatccgctccgtttccacccctaattttatatgttcttgtctttttaagcattggcacttgcctcattgcctgcattggtcaagcttacaccacttatgtaactgttaattgatgctcgctgctaaattggttgtgaattttgctttataatccatatcaactgttacgaattttcctaaactatccatgtctgaattagatgtaattcaggagtccgtacatgccaaaagtaccttttgtttttcgcccttatgttgcaagaatctgctgatgcaaatcttgatacagatttgaccttcataatccaaaagaagaggttttagttcaagcgaacgataatggggatatccaaggtgattggcatcgctggaacaactcttctagtcacgtctgttggtctgtggaagatcggcttaagaattgtcgcggttccttttctagcaaccagtactattgcctatatcatcgctgttgcatcccacaattccatcaacataccttggatcttgggaaagaattcaaaggggaggtttccaatttggtcaagtgtactttttggtcctttcttgatacttgcccgggtatatgcaactgtgaagagacatatgaggaagaaggaggctgtgtataacatgatcactgaaggtgtttatctgggaggatggccgtttatgttgaagcatttgcccccaggagacccgtctgttattgattgcacttgcgagttgccaagaagtgattttgtcccaacaaatgagtatctttgtgttcctacttgggatacaagagccccgacgatatcccaaattgaatttgcggcatgctgggcatgtgaaaagagagccaaaggaaaaccagtttatgtacattgtgcatttggttagtaacgacctatctctcttcatatattccaccttttttaaacgttgacacaaggactgtagttctataatctagttttgtacataattgcagctgctaattacttttgaatattgtgtgtgcacgcttatgttttgtgcatgactgcatcaggtcatggaagaagcgcttgtgtcgtgtgtgcagttctagtagcattgggcattgctgaaaactggaaggatgcagaaaacatcatccgagaaaaaagaaagataaaaatgaatgctgttcaccggaaaaccttagacgattggtcaaaatatagagcttctcagaagaaggataaataactgtgagtcgattgttctcagatgtacttctgtcatgttgaaagaatgctcaaaacacattaagagttgtattgtttaacatcttaacattcttaattagtaaaattgctgttttgacaatcaaacgcttatggcaatcgtttgttgaacatgaaatccaaccatcattaacttctttgatatgcttgctagtcatatgccttaaagccttttatgctaccaacttctgtaaaggtgtggtcttagacaactgctattagaaatttagaattttagcatgcttttaaaggttgctacttcatccccctctcctactagttcaactgttgcaacatactgattgcagcagaataaccaaaagtacttcagacccaacaacaatgtgtgcaatgtcagactttagatgagttgctagatctggaaaagacttcatttctaggtagtttggacctctctttttctgggcgtcagattcacttctattctattagatagcttttaaattcaatccaagatgttctggcactggaagtgtagattctgttccaacttttagctactcattaactttagaactgtaaaatcaacccttttatcaatcgaaggcactcttttcgaaatgaagggcttcacgggaaacataatttgccactaaatcacataaataagtagtatttcagcaacaaaatctagctaacccctttttgttgtcactgggcaggacattaaatcatttgacatctcaggcaaattaccatgtgagttctatgcaatctgggttctgagaaatcttcctagttctggagcttgcattgtttcccagctcatatcagtgtttcccacacgtgtcagattacttccaaaatttgttcccagttttgcttacttctgctcctatctgaaggttagtcttcaaagtccttgtaaatcagaaagctgaaaattggctttcagatggttgtgctgctatgcttagctctccacagttgccttcatctgccaccaatatcctacaggcaaataaggctccagctataaatatatgatggatgcgtccagataaatagcactacagctgctgtcctattattcttttagacttttatagaatttagttagttggctgaaagcctgaaatagttgaaacatgcatagaaagggacaaaatccatatctagcccttattttgtacaccttcacatcattgtattttatcataatcttttttaggataagggactaccactagtttattggtgtaatgaccttcaaaattatgataaaataaagtgcatgcagtatgcatgatgtgcaaaaaaaagtttgctagcttttgactacctccagtaggaggctggtccattccatgctgatttaatagggtgcattccttatatttttttgtctagtaaataatggttcagttatatgtacttcgaactttccaatcagagattaaaccttcaacaactacaggtaggaggcttatcataaaataaagaaaggaaaagaattaattgcaggtaggactagagcatggtgcttactctcggggacgagaagcccagagggagctgagggcacggaggcgattatggtactcgccaattgccaagaaacatcgagctgcctgcctaattgtcagaattctgtgcatctgatgaagagtctgttgcctcaagttatcagcctggaaatccaatttgacagttgcagttttagtacatgatgaaaggatctcactcttggcactagaaaattgaaaactagagcagatactggtagtaagtttgttttactatgccatactatagttaatcagataagctccaaagtccaaaataaggataatgtcacatgtttaggtgaccattcttttctttgtatgatgtagagataacatctctacatgttgatgccatagcatattactgtaggaaaatttgttccttttcactctttattaattaacatgttggcatgtcgcattattaaaaggataaaaatgactgtttttttgctcgactgtcaagtgattggattgctcatctagacatccacaaagttgagtcaaacagggagagaaggatcagaactggaaaaagggcaggcaacaaggacttcacctgtatgacaaagccttcaaggttggacagcttgcccagggcaagggccatgtaacccatgaagctcccaaggctggcttcgttgaccacggagccgccattggcgacggtctcagctagtgactgatgcagctgctccaggccctgggagagagcttcctctgcctgctgcgatgattgctgaaggctgcagatgccaaccacttgctgttcagtcagagggtctagctggggtgccactgtctgcatcaacatcaagagtttgtaatgaaattagaaaaaccatacttgtacttagaagatgaggtcagatttagcatggttaaaacttgatttggcaaattgttttgcacattgtgaactgtgaagtgagcttcatgtttgatgtcagattgtcaggtgcattttcttatgaaaactagcctagctttaacttatcatgttcagatgtgaggttatgactacataccatgagcatgtttaagcatgatatagtaaaag

SEQ ID NO: 59653 - DNA, 3263 bp, Oryza sativa
attttgtgacgaaaaaacttagctctttttatgatgaaagctttcttttattgtattgtttagaccacttattttaagctattcgttcaatttatttatcaaaatatttaatttatcctataattaaggagataatctgcagcagtaatcggctaaataatctgtttcaataattaaatagcttcgtgtccagaaaggggtttagaaatgaggaggatcatgtctaacttacttaaacttctaattactgacatgtgagcccgttgagtagaagatccacatgtcagtgactcatgtcagacaaaagtaagttagaggataggatctcgagtatgtatataccttgagcagatcggacggttggaaaccgcccatccagaggaagcagcgctcggcgggggtggcccacgtgccagtgatgaggtggaacacgtcggccttggcggcggctgccctcaggcggaagagctcgtcgtagtgggccagggcgtcgtcgacgatcgccctcaggtcgccgtccggcaggtgcgcgtgtagcccgccgtgcagctccgccatccgccgcccgccgtcctccagccaccgcccgtactcggcgtcgaacatcgccgctcctgccacgaccaaatggacagtaaagtaaaacatatatactgaattattactgatctgatgcaaatcctatatgacaatcaaactgaatttcacatttcagatcagtagataaaagctactaaacatgagagattgatcaagtgaaggcaatgcattacctgcgctggtgtttccacctggtgatcctcccagcaagaggccctgaaccaagaaattcagattttactgcattcatgatcctacctataatgtttagtaattagttcagaatgcagaaaaaaattactacctgggaacgagctctctcgagatcctgctccatctgagccagcctcaacttgctgctctcaagctgctggatgtaagcctgcaaattggtatttttgacagattatgctgtcagaaacttattgggaagaagaaattcagttctgaacaactcattttctttctatgcaggtactgaaattctcatggatctagctaggctcaccttctttcgcagccggctcttgcgtgctgcctctcggttctgggctaaccttctcattatctgattacaccaacactagagagtaagtaattgtctcaaactcatgtttcaaacagtctttaattagcttgcactgaatggttctgtacatacatataattgcatgagcacgcataatcatcatcatcatgctatctaattaagcatcaactgggagtatgagagagctaggagagtaggattaacctttggatcaagtgtctttgtcatcctgtggtcactgtgagtggaacttgctgccatcttctgcatgccatgtggacatgaacaagttattgttaattacaagatgcactttaattactacagttttgtgcagttagaaactatacaagataaatagaaaaatagtgatgatatacatgcttatgtgcctatggtgcaaataaaatatactagtatgatctttggatgcacgttacatcaaccagatataaaaaaacagcaatgtatatgggtggaagccacccactctaacaacagacaaaaatattgttctgcttttttgtttatgttgctgtcacgccctaatatgcaaagttctctttcagttaagcgtgagttagatataaacattgggtaataattgttcatccaatgtgatcttggcagttcatcaattggccagaaggaacctaaagcacccctgatggccaaattgccattgttcaggtatcagttggtgcaatttttttgggaccatactttgtgcaagctagagacaattaacatactataagaatgcatacttgtcgcctaatacagcacataagctagcatgcacaagtctaacatatcctttcctagacttatctgctcctcttcttttttccaaagaatgaaaaagatagaaatttgtagtggcaagtaaggctaaatgtcaaagaaaatgcatgggtaattactaaagtgatcatattctgcatctgattcttcagaaaaacgctggtcccttggatgaagcatcaggggaacaagttggaactttctaatgtagagccaaataatacacctaacttgttgggattggtgatcttgggagcagcaagatcttaaatgaccctgaactcttctagtactactccatgagcatcttgagttgtgggctagctactgacatgacaccagactagggaacaacgcattgcatctgcaccactgcatggctttattttcttctcgcgatgtaggtatatgcatgatcaggaatcaggagatccatgcagaagcaaagacaagatgaacacctccaagaacaagcgtttacaacaccaaaacgcatcaagaaactcaagaccaagaattacaccaaaacgcacatcaagaaactccagtgattgatgagaatgcaaaccttgtgctgcttctgctgctgctgtgggatctgatcaaactggctcgccatgtcggctgctgctgcaccctgatcgccgttgttcttgctgctgctctcggagtccgttgtgtctgccgttacatttgaacatccatcctacagaacacagctgtaactttgcctttgctttgcaaaaatgaaaaatgcagtagggatcatgctcaagtatttaccttcggtgttggaagagagctcctcctcataggccaggatgggaagatgtccagtgtagcaggaggcctagctgttgctgttgctgtagctgcagcagcagcagtggagaaggctgcaagaagatatcataggggaggaggagatcaagaaatgcatccaatcctgcaactgcaacatcagaaagctactaccagctgaagcactgcactgggatcacaaggggcaagtggggcccatgtggcagtgaaaggtggactggaatttattccctttgaggagctaggagtactgcacagactgtgtgctttgctttgctgccatggcagggagctagccagagctggtactatagtactttggagaattgttgcactctagagagagagagagagagagatggtgatgatgatgaggagagtcacaaggcagtcacaccactacacacaaggtgacaagaagcacaactgccactcctgctatctgtagctcttgctttgcattgcatgtggtttggctagctacaaa

SEQ ID NO: 59654 - DNA, 10380 bp, Oryza sativa
tgcaaattaagaagggaaattaaaacatgtaacatgagatcaacaacttgttgggaataaatttgttgaccagaatgatctgaagaaatattcatgaagaacagtaatgagaaagcaatatgaaaagaacaagctgagaagagtgctgattcagcaaccgatgcatatagcactcttcccctgaacgtgaaagagaagctcatggttcagaacttcagatcatgtttatgttgcacagtttgcacttcgcaatcaccagagagagagagagagagagagagagagagagagagatattgggagagaaggagacagaaagatgaaaacgagatgttgggagagaaggagagagaggatgatgatgaactgatcttacaagaggtttgcagaagccatggagttgggcaaggtggtgccatggaagccatagccaagaacatgatgaggattctgccctctcctagcctctcccatcctacgagccacaaaaccacagctcgatctcccagtatctccaagaatcagaacgaagcgctagctcaaatttcttcgatctacctccacaaagaacaacaaaaaagaacatcatgatcgctgctactgtacatgctagtatgctacacgccagatgatgtgaagaattcaagatgagagagtcaaagaaagaaacataccaagattgtggtctcttgtgataagcaagagccaagagctactatagcagaaaagtgaccggagtagctttagctagcaagaagtgcaagaagcaaagcttgaccggttcttggctctcagctggagtagctagctgttcttggctcttgctattgctgctcactcctatagctttagctctctcttgaatcttgatatggagtatctgaaagtgtagcagcttcaccttccggtctggggcatgctaatcacacagttgatggaaagatcttgtccttcctttctcctatgctggtttttttcttctttgaagagaggaaaggagagagaggtataggtcttgtctctacttgaaggtgttttgtcatggagtctgccacaggaatccctggctctacactcttatcatcttggaactgacttctctttctctctgtgtgactggtcccagatgcactgcagatgcaagtctaatttcttctggttcatgcatgtgtaaaccttattttgccccagataatgaatgggatgttgaatttgggttcaagttgtattgatcagtaccactattttttttcaattgttaatggctgttgacaaaacttgcaagttactatgcactggtgtaggaagtacatgatcctgtttgcaaagaaaaaatgattgagattaaccatgttgctactggattgttcaatattacaagctatgtatgttattcagacttcaacggtgcatgcatttcatctgattattccatactctcttcgattcaagattgactaatttacaccgacatatagtttattatatgcaaaaccatagctttcggatagcatttagaaatgttaaccattctgaccacacaataatcctacgttgataaacgcttctctcaccagtctcatgatttgtatgtacgatcttatctagttatagctctctagcaacttgattgcaactttgaataatctatttctcatttcaaatcgaagataaaataattgaactatcgaatcattaacatcaatagtaccgtacaagataaaactgaaaagaggaatagaaaaccaaacctttaaagaaatctttaggttctaaaaaaaataagtatagaactctctatattctccattattaatatatatcctgcatttaatttgcttggcaatattctcctctgttaatgcgtcaacatccgtgccttgtcaaaatatcacctagctaaacccatacctgaccaatcatatccatttcacaatacgaagatcggctaacttaatcaatttggaagttgattgtcacgtctaatatatcaatgacgctagtttaattgatttcctaatacgctcacctatatatatactttttaagtttttgttacgatatgtataattaagagcaactccaatagaatggccaagtaactacccaagctaaattttagcaaatatagggggaaaataccattcaacagtctctccatccggatggccaaatcgcacccctcattgaccaaacttggagagtctctctgcctggctattcgtgggctccacactcccctcccaccccatctctctctctgccctggctagagcaagaaggcggcaacgatgccgcttgtgaacggcgatggctaggaaccgcacaacggcgacggcacggaggagagatgcgccggagccagctgcgaccgccgccgtcgtccgcgtcgtcccatgcagcgactgtcgccgtcgtccacgccgtccctagtcgcgaccgccaccgccgtccgcgccatccctagccgcgaccgccgcccccgcgtggatttgaccgggcggcgtggattcgggggctgttgccatggtcgtcgtcgtcacgagccgccgccgctgccaccctttgctcaatcgccgttgcctcggggagtgctaagagaagaggaagagggagaaaaagaggaataaggggagaaagatgagaaagaatgggtatagagaggatggatggagaggctgttggagtaaagaacgaatttgacttgacaaataaaatggagagttgaccaaatagacatttagagagtcgaatttagagaaactattggagatgctctaagctagctttattaatagtacgtttcaataatgattacctctttaattggaccgaggctcctgtgattgatgtaccagctgtgactaccacagctgcatgcttatgcgtgtaagtgatgcactccctccgttccataatataaaggattttggtgggatgagacatatcctattactaatttgggcagagatacaacgaatatgattatagagtgtatttattgcactaggatgtgatgtattctagtaagcgaggttagtttttttgatggaggaattagctatcatgctgcctatgaattttaaattttgattttgagaataattttaggcaacgacagcggcagaggaaaacctaaaacttaaaatcaaatcctataatcgacgcagtgctaagtactccgtacacccttattcaaggttgactgcctactgttatttgactatttgttattaattgttactacaaattttgggtgaaaatatacaagaaagtagatatattttgttttcttgacaatgcatatgtatatattcaaattatacatcaccaactttatcacaatttattatcattactattgcatatttactacaattcacacatatatctagatctatcgtaatactctaccaattattttcatcatatcaaatttcatctaaaattacttctatatattttcgtagcaacacgcgtggtatcttcttgtatttttaatggtgagtaggagctagttgggatgagtgcaatgtccctttcattttgcacttggaggaaaaaatcaattaagtaaattaactacttcatgctccgcctagccgccaatcaaacagatttatttctcctcttcacccactatatttttcctaacaatgattggcacaataaaatgcgccaaaaacacatgacaagatcgagaacctactaatagctaggagtaagataactgaataattcattcttatttttcttttttgatctgctaattgacacacatcttatagctagtcatcaagtggcaacttcgggggcatgcctaataagacaaaaatagaaatagtagttgaactcctatataaactttggtttttatttatgagaaaattgattttggtggttagtgtctagctagcttctatggattgtataattagctgtggtcttatattagactagtggtttaattaattatggcacatgcatttggggctgaaaatttattgaacaggtagagtgcacgcatcatgcatgcatgcgcgtgacaaaatgattatgtcattcattctgctagctaagctagctggaaacctcaaacacatactcggtcagtcccaaatctcaatatacttattgttgtaggttatttaaatatagattaagatttgtttgaaaaagactataccgtttattattaaatgatgtatatatggtcgaaagtgagagggttgttaggggtagaatggcaggaggtgattgatttagtaaattatattttagagtaacaactattttaagataaattttaaatcttgaaagtgcatctaggcaactaattatgttggtgattaataacaatgtgattagagatgactaacaacttatttgagtatgagtgaatgaatgttagcatcggtgaaaaacgatgttaaaggcaaaacctctaggcctcaatgaccttgcaaatctcgaaatacaactattatgtcgcggagatagtattctactaatataagattatatatatgaaatttttttcaagaaatacattgacaaacattcaatttcaagaaatatcatcgataagtacgacttttataaaatgccactgtacaagcgactttgtctcggaaataccatcatcgttagggtttcgttagtagtcctccgttaagtattataggataaacggtgcatttaacaatggggatggacggaaccttaacagcaatgatatttatagaacaaaatcgcttgcactcgtcgatgatggctttgattgtttgttaatggtatttctggatgttctctatatgtatgggctcattgataacggcactatatgagtgacaatgagaaacagcgtgagcgaatctgtatgagatgacgtacgcgatattcatatacaggcattgatacaaacttctacacagtagctagtgttgctgaatatagcttggtcgtgtactccctccgtcccaaattaagtacaataaattttggttagatggaacataactataaatctaaacatattttttcagactcatattactagaatgtgtccaatcaaaatcttatatattttagtacgaagggagtagaccgtatgttgcgtccactgtatgttacatgtcgcccactgaattaaatatgaaactctgaaatattcaaagacgtcatcgggaagtgtgttgtaagtcagaaattattttgagctggggaatattagtttaatttcatttgcctctgatataatttgtaaggtgttttcaattttgttcaacgttatacttctctactttcatattagtgggccgggtgctttagcttaaactgtcacggagatataaaagcctatcttaatttttttttgacgagaaaaaacagcaagagaggctactactgtgattttaataagagaaagggaataattacagagagtatgtacatgagggggaaggaaagaacaacaaaactaaactaatcaagctaaacaagaaactgaatccatgattcccacgaaggtttatcatcctgttttactctatgcaaatgtagagtaaagtcctccttgaaatctgatttccacttgctgaaattgattgaaagattgttgaagataaagtcatttctcctgctctagatattccagcaacaaatagcaatgacctccatgaagaaaggataaggaaagttgttctttgcttctgagatcgtgttcataacatccagatgaaaatttcagttaatgcctaaactagaccagcattgctgagcaaaagggcaggagaaaaaaagatggtgggagtcctctatgaccactgatttcaggtaacacatttgatgcctccttgggtgttgaaatgttttctttgcaagagttccttggtgttcaatctgtccattagaagcaaccaaaggaagactttcagtttcagagtgcatttgcatttccaaatccaaataagaggagccggtgggtgaatgtgagcaaagaacaaatcatagacttttttggaatgatattgatgagaattccactgataagtccagcagtccaagtcattaaagttatccagattttgaaccagatcgtttaagatttgccattgttgaattgcttgtaccaacatgggtgtatgaaaagactgctcaatactattcagatcgaggaaacctttaagtgagatatcttccaattttgcgaatgagaataggatgcttaactcctcttgcaaaatgcttctagtccaattatctttccaaaacaaagctgtttcaccagaaccaacagttacctttgagattgctctgaaaattgggattaatctgaaaatgtccttccaccaaaaagaacccttttctgtgtgtgcatgagggggtaaatttgaatgagagtagtatttgttccaaatgagatttacccaagggagatctttcttattgaaaaatttgtccagatgttttgtgagtagggcaacattttgaagaggaggggaaatgagaaaactaaaaatatatgtaaaacaagataagttattagtgcatgattaattaaatattaattattttaaatttaaaaataattaatatattttttaaataaattttgttttttttaaaatatacacgatttaaccgtttaggaagtgtacacctgaaaaacatcatatatccctattgacactcccacctctcactcgtgacgactctatccaatccttctccgtctcgtcatggccacggtagcgccactcacatcagagccccaagatctcgaccctcatatatgggcccttatatatttaacctattagctagaaacaaaagtttaattaattaaatcccttaaaatatatgttggatctaatatgtatcccttaacagcaaagctatgtataatgactccatcaatcatcaataccggtttagtttgcgggccttctcaaatggtttggatgacagttttgctctgcgtggcgcacgttgatctaatctctatcctacgtctatattatattataaaataaaatagtaggacccatgtctcatcctcgcctcgttctctagctccttacacactttgagaaagcagggtatactggaagcagagagggcaggagggcgacagtagcagcaagccgaatcctggaagagcggcggcggctcctcccctcttctctcctaccgttcggttggggcacgggtgcgctcttctctcccttcctcctctctctctctctctctcttttttctttgagagcacttcagaattttctcaattcgctcctttgttatgtaacgaattttctcaagttcccttggatcagttacaaggacttgaacacccaattgcacttttgtcttctgaaggttgaaaccaagacatgcaattcctcctccctctcttggcttgattgtatacgtgcgttgagctttgctgtgactttgtgatgtcaagtttccaaacgctcattgtaccattgcaattattcaaatgaagaccggttgaagatagggatgaaaatggttggaaaatccctataccattttctttttcatatatatatttctcgtaaacgaaatcagaatggtagatctggaaatggtaacgatatcggtaatattggtatatcagaaacaggactgtcggaacgaaatataccgatattggttggaagtcgaaattcatgtcagaatcagcagagtgtggcatagcacacatttaactatacatgtaaatgacattttaactttattcttttatcatcacacaccacataacaccgttatatgatgattaataatatgataataagtttgatgaacagtataaacaaagtttaacaatacttaacatcgataagttgagaagactaaagttcagcaaaatccacatgccacatcatagggttaattaacaacatttttctctggtcactttcccttttttatgggccgcaagcctactagacttccttcattcatggacttctgatgggttaggcaggctaagccgctagagaacttccagaattttttcggaattttgacgaaaattatcatacaaatacggttaccgacaaaacggtcggaaaaacctccatctcatttccgctaccatttccagaagatattaccgtttccatttccaccactgttggttaccgataccgactgaaaacggtcggtgtaaactagaaacggcagccggaaatttccataccgttttcagggttggatgaagatcgatgatgacggtgctacccgagctcaagcttgtagggggctcgccagcatccctgttgttaccttctttcgcaggcgagtgtccaagcacgatctcgcgcgggacagccgttttaacggttttgcaattgagagttacgaatgagatttgacctgtatttgagataataaatcggacattttcttatctggcctaattagctgaccctttgtttggaccagagtcattcttaaaagtacacaccttggcctttctctttcgcaaacattcttgaacagttgcgtacgagttgggcttttctttatatagcttaacgtttccggcccatgtatttccttctctcctcctaatcgtttcggacgatgcaagaggtggccacgatggtgtgctcagctgccgtacgtcgtcgtgccaagacgagtcgccggcggcgagctgggcctgctgctgaagctgacgccaaattaattaagctcccaaacggccgcgccggaggactatactcacaccgttaataaatatttgacgccgcttattttttaaaatatatttgatcgttccttttatttgatttattgttaaatataattatatgtatacatatagttttacatatttcacaaaagtttttaaataagatgaacggttaaacatgtgctaaaaaggttaaatatttagaaataaagggagtatatttttcaaaaaaaaaaaaagcttcgtggccggagctctgccggccggatttaaaagagggaaagccggaggattatatatggatcgcattcaggtctataccttcctgctttcttcctccgcgtggcgtcgatttccgccgtgcagatacgaggacgccggcgccgagtacgagttaaggcctgaagcggatggacgagaaagcctataggcctttgcagcccatatatacattcctgcagtaaaaaacaaatctatctctgtaaacatcttgttttgtcgtcagagttgcaacgaacagaattgacaacgggacacacgtacagaaaacgaagcaacactgagtgtgccaattctttaaatattatagcatgactacaagaatccaggatttttcttttgacagacacaaaccactaaggatagcatcaaaaccgttaaggtaacatgttttgccggccaaccgccaagtttatagaccaaggaaaattccattttattggcggctaactgttatggaaagagttttttttttgtctccccaacaagaaaattacgatcatttccaactttcgaaagcgccaagaaataaaaacttgtcagttcggattgacaataatatactttactttagatgttatcgaaccgccaaggaaattatcaagaaaataccttattcatggccgctacaaccaccaaaggaagtatcaaggaaataccttattcatgaccgctacagccgccaaggatataacttggcggttctacgtaaccctcaataaaatagttgtatccttatcaactagttatgatcatcaagataacgaataatattggcggctttgttttggctgccaaaaaatcttggattgttgtatgcgcaggagaaaatcgatcagaacatatataagagggaaactttatatggtgaaatagctaagctataagctcaagaagagatgttttcctccgccaaagtctaaggttttggcctcttccttgatctttgctattagcttgattatcgagagtttcttatgttggaacattcattgatttctctcctatattttccatgtcgtaagtaggatgagagtgcacacccccctttttctgataggcttcgacctgtgagcagtgccacccaccattcatatactatcgaggttgtgctccatatttatgggctgagttgctcctgggatgtccaggtggaaatcatgtccatattctcctcatatatctgcactctggacacaagtaggtggaaggatgcttctaaggtgggtcggcaaagcgagtagtacaagtaggtggaaggatgcttctaaggtgggtcggcaacgcgagtagtaggtattgtttggccaacttctcgaactgttaatctctgtcagacgtccgtactaatgttatgtataattagggcatgt

SEQ ID NO: 59655 - DNA, 8000 bp, Oryza sativa
tgggtttggttgctccataatttcactccagatccagttcttgatgttaaatctaagagttggaacctaccaatcaggcccttagccaagcgaagatcatgtatttctttggagtctaaagcttccaaatgaaatatgatagttctgttaatggagccgaagaactgtgctcagcttctcatgaaattgagtcaaacagtagatacaatgaagagtttttagtcataatctctcatgcatgaacgaaggcatgataaaactatcatcttgcttgatttccaggaccatctttaccccttcttacatgcatatgtttaatcaagaagaaaagacaaagagaatccttgcctcaaaattccttatcaatctagctattatatacccctctatctctctctaatatacatatataagctaggactgctcttgttgtccatgaatacatacataaacttattcaagagatccaaaatggtaaattcatgcatgcatcattctttgttctgcatgcagctagaaaacgctgccttcaggtatgctctgcagggtaggctgccacactgatccgcagctctcctgctggtgcagcagctcatctgcttcagcttgtttttgcatgagagacaccatgtcgttcagggagatggcggcggcgtcgttgtgcagcagcatcttcttcagctcctgctttctgaccaccagcttcaccctcacgacggcgccgccgggtgggtcgtcagccatgtcggccgtcgccggccggagtgcctcgtcgtcgtcgtcggaggagacgccgttgaggggtggcggcggcggcggcagcttcaggatctcgccgtcgacgtccatgctcatgatcttgatctccctgttcctatcttgaatcaccatgcaattccccatgatgatacgacgacgaagacgagttttgcaaggagatttgggatgatgaaattacgaggtagctagcacgaccgaatgatcgatcgatcacaattcacaagttagaaatgtgtgtgtggtgtagtatttcttggcgaaagagtagggggttggaggggaggagttatgtgtggtatttaaaggaattgtattaggaggatagccacaaactttggagcatacttcatctctgtgccattggactagccaagtgagctttgcttacttcatgtcatgcctcaccaaaagcaagatatagccactgagaaagtgagaattagtgaaatcgaccagccatttcttttttttttgtctctatcttgttgtcgtccttgactgttgcatgctgatttgcatcagggcggttccgtgaaattcgaggccggttgcgcacgtcaaacatctcggaataaacttgatgtgcattttcagctagattttactattattgtcttttcagtcttattctagtctactataaccttaattttaagtactatgatgttgttgaattttctatatatgtttaacaatttgtcttactaaaaaatattaaaaaaatataaaagtcatgcttgaagtgtctataataataaaactagccacagtaaaacaaataatatttacatatttgtttgataagagaatgatcaaatatatgtccaaaagacaacgacgttatatgttaaaaatagagggagtatatatttttttataataaacaagataaaaaaggtatagaagttattaaataaccgttgaattaatggagcaaatcgactgtaaactacaccgacacttatatttatgacaacaaatgcttcttcctagtgccaggcatgcatatatatgatctcattcttatccatgcatattacatatatgtaattagatggcaaaatcataattttgtgctgagtagagggttttttttgaagatatataattgaattagcaagcaacatactcaggtaaagggggagagatcacaaaacattagtagtaggatacatgtggagcccaacatttgggcaggcctaatccatatccttgtagtggaggtaagaatcatttgcacctcttgtcaaatctgcaagtgaaaatggatttgtgtactggtcatcatgtggtttaatttgcaagtgaaagtgaaactaatagagaccatgcatccaatgcgtgttactggtcatatatatagacaggccgaaaacgatcgatatgatggatcctcctctccatcaagcactaacaaccaatataaacatttgttgcacgatccgcatcatttcaattcagtaagaacgctatgtaccccggcatctatagttctatttatatatacacgtgatgtgttatatatgcgtgctatttgactacaagaatccagaattttctttgcggtcaaaaacaccaaggcaatatatttttacgactacctgccaaataataaccaccaaatttagagagccaaggaaatccagattaatttcttggttgctaatcgtgagggaaagttctattagcggtctaaccgccaagagaactacggagaatattaaacttttgaaaagccaagaaatgtaaccttaccagtctcgaccgacaagaacacatcttaccttaggtggtgtcgaaccgtcaagaatatatggtcattgagtgaagctggagacgatcgattaatgcatccaaggctatgtatccaactatatatccattatatatatggttattgtaatgggataaggcaagagcaattattgtgttttagaattcacaatgttcgcggttgagttttcttcttctccttttaattgtttgtagctaacacagaccacacattaattcaatactttagtgaattgcacattatatcgcatatgttaggaaacgataagcgaacaaacgataaagaacaatagatcaatcacagaagacacgagatttaacgtgaaaaaccctcccaaaataggagagaaaaaaccacgggcgccagccagcaaaatatcttcactatatctggggtgaggttacatcgccgcatggcggcttacaagagatatatatatatggtggaaccctaaaagggatgatgatccgtacgggagacgggcctccgctccactacggaagctggcctttattaagtgcagatgaatttcgatcacaactcaacagcatcgaccaaatattctccccgaagtttcctcttgcaccacaattaattaactaatggtttcgctttcaatcatttttcattcttttggtttgctttggaccctagctgttgttgttgttgctacttccctagctcgttgtcccctctctcctctgatggtgagttagctccaagatctaatcatcgatcaaggcatcctgcataaggtaatggggacctgaaccctgatccttgatgggtaaaacgtccattaagaacaaaatgagactcactcacggggttcctaatggcaaaatactcccccattagtccaatgcatcctcctttggaggatgccactaccacacgccacctcgttgctcccatcctctacttctactaacatggtgactgcgaaaagggtgcatagggatggatggtgtaggtcaactcacgcccatctctctagcggtgtgctctagcaatattgtagtggttcataggatatgaaagagtcaaagcaacggaaaatacatggggtgcaatgcaagaagatatatgaagaaaggaggcgtgtatgtagtattgtacagaagagagaaggccaccagaggggggggggcagtgccaatgactttccttcattcagaatatatcacatataggagaagagaatgaaaaggctcaaagttaaactaaagggaagaaaagtttgtccaaattggaagaaaaaattaggtcaagtaacctaagataaaacttggtatgcaagaataagtgatgacctatatacatacgtgtaattcacttttaaattttttcaacaaggctgccgatattccttaatagaatacagttttgtatgtgttgcataacagattcattggaccctaggcaaaaggttgaagcacaagaaaacaaaaacttgtccttgttgaatgtcgatatcaattaaagaacacgtcctttcacgcacattctaaaccccactatactttttatgatccttcttcctgtacttttctttgtttatacatttgcttttgtagtgctccccataaaaaacactttaatcaagataaaagctttgttagcattagaaaataaagtgaaatgtggacactaatatggtgatcgagtcaaaattatgtggaagactatttcaatccctttaacgagagtgggttgttaatcacgaagagctctaagtagctaattgaaacatgatatatagacaggaaaatactacgagactgtctgcatggtatagacgtagctagggttttgacttctagattatcctagaattgatatgcaactagaaataacaagctttagaaaaaggaaaaaaaaagagaaaccatcagctttcagaaaacaaaatattatataatagtaatcaatgaaacttaatggaaagacttccctttactcgctcactactatctccgtcttaaaatatagcaatctagtataaaatgagataaattctagtactttaaatctgaacaggcataaacattaatgtaaatgtgagtatacattcatcattgtaagacattcacacataattactctgctatatataaacatctctagctgagccgacacatacgtcttggtatatattcacaaaattattataaacacttctctcgctatcgattggcatgtcatctaatagaaaaaacttaactaaaatagctgtggtatagtaaactaatatatatatgtgcatgtatatagccttagtggctagtgatcgatggtgcagcattagagcaagtataataggaggttgtaagccgactaaatactgaggtggaggagagaagagagaagaaagaggagaagtgggctgtaaacttacagccggcttggacacataagaaccaagaaactctgtgagagagacaagtgatcatgtattaattgtaaagagctactctctccgttccataatataatgcacaactatttttttaggatgttcataaggcatgcatgcatgtatacaatttattaggacttcttctccattaaattattacttttttttaaatcctccaccctcaagatctcaaattctattggatgcatgcattatatttattagggtgattcaaactaggagatgataataattgtttcttggtctttgggttaatggtggttgtgccttatattttggaacggatggagtaactattatatgggtgagctgagagaaggctgcaaataatcttacagctaacaagttagctgtattattagtcttgctcttgaggtagcttagctcactataatatgtgcaataagcactactctgtccgtcccaaaatatagtaaccttgtatactggatgggacacatcatagtacagtaaatctggatagaggtatgtccagattcgttgtattaagatatgtcctatccagtataaggttgctgtattttaggacggagggagtatcttattagctcactcctttgacctatatctagctaagctagctagctatagctactcgcccgttgaacgctttttaaccacgcgtgcatatgcacacgcgctgagatcgcgcgttttgacgattttacacgcggctcgttttggcgacgcgcggcggacggcgagtggccggcaaggctagtggggcggcaccgccgcagagactaagccggcgacgtcgccgtcgacgagacgaccggccgctatagctattagctgccggaagacgactgccgtccgtacgtcgtcgtcgttggtggtggcgtagtacatacgtatatatgcgcatgctagcttgcttcgcttttacttctccggtcgccgcctcgccggccgacgtcgccacgcgtataagaattgagaagttcggataaactgatcatatagtagtatctactcatcagaatattataaggttaattaacaaaagtcgatgcaattataattatgagatattaaaaaagactcgactcattatgagtttctcaatggagagtagaaaaccccctcaagaatttgaactttaggaacagatcgtcttataaaagtccttgtgatctctctcactcatctagctttgttatttggtgtcactaatagtttaattgttgtttgtgtaatcctctccccaattgccgctattctttattcttagttagtttactcgtaatctgagattttcggaatatccgaaaacatttcaaaaatatccaaaaatattaggaaatatctgaaaagttctgtttctgtattttcttcaagaaagttttaaatgcctattcatcccctctagggaacatcaagatatatactatatatagatattattatatcatttttacaaacttatatggttaaacttgaaaataattgacttatattaaaatcaagacatcttgagttctaaaacaaaagaagtactccctccatttcaaaatagttactatttcaggattcaaaatttatcctaaactaatcattattttaaaatactatttttccttgtcaatcaccttccattttacctcaaccatcatctcacttctattcaaataagtgtcgctatagtcttttttttttcttctcaaaccttaatactccggaggcagttgtatgtaagaaaaacgtctcaatctgtgattaattagcagtttcaggggctgaaggggatgtgttggatagacgtggttacctagagatctctgtcgaatctcagaaataaagtgcatcagaaatttttgtgtagtcgctttttatgtcgttttgctcttaacgacactcgtgcacgcatgtagtcccatttttctgatctgtcgtcgtagagtactgttcaccatacgcacggaggaaaaatgaggctcgtcgcgtcgttctgtttggattcttttgagtagccttgatcgagatttttcagtatatgccatccaattcgcaccattttcaggatatgccacttaattcgcatgactttcagaatatgccattggaagcacgaattccttcattccatgccatttttctctattttcccaaatttctcagatttctaatactttccttcatctttctcacctgaccggacggatttacccatgggcccacctgtcaggagagtagagagatagcctcctcctcttagggaacagatcgatctatcgcaacaaaaaaaagggaaacatatcgatccccttcctccttcctcccggccgacagacgcaacgccgctacgagccgccgccccgaccgcgccccgcccccacacctcgctggcagctccgtcccccgctctgcaccgtgcaaccgcgcctcgccggcagcttcacccccgccccgcgccatgccaccacgcccagcaatggaaaccctaaatatctagggtttgaaggaggagatggagaggggggagacagcggctcgagaagagggcgtgccgcaggcgacggcctcattgctacataatgagctttcttcggggtaagatcatgctcccctgctatctattattgcagaatcgaggtgcaagctcaagagcgtgtaggtcagcaacgattaagcgggcaaactaatgatttacttctctcgtttttgttgttactattcgataggattgatcccgatgcggtgtttagggtgtgcgttcagtttggtcaatttacagctaaacttgttgatggaacttgtgttcatgtgccacgaaagtgcttggaatgggttgtggactatcagcaatgcactttggagagcttggagaaggaccttgcagcaagggtaacatggggcaagtgccaacaggttgtgatgagtggatatgacatgaccacgggtgaggaaacaccgtttaaggacaatatggatgtagtgcatgcattgtttgttaggaaaagt

SEQ ID NO: 59656 - DNA, 1458 bp, Oryza sativa
ttcggggtgggatctaaacatagcctaaaaacagaacattcacaacatcaaattacatctgcagagagatcgctcgctacatggattgtcgtgcgaaaagctagaccaaacggagtgtcggtacaccacgacagtgcacgaatggtgggaagcgacaacaaacatggagaatgtgccaaaacgcatgtgctcctaggagatttggaaggaaagaaacgagaaaatctttcaatacaatgagctctcatctatagttttattggcaaaaattaaagagaagtcaaaacataggcgctagtaagagccagtgtctatttgttttgctgtttaaggataacccttttacaactttttcatgtcaacacctgtacagaaatttacttcaattctattcaattgaaattagcaacttgccgattcactaaaaaaaaacatttacaggatataagcaaatatctcaatctagatacaaccatgtagaggcaacagtttatgttgcttacagccacagatcacaggctcaagcaaagaatctcaattaaataaagaagcaaataaagtgaccaaaatgggtccatgcaatgatgggtacagactaccaatggagtaaacaacagccaatattgcatctgctttgcacagccacagggacctggaactctggaagatagctgctgctgctgcttcttctcctccattgccatctatcacctcacctgagctgaaatcaagaactggatctaggagaaggtcatggttccaaggatactcatcgttctcctggttgtgctgcttggattggcattccaggcaattctccggccaccacctcaaaaattgtgtggctcacccggtggacctcctgtgacatctccaagaatcaagctcagagatggaagatatcttgcttacagagaagatggagttcagaaagacaaggccaagttcaagatcatcagtgtccatgcgtttgattccaccaaggacttccccttgcaggtttctaaggtaaatgcaaacatcacgaacagttagatttgagaaaaaaaagtcatctttttttgtccatgttttcttttagatttttcatgcttttctgaattgattgcttagtttgtctgtcgaaattcaggaactggtgcatgaactgggaatctacattgttggtttcgacagagcagggtatggggaaagtgatccgaatcctaagagggatgtgaagagtgaggctttggatattgaggagcttgctgaccagctcgagcttggacacaagttctatgtgttgggagtgtccatgggaggatactcaatttggggatgccttcagtacataccaaacaggtaaagactgaaactgcaataagtaataatgctaaaatggtagtagtgctctcggtcaaaaaccatatgtggcttgacattttctcggttaaacttttgaaactataactatca

SEQ ID NO: 59657 - DNA, 1569 bp, Oryza sativa
actctggattgcacacaacatgccatctttgctctaccagtggatgacccaaaagtggctcccttcttctgcggcagccatgcgccaccctgaaatattcagcaagcatgatttggaggttcttcagaagatgatggcaatgcctctcattgaggtaaaatcagattgtttaacccttatgaaccaccacttatgcgtttttaagaatggttttgaatgaattttgcattattatagtagatttcaaaaaatcgcttgatttacactaatgtggtccagtttgggtacatgaaaaaaaaaatcaagaagagaaaataaactgaaaagtggaacatgttatatgcaaattaacctaaaataatactatcgcaaaccataaataccactatcggtttagatttgtttttttaaagagcaattgtttggaatgttgacatatatatatcactgattgcttcttgatttttcagaataaatctaggcagcaaggcatttatgaatcaacacatcgtgatttgcttgttgcttttggaaagtgggagtttgatccaatgaatattaccaatccatttcctcaaaatgagggttctgtacacatctggcaaggttatgaagacaggttggtgctggttgagctgcaacggtacattgcccagaggcttccttggatccagtatcatgaattccctgaaggaggacacatgttcatgctggtagatggatggactgacaaaatcatcagagcgctcttggttggagaacagctctgaagtctcatcaaatcattctgtgcttgttagcttatcatcgatagccaaaagttaaaatttcaaacttattaattctagagttgattttacattttctatatgatactcgctctgtttcattttcatcttaacttttttcttattcaaacttttttaagtttgatcaaatttataaaaaaaattaacaatatttacaacatcaaattaatttcattaaatgaaacattgaatatattttgataaatatgtttattttgaattaaaattgttgctgcatttttatataaatttggtcaaacttaaaaggtttgagaaaaagagtcaaagcgacttataatatgaaacggagggagtagtgtattttgtagaattggtttttaagtcgtaaataagttttacctataaattatttttactactttatttatttttttttatagatcgtcagccatcgctcaaacgattcgacactcgagggtaaaatttacttaaaaaaatgtacacaaagggtaacattacacgcatttatatagtcaactatattttgcagttttagtaaaacttggagtaatccaaactggagctagtggccaattcagccacggctgaggatactccacatcgatcgcagtgtcattcgtataatcataaactccaacgtcccgacgaagatgtttacggtgaaccaagtacccgtagtcatcgtcgaaatatatgtgatttggcatcaagtgtggataatccttcactggcaagcacatcgagtaactagtgccaataaacaatgcattgctaccta

SEQ ID NO: 59658 - DNA, 16706 bp, Oryza sativa
cttacgtgttcgatggtggcgacgggtgggaggtcgagctgctcgcctgtggccgggttgaggaggtggagctcggagcggtggtcggcggtgacgagccagccgtgggatgacccgacgatgtggcgctccgcgatgggcgggtccgggagggggaccgtgtaggacgtcgtcttgtcggcgaggctgtagagcacggcggcgcgcgggccggcggcggcggtggtgtagaggaggcagggcgtctgcgcgcgggagtagaggccgaggcggcgtatgtcgcgggcggtggcgcgccagagcttgcagacggcggcggagcggaacaggtcggggaactcgagctcgaggaggacgaggccgagcacgtcggccggaagctccgaccagtcggcggccgccggagtgtccatggaaacagatcgattaagcgtcgatgaaggcgtacgtacgtgccgcgtgccgccagatcatccgctaaaataaagcagcgcaactgatcgacgcggatcagatcggagtagaaaccgaacaggtttcagaaatctctatctctatctcttccctatctctactctctatctctatctcctctccactacctaaaaaattagagaaatttccgtgtctgtgtgctaaaaaaaaatgcgaaaaactttttctgtccgattgaaaaagaaagtgcaaaaaaggatttccgttttccgttaaaaaaaggaaagaaagatttctgtaccgaaaaaacaagcgctaaaaaaaggcgaaaaatgtgcgaaaaaaatatttccgtccgatttaaaaaaaatactgtcgtccgtggccaagaaaaagcaagcgcgaattttttctgtccgattaaaaaaaagtgtgaaaaaagggtttccatctcttaaaaaaaggaaaaaaatatttctatccgatatttttagattcttaaaaatagtacgtataaaccgatcctcaagaaaaaggttaatggaaaaaaaaagttctcgtgcaacgtttaaaaaaatgtctgattccataaataccgtcaaagtagatttggaaatttaaaagcgaattcaattttcccctttcgaattactttttttatgcattcaaattatcatatattaaaatccaccttaagatgtcgaagtttatataaaccgcacgagaaaaaaaaagccctataaaaacgctctgaacaaattgttagagtaaaacacctttataaaaaaagataataaaaccatctgacccaatgcgaggaaaaaaccatcttttctgagaaatctgtataattacacgtgaaaaacatcactatttataaaacaacagctttgaaataaccatgtgactcaaagcgagaaaaacaccaccatttattttaaaaaaagctagaaaaacaccaccgtttattaaaaaaaaaaactggttcggcactgtgcaatgcaaaaatgtccgaatttagaaaaaatgcatctgattcgtttcatgattcgtagcatttgtatcgtccatagtctaccatgttctggcatctggaactaagacaagtcttgcttgtgccttttttttttctgagcacaagatcaaattgatggacgtttaggtctgatagaatccatcgattttttccatctccaacacggcttttgtttcctcatctattctcctataaattatcatactactatagctactattctttataacatattatatgaaaataatattaaaaggtaaatatgttataaattgatatttagagaagagtgcacggtggctttttttttagacttgaccatgcgaggcagtgtaggattttgattcatcatattttttattgcaagaataggattgaaagagtattttagattatggccatgtttagttccatgccaaaattgaaagttcaaaaaaattggaacgatatgatggaaaagttgaaaaactgtgtgtaagaaaattcgatgtgacagaaaagttgaaggcttgaataaaaaagttgaaatctaaacaagccctatatgcatgttgtcacatgaataatccaacttttttgggcaaagcaaagcattagtaagattgccatcgtcgaggttgggccatttatggaagatgttctatttttccttatgatatgtcttagctacaacaatcaatacaaacattattattcacatggttatttatgaaaaacatatattatcattggaatttttcacccgttgcaacgcacgggcagttttgccagtactacttaaaaaaaagatatgttttcttcgatcgtcaaaaaaaaatagctagaaaaataaaaaaaaagtccgacccctagatcctattccctctccactcctctcgttttcaatagataccgtgatatcccatatatcttggtgaaaagaattgatgtgccggattgaacatccgtttgcaaaaacgaaatctacaggtcgagagcattccatttttatatgattttaatttttgggtttgtacttttgtatttgattccatataatttttatatttacatttgagtccctataatcttgcaataagatacttgagatcgttttagttaaaaaaataataaaagggtgagaaaagacagaaaggtgcataaaaagaaaaagaaaagccgcataaaaaaaagaaaaacaacaacaacaaacgtagatccgaacggaaaagaaaaatctgattcctataaaaggaaaaaaaagtggtggaaaaaaaagctagatccgattcctttaaaaagggaaaaaaagttttattcctataaaggcgaaaataaataaaaacatctaaaaaattcgtccgattccctaagaaagtggcgaaaaaatgcttcgtaaaaaataaaaagctggttcgtataaaataaaaaatgcacgcgagaaaaaaaaagaaaaaggcgaaacaaagtccgatttctaaccggtatatatctattctctatctctaatctaatctaactatttaaaaatagaaaatgcatgagaaaataaaaatggttcaaaaaacgtgtgagaaaaagtcagaaaaaagcgcaagaaaaaacacgctaataaggttttccatcttcctaaaaaaaattaaaaaatgggtgagaaaacttatttccattgtcggtaaaaatttttttaaaaaaaacatgcgaggaaaaagctgtcagaaaaaccgcgccatttttaaaaaaatggtttgaaaaaaccgtgcaagaaaaaaaaacaccatctattaaaaaacaaatcactctgaaagtactgtccaaaaaacgctaaattgatggacgcttgagtcggataggatccatcgatttttgccatctactacacggcttttatttcgccatatattctcctgtattggaaaaaagtaaaaaagaacattcgaaaaaaagcaaaaaatacgcgcgagaaaataattgtcagaaaaaacaggcaaaaaaacacacgagaaaagaaaagcaaaaaagggagaaaaatatggttttcatcgtcagtgaaaaaagaaaaaaaaacatgctagaaaaaaactgttagaaagaaatgcgccatttctggaaaatgattagagaaaatcgcgcaagaaaaaaaaaccatttataaagaaacaagtcgctcattaaaatacaaacattgtcattgacatgattatgcatgaaaaaagtatattatcattagaatttttttcactcgttgcaacgcacgagcatttttctagtctgtttaaaattaagataattttatcgtccttaagtaagtacctagagataccatatttagtgtaaaatttggtacatttaggtatcaagtaccttaagtatcaaaaaatttattgtaaaacaggaactgtaaatttcctcttaaaactatacttcagatatattctgctgatcagatgtttgtccgtgactgacatgtgaggccccggtcaacgtgtcactacgtgattggcctgcacattgtccagttcttttgtggtcgacgtgactaatataataatatattcggattaattttttaatagcgttagatgtgtttggcagtaatccgctaggggcatgcgaattagctaagggagttgatggagaaaattaacgtgcgaatttaattttttaattctaattatttcttttttgctgggtacattgctagagagaaataagagggtattcatgagagaattcatatcttctaagatatttgatgtgtgacttttgaggtggaaaattatattataagtcatgatgaacggtacggtgaggatgtatttatctttcacttaaaacacagttctcactcaattaccacccctccctagggatagattggtgggagttggatcgattaattccccatcccaatcttttctaagggtctctttgaatcataagaataaaaaaacagaggaatagaaaaaacataggattctgacatgaatgtaagtgtaaaacagaggattgcaaaacacaggaaaaatatagtaataaccgtttgattggaccacaggaaaaacacaggaatttgaggagagataagactcaaaggatttcttctatgaggttctacctctcgttaaaattcctacaaaacttgtatgggaagagacattccataggaatttcataggattttatagggtttattccttttattcaaagggctttgtaggaaaaattcctataggaataaaatcctataatttcctttgaatcaagggggcctaaattcataaatcctccgattaaagtgagattaaaatgctcacatttcttacactcccattccatctctcaaactcctctcaactataagccgtaacgccacgaaaataattagagaaaagaaaaggagcacactgaaaagagcaaagctagctagcagcccagtagctagccggcccagcagcaaaaggcagcccacagcagcatagcagcgcagtgcaagcagcagcagaagagcgagcagagcagcagcagcgctggtactgtagcaaaaataatcccacctcaccaattcaactcgagggagaccttttctccaacgaaagttggataaaattttagatactcgtggaacgcttttcaaactgctaaacggagaatttcgtgtgaaaactttctatataaaagttgttctagaatatcagattaatctattttttaagtttgtaataattaaaaatcaattaatcacacgttattaccacctcgttttacgtgaaacacttaatctttatattcatcttcatcttctggagattcaaacaccacctagataggagaagagcccccggtgagtgtaacagcatctccaacagcctctccaaatcgaactctccaaacacccataagccaactctccgtctgatttagctagtcaaactagatactcactccaacagactctctattaatcctctccaaaataaaatcggactcacatgtcaacatctatcccctcttcttcatctttctctcccccttcttctttctctttccttcttttcccccttccttccttcccgtcgaggcggtcgacgcatggtgcggtggtgcggcgacgcggggaggtgggaggcggcgacggcgacaacggtttaggggcgcagcagcggagctcggggaggggatggcgatggcggcggcggctcgcgacgacgacctcgacgacgaccctgacgacaacctcgacgatgacctcgtgaggagtacagttgctgcgggccaccgttggcgaggcgttttggctggccaaatctagccagccaaccagcgattttggccagctggatggctgccagtctgttggacctcctttttatggttgaatggccaaaatttggcttggagagtctgatggagtggttgttggagatgttctaactccgattctggaattttttattaaagtgaggacgaaaaagtagtgagttgtagtgttaggtgtggtcaaactggatgagatggatccaatactgtttttgggccttgggcgtcacaaaagccgtttaagtttttttttattaggtgtctctccttttatcccgtatatatacttttgtaagctacatggaaaacattttcattgttatttacctatgtttttaactaactccttgtcagggttatggataccacatacctattagtagttgactaaatctcggcaggactcaccacataccatgtcttatgcggaaacaaccttcggatatagtaggagttccacataaggaaggatgaatagagttctacatggaaacgacaaggactactcgggttgtatccatattggttttcctagttctacttggacaaggtgatacttatgggtataaatacaagaccccctaggagaagaggggatacggaacaacagaagccacaacatacaagccaacatatgccaagacaaaacgccggatatcgacttcagagataggcatggctagtcccctacggtacctacggataccgtcaggagagatatagcgatgtctcttatctcgccgaatgcggattcgaagaggaaagctaccctgttgtcgactacgagtcaaaccttcagaccgtcatgtcgataacagttagataggctaccccaaatattgtaatggtgtgattatgatgaataagagcaacgaccggcttcggccaacgggatgtagggttattacctgacaattcagaggcctgaacctgtataaaaatccctgtctccatctcttttacctcaatctcgtatataccctggtaccaacgatccccatactatgcaaataccggaatcgcgacatcaaacgtcaacactcctcaatagtgatcatttccagtcgactctcatggtattttttgtaagtgttattcacataaatatttgtacctacatatctattatattattaaaatagttttgaaagaaggcacttcgtttcttgtggaggctaaaaaatcccacattaatcaaagaaaaagaaaataaaagtccaagtagacgtacaattaaaaaatatctgaaatactaaaaataagcaatattgaaagaagagtccatataagaacccaatacaagataattaaaattcggaattaaaaataaaataaattctgaaattagaaaaaataaaaagagttcatgtaggaatataatttagaaataactgaaatttggaactaaaaataactaatatctgataagagtccttatacaactgaatacgagataattaagttcggaataaaaaaaactaaatttcaaaaatagaaaaatgattataaaagtttaagtaggaatacaatttataaatataaaatattataataaaaatatggaattttcaaaaaaaaaaagataacctagaactcaacgatgacaaataacaataaagagagagaggacaagtaataggccctaaaatagtaaggtggtgaacagttgatgggacatctaaaaattataaacaagaccacaaatagaaccccagcaacaattaagaggtggaataacagacaggacgctaagcagcatagccacgacggttggcgtgacttttacaatgtaaaaaatgaattgcaataacaatcatgttttattttaaaaatcttcaatgataataaatgggcaggtcatataggagtatagtggtggagccgacagcggttggcgaggcttctagaaattaaaaaaataaacccttaaaatttgaaataaaaaaattgacaatgggaaaataattctatgagttcacaaataaaaaaatcggaatgaaaaatatggaattttcaaaaaaatagtccatctgaaactcaacgatgatatataatagtaaagatgagagaaacattaggcctgtaaagcagtaagttggtagcaattcatgcgacatctaaaagctataaacaataccataaatagaatcccaataatgattaagaggaggggcgatagacaagccgttaagcagcacaatcacgacggttggagggacttctagaaactaaaaggtaaatcgcaatgacaatcatgttcgatttttaaaatctcaatgataacaaaaatacatgagcatagtggcgaagtcggcggcacggtggttgggcggatttctagaaagtaaaagatgaacctcaacgatagttatgtccaatttttaaaatcccaacaacaataaatatggaagacaataggtggatcatagagaaatacaatattgatgtttgacaacactcctaaaaattaaaataatggaacctgatgagacaatggactctaaaaacttggactctagaaactaggaggtgcaatttttaaaggtttaaaggaagataaataaaagcagtgatagatcgtacaaataaaagggtgataaaagagtaatgggtaatgactggtgtgacttttaaataaaaactataaaaatttaaggatgataaggttcgatctttgaaggttataagacaacgcaatggcaatttaacaaattttaagtaacgtcaaatataaaaaaaatagataaatttatatggatgctagcctcgcaatttcgcaggtctcccagctagttttcgtaacatgagtaagggttagtcacccgtcccgaagaatggatctgcacaatcgctcaaaaaacagcgggaggccacgccgcaagcccgaacaagagctttacaaaagtcggatagaccaccagtgaggccaagaaagagccgaagggtccgttaagaagtaagaacgttgcttatcaacttcacctgaacaacgacattatatgggatatcaaacacacagcccatagatagaaccgtacctaagcaagatggctagactctagagaaccaaacactagaagacccatatagctaacgttgaactaattatttagcttaacaatccatgttcaccgaatacttcagaaccaaattgtgtagtcgatcgtgtgcccatgcatcgatcgaagcacaaacagatgaatttccatttatattttctagcccggtccacatatgtatattcgatcagcagcaagcccacaaaaacaggtggcctggatgatagcaacgagaacaaacaaatgtgccagcaataatgtgtcttacatttgccctcggtcaagtaattcaccgatccacagctagcggggaaaaagttcttaactcgagtaatagaggagatcagtctatattcgggaaacaggtcgaactcgatccattgttttattgagagttaatatttcccgatctggtgtgcttcttacttttccgacgaaacctgcaattaattaatcaaagtacatcagaaatagccattcactgctgtttaatgcacgtcataattaaaaatcttccaatctagctagctagtgttctagaacacagttcaaattatgaataatggatcatctgaaggctaagggaataagtatatatgtacaaacccttcacaacagttagctgattaatcaattaccagctggtagtagacttgtacgaacttatgaagggccatgctcaggtgggaaagttccaccaccctacatatatggaaacaaagaaaaagaaaacactcatttgagatatctctttgagtttatctccatttccatggcactgtgttgaaatgcaaaataggcgcgaaacatgaatgaactaacacatctataattatcagtgggataatgaaacaatagtacgtactcctatatgggaagcaaaggtgacagaactgagataaattatatgaactaacacacacatgtttaatactagtattacattaattacattattactccttggtgtgatgagagacagtacaatgtggatctagcagatttgtacatagcagatacatttgcatgccacatgtggaaaggtagctaatttgtggagtagtactagtaaattagactgagatgcaaaatcgtaccgcttggaagtgaatgagcgtagtggtgatgcttgccagcggctgctgccgtatcgaacgcaagcaggcaatctttgcacttgacggtggccttagaatgatgtctagacatgtgtctcccgaactgtaacagtttagtggatcagaattcagagattcaaattaaatcatctatcaatcgatcaactgtagtagtagtagtaagttatgcagctgctggaaattaagacaattatattgcacatgtacacatgctctgcatttctgtaccttgtgctttggaatgtagcgtgggtcatcgcactgcgaggcctccatgcagatcaaacacgacaggaaatcatctggacagaatagcatagctatcccgtatcggcggtagaagagcacctcctcgtccgtctcggggtgtaactgcctcacaagcgctaacgcctcgaggaatctaccagtcgcgtcaccgctgatccttcgcctttgttggttttttttcccatttctggtggcgttgcaggctgcatgcagtttcagagagcacggcgtcaatacgattattgcccggtgaaacattacacgatgatgccccatattgccacgcgatcgcaatcgatggtgctcgtctcgagcggttggatcggaggaatgtctcggctggcccgtcgagaagagatcggagaaaggaggtcgagggtttaatttggaagagacctcgtcggtggaagggcttcggtgcggatgctgtggtcggagtcggaggtgtgtcgtcgtcggtgcagtcgaacgcgatgacgaagtacggcggtgggcggtggcgttcggaaactgcagcgacggccggcgtcagcaagtcaatcgcgcgcgatggcgctagggctaggcgctagctagctccgaaccggagagggaagctgggttttggactaattttggtcagaaaacgaacgggatagagagacggcactgccagtactggtttggtttactcccgccggtggacaaatcgccgccggagaagttgacgacggcgaggaatcgatcgaaacggggagaaaacggcaagggaggagatgatgcgggagaaatggttagaaaattgggggagaaaggcggagatcagaatgagttaataccttcccttcgtgtgctcggtgcggtggacggcgcggaggaggtggcgtggggcacggtgcggtcccggagctcgcagccggaggggtcgacgacggcgacggcggcggcttcaaccctcggaaactgcagcgtgagaaattacggcgtcagagagtacaacgatgctacgcgccatggcgctccagtctagaaaattccagaaaactccagaccagttagctagggtttggatcgcgagtggatgagatggggagaacgaggagcgcggatgcaggaacaggatgctaagttgctaaccttaagctgcgtgctcgtcgagatgcggagatggacgaaggcggtggctcgtcgaggtggacgaacgcggcgtggtggtgggtgcactcgccggagcccgcggccggagaggtagaagacgacggcgcgcgcggcggccgcgctctctctctctctccgtcgcagcaaaggagctcgcctcggctccgcgagatcggggggtcctggtctttatagccgagacagaaggcaaaagcttttttttctccctttttttctttgttttttttaaacatttcttatttccttattacttcctctcgaagaatggaagacttcgcacgaaatacaagcccaacacaacacggcccatctcctctgtcgccatcgcactgagataaactctctcttccgtagcccaagcagtggacagttactgagtgagtttagcatttgcttgtcagcaaatggaattactggtacacaatgcccataacaaaagctacacaattactggtacaacaacaattactggcacacaacagctaccaattactggtagtccgtaaactactacagtataccagcatctcaaccagataaacatcgcacagcgacgacgtagtacatatcagatgatgaattatccaaacaatatgagcattgttacatatctgacaagccaatgcatgtgccaggtgcatatgcaaaattgtcacttatacaagcattaatcatttcaacgaatcattgttgacttttaccaatagaaaccctatatactgttgtccaaatctcagtcccagatgttctcaacatgatcaagggattcctattacacctcatcaaaagagaagatcaatggagaactgtttcttcatgaacatgagaccaaggaaaaaaatttacaaaaaatagaaggcaacatagaaggaatgtactatctgtctggaaagaacccaacttctttactcaagagaatgttccccaagctccatcttccttgctgattgaagacgaaaacaaaaatatgctgcctgagcacagctaaataatgaacaattgtacagaaatatgcatatatgagatgttcttacagggatttccactaaaaaagtacacatggcacaaaacaacattctccaagtattgaattgcattttttgactggtcttcatcaaatccttaaacaaggcattatgtgcaatcaataatctggatgaatatcattctgatgcatttcagaatacagccttatagaccctggcaccctgcccagttaccttctttacagttctcatctatcagcaaagtgtgagtgtatttgtttggcaccaatccccttgcatcaaagtgtacagttgagaagaattagtgctcatgcaaaatgataaggattttacatggaaaaaagaggggaaagaacgccaggtctaaaattttatgtgcatggaacattatggcaaggaattaagtcaggtagagaacctggaagcagaggtgttgcgtggcaatggcaacagtccgtctcctcaccgaccagaatttcatcacagcttcatctccatatccaaagtgggtgattctgaatttccatcaacaacaaggacgttcgaagcaacaacttacatctgccgagtagaaacagggatttgactcaacataaaccatgtcgaggtaacagtttatgtagcttacagccggagatcacgggctcaagaaaagatctcgaataaataaagaaggaaagaaagtggcatgaaggggtccatataatgatgggaacagactgccaacagaataaagaacatccaacattgcaggatttcccctccacaggacctgtaagacagcttcttcacaattggcaccccttgcctgaaagcaagccaggatcagggagaaatggttccaaggattggcctgctggttgtgctggttggattggccttccaggcaattctccatccaccacctcaaaaattgtgtggctcaccaggtggacctcctgtgacatctcccaggatcaagctcagtgatagaaggcacgcctacaaagagggtggagttcaaaaagacaaggccaagtagataatcgcagtgcatgcatttgatgaaaccaaggacttacccttgcctgtttctaaggtaaaggcaaacaacaaatacagtaagattggaaattcctctttttgtgtggatcaaatctacatagaattgcaacattgattttttttctttagttcacacttttcttaacacattactttgtctgtcaaaattcaggaacttgtggatgaactgggaatttaccttcttgctttcgacagagcagggtatggggaaaattatccaaatcccaagaggaatgtaaggagtgaggcattggatattgaggagctcactgaccagctcaagcttggacagaagttctgtgttgggaatgtcgatgggaggatacccaatttggggtgccttcagtatataccaaacaggtaaagaccgaaactgcaatactgtaccatcaatggtatatgtgacccttcactctccagaaatgtaaagatacaactactgtgtgcaggcttgcaggagcagcgttagttctgcccattatcaactactggtggccttcttcccccgctgagctatccaggcaagccttcatgggtctcatcatgccagagcagaggacactctggattgcacacaacataaacttccttgctctacctctggatgacccagaagtggctcccttcttctgcggcagccatgcatcatcctgcaatatttagcaagcatgatatggaggtccttcagcacatgatagcgatgcctgtcattgaggtaaatcagagattatttcacccacatgaagtgctatttaatagaacattagaactacagataaacaaatgcatcggccacatccttcaaagcttgcttgatttatactactgtggtcaagagaatgataactttacattaaaaaatagtaagagaaaagctttcaaaattaatatttatatcaaaaccaacctaaagaaaaatgtcccaaaccataaatactacttgttcaggatggcatatcatcgctttctcttcatttttcagaataaatcaacgcagcaaggcaaggatatggaaattgggaggttgatccaatgaatattaccattcaccaatccatttcctcaaaatgagggttatgtacacatctggcaaggatacaaagatagttggtgctggttgagctgcaacggtaatttcaaagaagctttccttggatccattatcatgaagtcccagaaggaggacacatgttcatgctggcagatggatggactgacaaaatactcagggcattcttggttggagaataactctcggagctgtgagcctgtggctctcactgaagatgctatattgctatgtagtccttttttccaagtttatttccgataatatcaaatttggccccattcaatagatgacagaccatactgtcacattaagctatttgttaacagtgaattgggtaatgacaattgaaaacacgaagccttggtgcgtctctagcttcactttggttgtttatgagctgtcacaatgcctgcttcagctttcaagtacagaaggcaggtaaagaaataatgctaagataaatttaagtaggtcaatgggtattttaaaaaagaataatcaaatgcaatacaatcctataaaacagtacctgaatggtactaacatagtaataaaactcatggaaaccacttgtttcttgaaatgagtaagagtttgggcgactgcagaaatatagtacctgttaagattttttttcctctgtctggtaaaatcaagtttcatatattccaaatttgtgacagactgggcattcctgtcattcctgatacacctaacagaattagtccatagtattttcaagtgtagtaataaaatgttttcaataccagtgaccagactaccagacagcatgagccatatgacttaaatcagtccaagaaaatagttcatgatgagagtgaatacatttataagacaacaaaaatgcaatcatcacaaaaagatcagtctagattctaacaaatcaatgaaataatgaagacctcatagacaatagaatccacaaatgtaacacttagttgctttctttatataacacagctaaaagcatattcggaaacggaatgacggtttaactacttcagagtgcacttctggaaagagcgaaaaccaaatcgaagaaaggcaggtgtctacaacctgaccatattgcattaatcaacagagtagaatgtactaggcaatactaaagtaatcacattagtaaacataatactaagcattacttgatctaggttctggcatcatgaatgtcatcaactcactcgcatacaatgttacatctttttcactgctattaggtataccactacccacaaagtacataaatttgcaaaagatcaagaatgaatgtcagaatgaagtcactactttgaaatttgaatgttgcatatggtaataccaacattctgcaacaagttatggtccattttgtcaaaatgatacaacttacaaccttcaaaattaagaaatgaaaccaagataatgtatctgtttacaatatacggttaaaatgtcaagtagacaacagttacacaatcacaaatccttaaaagtactgtaactcaaccagataaacttttggcattggagaatcaaacacctgagtacctgatccacaagaactgattaaaatgcaatagagaatagaattcagagatgcatggattgatcatgttgtatacatgtgttttggatggatctgatcggatacaaaagtacaaatgagaaattcctgagagcaaaataaaatatactccctccattttttaatagatgacgccgttgactttttctcatatgtttgaccattcgtcttattcaaaaattttatgcaaatgtataagatataaatcacacttaaagtactatgagtgataaaacaactcataacaaaataaattataattacgtaaattttttgaataagacgaatggtcaaacatgtgagaaaaaatcaacggtgtcatctattaaaaaacggaggtagtatttatcagtagcacttcagaataaacagaagagaagaaaaatgcatgagcagatgcttcagatatcaggatttcaagtacagcggattaacttccaaaccaaacggcttacctaggtttacagacacaattactattatgacttcttgcaatgtttcaagcggcaataattcaatggaatctgaccactagtgaatgaaaatcatactgcagatttgtgctacccaaccaacct

SEQ ID NO: 59659 - DNA, 3348 bp, Oryza sativa
gttgccgattttacttgagtatagactccacggcacttaatggaaaatggaatggtcaactagcttctgcaacatctatagatggacacaactggatgtttccagttgcatttggattctttcagagtgagaccactgacaactggacttggtttatgcaacaacttaataaggcagtaggcaatcttccaaccttagctataagctcagatgcttgtaaggggctagagaatgctgtgaagaatgtttttcaaagggcagaacatagagaatgcttttggcacttgatgcagaatttcataaagaagtttcaaggtccagtgttcgggaacatgtaccctgcagctaggtcttatatgccagaaagattttatcattacatgaataaaatttatgaggcaaattcagatgtgaagccatacttagaaacctatcacaaattgctttggatgagaagcaagttctcagaagagataaaatgtgacttcatcaccaacaatttagcagagtcatggaacaaatggattaaagatatgaaacatcttccaattgttgagcttgcagatggtattaggtcaaagacaatgaatctattggctaggaggaggaagataggtgagaaattggatggtgtgatgctatctattgtggtttgtcaactcaatgcaatgactagagaactgggccacttgaaggtagttcaaggtgatagagaccaagctgaggtgactgagatcactgctgaacatcagattattagacatgctgtcaatctagtaaaccatacatgcacctgtagagagtggcaagtttctggtaaaccatgcccacatgctttagctctcataatatcatatagaaaccctaacatggctgattatttagatccttgctattcggtagaaaggtataagcttgcatacgcaggagttattttaccacttccagataagtcccaatggccaaaagtgaatattggttttaagttgttgccacctcttactaagagggaagttgggaggcaaaggaagaaccaaatagtcgggtgccttgataagggcaaggctaggagcaaaggcaagtggcaagttcaatgtaagagatgtcttgccatgggccataggtcgacgtcgccaaaatgtcctttgaatggaacgaagaaaaagtaagtgtataaattgtcatttgttttagttctagcatatttatttgtttcagatctagcaaatttatttgttttacttttgcaggccaagtcgggccaaaaaagggagaccacttagtgaagcaaattgtgcagcaagtactagcatagaaggcacacccaaaagacagaaggtaggcccaaatggttcaactaatactagtcagggcctataacaagaaggtaggcaaaccctttttcttgtttctgcacttgattcaaaaaatgttttactaacacctaattttttttaagtcaatcggcattgacaacaactggtggagaaggaccaatgaggcagatgacaactcctccaaggcccactagagctgcaaagaagatcactccaaagaaagggctaaaaacgagtgctccttgattatatattctcaaatatgggaactattagattatggatgcttttgtatgtgaaccacatgactgtgcaagttgtggcttttattttgtaatctgaacttctatgcctggattatgtattttggatggcattctctgacttgcttacttagaggtgcttgccttggagatcgttttacttgctatatatcatgccaaaatatggttacatgctgttcaaattggaaattctgggtatatgctgtcagaattttgggtatatgttgtcaaaattttgagtacgttgctgtcaaaaattacatatacaaatttttggtgtatgctgtcaaaattgcacagattttaggtatgtactgtccaaaattttgttctcacatggctcaggtaaacaactgcaacttgaaaatatgcttcaatctctaattgaaaaaacttctgtaaatcacgattgggaagattgaccattctctacgcatgctgtgaaaattgtctgcacatgctgtccaaattctcagattgcacatacaaagtgatatttcatcgaaattgtaaatgccaattaacaaacatgctacgagttgaaccatcaaaattgtctcagtttgcaactttccatacaaacaatgcgttgatacaactagctgaaccatcctactagcaaacctgcactcctggaaattttctgattacaatcaacttccaaacagtacaaagtataaagtttttggtaaagcaaattgtttgcagcgctggagtcgacggctcaacgcggtctggtcaaagacttcaggagaccgacgggaggtgggggagccgaccggcgcaggcgatcttcgcggtgagggcgtcgctcgaggcggggcgcggtggcgcgacctgaggtgggggacggtgctgccggcgatgcgcggacagagcagcgaggtgcggggacggggcgcatactgggcggcggggggctgagctgcgagcggcgagcggcgagcggcgtcgcctctccgtctctcggtcggccgagaggatgaaggggatcgatctgctttccttggaagaggaggctatctttttactctcctgacaggtgggcccatgggttaatccgtccgatcaggtgagaaagatgaaggaaaatattagaaatctgagaaatttaggaaaatagagaaaaatggcatggaatgaaggaattcgtgcttccaatggcatattctgaaagtcacgcgaattgagtggcgtatcctgaaaacggtgtgaattggatggcatatactgaaaaatctcgccttgatccgattctctttcatttttcgcacgtttgccatagagagtttgatgaattatatgaggcccgagagagcatgcacgatcgagacagaaaataataagtggatgaactcagttgggtactatgcacgattgatatatggcctagctaaggatgctttaaaaaaattgaaaatatattatttttaccgatacagtagaaatatactcgttttagaataattggcatcattataccgttgttgcgtctataggaaagcgaaatcgctgacatgctggtggatgcgcgcgagttcctaccaccaacgtgcaaactcgtgatgtcatcggcgcaaaatcatgcaagtacataaatgcaccacgcgaactgacgacatcgtgcgagttcatgagttcagcgtgcaaactcgtgacatcatccttcgtgaacttgggattgggatttggtgatattcccccgtaacattctcggtgacattgag

SEQ ID NO: 59660 - DNA, 9404 bp, Oryza sativa
cgtggcagacgcgacgacaataagtaacgctctcgcgtcctcttcatgcaaacttgagacggaatcgcgacctcctaatcacgacaaaggtgatctaatcctgtaattcttttggctgtagttataccaacgcaaaaaaaagctgtaaacaatatattattttcttattaaggatgtgttcatttggaattgttaatccttctcccagcatgtaaaatggaacaatagatcaatatatgattaattaaatattagctaaaataactttaaaaaataatcaatataattttttaagcaattttactgtatatttttttaaaaagaaaatactccatttaacaatttggaaaacatacgtgtgaaaaaaagaaagtagaagtttggaaagtgtattatagaacacaatcttaagacttggtaagacttaagactttagcactaactcatgattgtcttgatatcttctgcatgctttctaactattccctccatctcataatataaggcatgatcaaatttggcacagtcttcaaaatacttaattaggctgtgtttagttcctgaaaagagttggaagtttggggaaagttggaagtttggaaaaaaaaagttggaagtttacatgtgtagaaaagttttggatgtgatgtgatgtgatggaaagttacaagtttagagtagttggggatgaactaaacacggtcttaatcatgcaataatatgagcttcgttttgcgtgtcggggaggaacccctcctcccgaatacaacctagctaagtgagcctaaatattgtttagggtgtaaagcataccaacacaatagttcggggttgcaaattagacttttttttcttaattttaaacagatttcgctgctttaattattttagcggatgatctggtggcacgctttcatcgacgctagttaatcgatctgtacttccatggacactccggcggccgccgactggtcggagcttccggccgacgtgctcggcctcgtcctcctcgagctcgagttccccgacctgttccgctccgccgccgtctgcaagctctggcgcgccaccgcccgcgacatacgccgcctcggcctctactcccgcgcgcagacgccctgcctcctctacaccaccgccgccgccggcccgcgcgccgccgtgctctacagcctcgccgacaagacgacgtcctacacggtccccctcccggacccgcccatcgcggagcgccacatcgtcgggtcatcccacggctggctcgtcaccgccgaccaccgctccgagctccacctcctcaacccggccacaggcgagcagctcgacctcccacccgtcgccaccatcgaacacgtaaggccactctacgacgacgccgggaacctcaacaactacaagttggtctactacgacggcggcggcaacagtcaccggagcaacgacgatgacatgcacacggtgacgcacccgccggagacgttcagggagttcttgtatctcaaagccgtcatctcctccgacccatcgcgcggcgacgactacacggtgatgctcatccatcacccatatcttcagctctccttcgcgagatccggcgacaagaagtggacatggatcaagatggggaacaatgagtgtgagtggttcgaagattgcatctaccacgacggcgtgttctacgcccagaccgttcacggcgccatccacgccattgatgtcgtcagtgcttcttcctccttcacccatagactgattctcaagccgaccatgggtgaattgggcaccctctacattgtacgtaccacggaaggtgacatcctgcaggtcttgcgagtcacggaagaagatgaaggtagcgagcataaggacgtacgaacaactgaaatcggggtgtacaaggttgactacaagaagcaagatcttgatgacgtcgatgacataggtaacaatgcattgtttattggcactagttactcgatgtgcttgccagtgaaggattatccacacttgatgccaaatcacatatatttcgacgatgactacgggtacttggttcaccgtaaacatcttcgtcgggacgttggagtttatgattatacgaatgacactgcgatcgatgtggagtatcctcagccgtggctgaattggccactagctccagtttggattactccaagttttactaaaactgcaaaatatagttgactatataaatgcgtgtaatgttaccctttgtgtacatttttttagtaaattttataaaactattgatactttaactaaattatcacaaaactgcagatttataatgatgtatcataaaactacttcgttttgttccttattaagtgatgtttcggacaatgttgaggtcaaacttttataattttgactatcaataactttaaaaatatttagtttaaaggaactagaacaacatatataaatttatcttttaaagtactataataaaagtaaacatacatttatttattatatatattatagtagaaaaataagatcaaacatatatcttgtagaccgtgtcattgtctaaaacgccaatcaaaatgaaaccggagggagtacagctttaataataaatttatcacaaaactacaaaactacaggtttaacactactagaaaaacaatttttttatggcattaccctataattgtcgctggtggctatatgtaaaaaccgctagcaaaaacataacgaggggtggggggttatggactaccagcgaaaaccgattttcacgggtggtcatgataagaggtcgaccataaaaaataactctattttttgaggcggatctcttaagtatccgcattttcgctggtagtaggtaaagagtactgctgcaaaaaaaaatttcgaggcgaatatataatcccaccgaagatctcagtctttccaccccacctacccttctccatctccctcctatcttcttacccttctccaaatccactcttccatcctcctccctccccaccgaggcgcaggcgacggcggctccggcagcggcaaaggggatgggtggcggcggtgaccgggctcggcggcggccagtctcggcgacgacgacacgtgggcgatggatccggcggcgggctctccttgtcctcctccctcctccaccgctgccagttgccgtcgccaccaccgctgcgggctgccatcgcctctaccgcctctccgccgcgagctcagggccggccggatccggctgccgcgacgtcgggggtggccggatccgctgccgcgtcgacgggggaggccggagccaccaccaccacgacgggggaggtcggatccgccgccgggtcaacaggggaggccggagccgccgccaccacgacgggggaggttggatccgccgccgcgatgacaacgtgaccgctgctgggccgcaggcggcggatccggtcgtgacgagctcctccccgtagagggtgacgagatcggcgtattgggattggaattgtgggttggaggattgggattggggattttagggttttttttttttttgcaggaatgtgaaatgtgatttttcggtttgtaagttcatttgttcttgatttctctctaccgttctctgcttgcttttctttctcctagagatcgatcgataattatttgagctcttatggtgcatgtgattgtttatgccagcaaaaagagcatgggtaagtatctgtggaaatttttgaatggtggagcgttgacggggctgacggagcgccgcttttttttttttgaaactttgcagtattaacactggcggctcacagtgtaaccagccagcgataattcattttccctagtggcctatcttaggctaaacgccagcgaaaatagatctttgctggcggctggcttaagacgaccaccagcgaaaatgaattatcgctggcgttcgataactgctagcgaagatcttgatttttattggcctttgtttgtggcggctccaaattccgccagcgaaagccaaaatggccgccatgaaagatggttttcgtagtagtgtaaggctaagtatcacaaaactaaaaatttaataataaaattaccacaaaactgtagagtttggggtttaaacccttagcactaatgttatggttaagttataaactttcaagttttgtgattgaattgatgttaaacttgtagttttgtgataaaatttgttattaaatctgtagttttgtgatactccaccttaaatttgtagttttatgataaatttgatgttaaaactatagttttatgattcatatataacttaaattagtttagtgaaatttactctcttttttgttgatactcaaattgaagcatcagaattctctggccatttgattaatcgatttggatggaaactttaatttgatatccgatttgtcctccaatatatcaacaaaccagagtgctataatatgctattatatggattctttttcctcgttttgctatttttgttttgagtaaaatgtagggcggtccttaaacttgtaggagtgtgtcatttaggtccctaaactcttaaaatgcatatacaagtcccagaacttgtcatagtgtgtcatctaggtcccaaatgaccacagccccttcaggatattacgtggcgttgatgtgacatgccacacggacatgacatggcattattttaaccgacaaatgggacccatttaatttctctttctttttcttttttttcttctcatttttttccctttcttctcttttctatgtgatccgtgtagaagaaagggaaaaaaaagaatgagaagaaaacaaaaagaaaaataaaagaagaaaaaaaaagagaaaaagacacgccacgtccacgtggcattgccacatcagcgccacgtaggatcctagaagggatgtgtcaatttgggatctagatgatacactttgataagttatgtgacttggatatgtattttaagagtttacggacctatatgacacaaccctacaagtttaaggaccgctaatgcattttactcttttgttgtctactccctccgtttctaaatatttgacaccgttgactttttagaacatatttgaccattcgtcttattgaaaaacttttgtgaaatatgtaaaactatatgtatacatataaatatatttaacaatgaattaaatgataggaaaagaattaataattacttaaattttttaaataagacgaacggtcaaacatatttaaaaaaagtcgatggcgtcaaatatttataaacggagggagtattgactaacgaccgacaactttttaaatctatgaattttgtactccctcctttttatattgtaagatggtttgccctcatctagatttaatagcatcaatataattttatatacatcttatcttaactacttacaaaattgataactttccattagtacactgctggagaaacccacaatagtctcggtttgcaaccccctttagtcccatgttgaccacgaatccaggtctaaagatgcgatctttagtcccgattggtgtgttaccaactgggactagcgctaccttctttagttttttcattgttttttgttgtttgcatattgattttgaactaaactcaacaataaaatcatccacgttcatagaaacataaaaaaatcatccacaaattcagagatcgaatcaacatactcaaattgttataaaaaattcacatcacaaatttacagatgcaaaaacatcacaaatcatccacttgtctacgccggagaaaaagtcgcgcaggcccacggcgccaggccaccttcgctcgctcctcgctgttgctgctacaagaaaaggagaggataagagagaggagagaggaggaaagggaggaggaggaaaagggaggaggagtttgtaatcgagaaggagaggataaatgtgagggattatatcccacacgttgatttagtcccggttggtaatatcaaccgggacaaaagatagtaggggttagacgttttttgatccgggactaaaatgatctttagttctagttaatgttgttgggcttttcaaccggaaaaaaaaagatgtttagttcctgttcctattggaatgggactaatatgatttttggctgacccagtagtggtaacaccttatttttgtctgtcaatcgtccgattctcaatctctccataatagccgactcgggaacgacgagatccggctgttgataaaaactacttcagtttatcccgaattcgttgggatgggaactgagccgaaatccacgggatttagcgcaagattgatggagctttcttgaggaaattgtagaggagattgggaggaacctattataatatccaatttagaaaggggagcaaaggggaggtgggattggaaggagaggcagcgccggcttcgcacgggcacaggggttcggtctggaggagcgagcgggaagaagacggcaatgtggcacgtgggccccgagcgatagagagagaggagggaccgagggaggctcctagacttgctctgctgctgctgtgccgaaggggaaaggaagaaagcaaacaggccgaaaggaggaggagacaaattagacttgaccggagagaaggcaagcctgctggagagagggacagaaaaacagacttcactggaattggtccaagaaggagggaggattttaattacttttccatttaaattaatcactgaaatgatctttgaattttcaaaaacacttaaaatgcttaaataattccaagaaaaatcaagaaaatagttggacactcaaaagtatttaaaaaaatatttatctagatcatttaatgattaataattgtttaaataattattgaattattctttgtattgttaaaattaataaaagaaaatttcagagagtataattaattatggagaatttaataatgattaaatccagccatgttttaattaggaaattgtatttctcacattaaacttcacttgtaaattagtgaacaaaatccacaatcccttgtgagaaggaaaataatattgacttggacattcatttatgttcttcaagggactacatgaatggaaatgatgccggaggaaccagtagcaaattgaatgatagggcagaggtgtctagtaaggacaaaactagtgtttcggagctggaggatggaaatgtttgttcccatcatgggattgaagagcctaatgaagaatcaatgcaaggcattgtaatggaacaagaagaattaagtgattcagaggaagatagccagcatgtcgaatttgaacgtgaggaaatggatgattctgatgaggaccaagttcaaggtgtcgaccccttgctggctcaaaacaaggtaatattgcagtttagcacatatctgttattctagtatcattttactgttcatttctggatgtagaattctactgatttccccattctctagaatgatttcaccaatggcttttaacatatctattgcactctgttgcttatatcatggaaggttacctttgtatgattgcttttgcaatttcttggacttacctgaataaaaaagtgaagcatcacattgtcacatgttcaatcaataattggtgacaacgctgcaattttccctgaaagatctcatgtttgaacctttcttctatgaattaatgcttgcaatatgttctttctcctcttccttttgacatgctgataggctgatagctatagatgtttccttgtgcaggaggtttcaacatcagtgggttgtggggagtatgaaggtagtaataatcagagccagaaccaacaaatggtgtgtttagttcacaccaaaattgaaagtttgattgaaattggaacgatgtgacggaaaagttggaagtttgtgtgtgtagaaaagttttaatgtgatggaaaagttgaaagtttgaagaaaaaatttggaactaaactcaggcctacaggtgagtaaacagggtgcagcaacgcagaaaccacagaggctttctaatgccacaccagcaagagaaaagctgaagggggataatgcgaaacgtataggatctagaacaagcccacgatcatccacgtcccctacaactgaacctaaccaaacgaaaaccagaaggcctaaagctcagcaggtacagattggtgccgagcgcaagtccagtgattcaagaagaagcagaaaaaaacctgctccaatttccagcatcttgtctcatttgcacatcggctacctgtttgcctggccgcaatattctccagatgatagcacggcaatctgctgtcattcgcatttctgtgaacggagcagcaagatcaacattcgaaggtgagaccttgcaagtacatgtccactgttgaatagcaactaagcaagactgaagtggtgttccttgcttcacctctgacaccattgacacattagcctgccattgagtagttaattgcttttgattgacttgactgagtttgtgtcctctccactctccaggaaagtctcagcgagtcatgtgttgtgttacagcttgtaacatgagccaatgtgttaatgtttctgtaaagttggcgtagcgccatggccattgacgctataatgttagtaatgttgattagtgcatggcttatttggttgcacatccatttttcctaccatcacatatcttcaacctgtactgcttgttatttagatagctcactccaattacatattgcaagcttgtaaatatttttcaagaaggcatttcattccttaaaacatttttccccaacggaaaccgttggccggaattgatttcgccttatttgtagagaaatagcatacacagaacagaatgtactgatgtatatacgagggttaacgacgttgtgaaaccgctaatggttagtttgtgaaaactgatacagtatgttttagctgttttttttacggtttttactggtttttggtaaaatggtgaggagcggtttttaatttaaaacggaaaggtaaaccctgggagtacaattcagtcgttcaaagaaacagaaaaaaaatcatcagtgcctcagaggcagaaatcacctgtaatatgtgtataatcattgttgtatgtgtgaagtatatatttccctatttttggcatagctaaattaatcctttattacacaaaatctatggccgtccagcgtaattatgcactcctgtccactcgtccaacaacaacctgctaaatttgcgtcttgcaaagatcacctgttcatataatactctgcagggctcccctctgaaaaaagttgagatttcagacaattaacatcactaggagagaaatcaagaaacaagctagccagcaatggtgtctctccgcgcggcatcgtcctcgtcgtcgccgcctcgtcggtcgc

SEQ ID NO: 59661 - DNA, 4682 bp, Oryza sativa
tgatcatcgccgggaagccgtacgggttccaggcgatccactggcacgcgcggtcggagcacaccatcaacggcaggcgcttcccgctcgagctccacctcgtccacaagtccgacgccgacggcggcctcgccgtcatctccgtcctctacaagctcggcgccccggactccttctacctccagttcaaggaccacctcgccgagctcggcgccgacgagtgcgacttcagcaaggaggaggcccacgtcgccgccgggctggtgcagatgaggtcgctgcagaagcgcacggggagctacttccggtacggcggctcgctgacgacgccgccgtgcggcgagaacgtggtgtggagcgtgctcgggaaggtgagggagatcagccaggagcagctgcacctgctcatgtcgccattgccgaccaaggacgccaggccggcgcagccgctcaatggcagggccgtcttctactacaacccgccgggcagcgccgtctccttccaggaattcgccaagtgattctttcttttttttttctttcttttttttttggttttttgtatttgatgttgagttgatttgattaacatttcgacgtatgatatgcactatatataattaattaacatcgcaaaatactttttttttcgagaatacataaagggctcgcgtatctttgtattaactagtgggggtggggattaattactatatgcttggacatttttccgttcttcaagattgacgcatcgatcgataaatgtatatatttgtagctaagaaggggtaaatatactaggagagaatacactctattgtcattgagtttgtctctgtcaacgatttgctactgacattgtatgtttctatcagcgatttatcaattgtttgctaggttttcccccgttgttctactcttccgtgtcaaagagtgcatgtcagattaagcagaaccaccagctaatccccttcgatgcgcagccaccgcgccgcaccaccggccggggcttgagatgggaattgaagcacgacggagatcgagactcttctactttcaagatatgatggtatagtcttacataggtgtaggatcgaacagtaagaactaattcaagcagaggaggggtgaatggttgtagtaccaaaaaaacaaaacttttagcggaattaaaagttaccctcgaatcgatgtcgatcggtctgactggaatagatctgccggtctgaccacatcgatgccaccggtctgaccagtatagatcgcccgatctcaccgcccgaagatgccgaagtcgcctgtcgccgccaccagtctgaccaccgtgtactcgctggtatgaccggtacaaagccgtcggtctgaccagtggtgtctcgccggttggaccgccgaacccgagcaaacataaattgaagaactctcaaagtaaatgacaactttattacttatctctgtgtttacaaagtgtagcaacagcactcctcacgaaaatctcgactaaactcgaaaccctaactattctctcaactcaatgctctcaaaagcgataccgagaggccacacctccctctctatttatgcatgaggtagacagcctaaagccacaaaccaaacttatacaagaagtcctaatccacctaggaaaccttcccatacaagaaaccaactttataaactccaattgcaccaaatttgaactccttccaaattcgactccgcatcacatagacacacaatatctccattgtatgccatatagaatcttcaccaaccacgtgcattgatctttagcctaagtatctcgcatgatatctgatcatccggacatcaccttatctccaagttgactcccgatccatcaccggcaacactctcccgaggcgtcaagattacctacacatgaatcaactaagaaaccatattccaagaacaagctatctccaacttgactcattgttagcaaacaacagtattacatacgcatagtatccatctagaagtcataaacacatataatccacggatatccaatgaaacaacccgaaaccgaaaccgacacagagtcggtcggtcagaccactggctggccggtttaaccgcatgcatagcttcagtctgaccggcagcacctgccaggtctgactggaccaaacatccagcagcacctgttcatcacctgcaaattcaataatctccaaaaccacttcgccaataatctccaaatatcaaaatcaataatctcatatgccaattattcatcacaaaataagaatcaaatacactttgattttacaataggtgctcatagagataaagtatgtgtgtactcatagtaggtgagtgcacacgcgttatatgtgtctgcatttgtactatctttctaaaaaaaggagagtgtatatgtggcgtgcacatctttcgtgtaattgagagagaacaaacaatataggaataagtacacttgaggccccttaacttgttaatgaattcgattttcgtcctccaaccagaaaaccagatacaacaggtttctcaattgtcaaaatcagtgccgataactagataaggtccctcgatggtttgcacgacagttttggttgacgtggcgtctatgtggctaatttgattcggtcttcatctgacgtggcgtttacatgacaattcgatctaagaaaaataataaacctcgtgggatccacatgccagtttcacacaaattaataaaaaaatagtgggacccatgtgggccagcccacataattattctcagccctcctcttcttcctcctctctcggtctctctacataatattattaatttgtgtgcgaaactgcatgtgggtcccacggggtttattatttttcttagatcgaattgccacgtcaatgacacgttagatgaagacagagtcaaattagccacgtaggtgccacgtcagccaaaactaccatccaatctgccgagggacctcatgtgcactggttttgacaattgagggacacgttctatctggttttccggttggagcacaaaaattggattggtcgacaagttaagggacctcaggtgaacttatttccaacaaattgtaaatgggccgagtagagccagcccagcggctactggccttggtccaccttggctatatatatgaatgggcctcagattcctcggcccaggcggtacacgagcaaagcgaggcgattcttcttcttcttcttctctggtggtgtggtcgggaagctaaacccgggagaagccgcagcgcagcgagggtgacgaggaggaagacgaggggagagagagagagagagagggaagcagcattggggttcgtcgcctccagatctccgtctccgatccggcgactgagctctcgatcgcctcctcctccccgccggcaaccgccgcctgctctgggttcgccatcgatgcatgcaccctgctttaatttactcctcgttcgttgctctctctctctctcttatcccctatcgattcgattccttcgagttgatgagcaggtcccctccgcgatcgatgccatggatgtgaagggtcgctccgcctccgcgcccgcatcgccgtgcgtcgtgctcggggacgacgccgccgatgccgcagcggtgcgtgtgtcctcttcctcttcctcttcctgcctctggttcgattggtttgcgattcgatgcgctcgtgctcctagttttgcttttgcgctcaagagagtttttgtctgggtagtaagtagtaaccaccgcctaattaactactcctactagttaattgatgattggatgatgccgcgtgttacatagctgcctgttcaatttcgatcaatacaaaaactcgtccgtgctgtgatttttttttttaatttcattctgtttctctgcctattgagcaagacattgttactagaggtgttatggtttgattttgttttttcttcacaggttgccaaagttgatcggaaatatgggagtatgctcaatgctgggagtccactccaaattctttacacagatcagttagctgatgcgaaaggtggtcttaaggttagtttcctcactcagttgttattgttgtttcattacaatatctgcctccttggcacctgtatcttgtggggagaagaaaaatgagaaattatgctttctggaagtgaatcgagtttgtgaccagacattttgtatttttggcccttcccagtcacacgccttctgaaggtggttgatattgtgatctgcaacaacaatatatgacattcttctgtcctctttttttattcaggcaaatgcaccatgtgaaataacttctgttacagaatgcacctgccctctagaactacaaggcatgttgaaggaggaatgtgttgatcagtacaagctactatctgacaggctgcttgccaaggtaaggttttatacttattcacacatatgcttaatctatttgagcttcacgggttgtttcagcagtaattttcttgctatatattgaaatcttaagactagatcggcttgtgaaaaccagaactcttaggaatgacaacaaaaatatttttcagatagttcccaaggttgcaagagtcaagaaaccagtttccagttcagaggtatatgcagagtttggtgtttctgcatattcaaaatatggtacaagaacagtgagtacatca

SEQ ID NO: 59662 - DNA, 11236 bp, Oryza sativa
  unsure (1)..(11236): unsure at all n locations
ctctttccatgtttttcagttcttaaactgagtcagatgtgggttttattcctggtgatccttctcttagtctgtcctgtctattcattaacacatgatggaagtgcagagattggtacttgtcggtttgacaaaacgagtgttgctgcactctcttgcaaacagcctgatgggaaatggaggccaccctcagtgacatgttgtaatgcattgctgaatgcaattgatcatttgccagctagcaatgagagcggagtgtgctgtctgtgtcgctatttgcaactaagataccctaatgatgggcatggattggtatcatcttatgttctatgccagggaaaggataggcatattgtcactacatggtcttcttttccaatcacatcatgttatacaggtatacatttcatttctgttacctttactattccatcttaagatctggagtaaattaaagtctctaaatatttttctgtcttgttttaatcagtatgcaggcaggaaaaaacttcatcgagtggtatgagtaaccctgtccagaaggatcatcctgtgagaaatgcacatggaactggcaatgaggtcttcaagatcccttggatatttggttcagtggcattctgtgtgatattacttattttcctttggtacctgtggtggtctaaggcagcatcaaatgcatgccaactgcagtcccttcccctgaaccgaaattggaggctgtcatcagatggtggtccatgggctgagcgcaggcgatcctctgggaggcgttcatcggcacaactgaaggagcgcaggatgtcatattcataaacttccctgaacagttggaaggattggaatatctggttctaaacaagttcattcttctttcttgacgggcagtgctttaattgttggtatgatatgcattgttgaggatgtgatggtgtttttgtctcaaggattgcacatacgtgaacatagcaattcacaactgctattgcttaggagttctgatatgccaaagaatgttgtctgaatataatggccatgtttaagtgcagtaagtctgtgacattgtacatcagttatactgtctaaaacctaacaatgaggagttccagaccagtgcacaaagatacttgctacttttttttgcgtgtgtgtggaaactactcactttgtcaacatgccctggccttaaagccaaagttcatggcttggatgtcaaaaacaagcttaaatgatctgacagctctattccctagcatttggacccctcggacacctgcatcatccggcagaaaagtggagcaaattacattgtttgagctttcatagaatgcattttccactggcagcttcaaggtagacctgataagtttcatctccactgttggaaagtcattccagtttgctgagccactgtttgaaatgaagcaaatcctcctttcatcccatcctctggtatatcccttggcttgcatttccttcgtcatcgctttgtccagtgcatcaaacaccggggataaaatgtatgtatcagcagtgccagaatcaacaattgtcatcttggatatatagatatatggatcaatttcaagcctgattccattgaccatcatatcaagctgctgaatagcatatgctggtttatgatcgtagtagatcaattttgtccacataagattgatatctctggcatatggcccaatggtcagtgacccttcattctcatgatctctggggaagcagtaagaaaacgcggtataatctgtctgctgacatacctggttgaagaatgagtaacttttagtcccaaaaccaattatcccagcattgactccattgtaaagattatcttctccacagccaaagatgaaattatcaatgcttctgttgctggcaagagtgagcctgtctttccctaagtacccaactgaatactctcctgacccatatcttaagctgtagatacaagtatcatcctcttctacacacccatactcaacagcaagatccatgtgcatgccattgcaagcctcagttgagcacccaactttactgtaagttgaagaattgtaagggttgaatatttgtccagcttttgcagcttggtcatagcattttatctgacaatttttacactgaacccaggagagagttgagccggtgtcaatggtcacaagattgaagacaggtggtgtgccaaggctgatgcccatgaaatacttgttcttgcgcatgctatcatcgcctatgacggtggaggagtctgcaggtatgtttgctggctggatcattgtagatatgaaggaattgtttatgtggaacacagagaatgtaaaggctccattcgtgtttaaaccaatacctgtgttgttcaggagaaaaacagtgtttcatgaatcaagaacaagaacacataagtatgatgtgttaagaatgtttggcttaccaatattaatgcaaggactacaggtaaactaccatgacatagttgcaaaagaagtacttaatcttggtttgttgatggtttttatatgttgcctcgtgtcataagtgtgtttatttttcatgattccatatttaatacgaaaaatccatacctaaccgaattgcattctgatggaatagaatacccatgcaaattgcaaaataaaactaccttgcacatcaggtttacaagatcacttctgacagcaaaagaaaaaaaattagtatttcacctgccaagcttttttgggggaaaaaaaagatggcactttggtatggcattccaacgtaaagcagagctttcttagcttcgattgtgagcataattaacagattagatgaaaaaaaaggaatgacgagcgcattttctagaagccatagcatcatatagcagtaaaatttgaaacttcatttctgagttgattttttgctttactcatcatagtcaagttttcagcattggcttttaaactgctaataatatggatatagaagttctgcccatagcttaaacgatcatagcataatacagttgaaattaaaaaattaaaagtcattaaccacacatttgactgaattttgtataacatacaaatcgcggccacccatgtatacgtttttcatgtaatcgggggaaaaaaaacggaaacatgattaccgtaggttgatgaggaggctggactagtaatgctcatgcacagtcgaattgtgcaccatagcgaaatcaccatgacagccaagaacagctccatcaactatgtcgatcttcacaaagtctaagctaggtgctgagtaataaaatgaaatgtctctaattctcctatttattatatgggttttaattaacacatgctgcctgacaatatgcatgctccaactaccaacaataacagatatttcatcacgatgaatatgctatttctttttttttctcccctagaaatccacttaatttctctactgtttggctgacatgtgggcccaacaggcaaaacccttcctgttctatctcattctcatcgtcctggattaattaatccaacccgaaaatgaatcggattaggatccaacgaacccgaagaagaatcggattaggattcaacgaggcagatttaaagccaaagcgatcgaatttctctacagagattgctcgatcgatcgatcgatgatggctcgccacatcttggcggcggcggcggcgacggcgctggtgttgctatgctgttttcatctgccggcgacggcgatgatggcggataccatcaggtacgggccaccgagggtgccccaccggctgggcaccgtcatcgccgtcgacctcggcaacaccaactcctgcgtcgccggctacggcgacgaggctgatgcgccgccgctgttccggctctgcatccccacctcggtcgccttcaccggcgacggcgacgccctcgtcggcgaggctgccaagaaccaccccgccgccatctccggcttcaagcgcctcctcgggacgaggtttggctcgccggaggtgcggcgagctgccgagcacctgccgtacaagatcgtcgactggtgcacgatggctcacatcgaggtgaacgccggcgccggcggcgcggcgaggagcgtgtacgcctccgacgtggcctccatggtgatcgccgagctgaaggctcgcgccgaggctcgcctcgccggcggcgggaagaaggtccacaacgccgtcgtcaccgtcccctactacttctccgacggcccacgtgaggcggccatgaacgccgccaggatggccggcctgacaaccgtccggatcatcgacgagcccaccgccgccgccgtctcccacggcctccaccacggccgcctgcgcgacggcggcaacgtcctcgtcctccacgtcggcggcggcacctccgccgctaccgtcctcacctacgacaacgccgtcttcgaggccgtcgcgtcgcgccacgacgcccacctcggcggcgatgacttcgacgccaggatcgccggccgcttctcccagctcatcaagcgcgaccacggcggcggcgtcgacgacatcgcccccgcgaagctgaagtcgcagtgcgagctcgccaagaggacgctgagcagccacgacgtcgcccaggtgaacctccacgccaccaacctcgccaatggcgccttctccttctccgggtcactgacgagggcgcagttcgaggagctcaaccacgacctgttcgagaaggtcatctccctcgtggacgcggcaatggcggaggccagacgcgcggtggcggggttcgacgtgatcgatgaggtggttctcgtcggtggaagcacaaagattccgaggattcgagagctcatcaagaactacttcgccgggaaggaggcgacggtgaaggcgacggcgagcattggcggcggggcggtggtggtggtggagcctgaggaagctgtcgtccatggcggtgggcttctgagccatcccatggaggatggctaccattgcatgggagccggtggtcgccgtcagatagggtcgccaatggatcgctgttaccatgaattttagctgaatttgaaatttagactctcttgtgtacaactactgttgtattaatcgttgatataagagatgtagtgacataatagatgctctcttcgtttcaaattaattgttctaactttatcctaaatacttctatcaatttttaaaaattcagattcattggagagctatacctgtaggcccaaaacagtccgaagttattttttatggaagtatcgtttggtagtggtaaataattcaacaacatatgaattatatgttatacaaaaatatttctcaagctgaatctaaaaattgtatgaatatttacaaatttatagtcaaaggctctctttggcatagttcttcgagttgggtgttgctagctcaataaatcaatgaatctagatttgcgattacaatgataacgttaagataaattattttgattctattttaaatgaaatttaaaatttctaaacatctggtgacaatattttggcctgaattcactcggatttgtttccctcggattagtctctgcatgaattaattagcagttgtgatacgtttccttcccacgcacgcatgcggccagcaacatataatctagcttggcccaaaattgatgagtacacacatcatgtgtcgatgcggctaggtgaagagattaaagaaattacaaataaaaattgtgtcactgcgggaatcccacgaccttcacgtcgcacacacatacctttcctactcaggtacaagcgtttcttatatttagatgagacttgcgtgctagttatattacagtaattacagtatatttatattgtagttacattcgtgtgattttaatgaaaaaattgttaggtgatatataggtagtgatttaaagatatgccaaacagggtcaaagatatgagtgtttaatttaggataaaattaaaacgataagtaatttaaaacaaagagaacataaattatgttgtgaacggctgattcgagcattagtttcatgcagtgagacttacattaagctgtaattaagcaataccagttcaactcaaagcttatcactcatagatcacgcttctctatggcaatatggcataatctaaaacagttagaaacccaagagcacatcatatcactttggttgtagcataccaaatctttgaatcagtgatgtagcacatgggcaattacaaatatatttacaagttttgggttgttctagaaacctgggattaattaggccaattcgaaatgcataaagaaaaagtataaaacgattggttcaagctctatcctactagtgagtacttttgtttgtttgaagaagtctctgacgttcatcacgagtaacaactaacggatcactaattgagttgtcgtgtggcttgtgcactgaagtccttttctaatctatggtcgaacctttctggtctttggtcacttggagctcatcagtttggactatttgttcaaacatttcctctttaactttattctttatgatgttgacaagacagggacagtattaatggacttgcaaatagcggaagaaacaacggttatatatgcatattttcgtcaattataaatgatagttgttatttgtatctttagcattatgctccgagtagtttcttataattaatttgtgattttgtcgttcacattaattggctctagctttttcgaagcaaatgcccaaaaaaattactacattattaaaaaacaatgggctctgaattctaataattaattaactagccagtggcctctggtacagttttcagctagattatgtcttttgcaccatacttccttgcttgatgctgtttaatcaatcatgccctatggctaccctgattaattaatacaaagtttattccaaataccactgtatcaattatcttcagagtttatttcagatacctgatctgtataaatcatcagagtttatttcaggcaacaccgtatcaatcatcttcgttttgttctgatgctctagccagttcataggaggtgacaggtaatatatgacgcagaatgagaactaaaaaataattatcgccttaatttaggaacaaaccacaaaaacaaaatgaagttgccctgcaaacgtgatggtactactaatcagccagtacactctaaagccatgaaaaaatatgtatgttcgttcttgtagcaagaaaagtattttgttacgcatgtcaactccagttgcaatgtgaacatgccatggaaaatttgaaatccacattccgttcttacgtacggtcaatatgcgccatattgcaaattcttcgtgcgctataattagtttgacaataatgtcatgatttattagagtcttccctcggcaggtttcgccgtttagagaggggttactcttcgcctcacggtaaacacaaagaactaaacaaaatctatcaaaaaaattacttttttcttctaaactttaccccgttacgcacccagacccttcctatcaccgacgataagacatacatcatgtatagattcatagtcaaggtttgtctattatttttggacggagagagtagatggtaagggaaaccctgctcctccacgcatgcttatagctgttggcaagagaaaaaaatcagcattagtctcgattctctgatcttggtctaaagatgctccgttgaagatatgtgagaatattttccttgacaagcaaaaaatggatacgtattttattccaaaagagacccctgaatcttcaacgagaggggaaggtggtgttgaaagaatgagcaactggatgatccttttatttttgttcaagtaaagagttgtactttctcttatcagacgtttctcaagttaacatatcggaactaaacttgtctatcatttaaaataggaaaaagtacgaattacccctccgaactatcgcggtcgtccgaattacccctgaaccataaaaccggatatttttcatcccaaactatgcaaaccggacgaattacccccctcgatctaatccgcggtggttttggtctacgtggcgtacacgtggcatcccagtcagcgttttctaattaaaaaattgtgggacccgcatgtcatagtcttcactttccctctctctcactcttcctctcttctctctctcactctatctcactcttcactgcttcgggaagacacggcggcaacgggagacacggaggagcgggcggcgggcggcggaaggcggcgcacgggggcggacggcggacggcagcgtcgcggcgaaggccgagcggaggcggctgcgataatgtacttttctatttgttagtagaagaattatgctttgcagaaaaacacgatgagctcttgtcaagcttggacttggtccatggactcataacatataatgtacttttctatttgtaagtagaagaattatgctttgctgaaaaacacgatgagctcttgtgcccccacaatatctttttttttccaaaataatagggctaaatagggataggataactcccttcatgatatcctattagcaacgaaaatagctagttctcgatccgatttgctcggaccgaatcgatgatgtacttcccttgtcttaaaataaatcaacttttatacataaattttaacttatagcctatgttcagaggatctaaacatgccctatctataaaagatgatttattttgggacagaggggagtacaatgtattttctaaaacgcaatggatgtggattaggataggtattgctaaaatttgatagatatggattattcgatcttttttatgcagatcattcaataaagtactactatagaataatccattttttatatattactaactaaggatatggtatgtattgttttctaaaatccaattaatgtgaattaggatatggtattgttaaaatctggtgtatatatattatccaatttttgtgcgaaagtgctattggacatgatctttttatattaccacaccatttttttaacatacaaacatattaggaagcaagatcagagtttaggggataaaccccagtacattacagataagatctgaaagcacagagccaccctattgaaatgggaatttaactggactaaaggagtagacttcccgatgaaactgagcagcaaaaaaggagcagattgacggggagctacggcaatgccgtgacaactgcttcctaaagactcatttgacgtgcactccacttggtaggccggtaatccccatcggctatctccatggaaacggcacaaaacagaggtttgatgctgagccgtagattttggggtgagcttcaccggactcagcaaaggatatggaggttgtcattgaatctgaagagctctaacatcaaacctatcaatcgaagtcgcgcatgtggtctgagctcaacccgaatgacaaactcggcatggtttctactgataaagaacaaaagagaagccaaatccaaagaccaaccaaccttcaacatgaaagagtttgagtggctgaaaagagacttcaccatttgattggaccatacaagctcatctatcaattttaataacaagtcgataattccttatgagcagactttgctacgcaaagaatattattttggacaactccttacaagcagactctacctatgtgtcttcatctgcaaaataatatattttcaaatatatcaacaacacaacatatgctatgcacgaagagtccaattaatatccatatataccctatcatgaaccaggtccactaaaatccccgcaaaatataaaatcattaatcattatagataatcaaagtactaaaaatgaggagaaaaaaattaaaaaaaaggcgataatgacacgtaggctggcagcgatcccgagagcacgtccctcccttaaatccacgcacctcgccgaagttccaatcgaaaatcaaatcaaatcaaatcccaaccaaaaaaaaaattcaaaatcaaatccccaaaccccaccatctccatggccgccgccaccgccgccgcgcgtgacctcgccggcgacccgccggagtcgacgctcctccgcgtcgggggcgaggtcgcgtggccggacgtctatgaccgcgacgactcgctcaaggagaacaccaaccccaagtgcatcctcaagacctacggcggcggcggcggcggcaactcgtcgcagaggttctccggcaacctgaagccgacggcggcgccgatcattggcttgtcgaggaagctgggccatggcgggggcggcggcggaggaggaggagggggtttccgtccccccgcgatcttcccgaagaaggccaagaccggcggcggcgggcgcaccccgagggcggcggtgcccgaccacgagcccgggtcgcccaaggtgtcctgcatcgggaaggtcctctccgaccgcgagcgcgcgcgccgccaccgccggtggtcgctcgagacgaggccccgcggcgtcggcggcggatgctgcccggggctcggttccctgttcgtccgccggagccggtcgaggaacaacgtcgtggagtgcgtcgacgaccagtcgccgcccccgcctccgccgccgccgccgactgcggccgcgctgaggcggagggaggagaaggtggtgttgatgaccgaggaggcagcggcggcgccggcgccggcgctgggagggatgacgcggttcgcgtcggggaggagggcggcggattgggcggctgagatggagatggatggccacgtggcgagatctgggccgttgtagcgtgatctggaaaccatgtgaagagaagacatcgtgtacatggaagtttggtttggtttggtttggtgtgatttttagctggttgttgatgtaatttagtgcaagttttgaagtttgtgtacatattgaaaattaggagatgagaatgatgggattcaggtcagcaaactttgtctaattttgttctgttttgatctgtttctgtttgatgtgagttgaatggagaagatttcagtactgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 59663 - DNA, 774 bp, Oryza sativa
acatatttatcaaacttagcaaccaaacatgttatcacaggtgaaacaggattttcaaaatcagctttaaacactcttccatagcgagaaatattcaacacagaatcaccacaagaatcaaaaactttacttccagttttcttaaagtgaacctcaaaattttcatcaacaatttgtgaaaccgaaagcaaattgtactttaagtcctcaaccaaagctacattcttcaattcaaattttttatttaccttaaccaaacctgtagcgagaacgacacttgtagaagcatcaccaaagataatcgattcagtcttggatgccttcttgagtgaggagaaccaatttttatcaccggtcatgtgccgcgaacaaccggaatccactatccacacgttctccttccttgccaccaaagcctacacataagcagaagtcgaagcctcagtactggggttagatgataataaaaatttaggaatccagtactgagacacacgatcagaagatccaataggcatataaccacatgcaaaatcaattttagaattttcagaaaaattcctctgaggccggtttgaccgactcccggtcagaccggccactgtaccgccggtctgactggtgcctggtctgaccgacgctcagtagccggtctgaccgtcgctggtctgactgcgggacccactgcggtctgactggtttcctcgaaggaaaatccgatttttgccaccttgattttgcaaaagcaatctctctctccttttctgtttatga

SEQ ID NO: 59664 - DNA, 9118 bp, Oryza sativa
tagggcaagaaagcacttcattgtttttcacaacatcttccatgaactcaacacgacctaaaacatctttcaatttcaacttattcaaattacatgttgagcaatccaaaacatcatgaggttgttttaactttttagcagaaatcatgttaaacatcaaactaacatgaaaagcaatttgatatttttgcaacaactttttagttaaaaacaactcatccaaagtgcgtgtgtgcaaagcaaaactgcaagcaagagaagatctatttttcaaatcatgtgcagcattaacatctctaatttttgaaatctcattcattaaaacctcacaatttgagcaataatcatcattaggaataagagattttaatctagcaatttcagatttaagagattcaatgataaattcctgttttctatacatcttctcacacttcttttttttcactcaaaatattaatagcttcttcaaaagcacttacctcattatcttcatactctgtgtcagattcaccacgtgccatgaagcaaacatcggagatgttctttcccttatcatcatctccacttccaccatctacatcacttagtggctcaaaggcggcacaaacttgttgaaaagccttcctaagattctccagcatcctcccttgggatgaacccttcggcttgttgttgttggtcttctcaccatctttgtcttatcttttgcctctcccaagcttaggacaatgcgaacgaagatgatcaattgaaccacattcaaagcaacgatttggaccacctcttttcctgttcctggcattattcatagctcaagcaactctgttagcaaccaaagccaaatcctcctcctcgatctgttcgagttgatcatcggatgtggcattaaaaacagcaagaaaagaaggcttagatgaagaagcatcaatatccaaagaagaagaatacgaagaaatcaaagcacttgacttagaatcaacttatcgagaaagaacattcatctcatgtgttttcaattttgtgtaaagtgaatccaaagtcaaagtagtcatagactcctgaatagacgtaactttcatctcccaaatagacatgtcaagaccattcaaaaagtgacaagaaatctcagattgtggataattagtatcataagaagaatcaatagatctaagatcactcaaaattttattaaacctagagagatatcatccaaagcttctccaggtttcatctcaaatttaatgtactcctttttgaaaatatcacgacgaagttctttaatgttatttgttccttgatgaaagttactcaaagcattccaaattttatgagcagttcgaaagtgcgcaacacgatcataatcagaacgagaaatagcactcaaaagaatgttgcgtgctttgcaattttgttcaaaagcagttttttcagccgcagtattaatagcttcaggaatcacataaggatgagaaacttttctctaaatatcataatcttcagccataatataagattgcatcctactacaccaatgagaaaaatccgttccatcgaaaacatgaggcttagttgaaaacctagcgggagtagccatggcaaaaactctagatcgataaaaatccaaagaagaaaacaaggctctgataccacttgtaggatcgaaaaacaagaactaagccaaccaaagggggggtgaatggttggtatacccaaaaaaccgaaaacttttagcggaaataaaagttaccctcgaaatcgacaaaagtcggtctgaccgagattgatctaacggtttgaccgtgtggatgtcgccggtctgaccggtatagatcacccggtctgaccgccgatgtcacctgccgcgcctatcgcggccgccggtctgaccgcccgtatgcctccggtctgaccgccgcttgctgtcggtctgaccgccggtatatcaccggttggactgccgaaactcggtgaaacacaaatcgaagaactcttaaagtggatgacgactttattgattatctctgtatttacaaagtgcaccaacagcactccttacaaaaatttcgactaaactcgaaaccctaactcaaaactaaactcaattgctctcaaaagcgataccgggaagcctcacgctccccctctatttatacatgaggtaggcagcctacaaccacgaaccaaactcatactaggagtcctaaacaccttagaaaaccctctagtacaagacacaaactttacataaccaatcgtaccaaatttggactccttccaaattcgactccgcatcccatacgcacacaatacctccatcgtatgccatatggaatctccaccaaccacgtgcatcaactctagcctaagtatctcgcatgatctctgaccaccacagacgtcgtcttatccccaagccgactcccggtccatcaccgcaaatactctcccgaggcatcgagtcacctacacatgaaataaacaaagaaaccatattccgagaccaagctatctccaacttgactcattagtagcaaacaacagtattatatatgtatagtatccatctagaagccataatcatgaattaatcacagatatccaaataaacaacccgaaaccgaaaccgacacagcgtcggccggttagatcgcgggctggccggtctgaccgctcgatcaccgccggtctgaccggcatacacagcccggtctgaccggtcacataaaataacgaacctacgattcacctgtaaatccaatcatctccaaaaccacttcataaataaattccaaataacaaaaccaataatctccaatgcccaatttgttatcacagaataataatcaaaaacacctttaattttacagattatacaataaaatgttttgtagaaacatcattgaccaatatagaaatggtgggttcgctcaagaaatagaaattatttgtatattgaacaggattctgtgtgtgtgttatgtatgtatatatatatatatatatatatatatatatatatatatatatatatatatatatactccctccgtttcgaaatgtttgacaccgttgacttttatatatatatatatatatatatatatatatatatatatatactccctccgtttcgaaatgtgtgacaccgttgactttttagcacatatttgaccgttcttcttatttaaaaacttttgtgagatatgtagggcctgttcactgtgctgccattttcaaccttaccaaattttggtaaagttgccaaaaaaaaagtggctatatttagtttgctaccaaattttggtaactatataagaaatcaggtcaaagtgaacaggccctttatatagagctagctagattgtactccctccgtttcgaaatgtttcgacgccgttgacttaaaatcattccgattattttctcgtaagctgcggcatatttttttttataggagtagaatgcatggttggctctaggttataaaggctctaatcgatttgagcaagaattatcagccgtagaaaaaaagaaaaattatttgcgaataaagctttttatattagatgtgttatttacctatttacttatggtttcaacgttaaaaatttaagactgaaaaatacgcgctgaaaaaaaaagcataaaattgactccaaaacactttttaattttaaattttgtccacggcacattcgtaatcgattatgtgatctggtcgacgggacggggatggaccagccgtccgagagctcataagtccatcctcaatcacgggaaatcggtatagtcgtttactctgatttggaaacatcattggtatgaacaaacttttatcacacatacttcatcccattttgacttatggatttttatatccaacgtcttatttgatttttttttataattaatatttttttattataagatgataaaatatgaatagcattttatgcatgactttttttaaaaaaagaaattcataaatctttaaattagacgaacgatcaaattgataaggaaaatgaaacccacagctacactaaaaatagacggtgggagtattatccaggacaacttatggaaaacggtactggtacgaattaatatatgctgttagtagctaggagcacaaattaagctttgattgagtgttactactcctacatcacactgctaattaagtctgacccaaaatgccgccagctgtccgcactccacactggtcatgagcgtctgatcagtgatcagtccgtaccaagttgtactaaaaacaaaaggtgtactgctgctaatcaagccaaaacacggtgcaagctaaatactctactcctatgcgtcatctggttaagctacttcaccaacttgctgctactaacttagagtaattacagaaactaatcattaattaattaagcatgaactccttgcactaatgcatgcagcatgcatgcaatgcatcactttggctgctgcttgccgggcttgagggtggacgacgcgccggcgccggccgcggaggcggcggtgggtggccggtgctgggtcgtcgtcgacgtcgaggaggcggcggcgtggttggtgttgagcttggcgaggagggccttgttctcctggttgagtgcctgcgccttcctccgcagccgctcgttctcctccattatgtacacgttctccaggtacagcttcaggttcaccctctccatgccagtcgatctcgatctcctgcactcaaaaatgcccaatcaattaattcctagtcaactaattactagcatttgctgcatgctaagacatgactcaaacggtagctaactaagccatgcattcttgcatcgtcgtactaacagttacaaatgacgcaggatcatgcaaccaagaaatgtgcaagttgctgatgagaagatgatccatggaaaatggagcagtttcaactcgagacagataagaaacaccaagtagtccctcacctttgatctgaagatgctgctgagctagctagagagaaggaagaaggaagatagtactgggatagcaggtttggcagaggaagaagaggagattgttcttgagctgtgcagagcagtggtgttcgcgtagacggccgtctactgtatttatagccctcgtggagtatagtggctgtatgtactgtgtactgtatatctgctctgctctgcgggtcaatcacggcctgcagttcagagttgagaatgaaatcgcgatgaattgatgacgcacttctgcttcgctcaaagatacgcaatcattcctcttccaagttccaaagttgaaatggtactccagcttcttcttccttcccagtagagtctctctcgtgaatcatgatgtggtttgaactgtaatgacaaatcgttcaaatcaatttgacttcatttgactaaaatcaaatgatggaaatgcagagtactctgtccaaaaaagaagggagcagcagcagccagccagccagcagagaagcagtggcaaggcaactccaggatgtaaattgaggtgatgctagtgtaaaaaatataatataattaaaacaagtaaaggtatatcaactaaactattttccaatgaaaatgaaatgctcatatgatcaaaagaactttttctattttgatttgtggctatattaaaatgttcataagtatctgtgaatatattgttttgtatactcggaataaattatgttttatcaatttgggtagtagaatcagtgaggcagcttgcatccttgctatctaggaaatttcttcactaataacgccgtgtttattccaaagtaattcttcaaacttctaactttttcatcacatcaaaactttcctacacacacaaacttctaactttttcgtcacatcgttctaatttaaccaaacttccaattttggtatgaactaaacacccccaacttccaactttccatcatatcacatcacattcaaaacatccatacacacataaactcctaactttttttccaaactaccaacttttcccaaactttaaattttttttaggaactaaacacatccaactaattagacttgttaatgactataactaggaacagggattacacaccaaccagcctcaacagtggatccgccactgccgagaagtcgagaaggaacatttactcttgcactcgattatggcctactcgtagtagcagtgtggtgaagtcaagtctttgctctcatcatctgatctcgcaacggcagatctcttctcttgctgttccaaggcagcagctaatgatgatcagcattcaacctccacgtcttctcttcttccttccatcacttctgcttccaagcttcaattgctctctcgatgagcattattgcaagagctagcagagcagctatcatggcggcatggcgcatcacttcatacagatcacaccacgattcgatgtgaacaatgcatcatgcatgtcttatgagcacaccgattagtgcgagtacaaatcttgaattgtcggtgtgtagagagattttgggtcccggagaattgaatatgactagtagtagattctacagacattttaacatctgcactgagtgacatttgagaatttagcaattcccataaaacaatatgcatagcatacagaaatttgttcaaactactcaagatatggttccaatgaccgagcttttttgttggtttacatgaatcttgtagacttgtactccgtactgtactatactacttcatctgaatttctgatctgatggatgggcaagggatggatgcagcaggtcctactaccggcagaataatcttggattcgagatttggattcttggtctgatctgacatgttgaccttgtagcagcattgaactccatctgtatgactggatgtgtgtgtccgtcttgcattgcaatgtgcagcacagagatcatcatcatgacagagccaactgaagctggcgtcaggagttgcattttcgtaaagggagatctcatggcgcctatagatacgagcaccccatttctgtgagttgtgatcaagacttcctgctggtagttgatgattctgcatctcctctgacaacaacacaaatgcatcctttgcatgcattacttgagagtagttaagggtgtgtttagttcacgctaaaattagaagtttgattgaaattgaaatgatgtggcggaaaagttggaagtttgtgtatgtagaaaagttttgatgtggtggaaaagttggaagtttgaagaaaaagtttggaactaaaatcggcataaatagggcaattgaaatggatggattgattgatggtagcactcctattgagttttaattattaccaacttaaaaaatacatttgtaattattaccattagcaatttaaaaatcatgttaatgaaaaccgagataaaatctgtatcttaatcagaaaagagcatgatctaactaaatacaagaaggtaataccaaggataggtgcaattcccagtgaacaaaaacacattagctagtgatatacttttacgagcacgagcaagatcaacttgggataatggcaccgcatgtgtaaacttgtcagtactgaagaagaaacattgtgttacttaaacaatcttcagcagttagcagtctgatgattataaatcaagttgcagcagcagcagcagcagcagcttgtaaaggactggcaattttatctgaaagaaaaagggagaaaaggaatgggcaattggcaattggactagctgtttcttcctggattattgaccattttattagctttcggtcatctactagtactatactacaaccagaatattcccctagaagagattagcaaatcgacaacagaagcagataggagaccgcccaccaacccgaatatttactctcctttacttaaggaagaattaaacaaagacgtaatagttattagtagcatcagctactgatcattttcatacctaagcaagatctatcaccaccaaaaaaaaaatcattaacaagttcacaatcaataagcgcttccatgatcaacaagttcactgcaatggttcgaataaattcacaacaaaattgagctacatttctccttacaaagctcccaaatctgacacacatcttgtgtccgtatctcctcccattccccctgatttacaaattacaatgggattctacgtatcgaatatgaaatcagtttcaattttacaacaaaattcagcagcagctacacatacacccacgtcggggtcaccgtcaccagtgcaacctcaccggcggcacggtgaagccgtgggcgtcgtcgaggaagggcaccgccgccggccgcgcctggaggtcgccgtagaagtcgtactccgcctcgtagtcgtgcaggtccagctccttcttctggttggtgtggtaatggtgcttggcgccgggcgacttgccgaagccgaagaggctcacctcgtcgcagacgccgagcgccatcaccaccgcctgcatccccgacgagtagtggaagtacctctcgtcgtgcctccgcgtccagttcgccgccggctcgccggtggcggagacgaaccgcctcagcgagtagtacttggcgatgcgcgcgcacagcgcgtcgaggcgcgcgtcggtgacgaggagcgggaacggggaggacggcgtggcggtggcgttgcagatgagcgcgtcgaggaggtgggcgggctggcagacgtacatcgccatgggcacctcgccgccgtacgggtggcagccgcaggcggcgcgggtgatggcgttgcgggcggcgcagatgtggaggatgttggagttgacgaaggagagggaggtcttgacgccgacgtccgcggcgaacccggcgacgcgcgcgttgttgaggcggatgacgaggtcgtgcgcgtcgatctgcgggccacggccggagccgaggagcacgccgctgttcccgaccacggcgcaggtccggtaccggcggccgaggacccccgcgaggtcgcgcatcacgccggccacattccccccgcggccgcggcggcggcggccggccaagaacgaaccgagcgatgccctgaacgaggcgaggagcttcccgtcgggggggagcgcgtcgaccgggacgcggaggcgg

SEQ ID NO: 59665 - DNA, 8219 bp, Oryza sativa
gcgtcgaccgggacgcggaggcgggcgacgggcttgggccgcggcggggcgcgcggggagaaggcgtacggcatgcggaggtagagcagccggtggtggttgccgaggctggggaacgtcgagatcgacgcgttggcgaacagcgcggcggcctcggcgaggatctggctggatccggcgccatcgtcggccgcgaggcggcggaggagggggtcaccgacggggtggcgggacgacgacgacgacgacggggggccctgcagcacgaggaggcggcggcggaaggagagggagaggattgagaggaggaggaggacgaggacgggcgggaggtggcggcgcttcatccccggcggcggtgaggtcgccgtcgtcggtgatggtggcgagatctagtggcggctgccatttagagctcgagtggtggtggtcgccgacgcggcgagtgagtggggttggggagaaattaatcagagccagggagagagagagatgtggtgggacccaccccgacccaagtgggtgatttgggtggatgacatgtggggccagggatgaggtggggtcggtgtgtggttgggctgcaacggtggggcccaggggccgggttcgttcggtgagtggttgctgttgtgagaaacggttggttgcgacgcacgctcacaacgaattcccagaagtagaccgacgaaaatatggtttgcactttgtgtgagtgagaggcaaaggttagggaggtgaactgatacagcgatattctgtcgtaatctcaaagaatcactggtagttcattacgtaagtttgatagtaatatgaatctaatttttttttctcgttaagatataaattttacctcattttttattaccatggttttaagtaggtacattctatgagaaaattttatatataaaagttgatttaaaatatgaaataaaattttcaaatttataatacttaaaaattaattaactatgcgttaatggtttcttattttttttagaaacgaacactgccatatgtggataatattttattgtggcaattgcatctgtaccccaatttcgaagccaattgctgttttacccccacttttttagagtttgcagttttacccctactttttgaatctgaagcagccatgtgcccctgcttctaacagccggttttatctgtgttacttgtagaggaaaaggacaattatgctctcagtggttattgcaattttgctccaattttttcagcttcgtgtgattttgcacgccgaattctctcttcacgacgaattctctcttcacggcagtaatctcaaattaattgtggattacgtttatcatgaatcagattaacgagagatttaacagacgtttggaatttgcggcaacacgaaacggctcagggtttctacttctgcggcgattgcgcgcgttggtggagatggaaccaatcccgtgaaaccaaccaaatcaaaccgaacgaagagcgcacacacgcgaaggatcaaaccgaaccaaaccaaaccatacgtgccgccacgattaaccgcgcggcgagagcgtggtttgttttcgaggggttgcgggcgagcaaaatcacctggtggcggtacttgtagtagccgttggagccggcgatgaggacggcccatctggtgtcctcggcggcgtcgtcctccgccaccgcgtcatccgccacgccgcgctcagacggcaggcggaggttgctctcctcctcccctcatggttcctccatccgcggccgcgtgcccgcgccaccgcgacggcgaggagcgcgaagaggagcagcaccgcgagcggtggcaggacgaggcggaggcggaggcgagtgcgcgccgccagggcttcccgtcctgtcgcggcgcggcgaggcactgttccgtgcggaggaagaagaggcgggctgtctacctcctgggagcgggcgccggcgcggccgcacgccctcggccaccgccgcctccccgccgcgcgctctcgctgtcgcctccgcgccgccccgcgctagggattcgacctgcttttcccgtacgcacgggtggaagactcactcaaccctatccactctcaggggtacaaaggtaatttcataattaccctttttttattttcctttgtatttctttaacgcacaatgtgggacccatcaaacggctgtcacaagtgagggtagacggttgcttcagattaaaaagtgggggtaaaaatgcaaaccctgaaaaataagggtaaaacagcaattggcttttaaagtaggggtacatatgtaattatccctattttatttgtcatgttactacgagttacgagtattgaatggttgaagaagaggaagatcaaaaatgctggaattcttcgtatcttcgccacactgatggcgaaggcacttcagtccagcttcacgtgatccatcatgcctgaacttctattctactcctatcatgttgcttaagctgtttgcgagtactttttgggatcttccatgttcatcaaatccttcaaaaccaagtgacacatagtttagttaaccagggtctcacataaaagaatacgctaatccaggatgttatagccgagggtacaggaaacagtactggatcttccgacctccgcgtcgccctctcgcgcgggcgacacggagggcaaaccctagcccccgccgcctcctcccttcctctcccacccctcgccgccgccggagttccgcgcgaccaaccgtgagggcggcggcgaggcctttccccggcgacgcgacgactcagcgcgaggacgacgacgcggcgcgcgatgggcgggcgacggcaacggcgcggcatgaagcttcggatccggcggtgccaccaccggatctggcacccccgtggctggatccggcgccctgccgctggacctggccggaggcgagcgtcactaccatccgcacggaggaggcggagcggcggcgcttgtgctggcggtcggcggggtggaggccggagtgggcggggtggaggccagagtgggcgcggcggagctggccctcccgcggtctgactggaagggggcggcggggagcgctggacccggtgcccggtggcggctagcggcgcatgctacagcgacggcgggccggcacgacctcgtcggcgccacccccccccctctccccactcgtcggtgatggctaggcttggcgcgccgatccgggaccctagcggtcggatctggggttgtcgcctcgtcgcgcggcgcggtggacggcagtggcaggagcggcgccgcgtcgaagcggccccggcgctgagggcgggttccggccggcatgtgcctcgggcggcgtgcaccgcgacaacggcaatggtggtcggtgccccggccctcggtcgatgctcaggggcctacgtgcctccggagatgctgcggctagtgatggcacgacttggcggtgcgtcctgcgggtgccgtcgccaccgcaccttcgtcgtcccttgcaacagaacctcttccgcttcccctccccctagtatcctcgtttgtgtgccctctaccccctagttccaaacatcgctgatgattttgcccttcaacttcttctcaatctggcgtgcttgtttggaaattgtgctcctctatcagctcggattgctacggttctatgccctcctccaaaagttgtcgttgatgtttttcctctgtgagaatccccttagccatttccccttctgtctagccccgtgctcgtcttcaccctctttctccagatgtccaggaccgcaaggatcagtgtttctccctcctttgaggcttccttcccttgaagggcgttggagaaagttgatctaacaagcaatttgataaagcctgattgaagaaaacttaatgcgggtggcctcgagccgcaaccttcagtggccctccctcctttagggcttccttcccccaaagggcgttggcgagctctgatccaaacaacaacaagatcaagtcagcttcttgatggcttcatgctggtggctttggacttcaacagcattcccttgcctctctttttttcgacatgcttgtggctgtgtgaggaattggatgttgcttagttggggtttagcagtaggttttggaatttggcaagataattttgcaggtgtcgttcatcaattgtaatcttttaggagtttttctttctctattctctcttcgttgtatttctccgtgtattctgtttttctatcctccagggccccaggccccctgcgcttgcgtaggtaaagcttgctctgtgtaagatcatttggctcaatatatttaggtggggattctcttcccccggtgatttagtcaaaaaaaaaaggatgctatagcccatcacatgacggcattggagtgttaggagtcatagtacctgcccaaaacatgttgacgatacccatagtaacggatccaggatttgagcaaagggtattcaaagttgaaaaaaaaaatcatacagaactcaaaaaattggactgggaaaatcatacaggagtggtaatgacatgtttaaagccttaaaggtacaaacagtagcacaatagtcaagatgtctatctccaaatgcacacttggggacatatcactatcatgggcattgggtgcttcaagtagtagctgaataggactagaaggggcattttctgggatctgaacttcactctcattggttaatggttttggatcagaggtggaagctactttctgagacttggttgacctttcccacaaagacttcaattcttcttcatttttcaaatttcaagacctacagttcaaatttctgactgactaatttaacttctaagcaatagcaattaagcaatggccaatcgattggggaatttgacaagaggatttattttaccagtgtcagtccactgtccagccgtctagggaccaaggggacgcgccgacgcgggggtgtgtcgccgcaactggctgccgccgtgcgccgcaacgccgccgccatccgtgcgaacctcagctgctcagcgtcacccgtccccaaggaggcggcggtgtcgtcgcaggccgcgccacctccgcagcagcaggcccagggaccagggtccagggagatgaggctggtggcgattctggcgacgcgccgagccggcggccggcgccgccgagcgtcatgctctcgatgccccgtcgcccgtcggtggggatgagtggaggcgtggcggattggggctgggacgacaagaggggtggggactggctgactgggggataggaactagggatttgttcgtttttgggccagtgggcctattcgttgggccaagatggggaggaatgtatggtctgttgcgaataaatgggcttcttttcatttggactatacatgctgcacttccttctaatttctcatgtatatatgcataacatacctatatatagttttttttttaaaattctatgggtattcaggtgaatacccatgaatcacatgggatccgcccctgaccaatagtacatgtattatatatcctcgtattattttctccctttttacatacgcacgcttcccaaactaataaacggtgtatttttaaaacttttaatagaaaaaatacttaaaaaacatattaatctatttttcaaatttaaaacaattaataatcaattaaaggtctatttagtagggctccaactcctaaatttagctccaagggctcggtctggagtagagttgtggagcagtctaaatccagctccacatctctagttcattttgtgaaaaaactccagctaattctagtcacattttggatggaactgaaactatttttctggactctggcttcaggataagtggagccaaagctctgccaaacatgccctaattatgggtctcaattttgtctcttgatcttctcatctcttctcaaacacaccatgggtcaattggattcatgccattacaaatgtgcatgttttaaaaaatatcatcacaattcacctaattagaaggataccattacaatttttcatatatcttaaatatgccatattctacgtcccaaaggctattggacccatgaatagaccaatgtattttcgtatagtctaaaatacccccatatacaccccgctgacatgtggaccctgtcgtccatatcttcacggccacagagagcaaggcatcgagtcacgacgccgctggccagctgcacgcaccgtcatccctcacccgcgcacgtgactacctgtcggctgctcgccaacgcccccgcccaagccacccgtgccattaaccctctcctcgagcttggcgctagctccgccatcacctacccgagctcgcatgctgctttcatcctttcggtgcgatggatgatgtggcatagagggcagatccggcgcccggctccatcactgtcttggggagtagggatggcaacgggacggggcggggccgggttaggctggaacgccaccgtccccgacccccgacttcaccccccgcccctggccctgactgttgatacggggccaaatcaacccccgtccctgatctctctggggccccgcaacctgaccggggccccacattggatagcatctccatccaatcaggaaaaaaaaacaagacattcatcaaattggcaaaaacaaaaattgcacatacttgacacaccataaaaaataggatgaatcgtcggccaccgtgaatcgccggctgccgccgcacctatcccctcgccggccgccgccgcacctatcccctcgccggccgtcgcgcctttgccgcaacctcactggccgccgcgctcttgccacaacctcgccggccgccgcgccttaccatgtgatcgggtctatgcgccatcccgtgcgtcgtttgcactgccggagggagaggtggaggtggactcttgagggagaagtgaaggggacgggatgggaggctggaggggagaggagaggaggggaagggagagggcgaccggcgacgacgagatccagaggtgcgccgtgcaccctgcgccgcgccaccgtcgtgcgccctatgccgcccaaccgccgtgcgtggtgtggacgggagggagatggggatggggggactagtgagaggataaggttagggtttagtaattttgtttatatatctccgtttttttctgggttggactgttttggaccttttatgggctatattttgagagttcatatacactccccggccagcgggtcacccgtgggtgaaatgtctcccccgtctcctccccgcccaaatgtgggtccccggccccgactcccccgtaggggacccagtcctgcgggggaaattgccatctctattggggagtttgtcgacaacatcaagcttcgtcgctgcctctgatacggggaaatgtagcaggatcagcaaggagaggagaggaggcgcgagaagagccagagcaaggtggcaccggggagacgccaacgcaccgccggtggagcaggtatgggtgcgacggagggaaggttgtttgcgacgaggctagactccatgacggcggcggcggcgtctcctgaactaactgtcggtgaaagatttacccacaatttatgccaaatgacatctacttgaatgatgatgatgaagtcatgaagagtactttttcacctaaaccctttctgaattagccacacttcctatttggattacccagagttttactaaaattttaaaatacgtatagactatagtataaatgcatacaccttgtcacatatagtgtatattttagttgtcaatcaacattaaaattcaagaagctttattgcttctttggtacagtacaaagtatatacatttataaaccgctttacaaagtagtacgaagtatttacaaagctttatgaggtgtgtgtttctttgtacgaatgcacttctagtccaatcaatttataaattagttttgctaataaaaatatggtttcatatcataacttacaaattaaccatatactatataatttatgtgagagagatttatcaagtagtataatcatcaagagaatcacactacctatcgtcatcctagtttctcacacatcaatacaagctgatggaatacttcttgttgcaagccgggttggatgcgaggctggtgatccacacctcgtcggcgaccaccgcctcgtcgtcgtcgttccgccgccacgtccacagcgcgtgcgtggcgttcaccacct

SEQ ID NO: 59666 - DNA, 1995 bp, Oryza sativa
ggttaccccgcacatactcgtggctatcatgtacttattttggagactaacaaaattgttgagacttgcaaagtttcttttgatgaggctagtccaggtactagacccgatattgcaggtacactgtcacaggttcagggggaggatgattgtatttttgaagacgagagcaacgacaacgacaacgacaaggtcggctcggccggttagaccgggcgccaggccggtcagaccgccggcacacctccggttagaccggcataggaggtgcggtcagaccggccagggtcgtcggctgagggttctgttgatgctgtttgagatggtcctctagagattacaacttcgaccagtactgatacagaacatggatcaacttcagaagtcactgctcctttgcacatttaacgacgacatccgccggaacaaatcattggtaatataggtgagcggactacaaggtctaaggtaacgactcatgatgtttgtgcaaattctgtatttgttgctttttttgaacccaaagatgtgtcacatgcattaactgatgaattgtgggttaatgccatgcatgaagaacttgaaaattttgagagaaacaaagtttggactttagttgaaccaccttctggacataatattattggaactaagtgggttttcaaaaataaacaaaatgaggatggtttgattgtgagaaataaagctagacttgttgctcaaggttttactcaagttgagggtttggattttgatgaaacttttgctccttttgctagaattgagacaattagacttttgttggcttttgctgcttcaaaaggttttaaattgtatcaaatggatgtgaaaagttcttttctaaatggttttatataggaggaagtttatgtcaaacaaccaccaggttttgaaaatcctgattttcccaaccatgtttataaattatctaaagctttgtatggtttgaaacaagctcctagggcatggtatgataggcttaagaactttttgcttgcgaaaggtttttcaatgggaaaggttgacaaaacgctttttgttcttaagcatgctgataatcaacttttcgttcagatttatgtggatgatatcatctttggttgttcgactcacgctttggttgtagattttgttgagactatgcacagggaatttgagatgagcatgatgggtgagttattgtactttttgggattgcaaattaagcaaacacctcaaggtatttttgtgcatcaaacgaagtatacgaaggatattttgagacggttcaagatggagaattacaagccaatttcaacaccaattggttctacagctgtgttggatcctgatgaagatggagaagctgttgatcaacaggaatatagaagtatgattggatctttgttgtatctaactgcttctaggccagacatacaatttgttgtgtgtttgtgtgcacgctttcaagcttctcctcgtgcttcacatcgtcaagcagtcaagcgaataatgtggtatttgaatcatacacttgagtttggaatttggtattccacttcatgttctatatgcttaagtggatattctgatgctgattttgggggttgtagaattgataggaaaagtactagtggaacatgtcattttcttggtacatcattgattgcatggtcttctaggaaacaatctagtgttgcccaatcaactgctgaatctgaatatgttgctgctgctagttgttgttctcagattctttggcttttatctactttgaaagattatggtcttacttttgataaagtacctctcttttgtgataatactagtgttatcaatattgctaagaatcatgttcaactttcacgcacaaagcacattgatattcattttcactttttgagggatcatgttgagaagggagatgttgaattgcagtttttagacacaaagttgcaaattgctgatattttcactaaacctttggattctaat

SEQ ID NO: 59667 - DNA, 8423 bp, Oryza sativa
ttaagtaaatatgcaatgttgatgctagcatatggtttgatttgtaaatgctctatatatatatgctttattgacttgttattcctcaaatagctttaattgctcattgtgaaaaagagaataaaaatatgaaaaaaatgaataccgaatccttggaaacagtcttgacgacagggatgtattcgatgtgagaaaaataatgggtgccgaatctctagaaacagtcttgacgacagggacgtacctggaataaaagagaaaaatatgagcaaaaaggctcaagaaaaagaaaagttaaaaaaaattctcttggttattttgtgctaaaggttatttgagaaagagtgataaatgcaataggtgtatgagtttagtgtttattcttcaacctatgtgcttgttaagatgttgcattataaatcgtatgaaatcatgaattttgattgttgattcaagcttaattgtaaaatctttggttcatggttatactttaatgcatgcttgttatattatagatggatttatcttctttttattgcaacacatgacttgatatatatgtatgctaagcccttgaatattaataaacataattcctatgcttgatgaaatcattgtcaaaaggaggagaagtaatgtgaaaatttttggatttttggagaagcaaggtgaatttttgacgagttgttgagaagagcatgtttttttttgggttcatgagggaatttctttcttttaaaaagggggagaagttttcttctggattttcgagcacgatgtgtacttttgtacgaagtgtgctttttaccaattttgtttttatttttccaaacaccaaaacatttttgatggatttgccaatgtgttcatcaagggggagattgtaaaatcaaatgtgtttttgattattattctgtgatgaacaattgggcattggagattattggttttgttatttggaatttatttacgaagtggttttggagatgattggatttacaggtgaatcgtaggttcgttattttatgtgaccggtcagaccgggctgtgtatgccggtcagaccggcggtgatcaagcggtcggactggccagcccgcggtctgaccggccgacgctatgtcggtttcggtttcgggttgtttatttggatatctgtgattattttatgattatggcttctagatggatactatacgtatgtaatactgttgtttgctactaatgagtcaagttggagatagcttggtctcagaatatggttactttgtttatttcatgtgtaggtgactcgatgcctcgggagagtatttacggtgatggaccgggagtcggcttggggataagacgacgtccgtggtggtcagagatcatgcgagatacttaggctagagttgatgcacgtggttggtggagattccatatggcatacaatggaggtattgtgtgcgtatgggatgcggagtcgaatttggaaggagtccaaatttggtacgattggttatgtaaagtttgtgtcttgtactagagggttttctaaggtgtttaagactcctagtatgagtttggttcgtggctgtaggctgcctacctcatgtataaatagagggggagcgtgaggcttcccggtatcgcttttgagagcaattgagttgagttttgagttagggtttcgagtttagtcgaaatttttgtaaggagtgctgttggtgcactttgtaaatacagagataatcaataaagtcgtcatccactttaagagttcttcgatttgtgtttcaccgagtttcggcagtccaaccggcgatataccggcggtcagaccggcggcatacgggcgatcagaccggcggcggcgacaggcgcggcaggtgacatcggcggtcagaccggcggcatccacacggtcagactgacgatcaatctcggtcagaccgacttccgtcgatttcgagggtaacttttatttccgctaaaagttttcggtttttaggtataccaaccattcaccccccctctggttgtcttagttcttgtgttttgatcctacataatccttctacttaacggacaatctctactacttcctccgttttatattataagacttcctagaattgcccatatttacatagatattaatgtgtctagatttattaatatctatatgaatgtggacaatgctagaaagtcttataacctgaaacggaggtagtatttcaaagtgagtcgtggtggtctctgtttttcctttgtaattaaataatagatctaaacaaatttccaatgagctgcgaaatttccagctaactgtgctgtttctactagtaatacgacttattagatggtctgaaactctgaatttgtttttctgaaaggtctgaaactctgaattgataaaagatagtatcacgtttactaagtaggcagcctactgggcaacctaccatgtcccctacgtcatttcccaacaatctgcaccaacaaaatctaacaaaaaaagaagaaaaagaaaaagaagacatcgagacagacatatcaacccaaccaccatcaagtccccgactctctctaccacgtctatacgcgtgcaaaccgcaaagcatatatacacctacactgcactgcactgcattgcacgtacccaaccgatcgaaatcgcaccaccaagattaccatttcacatttcgcaatggcagccgtagaagcaaacgccgcaacgacccaccatgaaatcaccacggccgccgccgtcaccgccggagagcggcagcagctcaacgccggcggcgaggacgacaagaatattgggatgatcgtgactgacgacgatgacgaagacgaagacgacgagctgttcgagctcgacatcgccctcatcgaccaccgtgacggcgaagagtactacaccaagcgcctcgtgacgagcagctgttgcgtcgctgtcgccgccgcagccgccgccgccgacgacgacgacgaagaagacggcggtgacgcgctcctagccaactgcctgctgccggtgagctcggtcagcagggcggtgccggtgacggcgagcagcagcttcgtcgtcgtctcgtcgtatcccgttggccgccgctaccacggcggcggtgggtgcggcgacgacgacgacgacgacgctagctggaggtggaggaggttcttcttcacgtccggcggcggtggcaggacgcgtattggccgccacaacagcaataactctgcgaggttctccttctcaagattccaaagcttggcaaattttcagcgatactgatgaacgaatatgttctactgattcaaaggggcaagaaagagagatgaaatttgacgtgtatatatagccgatgtacagattgagtttctgggattgaaattttgtactagctagcttagatagggaaactattttaacagctcgagtggatgtccacccgtttattgcatgtcatctaaatggttataaaaaaaattaaaaaaatatgaataagatagatcaatatgtaatgtatcaatccacaaacatacaatttaaaattcaacttctacagattgtaacaaaaataacaaacaaaactcaaattactatatgtatatttacagttaaatttgttatttttgttacaacttgtagaaattgaattttaacttgcatgtttgtggagtgatatattacatattgatctatcttaccaatttttttgaaaatttttcgtagccatttagttgacatgcaataaacaggtgtacttccactcgagctattagaatccatcccagcttagatatggtaccaatcttatcaaattgtgcaaaattttcagttgtttggaattaagggcatttgtgattttactggacaaaatttatgtctgttacttcaagctttgcccggcaattgtacaaaattattctaaatgtaaatttaaaattaaacttaatttaagttagtatctttttgtggtaaccgccagtttagagcgtgattgaccattcaggtcaagagaagagaatgtgcggtggttgactggtccatatgtggccagttgaatcggatgcccacaaaagaagcccacttaggccttctctgtataggccgaaattttggcccatatacatttgagggccgaaccaaatgaggcctcaattgcaaatttacttttacaatgtgcggcccaagcctactactggtagacatacgctccgcttgttgaataagtacggtgtacggccacctcgccgtcgcggccacggcccctctcctcggcgagcacgccgccgcccgcggcggcgggatatcccctgtagatgaccacacggtgatcgtctccgccggcccgggacgacttccacggcgagccaggtgaagcgggtgaggattctctcggcctcggcctcggccaacccatccccatctgattttacagttcattgttaccgcatcattctgtttgctgcacctgcgctctctgctactctgctgctggtccgactgtttctgcgcaggagatttgggatttccagcagattacacgagtatgcttcaaatttctcatcatgttgtgctaatggggtacagcctgattagcaatgggggtacacttgtttgtgtaaattgggattagatccgaatccaatccgatttctagggaggttgagatttatgaaatgatattcatctagaatcaagttcttagagggaaatgttgtgattcaatgggaaaaggggaaatagtggaggagagctcatagcctgatagtcagattttttgcaagaatgtgtacatgctacagaatggattattgccggccgtttggatgttcctctggatcaccgacaatttcatatgggtgttcctctggatacaatgggtacatcccttttatgtcatgtttttaggaatgtggtagcaggctagcggcgctggtgcaatacagttaggagggtcaggagggtctttgtttgtccttctacaaggtgacacaacaagatctaacaaacttcatgtccagcagatcgcgtgtcaacaaaagtgcacatcttgtggagccagaaagtgcatttggtggataaagctttttttgccagctagcccctgtatcagttatagattgctaatatttgcatgtgaatgcactggtatttatcatgactctcaatcttcttacaaaaacaatccattacttaatttttgatacgggaaacaatctgacactgatacaatctgtcaaatgcatttggtttattgtagattttcttgaggcaaatgacgtaatgatgaagccttgatccacaatctagtgatgtggcagataatgtagacgacaggagaaactattggatggtttttatttatcacagcggggataatgacagctggaattttttagcgtctcctggcagcagtctctctctgagcattgaagtagacagcagcgacaggaaggccaagttcgttctcctcagcaaactggcgtgtattgaaatgatccctagagatggcacaactacagcctgctacgcttctgcttgaagagcacaaaaacgaacctgtggataccaatgctgggctttgggctctcatagcttatgatttcccgtcctgcaattcaaatgccagaaagatgcatattaagaacaaatacatgcaagcatggaatgatctaatgcaggttagggagaggacctaccaaaagaggcatccgttgttccaggtatatcagttacaatcctgcataaatattaagggtaaaatttaatgatttggccacaccatggtcattatctgttcagaaatatattgttttttggaagaaatatttttcttattagaaatatgatgttttgtatgaaaacaagaaaaatatgtggtattagactactagtgccatctccatcagaaacataaattttatagtgaatcaataatcaccaattggacacaaatgtatagattttggataagaagtgttgaaggttaccaatgtaggtgttcccttagatatggatcacttggtcctggcacatctgggtctgtcataacctgaagcattccgagttatggttaataggggggggggggggagagtatgaaatgcactgaaagctaactatggaactcccaggatagagttagaccagtccgtaccaatgtgaagaaagaacgcatatcacccccttggacctcgactcttggtttagatacaactgctgatgggtagaactcatggccattaaagacaagcttgtttgaattgtaggttactatcatcttcgtacatgggttgaatgaatcaataacttctccgatcacccgcccaacaacaagaggctccacagacctagacatggttggagccttggagggacaggtaattatattttccgaaattagtgctctggctagttgtaaatgacaaaacctagtgcacttcaatgtgcccttggttgcttattgggcattgtagagtgatgagcctctatttatagtggcaagaagcatgctgtcttctttcaagttgtagacttgtagggatatatgatagaattttccaccagaatcataagatatgtatgaatgtgcatatttgtttgatcttatttatacatattcctctattccaggccttcttttgattatttataattttatatgcatgtcctgaagattaagaaaacacttacttttttatttgattgaaattaaatgtttttaaagtaattttatttttcttgttattttggatatcaactctggacacaaacttgaccattaatttatctcactatatgttagtaatatattgatatgacaggtttttaattatcagtcctattaataccattttacatgacaaatccaattaccctttttttattgtagcataatctaaatcttactaggatagattgcaatcattctaaattatcattaaagaaaaacagagggagtatcatagatcactacctatgttatttctttatgaaacataagacacttcaggcaaggagatctctgaagattatgttgctgaatttatgttatagtggtgggaaaaggggctcatgaccctatatgtaaggcctgcatgacaatgcagtctgcagaatttttgcacactatcaaattgtcatgtaatttctatacttttctaaagaaaaacagatgagctattatacaaatttattttttagttttttggcaataaattgacagatgggttttggggatggagctgcaaatagccacaaataccttaccgaaaagaaacatgtagataaaatttcccacttttaggaggtatgcaattgtggataaaatgagaaaaaaaaagaaaaggaaagggactataatccttctggagtgatgccgttcacctactccctctgtcccaacaagaatcaatgaatctggacaaacacttgtccagattcattgtcctaggataggttatactaagttgattctttttgggacggaaggagtaaaatacaaattcattcttgattgctagatttgatgttacactacggaaacataaaggcttggcttgctgagattcttatcctactgttttcaatgaccttcttttgttatctatgaggcagatgcactctacactgtctgcgtggaagcctatcaacccccaaatgtttgtcgttagcagccttgtttgtctgggtaagtctcacgtagcttcttctttttctgttaacaaaaagcaagctatggagttgaaatgctgttggaatttttctttctcaaactgtgataccaactggattataccattattatctgtttactctcttccttggagtgctatggcagcacagcaaggaacagaataaacgaatgaggtgcagcgccgcactgctgccaccacttcaccgtgtgggggtactgtctagtgctgagatgtcacttcactgataaaaagatcataggttcttcttgattgaggaattaaaaatacttctatattgccataagtagtggagccaagtacagccttttgcactgtgctcttttggtctagtgctatcatatttgcttgacattttgtgcaagtaaaaatactgtagtcaagtacaccttggcagcatttttctactcctaatgccataatatttgcttgacacagctgatttagtggaacctcataactgttggctgtaactaatggtaacttatctgtgatgtagactagcagtgcacctttagcttggtgtgctgacttgtcactagtggtcaggacaggcgtgcaaggtcagctgtgagttatcattgtatttcttagacgaatatttcttcagctgttttgtaacaggtaattctccactagtcacagaagattaaaattgcttatcaatattgttctgcttcgctaatcggtttgtataacccttacaca

SEQ ID NO: 59668 - DNA, 948 bp, Oryza sativa
agttgtcgacatcgatgagagatctttccatttcagttcttcaagcactctacccgcttgggaaacatcagtctggttcagtttgctgtcaaaactacccatatcaaaatttagtaatgccaaactttgatattattaaatttcagttttgtatgtatttggtttgtgccctcaccaaattttcaagtgtttttatgagaggaaacttctgaaaattctgaagctgggtagagtggcattagtatgaatatgtttagccagcatttggtaatatcgaaatttagaatggatgaaagcggtaacaactaacaaaccgaacaagcccatggtcccaactcccaaaccttcatgagtgaagaaagggaatagtaatttgtaaaaaatgtattgactgctggtgaggatatcttgttctgaatgcctgacaccaattgcacgcctatgcttacctgcactgaaatgcgacatgacaaggcgttcttgatgaagcacaggatgagaaacacaagaatgcaggacagctgatggcatgctgtccagcgcaaactgtcagtacgcacccagataatggtattttcgtaacatcaataaaccagaaaaaaattcaagctatctgcaaaacatagttgaaaataattttaaaaaatggattttcatccttaaagagacattcacttgtttcttgtaattgtatgccacctaaatagtcataaaaaatttaaaacatttaacaacatagattaatatgaaaatatatcactccacaaatatgtaaggtcaaatttagttacaagttgcaatagagaacaataaactattaactaaaatagttaatgtacattcgcagttatatttattataacttataaaagttaaatttaaacttgcatgtttgtggaatgatatatttcatattaatctattttatcaattttttaaaaaatattt

SEQ ID NO: 59669 - DNA, 708 bp, Oryza sativa
tcctgcagcccttggttttgttatttggaatttatttatgaagtggttttggagatgattggatttacaggtgaatggtaggttcgttattttatgtgaccggtcagaccgggctgtgtatgccggtcagaccggcggtgatcgagcggtcagaccggccagcccgcgatctaaccggccgacgctgtgtcggtttcggtttcgggttgtttatttggatatctgtgattaattcatgattatggcttctagatggatactatacatatataatactgttgtttgctactaatgagtcaagttggagatagcttggtctcggaatatggtttctttgtttatttcatgtgtaggtgactcgatgcctcgggagagtatttgcggtgatggaccgggagtcggcttggggataagacgacgtctgtggtggtcagagatcatgcgagatacttaggctagagttgatgcacgtggttggtggagattccatatggcatacgatggaggtattgtgtgcgtatgggatgcggagtcgaatttggaaggagtccaaatttggtacgattggttatgtaaagtttgtgtcttgtactagagggttttctaaggtgtttaggactcctagtatgagtttggttcgtggttgtaggctgcctacctcatgtataaatagagggggagcgtgaggcttcccggtatcgcttttga

SEQ ID NO: 59670 - DNA, 11126 bp, Oryza sativa
ttatgcaattgttttgaacttcttattcacattgttcttgactcttctcaaccgtaagtttgtgctaacttcatggacccagacaacttagaactgcaatcaaaatagtttctcattctcacaactggtgctccttcacagctattgggaatatacaagctgttgtgtccaaagatgatattcagcatagggctcctaggaggaagaatggcaaattagccctagagctaagatcttacctgcactcagcttcattgaatggtaatgctagataatgaatccctgtacttacatcacaattcatttttacccttttactaagtcttcatattaactgtgttccagggcataatctcaaggaccagaagggcatggtgttaccatttcaacccctttctatgtgctttaagaacatcaactactacgttgatgtaccagcggtatgtcagggggaggccggtttatatggctgaaatttcttttaaaaatctatgtatattgattcataatcaagttttgcctagcaggaattgaaaagtcaaggtatagtagaagaccgcctacagttgcttattgatgtcactggagcatttaggccagggatactaacagcacttgttggagtaagtggagctggcaaaaccaccctcatggatgttttagctggccggaaaactggaggactaatagaaggaagcatcactatatctgggtatcctaaaaaccaagagactttcactaggatctctggttattgtgaacaaaatgatgtgcattcaccttgcttgactgtaattgagtcattgctgtactctgcatgcctccgattgccttctcatgttgatgtgaacactcgaagggtaaagtcttggctgggctgcagtgctatgtttattgtacaagacatcactatttttgtcattctgatccctgatggttcatttcataggtttttgttgaagaggtgatggaacttgttgagctaaatgcattaagtggtgctcttgttggcctaccaggagtgaatggtctgtcaactgaacaacgcaagaggttgacgatagctgtggagcttgtggcaaatccttcaatcgtgttcatggatgaacctacatcaggattggatgctaggtcagcagctattgtgatgagaaccgtacggaatattgttaatacaggacggacaattgtgtgcaccatccatcagccaagcatcgacatattcgagtcatttgatgaggttaatttctttacaaaacctagtagtcaatttatgcatgcatgacaagcaatagttcaaaagtcattattttgagctatccttttcgtgacatattaacaagttgagcacagattttgatattttttcgaagcaacagtacagattttaataatcgttcataatttgatgttaatcagttttcttatcaatgatggatgtgaacagaaactagtcccttttacacttgatctgttgaactttcattgtgctacttagggaaaccgcgaaattttcttatacaagtatgtactaacatttaaccagcaccctttcctaactcattcatatgctggtcagcttttgttcatgaagcgtggggggcaacttatatatgctggtcccttgggctcgaaatcacgcaatctggtcgagttttttgaggtacaatctgcacaatgtgtttcctcagtgatgatagcttatacaagtttctctgtccttacactttgcgttcgcgaaaaaactgtccttacactttcaagtttgtaaacaggcaattccaggagttcctaaaatcagggatggctataatcctgctgcatggatgttggaagtcacaagtactcaaatggagcaaattcttggagtggattttgctgaatactaccggcagtcaaaattatttcagtaaacacaacgacccttttcacctctataaatcttggtctctttttccttaaacatgtttatgttatggcattccaggcagacccaagaaatggttgatatcctgagcagaccaagaagagaatcaaaagaacttacttttgccaccaagtattcccaaccattctttgctcaatatgctgcttgcttatggaagcagaacctgtcgtactggagaaatcctcaatacactgcggtccgattcttctacaccgtcatcatttccttgatgttcgggacaatctgctggaaatttgggtctcgaaggtatgtccactgatgattctgtctccacttttcttcctgtacttggctggccttatagcgaacatgtggctttgtttgacagggagacccaacatgacatattcaatgccatgggtgccatgtacgcagcagtactcttcataggaatcactaacgccacctctgttcaacctgtgatttccatcgaaagatttgtctcgtacagagagagggcagctgggatgtactcggcactgccttttgcattctccctggtaattttccctgtcaaaaactcctgtcatctcatcatgttttgatgctcgtagtagtaccataataaggctaacaatcgaactgttcttcggcatgcaggttacagtggagttcccttacattcttgtgcagtcacttatctacggcacgattttctacagcttgggctcgttcgagtggacagcagtgaagttcttgtggtacctgttcttcatgtacttcaccttgctgtacttcactttctatggcatgatgacaacggcgatcactcccaaccacactgttgcgcctattattgctgctccattctacacgctgtggaatctcttctgtgggttcatgatcccaagaaaggtacggaaggaacaggaaccccatgcataatttgcacctaacgtcctctaattgtactggacccatgatctgttttccccataatccatattccagtgcacattatccatatctttattttttttgtcacattagcatatatagctatggaaatagtgtttccaatccataaggccacttccagtgcacattatccatatctttatttttttttgtcacattaacatatatagctatggaaatagtgtttccaatgcatattatttattactggggccaaaaatgaattatctcccttcgcaaatttcatcagaaattcttagaggagatatctattttcctggtttgaatatatatgcaatgtctcatccgagacactcttttttctttataattccttagcacatcatctaaaatgctgctatgttgcatagtagtttttagtttctattaacattgtactataatggagcatgagtgccctgatataccagtgcccctaataatttcaccaaacccaccagtaactttttttgtcctacagtgaccacttgtcatgtactagaaccactttagcaattgggaagcaataatggtttgtttaaattaggacgtgattaaagtggctaatgattaatgggcttaaacataatgcagaggattcctgcgtggtggaggtggtattactgggccaacccggtgtcatggaccctgtacggcctgctaacctcccagttcggcgacctggatcagccgctgctgctcgccgacggcatcaccaccaccaccgccgtcgacttcctccgggaccacttcggcttccgccacgacttcctcggcgtcgtcgccggcatggtcgccggcttctgcgtgctcttcgccgtcgtcttcgccctggccatcaagtacctcaacttccagagaagatgagacgacgacgagcgagaagcgagctatagggagcacgacgtacaccaccattaattctctggccagctatagcgctcaaatgtgtactgcaactactatgcatgcatcaatccatttcgtttcttcagaactgcacgcgtctcttctctctgtcgtcacgatgaattcctcccggtcacgggagatgctggagctagcagagatcagagaccagcagaaaaaaggagacaagtgtatagctaagctacctgttgcaagcctgtttggcagatctccaacaactagatctaactcggagctaaagtgaagctgtggaacagccgaaacctcgcctcattctaatttttttcagattattttagcctgtttgagctgaaactgtttggttggatagagttggagcgggagctctatcaaacaggcaagtgctccttgattggcttgatcgttatactgcgtacgtagtggctggtgcggcagcagtgcaatattcggcgagcattttgcagcagccacggtgagccaatgggaggtcgacacctgcaagccttttgactgctgcaaccggcgtccctccatgggggtactcttttggaagtagcagcagcagcagcagctagctatagcagattctgcgtcccctggcctctgctgctgctgcctccgaggactgcaaaacaacaacctagctagagcagcaactactactaacaagaaagaaagaaaaaaaaaagaaaaggaaaaggaaaggtatgaggagtactgtactgagtactaaccatttggtgatcgatcgatggtgcgtggcgatgagagatggagaagaaacgggattgattgatggattgaagatctaacaccttcaaaaggggggcagtaggagcatcttctacctgcatcgcaggtacgcaacaacacatgcatggatcgatccactcgtcccagctttttattactaccatctttccttcctttttttttccctttagagcaagataataatagagcacactttctattattagctcatcttaaagccaacatatataatagattagctataagattgactataattttcttctcatctctctatctctcacttatatatttaatgcatttgtcttagagctagtgataagctagctcttgcatgagagccaacattcttaatttttcgctacctctctcctccatctaagcttatagtaggcttatagctcactattatacttgctcttagtgagtgtttggcaaatgggaaagggaaatgatttcccacccatctttaaatactaaccattcattctccctcttccatttaatcctaaccctttattcattttccaatcccaatcccaccccctattttccattatccaaacacatccttatatcttctacttctcgagaggaatatatatgcagctactagctatagctagacattcgtgtccggacgtataggaaggtattcccagcatcattcatccgtgccgtgtgcagcatactgttttcttaagcccaaaccaccaatagcgtttcacgatgatcgatcaatttttttatatattgatgacagtttgtaataaagaaagaagcaacgaatcgatcaaattttacatatgttaatggcagttcgtaaatggtaatggtcgagctgtctccaccagtgtgtatacatatacatacgtacagtggtggaggcagcttgatctgctgctaatgtatatacaaatatatttggtttgttctctctatatacatacgtatatcttgcgtactcctttcgtttcaaaaaaacacctaattctaagtgtgtatccagattcacatctataatagagttatatgtgtccagatttacactggattaaattttttagattaatttttttagatggagggagtacagaagtgagattgagagagcgatcagccagtggagtgagtagctatagctgagcttgagtgtagcttagctaggggtgacgcgactgttgctgggacacgtggcgtgccttggttggatccatgggctgtgcatgcgtgcgtgtcggaaggcgacatgatcaatcgcctgcatgcgccctgactcttctgacgtacggctatggtttaagccaagctataaccagaaaccggccggtcaatgtacgtaacggtcatgggtcaatatgtgcagctaagctagctatctcaatcgatcgtcgagttattcatatcgtttgtagtacttttcttcgttgctatctagaataaaatttaatccatattaaaataacaaatctagataaaaataaatatatctttattcgttgttgtaggataaatcaaatcctcagtaatattttagaacaaaaataataatagtaggatggtatatcatggtttggccccgttggttagattcctaaattaatttattttgaagcggaagaaatagtagctcaataattgcaatggtcgattcataccattcctagctacctatgtatacacgttgattctgatcgattgggcgacgatggattacacatgcagctagtgtgtgtcgtatatacttatagtatactatatgtactatcttcgttttcaatagatgatgttattgactttaatatattgtttgatcactcattttattgaaaaaaaatataaagatattattttttatgacttgttttcgttattaaagaagtacttttgcatgtatgcatcaattttaaaatctgacaagtggtacaccaaatttaaggatatcatctatttaaaaaaggagagggtatatacgtatatgcaacttggggtgggctgaggaagatcaacatcgagaccgaaaagaccgtagttttttctgtttatgtttatgtttagcgtttgaccgtccgctttatttgaaattcttttatgattagtatttttattattattagataataaaacataaataatactttatgtgtgactaattgttttctaaattttttcataaattttttaaataagacgtacggtcaaatgttagacacaaaaacctactacacatgagacggaggtagtgctacgtactttttctttttaaacaacatatacttatatatgaacgtacttgctcagttattggacgtatctggcaggcaggatgcaggtatacatatactatactactagtagtaacaaataattaacacatcgaagttgtctcatcacgtcaaatatatgaagaggggggtcgtcacgccaggcgatgctagagtccacgggagttgaatttgtctgtccgattcctggagctttccagattgaatcgggtgttgtttaacctgcagtctaggccgggtcaatctaggtctctggtgcaatcctttatacaagaacttagggtttggtcttgacctcggtgtagatcgattcgctttggtgtctgctgcgtcgtctgcagtcggggaagtccagcatatagatcaaattggttcttggcaatatggcatcccatgaagatccgcgcgatcgtcatcgtgatgaaggtggtgcaacaaccgatgaggaaccgattgaagatctgggcggggcttcggaggaggaagacgatgaagatgcaattgtggtagactttgatgaggctaaaaagcatattgatacacagtatgtggccattgggaagttcttctcaaggaggactttcagcgcaaagggactgtttgaagccatgcaaaaggcatggggcttgagacaaggcatggagtacaaacgcctgcatgataaccgatttctactggaattccaatctgcaggggatttcaggtttgcgactggaggcggtccttggatctatcaaggggatgctttcctgatcacggagtatgatggcaagtctagaccttcggatgtgaaactgaactcgctaccagtttgggtgagaatttacgatctacccctgtctatgatgactgaaacaatgggtaaattgattggtgcaaggctgggtgaggttcgtaaggtggcggtggatgatcagggaagagcatgggatgattttatgagagttcgggcggagcaccctgtggataaaccactgacgtgttggctgaaactgaaagacaaggagtcatcttcggtggttcagaggtatgatgtcaagtatgagaggatccctcggttttgcttttactgtggccacattggtcacatggagagggaatgtgatttaccctcggataagcaaacggtgaggtttggccttaatctcagggcgtcaccttataagcagtttgaacatcgtagctgggctctgcctggtaaagttgacaacaacgcgaagagaaatctatggttcccaggtgagaaccagtccaagccagctcctgcgggaagccaaaataaagatggcccatcaggcaaggaagataggaagaagaactcgccagaggaaaatgctccagtaaaggaaaattttgctaaccgggatgagatagaggcagagatccctacggtgcaggaagagttgaagggtttaaatgctaggaacccaggaaaatccagggaggatggtgaggtcaggaagctagctgaacagtgggagcatatggggaaaactcaagaagatcagcctaccttccacgcagcttcacagcaagctaaggagggacaaataaggagtgagactgcaggggagacttgggtgtctagcaaagattcaatcaatcagtacgaacagcttgatgaaggtgctgggaatggccgtgaggaggtggacgaacatgttccacccctatcaacgatccatgaagatatctctcttataaaccagcttagagatgaggaacttggtgagggacataaggaaaatatcgatgatggggtaaaacctgtgctaggaaagaggagtatggataaatctctccttggcccaggatatgatggaccttcgtttgatgttctagttggaggtgatagtaagaggagtaagagtttgtctctatagacagcaaagtcgatccacctgacgggcattccaaaggaagcccgtcaggagcaatgaatattttaagctagaactgccgaggatcagggaggcctcggacagttcaagatcttgtttgcctagtgcaaacacacaagcccaagctggtttttttgtctgaaacacatcaaaatatagaaagagtgtgtggcttaaaatagagattggggctgcggaattgtgtagcagtgcctggagaaggaacggggaggggggggatggactagccctcttttgggatgacacagtacaagtggatcttctatcctacaacttcagatatattgatgtgctcattaaggacgaaagctgccctgtgcaatggcgatgcacctttgtgtatggtgagcccaaagctagcgaaaggcataacatgtggactcttcttcgtcgcatcaaatcaaattctactgctccatggtgcttagtgggcgactttaatgaagctatgtggcagtttgagcatttttctgaccacaagagaagggagaagcagattatggatttccgggaagtcttgtcgcactgcgatgtgtttgatttaggtttcacgggtgccccctggacttttgataacaagcaaaaaggaaggaataatgtgcgagttcgactggatcgtgcagtagcaagccagagttggtcttctctctttcctgctgcagaagtgattcaccttactgtgtccagttctgatcacagtcctattcttctccaagcctcccgagtggatcgcatcaagaaaggggatcggtgtctgcggtatgaaattatgtgggagagggatgagcatctgacagatgagattaaatctgcttggcaactacagggacatatatcagacttaggctcagtggcaagccgcttaaagtctgtgatgggagcactgcagacttggagccgtgataaatttggttaagttagcaaagatattaaagaaacaaggaatcgattggcagagcttcagatggcaggcaggtgtgctagtgatcaagactatctcgatatatccaggaagctggatactcttgtatagggaggaaatgcaatggctgcagagatcaagaatctcttggttgaaggaaggtgaccgaaacacatccttttttcataggaaagcggcttggcgccacaagaaaaacaagattaataggctgcagagaagtgatggaacctggtgtgataagagggaggagatggaagatatgacatcaaatttcttcaaagagctttacactaatgacccttctgtcgagccagaaccattacttgatttggtacagcccagagtcacgtcggagatgaataagctgctttgtaaagaattctctgatgacgaaatttcaaatgctttgttccagatgggtccgttaaaagcgccggggccagatggttttccggcaaggttctttcagaagaattgggatgtattgaaacgggacattattgcggctgttaagctgttctttgaacagagaagaatgccacaaggtgtaaatgacactgccattgtgttaattccgaaaaagaaagagccaaaggatttgaaagattacagaccaataagcctttgtaatgtgatttacaaggtgattgctaagtgtttggtgaataggatgcggccgttacttcaggatgttatcgtgccagcgcaaagcgccttcattcccggccagatgttcactgacaatgctctcatagcttttgagtgcttccatgccatcaatcggtgtaaatcggttgagtctcaattctgtgcttacaagttggaccttacaaaggcgtatgatagggtggattggagatacctagagggagctcttcttaaggttggtttttgttctcaatgggttcagctattgatgacatgtgttacctctgttagctatgctgttcgcttcaacggatctatgcttgaatccttcaaaccgaccagaggcctccgacagggtgatcccctgtcgccctatttgttcctctttgtggcagacggtttatcaacggcgctgagtgaagctgaaagatcaggacggttacaacctctaaaagtctgcaggagagcccctggaatttcccatctcttgtttgcagatgatagcctgttgttctttaaatcaaatatggaacagactaatgtggttaagagtgctcttactttgtatgagcaaagcacaggccaactcctgagcccggccaaatgttctttgatgtttggaaagcattgtggggatgctctgcagtctgacatcagatcccttttgcaagttcaacacacttcctttgaagataaatatttggtctgcctacaccgctgggtagactgaaggcaggaagacaccaatctttgaa

SEQ ID NO: 59671 - DNA, 10942 bp, Oryza sativa
attcctgcagcccgaatgaagagctagttcgtcgaatcttctatcccccggatgctgaggaaattttgaggatccaattgccacatagccctgaagaggactcattgcttggcactatgataaggtgggtatgttcactgttttttctgcttacaaattagccctacaggcccagatcagagctgacgaagaggttgcacaatgctcaaatggcgatggtgataggaagttgtggaagaacatttggaatgtgcaagtgccgcagaaaataaggatttttgcctggagagtatcaagagattgtctagccacacaacataataaacatcgacgacagattgtacaaaagccaaactgtgagatatgtggggcagaagtggaagatgcgtttcatgctacggttgcatgcacgaaagcagctgcgctgagggcagagatgcggcagaatcggtggctaccgggggaacaggagttctctcagttaggacctgactggctgctacatcttataaaccgtgccgacgatcagacgagggcgttaatattcctgctgttatggtgagcctggtttttacgaaacaatatagtgcataatgacggccatgcttcagtcactagttctgtggtgtttcttcggagttatgctgaatcattgtttctcaaccggcaaccaagagctgacagaaaagggaaggctttgtgtcgccctgaacaggggaaggagtcaggtccaactcgggcctttccatagcaacgtgtttgttggcttatgtctgtgaatggctgggctaaaatcaatgtcgatggagctttcaatcctgaaaatggtaatggggcacttggacttgtaatcaggaattcgaggggcgaagttctgttgtcttcttggaagtttctcaggcgatgtgtgtcagcggaggaagcagagctgcttgcgtgctatgaagggctgaagctagctgctgaatggattcccatgccagttatgcttgaatatgactgtgccacagcgattgcgaggttgttgtccactactgaagagagatcaagatggtcttttctgctgcgagcagcaagatcagttatagggttaattaaggaagtgcgtttgatgcactgtaatagagagtgtaatagggtcgcacatgaacttgctcagattgctatccgttcggggcaaagcgcggtttggcgtaataatgcaccgaattgtgttatgcaatgtctgcagcatgactgtaatcctgttacgtaatcaataaagctctctattcccgcaaaaaaaaaagtagtaacaaataattggggttaatgatgagcagagcgatccatggttggatcgatcgagctacctaagctatcatctgcattacggcagctagcccgatcgatcgatctatctagttgggggcagatgatgacaagagatgctagccagctgcagactgctgctgctaatctcgtctcttctgatatcgatcacccacagaaaaggggagaaaaaactcagatcgggacagacagcccaaggaaaacaaaagacgaacacgcagagtactctggtgataatcagccacttgatcattaatttcttcgtgaccgttggcgtagccctgcctcaaatcaaatcgatatatatatattcttcgatctatctactctctctaggcttctcgaatctcgaaggacgatgatttgtactccctccatcccaatataaatgtaaagcagatataaccagcttatacaaaccaaaactacctgttcggattcgcactattagagtgcgttaagttgttgaatgtcagtgttacaatgagcaaagcaatagtccagtattacactttgttgtaatatgacgaattgagagccaatttggattgctaccctaccaaaatttactctaccaaaacactggtagggtagcaaactaaacacctatattaaaacattacctttgtcataaatttggctttgcccataaacttataccttatgggtatattttggcttcaatcaaaatcaacattttcactctaccctaccaaagttttggcggcatgtctaagatttagcactatcaaaattttgatagggtatcaatccaaacatgcccttgtactatataattagctttggccggtcggccgacagaataattaaccttggcggtttttagattatacttggtggttttcgaccgccaaggacatgccgttttcttgtagcgtattgactctcagaatatatctaacaaaactgccgttcgtgcacatgtatttaattacgttgtaaattgacaatccattctctcttctctctaatcgtaaactaaaaacatgtgtgttaattagactatgattttaaaaaacaactcaatacttagaaaattattttcacagctccctttatttttacaaatgggctaaaagaagattcacttgtgaaaatatataggactctcacagtcaacaccgggccggcgctgtattttagacgaccaagacgcaccaacacatacgttatattaaaataaaggagcacgaacaccaacaacaccttgcttctcacattttccttaaactctccacacttccctctcctcttcgttttttctttccacagcacagaggacactgccttggctcctccttcccctcttgtagatggcggccggcctcaagagcaacgacgaaaatgacaacaaccttaggagcggcggcggccttgggagcgcgcgatggatccatcgccactggcctcggttggggcagatccccagcgtgcatgggagcgacgttgatgatgaccgcgctagccttgggagaggcatatccaacgacgggagtccagggatggcatcaacaaagtcggtggcggccattatggggatggttgcggcgatgatgacgaattgcaatggcggcgatttcgattggggattggggctatggtttctgtaactttttggattttttatatttttcgccaaaaaactttttgtagtcagggttgaaaatccgttccgtcatacggttatgatgcccgcaatagaaaatcttgacttttgcataaattgtcttaggtgggtgctccatctatctaggaaaggtggttttggtcggctgaaaaaggccggtctgtagtggggatttactgttagtttctatcagtatatttcagatacccctcaatattacaattaatactgggaaagcagaggcacttttcgcagcaaatatcaacatatacatgtgtcgacgtttgatgtcgcgattccggtatttgcatagtatgagaatcgttggtactagaatatatgcgagattgtaataaaagagatgtggacgaggatttttatacaggtttgggccccctgaattgtcaggtaataacctactcctgttggccgaagccggtcgttactcttattcaccataatcacaccagcataatatttagggtaacctatctaactgttgtcgacttgacggtctgaagtgttgactcgtagtcgacaacagggtagccttcctcctcaaatccgtatccggcgagattaaagacagcgttatgtctctcctgagagtatccgtagacatcgtaggggactaaccatgcttatctctgaagttgatatccgacgtcttgtcttggcacatgttggcttgtatgttgatcttgtgtcttgatctattgttccgtgtcccctctctcctaggggccttgtatttatacccataggtgtccccttgtccaagtagaactaggaaaaccattatggataaatccgagtagttcttgtcgtttccatgtagaactctattcatccttcattatgcataactcctcgtatatccgaaggttgtttccgtataagacatggtatgtggtgggtcctaccgagatttagtcaactactattaggtatgtgatattcataaccctaacaacatgtgtgcactgtgcaagtgcaccagacattgacacaaaacaattcgtcgatagacaagaaaattcacacgcagagacatgcacacaccacatgctctttcttcgaaggaaagaaatacacatgactcgatctgcaggtgctgccaaggcatcacacgcaagcagagacgcaccacatacgtacatctaaggtgcttacttccaagatgcgtgaaaaggcatctctctctcaatgtggtcttcaagaaaaaaacaaaccaaggtaatatttctctcggatttttacaggtatattatgcgtgtatattaccgaattgtcgttagttcactacacgagaaagtgactgaattgtcctaagtaatataaaaatgtaggaaacgaggaaagatgagagtgtgtggctagaaattaataaactgaaacatgatatatactgtttatcatgttacatattattaaagttttaatttgagtcacccttaaaccaatctttctattttgtatcagattgttatttttttatttttgagtttcttaaaattttaaatttaaaaataaacatttccaaaattattttcaagatccgaatcttctggtcaagctaaccaagctggcatggcgaaacaatattgtcacacggtctaaatgacgtagcaacgttatttggtcacgccgatatagctagtgtggcaacattatttggccatgtcattatggctggtgtggtaggataaaagtcacacctaggtagcatgacgaaaattgttattttactgggtcaggcgagctgtcatgaccaaaaggttccgattttagaaaattaaaatatgaagggttatttatttttaaaataaaattttaaaaggttcaaaaataataataaaaaaaatattattttaccctttcttcagtttggataatccaactctcttttctactcatatctagcctccagtctagcaaagatatggcttgcatatggataggagagtttggcgaccggtttgccagaaccaatttgattgaggtcgttgatgtgtaatgaagaagttgtttgggggtggttaaactataaaagcgataaaattcaatggtccaaagtaaaaagattggtttactggtgattcaaagaaaaactataataataaaatatagcctaaatttcaatacactatttttttatgaaggaagtagcagtatggtagcatggaaatgaaacgatggactaataaaccgagccatcatcatgtctagctactactggctactgatctcaaacggattcgtccacatcttgtctatgactttcaatgcaaatgatgctcagacagattatgatattatcctaacaacttttatccttcctaagcgatcgatcgacgattaatttcacatatcgtatttaggctaagatttgtcaattgaatcatgttccattttccggtgctttgtggtagcacaaaaggaaacaaaaggacattgctcatgggaccccatgctgaatgaaggagccacacaagggataagagtgatagatccagcttataccaacatgaaacactgtgtttggcttatgtggatgaatcagtggacactatctagtgtatggagaggatccacaaatggggtacttggcaaattgagcatggtgtttgcccccctggttcaatggacttgattgcgattgatgatgattttaattaattgctaatatatactaattagacatgtttcttaatttccccttgaaaaagatgaacatgcatgacatctataatacaggttattatcatggacagtccacttttaaacttttcattgggactctagatatatattacttactctatctctaaaataccttatatttagaggatgtttagatctagggtgtaaaattttgacgtgtcacattggatattatatagggtgtcgcatggagtgtttgggcattaataaaaaaactaattatagaatccatcagtaaactgtgagacgaatttattaagcctaattaatccgtcattagcaaatggttactgtagcaccacattatcaaatcatggagcaattaggcttaaaagattcgcttcgcaaattagtcgcaatctgtgtaattagttattttttagcctatatttaatactttatgcaggtgttcaaacgttcgatgtgacagggtgtaaattttttggcagggatctaaacaggcccttagtcaatctcagatatattaataaggatgtgaaaaaatgaatacgcctttcattaactgtatgcttctcctaagctttgatgctcgactaaggctgtgttcgttaccggggttgggaacccatctcctccgcacgaaaaacggagcggtccaatagcacgtgattaattaagtattagctatttttttaaaaaaatagattaatttgattattaagcaactttttatatagaaactttttacaaaaaccgtaccgtttaacaatttgaaaagcatacctacggaaaacgagatgaaagggttcggaacaggctgaaacgaacgcaacctttaactcttcacatggccaagctctaattaatgatatttgcaacttactattggaggtggggacgacggtaatcaagggagataaaaacgaggataataaagtgggccaatcgacacacgcctaaaaataaggtcttttagggtgaagcgaatagatagtaggttgtcataagaaatttaatatgaattactagtgcatgttttaagaccataaaagttgtacgaaaatactagcaaatgacttacagtacatttgcaatcaaagtaaatattcattctgtttcaatttacttgtcgtattagataatttcacactaaactaggtggtgtggaaggggctaccctcattaattacatgctaaccatcgtacgtcttctcaaagccagcaataaaattagaaaatgctacacgtacgtccgaaatgtccgactcctgtacgactgcaacgtccgtccatggcttgatccccgcgctgtttaatcctccaactcattgagcctcacgccgttgtgcatttgctgttttgacgtttagtcgtacgtcggtgggacaagaaagtcggatgtatagcagtctctccaagttaaaatttagaaattttagcaaaaaaatctcattccaacagcctctctacttgaatggctaaactagatggatggccaaacttcacctcccactagccaaacttggccagccaaactgactggccaattgtgggccccacgcctttccccccactctatcgatctatccccgtccctctccgcattgctcgtctctgcccgtcatgccaggttgcgaggagggaagagggcgcgtcggtagggcaacacgactatgagcgtcgcctcggcctctggctcgccgttgtcacgacgacgagcgtcgcctccggcctctagcggaattttctccgccacgagatccgcacgtggctgtgcagaggaaaaacccagggaaaagggcgacgacagggcggcacaacggcaagcctcgccgtcggcctccagcgccgatttctgccgccttgccactgtcctctggagcttcggagagagaagaagggatgaagggcagcgacaccactcgtttgcgggtgagagggcacgatggcgagggatggagggcgcggtggtgagggaggagcgaggtaggccagcgaggagctgatccgcgcactgcagcccaccggctcggcgccttctccgctcgccgctcgctgctttcccctggcccacctcccatgcccgccgttgccttgcgtgcccacgagtcaccaccgctgtccgtcgtcgcctcgcgtggcccgcctcccgcgagttgtcgcaccgcatccgaggtagaggggaggaagaaccgaaaaagggagatgtatggggggaatggggtggaagaagtgtagtagaggttgacatatgggtcccatttgtcatagacttataatggagatagtagatggagaggctgttggagtaaacaacgagtttgacttgctaaattagatggagagtttgccaaatagacatttagagagtcagatttggagagactgttggagatgctctaaggagtactagtactagtattactgcattggtgaagggaaggacatctctaaaaatatttttgtatgtctcagaacgacaagtattttactaaaaaaaagctagaatgacaagttaattgaaacggagggagtaacgaatatgaattggcaaaattaaatcttgtgtgcacctacagtatattttgaactatacagtaacattttgtattaccaaatgtccatgtccaagtacctttgactaatctctcctacagatgcaaaaggaggtcaaggaaatgaagaaacttctgcatcgacgatcatgataaccggcatattttcataaagatattctaactgctttctttcacaacgatcacttcacaatttcaaccaacagtcctgtctttgatcgatggtgcttgagaaactacaaagccggtctcctcttttttgtttacctaagggatctatctatcctagctatccaaaaagctaattagctagtgtatgttgtacatgtgccatgtcctacacatgaacggttttaatttagtacccaaacaattaggtttccccagtgctgaattaaattcttgtatagcaatagcattgttcatacatgctgcacatatatatgcatctccactgagctatcagtgctggtcgtcttgtcaactaagatacactacactccatccattcccctattctcctttgtggctaccaaccagcaccctcacagcctcaccaaaggacatcacattacacccctcaacacccaccaccctcacacaacatgttgtcctaatgtttcctagtgttgacaccctaagtgtgtgcaggtgcatcagtatgtacacaaaaaatgcttccattggtgggagtttgtcccatggaccatgatttttgtaccattccgtatagatgcggccaatcccatatatatacacatgcatgcatcatgtgtgtgataagcattttcattttatcatcgagttgcatgcaccgaccggttggattacttgatcgcgttgctagatggcaatatatgcatgccatatgtgtaatggtggagccagcggtattatcgagcatggatagttaatagtattttttgacaaccagctagtttttacgggcatcgatggtaattgtagtggtaacagtagagcttgggtggacatccgacatgccaagaactgccttctgcgccattgcatatgtttatgttgacgtgtacgcgcctcctcggttgttcatactttcgattgactatgcttttgcactgtaattttaggtaggtgttaccccacatcatgtgacattcacatggtagacaagagtctcctaacttcaattcatcttgtcatatttggccagccctggcctgacaatgtccctagacaatatgtgttgggggtttggaataaatgccgacatggtgagcctccatttagaactcatttggttaatttgtgtactatttatatagcaatgtgttttagttttcttttatttgatagtaaaactacacatacttcctctattccaaaaaaaataaagaatatgatacattacagtacaacaaatttataaaaaaaacttgtacaaattcattgcattaaaataggtcgcatcatatcatattctagtcttagttttttttccttatacaaggagtatatagctgggtcgatctgactaagggggtgtttggaagagaggggcccctaactgtgccctgccatatggttctccataaatgcctgctgtagcatccatgattgaaccatgtgtaacaaaagatggagcaggctagccaatcaaacaaaggaatccaggaggatatatgctactgacatgctagctcatcacacactgctctgctatgggtacccccccaccccccaacacacacacaaaatcgacgagggttatctatagtactgcacagttgtatcattaatatgtgggactatagatctacctgctcgccgcttccacaacaggggcggtactgtagaggatccgtgtcagagaaaaaaaaactttcatattttcctctctaaattaatttgagaataaaaatgttatacagggcctgtcgtttataggttttctttttatgcatccagaaaaaccccatgtcggtcatagtatatctgtatatgttactaagtaattgactggtatttttagcggaatgtgacatgaattggattagcttgacaaggagatcgtgccggaggaaaaggacaaatgatatttcatgatagaagatgctctacatatctatcgaaattatgcatttggtggctagctagctaggtccccttacgttctaaaaggtcatttttactcgttttccttttcctttaagttgcgtttctttcttgacctgaaaattatcagcagagatagcccaatgcaggaattttgcctgattattgtgaggaatgaattatttcctatgaaatttcttcaaaaattctgaatacgtgatatatatattataaatttatataccaaatgagtcaaaataaaagaaatgaaactgttttcgttatatgtagtaccggatcaaacaggactatactacgtaccctgcatcacttatataaagttgctactccgtactaggcttcgaaccaatcatgtgtggccgaaaaccgtcaaaattaatactacctccattcaaaaaaaatattttttacctatctcacacataccaatataaaaaaaatagaatacccctactttatcaaatcctaatgcaattattcctcattttatctactcccgatacaattattcattacttttataaactatgatatgtaatggttattttaaaaatacttattttctgacaaatgaaataagccaaaaata

SEQ ID NO: 59672 - DNA, 2509 bp, Oryza sativa
atcttgtttgcatttgcattgcaattttgcatggatggatatatcgatgtcatatatattgtatgatcgatctagagctatatctatatatctatcttaccctagaatcatatcctgttgtgccctgcatttgctacttgcatatcctgtttgtgctcgagaaggaacaagctatgtcgatcggtatatgtgtgtatatgtgcccatctatcagttatatccattgtacctccatgctgttgtggtcgacaatgattgacatatatcttgtgcacaatcgctcggtttgcgcgagatatacatgcactacttttacaggccatcccttttctctctcgatgtgtggatcgaattgatatatgatagtataacatatagtacctcctccgatcacaaataagtgacgttatagatgagaggcggtcagcgatacagttgtttgattattactccttccgtttcgcagctactctcttcgtctcaataaattaaacatttgtcataatactaggatacaacttttttttacagagagagtaattcatttctgacaattctcaggacaaataatagtgggagaaatggctatggtgtcccgtgtccatcattagtacagtattttctagaggctccattcaaatgcacgtggagagagtaattaatactacggtatactccctccatctacttttgatagtcatatttcatcttggtacaatgaccaaggataagtgattctacttatcatccatttaagctattcctcgtaaacaaacgatttattaatatttacatttctcgatgtctatatagccaatcttgtgtggaagaatagagagtcacgcattaaattcgagaaagtcattaagaggatatgtggttggattgaaatatgcctatcagatttggaaatatacttatcaaaagtagacggagggagtaacacttatgaaaaatgtggaaaagttataattatttgaaactatttttaaagtcaactctagcaacaacatttttaaattaagttaaactcgaagtgttcaaagagatattaatggtcaaaacttaaacgagttgactgacgcattaatataaaatatcacttatttaataagtgaatggaaggagtacatgttattgaagtttttcaaattttctcttaactatttagataacatacaagaaagtgaacgcatgtctttatataaccctaaacctcacttttgtaccataacaaataaatatatatataaccatgaattggtggcagactgatactgtgacagtgacttattatgttgcatgtcaactcaccaggtaggtttgaagtgtttgcagtaggcctctaaatgttctttgactaaaagaacaaataaagctgaagtcctacgatttttctcagaaaacatctcacattccagccgacaaggtcatgttattcctagatcctccactgcttgtgaagtggcctaggataagctttgtcatacaatctgaagggatcctaatggcagcattaagcaccgatgaaattgatgaaaaagggagctatatattgctataataatataatattagtcaatgagaattgtttatatatatgtagatatcagacaggccacgtacaccttgcattggccacattgtgttgtttgcgcattcagcatcataatccatccatccatcagtgtgtgtcgatccgttttagatagcggttttaattataattgcagtacggccactagtacagtgcattggatccccagatgctgatgatcgatcaatttaccaaccaattatgtacaccagccctccatttattaatgatagacctatctgatctccaccaatcggaggggtcttctctcaagctctatatcggatcacgtaagattcgtgttaccggcgaaacagcccttaagagcatgtacaataacaggctatagatcagctataaacacatatggatagtgtgcatgcctaagaatagatatcaagtgacaagtaattaatggggatcagatcgatgaagattgacaaagaaccattggcttgattgtgtaatgcaaaggttggcgcaacgaattcatgggtaggcaggcttatgtgtggactacaggcaaatctgtatttttcttaaaggcaacctcactataaataaaagaataaaatatctcgatggagccaaattttcgaggggatgtaataagtggagtagatgaagcaagggatgaagcaagtggggaaaggaaggggtagagcatggaggatgcgagggatattagttaggttcaataatgtatatcgacacaagttttgtactattaattagatggagaatgagttgccaaaaatcaaatagtattgtaatgaaaatttaaattaatgtttatatccaatatattgattattttttatgacaaaacacacacatatataactcataatatctatcttattaattacttcctccatttcacaatattttccgcagcttatttatactttg

SEQ ID NO: 59673 - DNA, 37205 bp, Oryza sativa
  unsure (1)..(37205): unsure at all n locations
ttcgatccgttaattagcagcagcaggtatgctgacatgatgctctcttaattaattaattaattaaggtagtggttagcaacacatatactagtacaatacgtgcttaaacgacaagcacaaaacaaaagccattagggaaagctaatgtggctatcgatggaaagggccaattcatcaagcagctaatgtgaggacgtgcaacgagacaaatcgcaaatcttttcttgtcgccgtgtgtacgctctgcgacaagcattaatgcgtctctcaacgtcacttttacagcctttggttccatgctaaaataattcgaccgttttttgtccccgatgggggcattaatactccaaaaatatcgacgtcgcgacgagcaaaaaggtcgccgatcgatcgattaatttatataattaatttaatggttattcttttcttaaaacatatgacatacgtatgcactcgtataaacgtgtacacgcacacccggtatgtatggacagaaccgaagagacgtaaatacgaacactctgtatctagaatttaattctgaatagacaaattccaccataataaaaaaaattaatcagttgactacactcacttttcaaattaattggttattattgtacttaaaaaccaaaggtatttctcaattaattatctttctttcgtattcaagtcgtgggtagaagcaagatcagatactatgatattattatcgtccactcgcacttatacagacccttttacttatatgtggatgagagaaatgaaagagagacgtcagtaacaaccatctctttctaaccataatttgtatagcacatgggagaattaaatgccaaaaaggacaccgcaatagaaacgtattgttacaattatcgatacgagttctttattagcggatatgacatatcgctcaaatatgagcgcagtcaaacttcgaaaattaaattattaataaaaaatatcaggatttaagatgtaaaaaatatattggtagattcttgacaaaagaccctctttttcatatagttatactttaagtattattgacaaatatatagttcaagaaaaaaatgataaaacattgaagactctgtcgatgttttagaacgtcatcctagctatttagaacggaaatagtatagtataagacagttattacagacaactgctatatatgtccaataactaaccagccaagatgaatgaacaataaacatatcactaattgatagagttaagagtagtgctgctgttcatatgattattatttatttatttttttcagattccattgtgctaagattccttctcttttcagctggatggctccaaccattgaggtcgtcctaaggctagagagtccataggatgcactgactagagtactctgtgcatggtgatctactagctactacactcaatattggacaaaagataccccaaaagtgccatgcaaccctgtccatttttctattattagcgggctgtactgtggtttggtgacagggcttgctgtcgcaatgcagttggttagaatttgtagttgcaaaaaaaaatgtatatatgcccctctgctgtgaagaacataattgacttgttaatgaaatcttttgcatttactatatcccaaaaagattccaagaaaaataacttgagaagaagaaagtagtagtactactgtaaattgaggtgtgatgcaaatcaaattgagttgagacaagtgtattttcatttaccaattaagttgtttttctcatgtttatttggactaatataatatttctattattattcaaaaatatgttcctatcgattcatatagctcgatctggtttttgttctgtttctattactggtatttaattcagcattttttgtcgacattttagtggctttcagagctactcttcttgtaaaaccaaaaaacaaaaaagcaaaataattaaagtgggaaaagcacactaggtgtccaaaagttttaacttgacaaagtaaaagaaaaggacagaaggaaccttagcttagctatcaggtgtggttaataaaaattaattctactgtgcccaatcattcgcctttggtttgttaatttggaggtgagatctcaatgtgggtcccagctacatgctatacactcatctcgtatcaggtcaggacaaaccaacggacaaccgtccatggcgaatttgattttctccttggacattttcacacgcggtgacttaaatttatcctcgcgaaattcaaattaaactgtttgccattaaaaaagttttccctgaattttgtacggttgtagtttattccaggggataagaacaacatgaccaacaagtgtgtagcacatcgtttgtctgacagcttgtctttcttctcctcgttgtttcagaagagttttgtgagttggatagcagcaactagcagcttgtcacctctcactcacaattaatagataatttcagggtgttatgctccctccgtcccctaatataaggatttaaacattttacttgtactgttttaccattcgtcttataaaaaacttttagaattattatttacttttttacttactttattatctaaagtattttaagcacaactttttactttttatatttacataaattttttaaataatatgagtggtcaaacagtgcaagcaaaatttcaaaatcccttatattatgggatggagagagtacatgtttaggtaaagaaaaataagatcatccatggtatctatggaaattgttgtaattagccgctgagctatcacacgatttgttgggctcctttcagcgaatatgaaccaataatggataaattgttagtgggaatactcaattaaaaggagggaaaaggcatgtgtgtataaatacaattaggctgagttcagtacccatagctcccaactcgtacctctctttttcatacgtatgcttttcaaattgctaaacggtgtattttttaaagatttttatatgaaagttgctttaaaaactcatattgatctatttttgaaaaaaaaactactaatacttaattaatcacacgttaatagaccactccgttttccgtgcagaagtgattagttatggagcttaggagggttaaacatttagtataggttttatgataaataaattgttgaaatgagcaaaattgtaggggaaaaaatagagtggccccgaaagctattcgtcaagccgattgggttaatcattttgcacattaattttggaagatgttcccatagaattcccaacatgcataaggagatgtacatctattttaaccctaacaataaaatagggatattggactgcccttgacgtaattgtttgatcatttggcgcgtttagcatataagagcacaatacgtgttagttatgcaatgtatttaccaaaacaagaaaaaggtgcaagactcccattcttttggccttttcctcaccaattccacactcctgccttgagctgtatatgacttgtaaaagatatttggtttacaactttccattccccataggagaaaggcccaacgggacttttcgccggagctccattgattgtgaaatatgggaaatgtaccggcaaatggccccctttacgttcgaaacaaaatacatctctcgtggcattctaagatacggggtatctgtgtgcgtatgactagcatgtctgaattttccccatgtaataacatatggttgtagtcagcggggccatgggcggcggtgggccacgcgttgcagcggagaaggtcaggagggcggcgctgcggcaggtagcagcaagacgttggcgacgatgtctctttgggtggcaggtgctgcggagcacgacagcgaagggtgcggcggaggatggcggcgtcctaagcgtcgacgaatagtcctcggcaagaagaaggcgaatccggtaaaggtggtttcgtaggcagtagcgaccctaggggcgatagcggcctgcgagtccgggtagaagacctcctcagcttcggtaactgcggccctaggggcggcggtggcctaagtgccggtacaaggatcttagtgaggaggaggccgatcccggcggtggcagtggccctagctaggggcggcaaaggcctcggagtcaggacgaaagaggatatcctcggtgacagctgttgaggactccaatagcggcggcaacgggctaggggtctgagaggcggaggaggattctgatgtcgatggaggtctaggaatccaatgaagcagaagctgatccttttggctcacatctggtcggctagttctgactgtatgacgatggatgagtggggtttaaccggcgtcacgtggcgtcagctcacttgaagcggatgaagatagcaccagcggaatttcgtagcgacaacgcactaggggtgatggcaattagatgacttccactcgttgaatttggccacttcaagagaggatgtggggaagcagggatgtatagaggtcgtagtgtttttttttccctttttttttggttttgtgttctctttgttgagatgtgagtctaattgttcttgtatcattttgattttgtatatccctcgtagatatagaggccggactaatgaaaatcaattatctaaaaaaaatatggttgtaatcatttcttaatatttagcataataatcaacattattttgcaaagaaaaggtaaaacctagaccattgcattattattgttactaaaataaaagaaatatagtgcagaaaaaatcatgatgaggattagacatatattcaggaactagagtggactcgaatccttatatacaaatttttatatactaccgcattattatttgtttatatttaaataagaaataagaatggttccagggcggcgccgtacgtagcctaaagagagaaaagggagaaattggtggagagcgcgtgggaagcggcgggcggcggcggggctgcacggatcccacccaatggcgacgcgccctctgctccatcgatcccgacaacgcatccagaaggcgccggcgacacctcgccgccgatcgtccgccgcccctagtcgccgccatctctcgatcatccccctgtcccttcccttccacgcacggccggccattccatcgccgcctacctccagacccaatgcatcctctctctctctctctctctctctctctctctctgtctctgtgttaattttgtaatgtattagcaaccattcatggatggatggatgatgatgatcatggcctctgtcctctgtttttactcgtggctgcagactagtgctgtcttttctcttgtttgctgttctagaatctgtgtgctgttttctaaacaatttactgtttatatttgttttgttttgtttatttttgtagttgtaatataaggttagtcttcttagtaaatatattgaaaaaagaagaagtagataacacggtttgaatcttggtaattgtactgtgctcgacaaattaggacgtaatcctatcgtttcagattataaaatgatttgactttagtcaaagtcatgttgtttcaagtttgactaattttatagacaaatataataatatttataatactaaattagttaattaaatatattttcataataaatttgtcttgagttaaaaatattactactttttctataaaattagtcaaacttaaagcagtttgattttgactaaagtcaagacgtcttataacctgaaacggatgtagtactgtatatgggaactagcatgaagatcttgctactgaaagtaaaatatcgaatgaaattcgacgtgtatgagaattatacggtaatcataattaattagaagtggctgcatgtgagaatgtttggttctaaagcagacagacgaattaaaaaaaaacaccacggcaacggaggacgctactgttcctgtgaaattcctatgtttaattacctaatctgttttatgtaatgtgataattaaaaattactctggtgcttatttcacattgtgattttactttactataacataacttaatttgtatgaatatgtgtgttattaattgggtggcagtgccactagccagccagggggtggtgatgagcatactagctagatttgtgttgtgtagctaagctggtggccttgtgtgctccacatcactccaaaccctctgtcccaatcaccacattttttcctctccaaatctattaattaatgatccatttcaattcttcatcactgatttattcaccaattaattctctctttttttttcttccactacgctccaaaacttctctccctatatatacctctcccttgtacttgtccagttcttacactcgtctcactttactactcattccactattgtaaagtcatagaaaaaatttatatagagagaaaaaattagtgttgttattgttactggctttctgccagacgagacgagcgagcgcgcgagtgtgttgctctctggtcatcgtcgtcgtcgtcgcgatgccgacgccgtcgcacttgaagaacccgctctgcttcgacttccgggcggcgaggcgggtgccggagacgcacgcgtggccggggctggacgaccacccggtggtggacggcggcggcggcggcggcgaggacgcggtgccggtggtggacgtcggggcgggcgacgcggcggcgcgggtggcgcgggcggcggagcagtggggcgcgttccttctggtcgggcacggcgtgccggcggcgctgctgtcgcgcgtcgaggagcgcgtcgcccgcgtgttctccctgccggcgtcggagaagatgcgcgccgtccgcggccccggcgagccctgcggctacggctcgccgcccatctcctccttcttctccaagctcatgtggtccgagggctacaccttctccccttcctccctccgctccgagctccgccgcctctggcccaagtccggcgacgactacctcctcttctggtatatatacatatatactctcccatgcattccatgcacatacactctacgtatatatctacctctacgtatatatctacgtattgatctacgtataatatacgcagtgacgtgatggaggagtttcacaaggagatgcggcggctagccgacgagttgctgaggttgttcttgagggcgctggggctcaccggcgaggaggtcgccggagtcgaggcggagaggaggatcggcgagaggatgacggcgacggtgcacctcaactggtacccgaggtgcccggagccgcggcgagcgctggggctcatcgcgcacacggactcgggcttcttcaccttcgtgctccagagcctcgtcccggggctgcagctgttccgtcgagggcccgaccggtgggtggcggtgccggcggtggcgggggccttcgtcgtcaacgtcggcgacctcttccacatcctcaccaacggccgcttccacagcgtctaccaccgcgccgtcgtgaaccgcgaccgcgaccgggtctcgctcggctacttcctcggcccgccgccggacgccgaggtggcgccgctgccggaggccgtgccggccggccggagccccgcctaccgcgctgtcacgtggccggagtacatggccgtccgcaagaaggccttcgccaccggcggctccgccctcaagatggtctccaccgacgccgccgccgccgccgacgaacacgacgacgtcgccgccgccgccgacgtccacgcataagctatagctactagctacctcgatctcacgcaaaaaaaaaaagaaacaattaatagagcaaaaaaaaaaagaagagaaaatggtggtacttgtgtttaaggtttcctccatgcaaaatggtttgcatgcatgcatgcaaagctagcatctgcagctgcaagaattacaagagcagagaagcagacagctagatggagataattaattaattaattaatctaattaagcatgcaataattaagattattattctgatttcagaactgaaaaaaaaagtgtggttaattaattattggttaggcttaattttatctagatgtagaaaaagaatcaagatcttcaagcaagagagaagaggatcgaagaagaaggaaaagaaaacgaaaaggacatgctgtgttgtctcttctagttgtaccctggctgctgattaagtgctttgttttgttgctgcaagcttgtcgttactgattattagttagttatgcatctaattgattaaactaatctgtttggcattttggctcgagctaagctatagccaggctggtcaatgataggaacttgtacaatttaagcaattgaacctgatcctgtactggcatgtatgtatatatgcaagtgatgagaaccactagctagtatagctagacatgtatttgtatagatgtgtgtgtgtatgtatatttatattcctacagtggaataggccatggatgtgtaagctagtgcagctacaagtctgcaactttgtaggacacatctggctttgtactgttgtgcaagcaagcatgctctcaacaagttaacaaaccagatgggccagacaatgcatgcatgatccacacggatacaatgcaagatgtagaagaagagaagaacaagcaagaaatagtacatggttatatgttcagggaagctcgaaattctgagaagcagctaagatgagtagctagctggattttgtatgaatgaatgaatctgaaaaagtaaaactaaactggattttgtatttcctgatttctagtttatttttttagattttacaactataaattcttggaattttgttaaagaattaattaggattctgtttgagggagtcgaagatttcgagagaagccatggctccgagaagctcctcgaaacagggctacactatgtgctagcttctttttttttctttttttctttttttttcttttttttatgccgggaacactatgtgctagctgtgtgtttacgaatcatgtacataatacatgtggggcaagagcctgaaagatgcagggtttgggcttttcctgcaagcacaaggccacaagggagccccttttgttctgaaagagtgaaagaaattggagatctctgcagggatccctttttactttttgcatttcagcctggacacatctatgatctactgactactaccccctcatttgcatgcatgcatgcatgaatgaatgatgcaaaaccagagaagatgccatgcatatgtgcattaggagttaggacacagggccaggcctcctcaactaacattcagattttcagaggctgcaacttgcaagcaaatctagtacaaagtactactagtgccaatgccaaatcagatgccatctctatctccatcacacacacaaaagctgagtagttagagaggcagtcagtacagacatggaggcagaggaaatttatgtgatggttgcagaggaagccaatccaggggactggaaatctgaagtttggtgaaggaagcaaagagaatgatgagtgagctagtagtagcaaagctaggtcactgagcccagtgagtgagtgagcgactgactggatgagtgaatgagcatgtgcagaagcaaattgaatgcatgaacacaagagagattttaatttctcggcatcattctcttcctcccattgagatcatttcatttcatctctctccctccatagctggcatgcagcacggcagccaagtcactgaacacagggcaatattaagccattgcaggggatgatcagttgttgcatgcaatattcactgtccgtccagtgaatcaattccaagaattaatgccaccgattttttatttttgatccgcacgcatccctgcacagcaaagaaattaaaaaaccgtcggttttcgatcaaatttggatcaatcaaacttctcccctcaagaaaacataaataaaattatataataaagagctcaccgtcttcgtcgccatcgtctatctatggatggtgacatggatgggtaggtgtagcagagcagatacggcgggctccattggggcctttctgtctacccggagcccggacaggcaccgcgacctccacagtacgccggccgggcgagccggagccccggacaccgacggcgcccgcggcattttgccattgccacctcatttttcatctcctcatctccattttttttatcatcttttttcagacaacgatttgttgttatcttcttgcagagtaggcatgccaactaggctcgccagcgagtcgcgccactgtgatatatggcctgtatttttccgggcttcattatctaacactatccgtaaaccggaatccgcgtgtagtatttgtctaggctctagaaaattcctggatccgccacgcggagagtcgcgtggctggatttatatgcatgtagttgtagttcaggtgccatggtgaaagctagaggtatggaagggagctaggttggaacacttgtaaggaggaggtgcaaccatgtgtaaggcaagatggatatgggtgaaaaaccggatatatgatgatttctttgcaggttaatcttcgctttctgatctttactgaacctcatctggaaccaaccaatccgggcctgaatatatatataaaccttttaaaaaaatccacaatatggcactcgtacaaacgtgcaattaattactccctggaaaagatcatagtctcctaccattagtagcaagtagtagtagctatcccgtttttcgcatgaaggtgtttgtgccggattgggaatttggattgctgcttggtttcatggtgtgacaccacatggaggataacgatggccggccggccgcctcgagcacacgcaactcaaccctgcctcaaagctcaaaaccagtagaagggtaggataggatgctggagatggagtgagctctactccgccaacgacagccaggcgcgacgacatggcactggctgtcgtggcggaacctagaaagattttagagcccggacaaatctaactacaagatgatataacgttagttatggtggcaaaaccgagtaaacttttagagtccggacaaatctaactacaaacgacataacgctagttgttgtggcaaaaccgagtgaacttttagagcccggataaatctaactacaaacgatcgaaacgatatgacgctggttgtcgtgacagaaccgagtaaacttttagagcccagataaatctaactgcattaagtatttgatatctattggttggctttagtataacggagccaaaaataacttttagagcccgaacgaatctaactactggctggttatgtgcatctcgcgatgcagaggctgggatttgacctctcccaagcatcgtccagcggtatttgacatctcactaaaaaccacgatgcaaatacaacggcagacagactgctagctggaatgaaacagggagagatggtttcacgttgaattattctccttttcaagctgtaaaaggatggtggttcagaaacagtaaaagaagttgctgccactttgatgccatcgtcgttgtctactgttctttgtgtgtgtgtgtgtgtgactgaccatgacagtcagcaatacatacacattgccggtgtgtaaatacggccgtaaatttcacaattaagacgggaggacaaacgaggcacattgatttcttcttaatcaccacgcgcagttaatggcgacgcagtaataataactctagatctctcctctttcttctacctttggccatgaacaagatgagctgcgaccccaaagaggaccacccaggatcagggttttctggcacgatcatatggcagatgacacacacaaccatgatttcgatcgatcacccagcacggcaaaagcgtaatggtctctgaaattatctgaattggcatatgctgagtgcatacatgatgatccactccataatgctcctctgttctgaacttctgattaatgttgatccaccaacctggtccagcgtttaattcccaggataacatcgatcctctccaaagaaacaaaaggatgtgatagactaaagcctctccttcaggaatcttacaggattttcacatgaaccagttcgattccgacaaaaatcctcgaaaactaatagtattattcaatccactccataatgcagacagcatgcatgaatggcttgatcttggtagctagcgaggtactctagctagaatccatggcatggccttttcactgcagaagggttggccgggagggacagggataatatcatcgatgtttaatcagtcaggttggggggcaccggcagctgcagctagctaggctaagcaacagtgctactgcagggggacagtggtgttgatgtgtaatgctacagctactgtatgttggttttggctccagatcaatctatcagattcagatatacaaactgtacattccaaacaagatggggatcggatatgatcatccatagatgaacagtcaggtggttagcgatggaaggaacagtgccggatgctgctagctgcagctgctgctgatagctggctggtcgagaggcatcatcaactccattgcactggggaaagctgcatcatgcatgtaatgcagatgcagatgccgttctgaacatctgaatgttgcagggctggggctgggcttgctatgctagctagtagcaaagcaatgcaatccaatgacaatgcccgatacagtattgggttatctaccctccttggaatggatgcagagacatgcagtgaatcattattgtgttcgcctctcatgcaggagtactccctgcatactcataagggtacccacaatggttatctataggctctatataagagatccatgtcagcatattttcctacttggaagagattaaatgaagagagagagcaaagctatctactaacctggagatagtctatagagaaaaacgaggcaatgtattagagagctatagatacccatgtagacatactattgagatgatttactattaatctagtctattgctgagatgtacatgttttatagataacaccttactttaccattgcgggtgctctaaagcatactcataaataaagccgtttaggacaatgtttaagtcaaaccttggaatataaatcatgaataaagttgttgagtttgaaaatataaaaattatatgaatagatttgtcttgaaaaatactttcataaaagtatacatatatcacttttcaataaatatttttatagaaaaaagaagtcaaagttatgttttggagactcgtgtcgctgtcctaaacgacttcttttacgagtatgtagggagtactgcacaatactactactccatccatcccaaattataagacactctttttaaggaaaatcaaacttgataatttttgacaacttttaactagtaagcatactaatcatatataggctaagtattatgaatgttatatcactatattcatattttaaaatattttcatgtgatactaatttcatattcgtggagagcataaaataaaataaattaataatcaaaatatataattgaagacgtataaaaaagattcttataatttgggatgtacttttcaacgagcagtgcttatcagtggcagaaagaaaacagtgtatgcatacaaatggaactgacacaaattccaaaaagatgaacttgcatcatactgtaggtcactgcatgcatgcaatgcaatggacacatactagagtggttcctacctgctgctctacttgtttctagcagggtgactgcacaataatgagtttgcaaattatagagttgcatgtaccgatctagttcatcttgaatattaagatgacaagaaaagacgagcaattcacttatatttcaatacaatactacagctgacgtgaaaactgcaattattttgtgtcagccagatgcatatcaagcctagaggtcttaaattcgaatcacgactgactacaagtttttttaaaaaaaaaaagaaaaaaaaacaatggctgactacagttggcagccttcagatggacctcataaaggaagctgtctcaaaaaggaccaaaacacaccttagaattaatcgtcctagtgttggtttgtcctagtgttggtacacacacgcaggcagatcgagccaacgacatggacacgtagcctactggctgactacacgattaattaagcacatgctaatagcgttggacaaaccaaaaacatcgaacaaaagcttcagttacccagcattgtcagcattaatatgtctaaagttgcagcagcagcagcagcagcagctactacgtgctcggatcagacaccacacgtatgtggcttgcgtgttttgaactgattgggtggttgattagcttaagcctgggtcaactagtgttaattagtcttcgtcaaacagatatatgtacgtctccatctacattatgtttgtcgatcgaacagcgtgaggcccatggcggttggaaagctgaagctggacaggcacggaatgctgggaaaaaagggttgcttcagatgacaactagcagctgggtcgcaacgatgacagcccaagcaacccgaagattttaattaccagtactactccctcggtccctccttcccaaaatatccgcatttctaatgtacaattgttttgtacttgcatatttgttttgtacttgtattaacaaaatatgcgaaattaaataagagacattgaaattggtcaaaaccgggaaattaaataagagactactgtgattagttgaaataagagcatgaaattgttatattttaaaataaattcttaacgctcgaagttgatatattttgagacagatgacacaagccaaggtttaccaaattgtttagggtggggttaccgccacgccacgccacggtttggcggttatcacggtaaccacacggtataccatgattttaaaaactgaaaaggttaccgtacggttttgtaaagcatgacgcaaggtgtgcatgtgattgcagtcactagcacgcatccaggcgagtgaccgtgacatgaacccactgctgcgacgacaacgttgatggagacagatgacatgtagacgccggcccgaacaagtgaacaactagccggtgcaattaaagccgtggctcttgcctatctcaattttaacgggtgaggggtgaccaaggtgatgtgtatcgcaaatgcgtcggtggcttgcattgagcacgtgtaatgtgaggcgtgcgaccatatccccaaactcggctaacccttggcagagaagacatcgtcaccaacgaattacgtataggcgagtgactctcattggaattaccatgatgaagaggctgtgagaattacaatgtggtgaggttgtggacaatgtgaagcggaaggttttaattgggcaagagttccaacgtcgcacgaagtctaattttacgaaaagggagtatacgcttttggtttggagaaggcatggatgcatgggtaggcaagaaggcaggcgacaagaagcagcacgagacaggaggcccaagacagagatgagctgggcccaagatgagatgagatgagatagagggggtgcgattctgacagcggcgtgtgcacggcatgaggtggctgctgccccgccgccagccgatgtgggagggcccgggccccggccggcgacagagacatggtgtgggcgtcgccggcgcaggggacagccaaccgtgccaaatggccccccggcatgtgcgcgatcgtgtcgcccagcactgcctctcgatcggccacgccgtcaaatcaaaatgggcggggacagacaagtagaacagccagccaaccagacaccagcagtgctcatctcttaggagtatcttctacaagtatgttgtatacgcatatgatatagcagaggacacaagggtataatgaaaaactcaccaggtaagaagggcaaggggcaaggagagatggcgaaggggatgcttggtgttggtgtccaggaccaatcttttaacacccagcgctctgctacaatgtgcaaaatatatatgcggcatcagggaccgtcccttgccttttgttttccatttcatatgtaaaaagttgagccagtccaaagttttcatggcagaatgttaacgctaagatgatagatcgacaaagaagaattgaatgtgccaatgcataatgccatggaacaaagtgatatcccagctgatcgatcagtctaaagtcagcacgacaggatgtgaccaacactcgctctaagtccatctgcatgcaagttcaccgactatccgccgtgcttttgatcataggtgcccataactaagactcaagtcagcgagcgaatgtatttcttgcctgtgaagtctttcagctgctaatgctttatatcctttgaaagaaatacaggtatcccatatccttgggcaagtcgacagaggcagcaaccttactatcattgaatattacccacctcccgtctttgaggacatgggcaacgtagtgcccacaatgggtagaggtgcccatatggctcacaaacgccatcaatttgtatcctgcagagcatagagcaatgttaataaaccaagaactgcaaaacacacacacatactgaagatagataatcaaccatctagaagtattgaacccaatggtttggaaacacctacagtctgagacaagtttggagcttacttttatatggtttggctaatcattcactaccatggatttctttacatatatcttaaaagaaaaaaaaattaaaaaagtaagttttcttggaaacttagatgggacatgggtcatataattgtaaatccacatccatttcttgacgataatgtgccatcgttattcagaaatgctcagggcatgtacaaagtcatctttcaaatgttgcaaactacaaattcaacattaacagttcagaatgttaatgaaattagctcatgagattggaagcttggcactagaaacagtaaaacagaaggggtagaaaaacttactgccacttccatctggtatgtgtgcatcatcatcttccatattgcttgttgaagaatcagtaggtactgagctaaaagcctcagggtggctaaaaatccagtctgttgctctctcgatatttccaccctatcacattagaagtacaaaacataagcctccgatcaaaaaggttggttgcagacaacgggaaaggaacaccctaagacagttttgaaaggtcattatatgaaaataagcaaatatcaactttctgagaggtattcaacattgcgaactgtacaagaaaatgtaaaagatcaactatcatggatgaaattaaaaacagaagattattacagaagctgccaaggcctttcgagcaacatcttcttgaaatccgaaggaaacaagagtttgaacgctagtttcatcaacagtttgttcagcagcctgtgaatctttagatattggatcgttgatatctgtatagcagaaaggtgattaaagtttgtagcggtcaagttacaaattacaagacggccaatcatcctttcatgatgacaaagaagtaatatgtaacatttctgtttgtatactgacctggatcatccatgtgtgagagaagccaattcatcgcctcctcaactcctgtgtttgatgtactaatagcagctttctggcaatgaagataattgaaccccatgcttgccagctgagatacaatgtcctcactggcaacaggatgaacaggttcagctttgttatcaccagaagctgcaagaatatgttgcagtcagcaaagtcaatcgggaaaatctgatcaagttgaaaatctaataaacaacagtctaacctccttcaggtagtagctcttcaccaggctgtatgcctttgctgcgcatgtgcgagatatcaattatatctggcacatctacgtatacatctgaggggaaattcaatgtcaagactcaagacaacaaatgaccaaatatggtgaaaagaaactgaattactgtctacatggaaacttagttactacctacgtcccaaaatataaggagtacgttggactcggttattatgaaagtggaactaaatgggagaaggctgtgattggttgagaagaggaggtaggtagagaatttgaatggtggaagattgtggctggttgagaagagaatgtaggtggagaagttgttatatttgggacaaatattgaaggctagaagttgttatattttgggatggagggagtgtatgcaccacgaaaccagctcaggttccaaaatttctcaaacaggagaagtgaaatactaagaacttagaagtaaagcctagttgttattcctgccaaattataggattacttcaaaattattgtttgttggagacagagtacatcaaacaatgcgatgtgttacatcacactacctccctttttaaatagatgaagccgttgactttttgttacacgtttgaccattataatttatttcgttgtgagttgttttatcactcaaagtacattaagcatggtttatatattatatatttgcataaaatttttgaataagacgaatgatcaaacatgtgttcaaaagtcaacggcatcatctattaaaaaatggagggaatatcattcgctggtaataaagcctcattccaatcaacttctatcaacatgaattatgggataaaaagtttactgggccagaaaatacgaagaatataggtcatcatatggataggtactgctagagtgctagttctttcaggaaatcagtccgccatacagtttggggcaactattcgaatctagagtcagcacacatgagagacaactgacacttgatagggacattacctagtttctttggcacccatcctgcttccattacaaacttgcgcatctgcaacaccaggtaatcaggaaatgttttaaagccagcagtcctgaaaaccaacaagttatataatgtgttagtaagaagccatctcctgtttccacatcattaaacagacctatactaaactataatgaacataccattttactatttgcacacaaggacaatgttgaaacaaaacattgtgaatgatccaggagactaaataagcagaggaatcatgttcaaaataaaaaccaaggtcatgacacctcacactgagaaattaaaaaaacaaggactggaagttccctattaagtgtctcggtaatggtcttaagatagtacgactaaattatagcagtacacccagtcacagtaatgtgttaatgttgaattgctcaggcattacatttcatctgctatattgagttgaattacagctagccaagttacatataaggcaagtttgagagattcagtcttttacaaactgaacatgccacagatatgagtttgcttgcattttgaaatatttcttattcaatcaataaggctgtaccacatttccatgtatataatagaaccaaatggcaatgaagatatgcatacttaattgctgttgtctttgaattcaatgcagtgctgtaaaattcaggcacttcctccgcgcctgaaaaacttgctaagcatgcctccagtgggactctaggcctcacaatttcctcattagacctgttttatggaagcaaagtgaaacataagtcgtgctcattagacagtgcatgagctatgaacaacttacacttcctttccatccaaatccattgcagctttcttctcatgaaatgcttctagctgctctgcatatctcacaggtgtcaaggatatatgcactaactttataatacaacagggaaaaaggttttaaagtcacctttgttagtagcttcatgtaacggtatgttcaaagaaagaatgtagtcagaacgtttgttataggagacttttccagaagggcattgaagacgctcctcaatgaagaatttgaaccctgtaaaaggattcagctcatggtttccggtgtttgcctgatcaacttggtcaataagatgaaggaagaaatcaagcgcatcctggacaaagagatgagttaaaatgactatttggaaaaaattgtacccaaaattgcagttaatgatgcaaaggaaaattcaaataagtagctcctcaaccaaaaatgtgtgattccaggtccaaagtacctgttgcctcatactggaaaattcgggatgctttgcagcaataactgtcttaaacatacgagggtgtattccttcttgtccctatcaatatggaacataaaaattaggagtattcaaaagtgtgtccaaaagtactattcaggctgtaagtatcaaaaaatgagaataggatcaaaatgagatctgctgatcacattatgtatcagaaaacttagcaggtatagtaagtatatggtactcccgaccttgggccctgttaggaacgccaaacattttcagattccataggattgaactatatcgtgagtaattccattattccagacagggtctcgattcatattgaaagtgaccagtggttaaaattgcatagaattgaaggaatagaagttaaagaatttgtgcatccaatcagtgaatattggctgagttgaaatccacaatagtattaaacttccaaacatgtgggtaggattccatgtttacaccatgtttgatagcaggaagctgtgtgtagcacatttaggaattaaagcttccttagaatttgacttgagtcacaatttatgctacagaaaaggaatattccaacttccaagttctcgcacacagttaaatgcaggcaggttttgtatatcagttgagacttgagaggacttgcccacccaaatagggaccatatttgtcagagaattaagaagctgtaatttgtgcacatatccaaaataaaacaagaaagcagtctactcgaagattgaaccattactgaaacaaacaaaattgctaaggtaagtaggtaactaccaacaacacaaagcgtaacaacaggcaaatatacaaacaaattcttacctcctgatttggcacagagtatttgccagagagcattccatgagccaactttgtcctgaaaatgtcaagtgatgagtataagagcggaaatattttttactaaaacttcttccataaaaatagattctttctagatttcttttatcataccacagtagcactgaattgaggaaaacgttcacttagaaacaaaatgcaaagccttcaatggacacttggacagcatgatatatgtttgattacagcatttgctatgagtctaacacactggaccactacagcacccaggatgaattccctccagcagctaccaagcgcgagcaaagaaacaagaaagtgctgattcaccaaaaaaaaaaagatcctagaaagaatcactttgtttgtgattgcaagtgtttaaaaaagtaattgtacccgaattacggtttcttcacatacaaccatacaggataaatggccaaaaaactgctttatgtattatccttacatttagcattagaagaaggtaacactgcatctcacaccaactacctcagaatagtgactaatccaataccaatacacgcaaaaacacagatcagctggtgtacacttacatttgcatgttcaagtccaatgttggatcagctggggcaattgcaaatgcagctttcaagctctgcttctcaaagtagctgaaatgatgcaagaaataaatgcaagagcatgtgctactaaaaaggaaaaaatgcaactctagacaagaagtgctgaagtatcaattgagaaagtagaaccaaccgtgatataaaaggatgagttgaaaacataacttgcattactgaggccatatagcaactgcaaagaaggaaacgcatgcattacataagagaaattattacaaaagaaaattcatgacgtcaaccaatgaaccaaagctacctatttccaagatttacaaggccagtataaccagggccgtataaaagttcggcatctttgccactttcttgtattctattccagtcataatttgtgttgtgatcaagctctctttcagcagtagtcatctcggtctgcacaacaaaagggtcacatcaaatagcctctaaactagacagatagacaagcatataaaggggaaaacacagtatgaacatgagatgctacagaatatattattcccatgaaaaagtactaatctgttactatcacaataaaaaaagcaagtcatattgagcagagctaaattatcgctcataaatgtcatcgaaaatgatactactcaccttttggagtgaagaaaaatcaataccaaaatgtgacaaatgctgcgctaatagtggatcttcaacgctatcatcttctgggtatgagaaaacgtctgagctgtcacagaaaagcttgtatgaataggtatatttaaatataaaacaacagtaacttcagcagcacatgcccttgataggaaggttgctttaggactttaagaatattctttgttaaaactaaaataagacgaaagcaaaatatttcaatggaaggttaaaatatcagtgtaaattacttttatagtagctaattgggctgtgtgttataaattatgaagtacgagcagtatgtatccagggaacaactctggaatttaagaacgagtcttactgattaaagtgaatattcaataataattgcaatatactccctccaatcacaaaatcattaacattttccaactttttgtgcctctgaataaagacaagtatttataacaaacatatctctaaaagctatttaagtattacctctggttttaaatatatgacaccatccacttcttttctcaaacgttgaccaacaatgtttattcaattacttagttaagtaaagtggtcatcaaatgtactttaagagtgccttatatgtttgtttatttgcacaaatatttctagagaagacaaatagtcaaacgaatttaaaaggtccaccgttttgtatatttaaaactagagggagtatagtattctaaaagtgcattccaagttgagcatcatatatatgacacttttaatttagatattacaaaggatacagtttgtgagaggttaaaaggggtttagttcaatttttcacaggcgacaacccaatgtcaccgtaagttgtattcgataatagaagaggaagcctaaatatgtaaaaggtccacgagtagcattacctgctgcttctaaatcagcagtaattgttccaagctttaccgcaagaggatatttagtctgttcgtagtgttcaatagcatgattattccccccacttccatcccaaagccgcctcccacataggatcatgccatcagttaaatttaaccagagattctcagttttatcacacttgctgcacttccatcctgtaggtggcacaatgacaccattgtctagctgcttcagatccatagcatgtgcactgacttttttcttgtcagcaacccaagaagccaattgttgttttcgatcagcactttcggcaagtataactttgtcaactgcaatcctaacctgtggagttgtagagtagtaagtaactactatgtagtaagtaagtacaatctcttatgtcaagcacagttaccttctctggcaagtcaattgatggaaaagggagagaagtaaattcaggcaagataacaatttcaaaagcctcatcgtattcgggttcttgatcagtgaaacctccctccactcctataaattgtagaaaacccggattagtaaagatggtcaacgcattcatctatttgccatcatgggaatacagaacagagaaaatacaactatatagatctaaatccaggacataggcaactattctaattacaaataactagcatacagatatcacataacaaacaattcaccaacatggccaccatatgttggtctctgtttccagattagcaaacaaagcaatgcactaccatattttttctctacagcacagtagctcaacagatcaaacagaacacaagatatatgataactaccatagtttggtaagtctctaccacaaaggggaacagataatggggatacagattttcaacagtatgaaatacgatgttgatcatagggtaaaaacaagtcgcaataggaaaacgatcacatcatccaaacacaatcacataccctaacgcgattcatgcgttcacaattttaacagtatgaaatacacgatggtgatcagtgggaaagcgctgtcactcataccgatggcgagtagcgtgggcttcttcagcgggcgatccgcctcgtcgtcgggctccggcttccggcgctgcacgatgtggaggtacacggggttcccactcttctcgtagttccacgccacgtgctccctcccgaaccccaggaacgaggtcatgtcgacgtacagcccaccctccgacctctgcacggcgaaatcggcgtcaaaaccctaaccctaggaaaccagagcgaagggggggacaaggcgtgggtgggtgggtgggtggttggttggtttaccggggtgtcgaaggagacgcagcactcgtccttgtggatgcggctgccgggctccgggatgcggaccttgtggaggtgcgagcggaggagatccatggccgcgggcggcgccgggcggcggcggaggaggaggagcgcggcggcggctagggttttgggggtggagacggcgaggcgacgaggtggggggagggtggaagaggggaggagtgattagattagagatggaagaagaggggttaagttggtattggtaggggcaggagacttgtacgggaggcgatttaaacacgggggttagtttggcttttgccggcgcatttattgtcttgtttttagattttctttcagaaaaggcacaaatactacccctctgtcccataatataaaggattttaagattttacttgcactgtttaaccactcatcttattcaaaaaattttagaactattatttatttttttgatttacattattatccaaagtactttaagcacaacttttcgttttttatatttacataaatttttttaataaaacgagtggtcaaacactacgagcaaaaactcaaaattccttatattataggacggagggagtacttctttgtttgatattatattttgtttttttctaatcaagtttcattaagtttgattaagtttataaagaaaaccaaattagtttcactaaaactaatatttaatatattatgataatatatttgttttgttttgaaaatgttgctatatttttttataaacttgatcaaactcaaaaaggattggctataaaatatcaacacggcttataatagtaaccagggataaatatgtgaaacaaaatgatacatccatctatccctaatgattttttttcccaattacaccggggacttttttttttgcaaagtctgtgttcttccccagtatacccaactcacctctcccgttctccacgcgcacgcttttcaaactgctaaacagtgtattttaaaaaaaattatataagaaagctgttttaaaaaatcatattaatcatttttaaaaaaaagttaatacttaattaatcatacaataatacgtatttttcgttttgcctgttgaggatgaagggttcacaacccctcctcccgaatgccgcctaagaacagtttggcactactactccaagattttattagctagagcgatgtaccaaacaccttcaagatcttaaataatgtagagtggaatttgccgctttcctcctgataattatacggataggcatttccgctactcaaaaccgataaaaagttcttgtaaagttggattagatgacattccacccagcctgttttagaaacggttagaacctctagattattttggattactaaaccagtattttccatctactcggacggcattttatcctcctcactttatgaacgagaaatacatttttctccaggttataaacctataaagtcaagtggtaaactaaacaaaacagaatctgagaacctgttaaacctgtgatgatggttgcaacaactaagcattgtatttacctctgatcattctgatgaagatgcatatgactcttctcaaaaattcccatgtaggtgtagctatcattgtgaaagccctacaggatgcagtgttcttccaaactgaagatcagagagaaagatgcacattccctatctgataagaagaaaaatcaatgttcagagaagtaactgaacatctctgatcaggaaccaatgatctgttcacagatttgtgttgcaatcgatcgatcaaaccgtgtcatgggtatttttggacaggctggggaatctaagagccgtgcaaagactgaacatgcaaacagggcaaatacattcgtttattgcaggccagagatgccgattcattgctttccccagacaccaagcatccgtgacgaaaccacgtttgtaaaattcagtaagaaaatttccaatttcttgctggaattgagcatacttcttacaaaaaaagtcccttgaaattcctacgagaatgccacattcatcacattcttcatattcatagcagagatgcagcagaataacttcttagaattcagaccataaacacttcagtagttcagatagactatgattaatactaaagcatagttcatgttctgtacaaaatgctactttcccagggtcagcaaaaggtatactaggatagcaatattttcatcagtcattcagtagccagctactttgtgggggatattataccatatagagtgtttataccatcatcacacaatagctcttcagagctgatggtgtgaccaaaaaatgaggaagaaaaaggcccatccttagaagagggttagagggcgcggctagcttgaaagcacatcatttccacagcttgacgaacttgtcgtggctcgtggaagcgaccaaaccggagcttgacgacgccagggctgtgatgaggctgtcatgagctgcgagcgtcatcgttctgttctccgacatgtcccacagctcaagagactgcggcattcaaacacaaaaccagaggtaagcgtactacaggcattgtaaacatgaaccgcggtgaaaacataagtggtctctatggccgaatgcttgttcttaaataggaaaagtatttcattgcagtaaatcttcaaaataattgcatgtgtatcatgaaggaatatttgaggaacttgatatatgtgtaatgatgtactgaaattcaagttgtggaatgatcctcagtgtgagtgagtagtcatgagttgatctagaaaaagtcatttttaaccagctacttaggaattaggatgatcagtgcagattagttttgaatgaatcgtgacgcatgagcataaaagagatccacgaatataaagtacttgcctggtaacaaccaatgataagcatagatgaatatgaagggtggaaagcacacgagtgaaacttgctcccggtacagctaagctcttgcacgcagcgatcatcgctcccagcattcacagaccacaccttcaccgtgtcttcactgacagatacaacatattcgccactgggatcccagcatactgaatcgacatgctttgtgtggccctgcagttcccaataaagaggacagattaaagtgattggttaccatcactcggaaactctaaagattaacatggaagtgaacactggctacagctagcacgatgcgactttgaaaatatgtaaacaaccaagcaaggacaactaaccatcaagggaaatgaacaccacaaagctaattacaaaataaatagatagatttgcagtatccaaaactcactctaaaaacgagatttgaaaagtaaatacatccttgcacatagatttgttggtcggtatatatgttactggaacctcagtgaatttagaagatcagaatgcacgtgccaactgcaaggtagaaagtctctacaaacctcaaatctcctaaggcaagcttgagtctccacatcaagtatagagacagcattctccgaagctactgcaagatatcccccatgacgtggttgaaatctcagctggcttgatcctccctacaaagggattggaaacaaataaatcaagaaacagtgtatcctacaaggcatctccttttgagaccagttgttgattatggatggagacacctaataacagcccattaactacaaaggggttatgacagtgattgaaaccaattaacaagtaggtatggaaaacatctaggatgttttcttttacgtaattttaggatgttttcaacagattgacattcatcatgcacattttctataaagagaaaagtctacaagtatacgttggagtgctttgtcaaggaaatgttaggattgttcacaataaagcagcacttccagattgacagaatgctgaataagaaaaactgagtaaccttaaatatccggacgatgtttccattgttgatactccagaatcgaatttcattatccccatcacaagaacaaatgaggtcatccttgtttgggtggaaatccagtgacataacagatgctgagtgcccagtgaacgttcgaattgaatagccttgctgcaaaagtacaatgacagcattagaatatgatgagcagtaaaacacaacagtactttgctgcccttgcagctttaacattacaagtactgacattacccaggaatctgaaagttcagaagtatcatgcttatatcccctagagaacaaacaagttccacttctacaaaatgaatccatgccatgcctatgaatctcaaaattgatgttgtagatcattcacgacatatgaccttgagatggacattgcttactgtattctttgagaatttatagcctacttaactttatgatgttgtttctacataaagggcagttcaaaaggtaaaaaaatctggctaaatatacaaatggcaatttgatatggtttcagtgctagttggcaggtttttgcaacataacacagaggcaatcaccgaggcaaatagatggtaggaaaaaagaactaaacagttatgtacttacattgtcagcatcccagaccctgacagttttatcaaatgaggaggtagcaaggcgtggaatgcttggactgaatcgtacatcagttatcaaaagagaatgttcctccaatactgacttctgttttaaagtttcagcatgccacaataccacctgcattgaaacattgcaagtatctatttcaatatcaccatgaagtcaaagatatgcctgcccacttccaagagtatcaactaggctgagcatcttaacaagcccaggcatgtgcacttaccttcttatcatgacccccagtagcaagtagctttccatctgatgagaagtggcagcatacaaccttgttcgtgcttgcttgtacagaagagacctctcggaagatgaatcctgcttaagacatataaacagaatcaaagctctacagaacacaaattcatgttagacttccctacaaaatacatcataaatctaacccactgaaccaatatatgttaccacatgacatattagataatttcccctctcacaggaccatagcctgaaccgcaccaactgctcaatttccaagctaaattcacctaagtgagttcagcttgttggtactatttacaccagccataattacattcaagactaaactggccagggtaaccactgccaatgatgttaatatgtcaaagccaaccattcaacttcaactagccataagttacaaaacagttagccttatcacacctttagtagattccatacgactgccatctcttcgatctgcatcatcatgcgacaggaacgaatccacatgatcttccaagcagccatcctccacaaaacgatccatgtcagcctgcagtgtgagttatcagatgttcagaagtcaggcatcaaacagaccatcagtgcaatgaaacatttccaaantatgttgcatgcataatatatccacgtaatagggccatagctgtttggatttagaaccagttgtaacttacaagttgatttgatggtgatcccattgtccctgctgtactggtaccgtaaacaactaaagcctttgataagctagcattgtggtgcagcgagggcattgaaattgtgtctcctgggctttgcgatgaaggagttgagggttctgaggaggggaccgcggtgtttccagtgccagaactattggctggaccagacgatgagattggctgtttgcgttttcgcccattttgattcttggaaacctgcaaaacaatatatttatgatggatacaagtcttaacaaaaggataggcacagtaacaaatcaaggtggtaatgttgaatatatgtagaaggaagtgaaacctgttcacttccacggaatgaattagacaggcttccatcaatagtaacacttccagctcccattttttcctgctggcctggaaggtgattagagattggtggttgctggctaagtaaagaatgctgaaggagctgttgctgattgctgctttgctggtgctgctgtatagctgctatcttctactacatataatgacgaggtgttaaggtcgaaaaccaaagatgtagaagttatcttgaaaaaggtagcttcagaaaacatgtgagcatgtattaatagcagctagatcattatgaaatccaaatagtatgagttcctctgttcaaaagattatattacacaaggaccaagaccgatattttcatgatttaatcactatgctatagtagaaagtaaatggtactgtgttatgcaaacttggcaacataacataacaagaacaagcatgataaatttaaatgaaattctattactgatcactgacaagaattaaacaatataatctatgtacatataagatatcaattgagaacaaaattatgcataacccggtggtttacaaggtactattacttacatccaatgtatcctcgcaaataaataaatgcatgaatatagtaaaacatacaagtgaaacttaccttcatcagcatatctgtctccatgcgctgcacaggtgagcacatattttgcaatgaagggccaacactaggaataacttccgtgtaggcatttgattgaccatccctcccaggaacaatgtttcggctactcaaaagcatccgaagccttctgctgtccatctctccaggtgaagatgtcatattttgttgtgcttgaagcagaagctgctgttgttgtggagtgagaaattgtagatggtgcaatggttggggagactgcataaaagatttctgttggagaaacccagatctaagctggtctaagccctgaaaagttataatcaaatggtaaaacatcataaaaacaaaaaaaaaaagaaggtgctgtattcaaacttgctcctaatttatagcttagaatgccagttaaggaatgatgtgaagaactcacagtaagaggccaccctttcaacgtcaaattgttccctgctgggttagcgcctgccagacaacagggtatcaaacaatggcactaagtacatgaataaacagtacagcaggtctaagaatttccagttagcagccagaaacaacaaaaattagtagagttcaaagcaaaaaaacctggtactccaattaatgatccatctgcccctgcagctctcatgtgtacagcagcatttgtgtctacctttatttcctgaaacaaatttgactcgtctagttatagacaataatgcatgagattatacatctgaaataagactacctgtgttgatgcctggagttgttggttccgggcctgaacctgttgcaaagtacctgacacgccaccagttgatccatggaaaatttgcctaaaaacaattgatcaaagcaaatcaatacacacacgctaacaggaaaacagaagctagagataattgccgttaaacagccattacagtatgaaccatcaagatagcattgattacggaaatttagtcaaacagctactacatgctggatagatttattgtgaataatatgaaagtaatataatagtttttattagcacattttagtgtacaataagaattaatggtcaaagttgcaatttgaagaccgcaaaatagttaggtaaaaacaaaggcggtaaacacaattcaagcatggtaggaaatcctattagatcacacattataggctgtatttaagactgatatggtatttattttgcgctccaaacctcccatccccaccccacactcccccccccccccaaaaaaaaaaaaaagagaagtaaatgattagcaagcattattgagcagttggtaccctgaagcctgagctgttattgcaacggacttcagcatagatgatgagtttgattccagcagttgtccaatattttctgtaaacctttgctgcagtataaagatatgcatttcatattatgagagtttagatcatgaaagcaacaatacacattgccatgaagaaactacctttgcaggtgcttcatctaaggtgtccctttgaacagaattcttcaccctctcctcgtacatctttgcagacaaagaacttgcagctgaagtgctttgtcgtgttggaggatcagcagaaaccaaaccattatgtgcacttgtcggcaaatgactgctttcactacgctgttgttgcttctgctggcggcgttgttgctgtggttgttgctgactctgctgctgctgctgctgctgtgcatgcctctgtagtaggagttgttgcatttggatctgctgtgatgactgctgggaatgagcctcttgctgctgcagctgtgatggctgctgctctcgagctttaattgactgtgtctgggttacaaaatttatgtgtaacaacatcaggaacatgaaaatagcattttgcaataagattgacgcatcatataccaagaaatggctagtttcaaatgagtaatcaccagaaaatgaacaggtattagctacggcctactacaaagggaagggaccattgccttcaaagtaattaatcatattgataataaaatgttgactttgaaattttacttgaattttaaagatgataatagctggagacaacatagtatgtattctacgagaaagtgttttgcattctgtaccttctaaaatgattaagacacatgttcttctataattgtgtgatatgatgcagcatgttttgtttggaaatatggggaaacatttgattttttttttaaaaaaaaatatccaccataacaagtttttcctacatagatgaattaggcattttcttcttttttttcaagagtgacatggaaagttcttgaatttggttttcaatgtttgtgtggaatttaaatccatttgctttaggcaaaaaactaaatccttttacagtgaacatgatctctatgactgacacaattcaagcatttacacatgtttattgtaagataagcagtaaaccactgtaccaagtgagtgcaagcaaacaacaaggacaagtaataaccaagatgcatgtgctacaagaacctcaatgtacgaagcagcaacatcagagtgcttctcgttcgtccttgcaatgaagatgtcccagaagacagaccaccactccaagaggaaaccccctggggcatcaattgctttttttgcaaaacaaaagctgacatctttcagtacaagaagattaaaatcgcattcattacaatgcagaaacatcagagactggcatgcataaatcagacaaaacaatgtggctgtagtattgttcctttgtatctgcccggtacgagtagctaataatactcgtgtctcgcacatgcacaaatgtaagtgtagtactaatcaagctaatcaaatgatcaatttgtaaccatcctattggcccaagaacaatggcagtctgaggaacaaactatctggtcctaatgcagaaagagcaaagattgcaaactacagtagtatgacaaaattcagaaattgatgcactgaccaacaggatcggaagacacgctgccttctgcttggatgccttggcagtgctctgcaggttcctcttcaaaagataatcatggatgtacacgtccaacctgcttccaagaacagacatggataagttcagtgcggggatatataataagtaaaaaaggaaacatgggggtttgcatgcaagcacagcagcaacaggaaggaggggatcgaaagttttcatgagaaaataaaaaggtaaaatgcagattaaagtgtgaaagagcaaataaatttcgagaaatgaaaaggcagttgcaatgcaaggtaaaaggaaaaggcagttgaaaagctagcaagcaataaaccaaactagtactgtatccgagaaaaataaaaggaacaagaggaacaagaaaaaaaaaagaggcatggcttttgcaaaaggagaaaccaaaatgcagaacggaaaatgcagaaatttcagggaactcaaacagaatctcaagcgtctgcagccctctgaaatacaacaacaagggaagatgaaggacaagattcttgcaaaaatcaccagaaaaaaagacgatctaaaccgccaagaaacgaatccgaaacccctcccagaggaaaacaagaaactaatcttggggaaagataaccatgcggacaccaagagaaccaaatggaatgacaaaaaaatctcaagacaaaacggagaacatttcaccaacataaaaaaaagggaaaaaagaatgtgcgaagaacatcaaaccaatctgatcgcaataacaaactaaggaatgatgaagcaacgaagaacagaagagagataggagaaagctcacatcttctccgcttcccacgcactctgctgctgctgctgctgcgccatggccgccgccgccgccgcctcactccctctcactcctcgacctcgctcgcggtcacgcacgctaaacacaaaggcacaggagagagcgcctcaggaactgacaaaaggagagcacaaaacacaacgcgcacaagctaaaaaagaaggatttgaccgctcacattcgcctctaaaatctactactaatcgaggtgcgccaaaaaaaaaaaagaggcaaattgcttcctttttaaaatcttcggtcgcggagagatactatacttctactaccagcggcaatgcgtgtggaatggaatagaggaatcgaataaaaaagaaagagatgaacagggcagtgtgagtgaggagaggaagggcttaaacaaaaaaaaaaaactgaagatgactgtcaaaaaaggtcagtttaacaatattttctttcttgaaaacgccaaacagctgcccatttcacactgttttagtggttcaccgagtaaaaaagaaaatgagattgtgggattgtgaatttgtgatacagctgcatataatccaatccaattatccatatcaattatcgttatatgcgattaaggccgagagagagagaaagaaaataaatgtgaaatgatgctacagttctagggctataatgagtgtgcatggattgatgagcctgcagaaaaaagcgtacttgcggctcactgtagctcctcggtcgaaactgcccctccttttgcacgatatttcgctactgccatcgtggctatattttttttctcgaggcatttgtcatgcaggtaagataagggaggtgattctgtagaacagtagagatgatgagactgtgcaccaggttttcaagagcccaattgccaagatttatctggtacttaattcattgttatgctttgttttggtaatgtaatgaacatatctcatcatctctgagcttttttttaacacatgacagatgcatgcacttatatgtacacttgtgcatagagcaccttcagagattgcaccaacatatctttaataaagaaaatcatgtagatgtctcactatcaataggtataacagacatatttcatcattgtgtaaaactttgatgtttttattaattggccatttaaggttttaaaatttgacggtacgtattttgtgacaacgtttatccaagagtgaaggtgttggttattcttactttcctatatgtgattttgaatctccctatttctactcggatttcacttcttatccccttctggtactaagtttgtaagtcagtcaaagttatattctgtgattaattgaatagcacgttgcattcagaacgctgagggagtgtttggttaggagggagggggaatgtttgaagatgatggaagtttgaggggtgaggagttttaagagcgaactctcgtcttttcaatatttgggtagaggcaggtaactgagagaaaaaaataagttagtatatcatcacttaaaattcatttctcactcaaattcatcataattctcatatctcctatcaaacgacagagattaaaaatgaaacttacaggatcaatcccttcattagcttattactctaaatttccaatctccttaccatgagttaccaaatatgtattgatgaaagttataagtccactttaagggttcctttggaacatgactcaaaatacaggaagaggaaaacttaggattgaaatgtcacgacatgaaaaatcctccaagcaatcaaactacaggaatcattcaaacacaagtgtttggatatatcgaacgggtgagagaaaattgagattacatgtttaatttgctagagagaggaggagagaacatgccttaaaaatcacaaaagaattcgaaacaacgaggttagaccccatgctagaattcctcgaagatgtggagagacttttcctatcccttgaaatccctttgaaacaatcgtatgatccaaactaaactgctcatatagtaggagaatttcttttgaattggattcctccatttttttcctcatcataaaaatcctttaattcaaataagccctaatttccccattcatccaggaccaaatgtgtagtagtagtattannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 59674 - DNA, 13854 bp, Oryza sativa
atgagttaacagggcatttacagtcttagttttttttattcttagcaaggtttagcgactttattatacgtgtgctttatattttaactggtagacaatgttacatttccttgtgacagtatttatttgagacatcaaactgctactctgctggatgcatctcgaaattgaaaatacctgaatgaatttgaagacatagatgaacgaattccttttcatcagcagatgctgccattgaaagttggactttagaagctcaagcctccttacaccataatttgatgttgaaagagctgcgggatgattgcgatgtctattgtatggaactgctaactcatcgtgcagcctcttgccaataacaaatgttttaaaggcttcagcaaattttgatacagagacatactggtaaggataatcatagtggcaccaatattgttgctggtctttcttggacaaaacctgcaacacagaaaatgtaaataactatatgcaagaacagtccagttaacataatatcacaaacacagattacaactgcatacttcttgcaagaagtcagcgacgttttttctttcaggacatctgaatcccataccggcaaaaaaatcaacagcatattcacgtggtccctgatatacaatttgcccttcagatatgaggatgacatcgtcaaatagttcgtaagtttctggagctggttgcaacaaggatatgattgtagtgccgtcaagagcatgagtagaatgccttaaatacttgataatctgatatgtggttgcactgtcaagtccagtagatatctcatccatgaacagcacacgagcagaaccaactaacagctcacctgcaagagcaacatatatgagcacagctgcaaaccagaataagcatgcaatccatacaacttgcaattgcccaatttcttcaaccatcagcaccaataatatgaaggagattaaattatcatgcaacaacctgttgtcaggcgcttcttttgtcccccagagattcctttgatcatttcatcaccaacaattgtgtccgcacaaatgtccagccctaaaatcttggctagataaaaattagcaattcagaaatcttgccagaaccaaatgattcaaaggtagatcatgttgatgctgtaaaaatgataagccaaaataacattgtagggaaaattgaaaattgtcttgaatggatgggaattaagtgagccatttggttaaacagcttgatgaaaatattgagtaaatttcacaaaaccctaggttttataggacatgcgtaacccaaaccccatgtattgcaatttgtctcaaggaaccccatgcataataattgtaaaaaatagtatgtgatatatacatattagccgcacttccaacacatgtcaattatcgaaagtataaaccattttgtgtttatgtaactggttaatctgtcattaacagtgagcactgtgtttgtgttgagtttgtgcaatcatggagagcgagagtgaggaagaagaatgtacattttgtgcccattatatatgtgaatataactaaaaataccatatattattatgcaaatgaatattttataaaaatctggggttccttgaaacattttgcccccaaaacatgggggttttcgttatgcatcgtgaaatttgctcgaaaatatttgtgcagttcactcaaagaagcaaacacttgagactccaaagtagataataatagcagctgaaagggatacaccatataccttcattatatattctgcgacaaggcttgtctgcttcccctcaagagccaatgcctgaaaaattaagtacaaacagtgtcatgagacaatcaccaacaaaacaggtagtgtgtgtccaaataaagctggatgtgatctaccttcatgaacacatcaaggtcctcatcgggttttataccttcattcttttctctcctcaagagttcaacgagcatatctacatattgattaacgtcaaagcgcaaactaccaaggaggtaaggaacaacaccaaggacattgtggtgaaatgacctaccatactttattccaacaccctgacagcgcccagcaaactctaaggtttctctgaccgtcatctctgaggcatgccagtcttgctgactgacataagcagatgttctctggggcacaaattcattcagatgatggccgttgtaagtgatatttccagacacctgcaatccattgggtgttggtagtcagtaaaaatgtatagtcctgaataatgccgcatggttaaaaggcttcttgcactgatcagaataagcacaggcctatagcactgaagtagtatttatttttcgatagtatttctgaaatgagaaggatgagcgtttgaccagaaaaccattttcatgctatttgagacactagtactcttgtcagcaggtgatagatgcagagttggttgattgtatacatatagaagagatttgctcatcatctttgagcggcgagaatcgaagaaaagaagacggattgatgtgataaggcacacctttagtccagggccaagccgtccggcaagggctaaaagcaaggttgtctttcctgaacttggagggcccaatagcagtgtcattctgcagcaagaaccaagtgtcaaattttacaaggtcgtacaatttgatccagcaggaaacaaaaaatgttctgcacgtggtgtaccttgatggacgaatgatcccactaacattatccaatatcggcaacttcactcttccccctcgatagatcctcaaatgcctcagaaatgcctttcagaaaaataaaaacagcaaataagcacatctagagctcatttgtgaacccactatttacagctttttacacagcaattttacccagagtaaaaaaaaaaactaatgtggttaaaaatcatgctactgttcaaaacagctagtagatcattgctgcagagctgagacaaaggaggggaaattccagtggtggattggtccaacctctgtcatgttgcaaatgaagtttgggatggttggcagcgccctgctcccgacatgcacgtatgcgtccactgtcagatcctcgtacctcacttcgatcttggggaactctatctgcactctgcaaccaacaaaaataaaaaaaaatggagagcagcacagatgcttcagatcagcccatgagcaagtttaccaacactacaagcatacaaacaaaattctacaccaaaatccaaaccaaccagaggagacgagcgatttacagatcctacaagccgtagctgaaattgtttcgtaaaattacagcaaatttttttgtaaaatcactgcgttccaaatgtagccttccccgcatgatctaggcatttcatcagaacgatagctttagagtaggatctgaactagcaagcgaacaaaacgcaagactggcatgtggggcccatgtgtcagccgctcccggccgcaaagcttccctgcgtttttggaaaccgagtacttcgcccacagaagaacgcggcgagcaaagcgcttctagaagcttcccccggtgtgcgtgcgtaccagttgggccccacatgtcagtgtcgagtgttgcgcttctagaagcttccacgcgagcagagaggcagggggagagagagagagagcagtgtggtactgacgcgtcgaagcgggagcggatgcggcggaagaagtcctcaacgtcgccggagtcggcgaggaggcgatcgacgagggcggtgcggtcgccgggggagaggcccgcgacgtcgacctcgcagagcgcgtcgtcgccctggacccggtcctcccccggcgcgggcgacctgagcaggcccctcctcgcgcgcgccaccgtcggcagccgctgcagcgccgcccaccgcagcgcctcctgctcgtcctcctcctccctccacgaccccgacctcgcgaacgccgcctccgccgcccacatctccgcctcctcctcctccccgcagcagcaggtggtggtggtggtggttgcagcggaggagcggaggtggtgggggatttatggaggttgtactgtgaagctggccatggccgcagtggcaattgaggctggctggatccatccatccaccgactccccctcgcattaatggcgcgagacgagacgagacgagctcgccttctctctcctcgcgtcgcctctgctcttggtttgatttgatttgatttttgtgccctaattctgtggggaattagaaatttagaattaagcgtaggtggaggatggagggagacgacgccttttgagtttagaccgttcggtttggctcttctgggccacctttgctgctacctcgacatgggcccctcctctcctgcctccacgtggcccaatcgttgtgcttccttctatctcacagaaaaaaagtttagtaaatttcgcaaaactatcgttactcttaatgtgatgtatcataaaactatatatttaatactaaatttaccataaaactacagattaattaaggtggaatatcataaaaatatagatttagtaacaaaagtatcacaaactacatatttaatgataatttaatcacaaaacttgaacacttataagtccaacataacattagtgctaaggatttaaaccgcaaaatctataattttatgataattttttttattaaatttgtagttttatgatacttagccttaaacctatagttttatattaaatttattggtaaatctgtagttctgtgataatttaattaaagtatttgtagttttgtgaaatttactttaaaaaaagtttattcttcgtttcaccatgccataacacggtgattttctttttagccatttttgaacgcaaggctccacgatttctgtatggttggtagtttagatttcatatgaatgcgtataaattatttgtgtttttaggatgccttggtagaagatgttttgatttacagtgaaattggatagagtcccgtgcttcaaaataggggcgaacctaccatgggatggcgcgcaagggtcttagctttgtccagtttaccctctctattattttttcctgatccacaactgcttcaaaacacgagtgattattttcttgccgttgattatatgtttgggaaattatttttctagagctggatcaatgagagcagtagaaacaggttggcacgccggcacgattcacgtgaagaagccaaaacaggttggcaaatgcagatgatgaactctcggaaatcagatccagggctgtgtttagtccgtgtgtcaaaaaaaaatttaagtatacggacacacatttgaagtattaaatgtagactaataataaaataaattacagattccgtctgtaaactgtgagacgaatctattaagcctaattaatctatcattagcaaatatttactgtagcaccacatagtcaaattatgacgtaattaggctcaaaatattcgtctcgtgatttacatgcaaactgtgtaattggtttttttttgtccacatttaatgctccatatatgtgtctaaacatttgatgtgacgaaaaagtttaaaatttaaagaaaaaaatttgaatctaaacacggccctaaaaagatgatggacagaaagaaacaaagcaagtaataacattcaacggaggacatgtaatgagggctgaaaattgtgagaaacagttcatgaaaccaatagggaaatagtcttttcagtttcgtacttttaatttattttctaaattatatgtctgtaaattttaaaaatctaaaactatttaggccctgttcttttctccaacaacttttggattaaattttgaatactcgtggcacgcttttcaatctgctgaacggtgtgtttcgtgcgaaaactttctatatggaagttgttctaaaatatcaaatcaatccgtttttcaagtttgtaataattaaaacttaattaatcacacattatactatcccgtttacgtaaataacttagtcttcatcttcaggagaatcaaacaccaccttactgccttacaagacttgtaaataccagaaactcctagtccaagaagtagtccctcctacgtactctacagtggagtgttgtgtacgcatgcacgcggtgacaaactctgacaggctagctgggggtggggcctggccgcacggccttgccggagccggccggaggagttgtcgccgcggctaatttgtcgccggccggccaccggtcgatctggattatgggccccacacggcggcgtcttctactacccagttgatcaaagacagttattgggctagagtgaaagctgaagctgaagctcggatgagcgcattgaatgcagtccccaaccgcatttgctcgcgccaatcaattcgccactgtcaacactgtgtcactaatctggtactcctcctgctagtttaactgctgtaatttttgaactaagattatagtcaaacttttataattctagaataacacatatgaatctgtctttcaaagttctataataaaaataaaaaataaaagtaaatatgcatttatttattgtatatattataatagaaaagtaaggtcaaatatttattttgaagaccgagtcatttaccaaaacaccaagaattttgaaacggagagagcactcattggtcatcccttcgtctcatactataaattgctttaggtttttcaaaatcaaattcttaaaatttattaaatttatagaaaaatatagtaatatttaaagtaataaattaattttattaaatctaacattataattttttagttgaaagtattactgtatttatctataaatttagtctttttttctataaatttgatccaaactaaagaaggctgatttaaaagaaaatcaaaacacttataattagtattactcgtttcatccattgatgattataattactactagtataactaattacagcctggaatagtgggaagtgctgcatgagtataattgatactctatcctgcttgcagttgcagcatatgtaccgtatactggtgtaccagtataaagtagtgtatggtcgtatggatgtatacaggagccacgccgtgttggttgctgtgagcagaagccattccattatacgactgggtggtctttaataagcgccctataaaatgtgcacatacgtatatatacatggtactccattattgcgctgaaaatatatactgaaaatgtataaaatgtgcacatacgtatgtatgcatgtctccttgcattcagatgaggccaatacgcagtacaaattggaaatgatcttgccaaattttacactagtacaattttaccatggaatatgagagatgcatgcatgtttgcaatttccacaggccgttcgagaagaggtgatccctatccagcggtatcacagctagcacagaaccacgtgttatcaaaaaaaaaaggtaacagcgtctggattttttatgtttgattttttttaaaaaacttattttataaataaactcttgaaaaataacttgttttagactcttctctcgctgtcaaacaccctggcccgtttggttgggggagttttcaggagggattgagagtttagatggatgagactattaactgttttgtttatttgggagacatgagaattttggtggaatggagatggggaattgaggaatgaactccctccttttcaatacctgggtagggggtggtaattggaagggaattcctcatttacttcgcctaaacaaatctcagccatccgttttcattaatgatctaatctcaaactaaactccctatcaatttccaccacctctaccaaacaagagactgggatgaaaaatcaaattcccatcttaatctcaccatcacggcttgtttggtaactcgagggagggaattgggagtttacacgagggaattgatgatgagattaaaatgggaatttgatttttaatcccagccatcttgtttggtagaggtgatggaaattgatagggagtttagttggagattagatcattaataaaaacggatggttgagatttgcttagacaaagtaaaggaggaattccctcccaattacctgctcctacgcaggtattgaaaaggtgggagttccttcctcaattcctcatccccatcccaccaaaattcctatgtctcccaaccaaacaaaacacttaatagcctcatcactccatactcccaatccctcctaaaaactccctccaaccaaacgggccgtcaattctctcatgtaaactcccaatccccttctctcaagttgccaaacaagctagtctttagctgccaaaacataaaaaggttggtgcagaggaattatttataaaatatttttttaaaagaatagtcataatgtaaatatttgttcctataaatagatcatcgacatcaaagacccttaaagctacgttcgattctcctggttgggaattcattccctccacacagaaaacagagcggtacattagcgcgtgattaattaagtattaactaattgttttttttcaaaaatggatcaatatgattttttaagcaactttcgtatagaatttttttttaaaaaaaacgtaataacgtttagcagtttgaaaagtgtacacgcggaaaaagagaggagtgagttgagaaccatgcgtaccaaagtcagcctaagcctttagaattctttttataaataggaggcaccaacctccttagcatcaactacttatctaccaggaagagataatattagcactaatgttattggcgctgagacattggacctcgatattaaggagggtctatttctgaaataagttttttaaaaaaatccatttaaaaaataaattttttaaaagagttaaaatgtttttttaaaaaaaaacaggtaacagcttgatccatcgtaaaccctgaactctgaaactccacaattttttttatttctttcttagaagtgagtgcaatcatgcattcgtgcgtctgtccgtccgctgctcctgcctgccggctgccgctagctaccacttcgccgatttccccttctgcagccactacctccaggctccagatgcgcggttttcctcgtcgcaccaacaaccatcacacgtcttatacttttttttaatggaaatcacatgtcttatactacattaacttaatatatgatagagaaagtagtagaaatacatgacatactctctctatcccaacataacaaaaaaaatgtgatatatgttcagattttttttgaaaggacatatatgttcagattttagattcaaggtaatagaataagttacattttttaatatgtttgtttattttaagagcgatatccctccattccattccaccgatcgagggcatacgttgtcttcgtcggtgtgtggtgctactgctgcagtaggttgtcgtacatactcctctgtccaaaaaaaattaaactctaggaatgaatatggacacacactaacacacgtgtgtctagattcatcatttttttttgacggacagaatactgtccgttcgtcgtctctgcttcgtcaaatcgtcgatgatcatcagcaaagcaagttagtagacgcatctctctctctccctctctactccatggccatggccattgcagctgtagcttgcatttgggaccattatatatacgaacgcaatgcattgattcaactatggccgctgcgatgctcacacatggccaacacctcttcttgacctttggagaagagaagcgattcaactcaattcaggccaagttttccaaactttttcttcaaacttccaacttttccatcacatcaaaactttactacacacacaaacttccaatttttccgttacatcattccaattttaatcaaactttcatttttggcgtgaactaaacacaccctcggtagcttgctcgttggcatgctgcaatgcaaagcgagattcaattgatttctttgtaaaaaaggtgagagccaggcatcaatggcgccctaaatgtgcccagatcaacaaaacccaatgcatactgtagcagtacgtagtactgtagcttgcagtgagcccccaagtagtacttggctaatatactcttgtccttcaattatttgttcgtttgcaattgccttgcctggacttctctctctgtctcaatcttattactatagtttcttggctttgagttgcattggggcagcaatgcatgtgaccatttcttggtactaatcatatactgttcatcctattttagtcctgaagaatgactctgacgcaaggcggcaagggacgatatacagtagttactgtgtcaccccctgcaggttagcctgcatttctgggcaatagtttaaggacacattaatttggattataatatgatccggtaactgttaaacggcgtattttgtgcgaaaacgttttatatagatgttgttctaagatatcatataaatccaattttcaagctcaattaatcatacgctaataactttttttttacgtgcccgtacttaatgtccatcttcagcaagttcaaatggggccttaaacgacgccgactattggcattcttggaaaactcttttaaaataaggatattgatcaactttgtaatattcaattcgttcgtgtataccttcgaataattgtgtcttaaactcagtttcagcagcatccatcgacacttcggaatgcaccctaggtgaggttggttgggcttgatgattggtaccagtagtggttgactgaacttgctacctgcatcttcagaacaagtggtactgaaatgctatatatgcacctgctagtaaaatatatacaaaaaaaaatgtgagcaatttcactgctagtacatgatagtagcaggttagattagcaggtaaagagcagtactaccccttaatccagggactttgatggcagtactgcaactctgcattgaattgcatttcaattgtgcagcatgcagggacaagtgcagtgctgcctccacctgctttcttctgcaatcatttactcccgtataagcactctctctttcaatgcattattggtcatctggcaatgagatgtgtgtacacatcctctcaaagtctccaacacaaaattagcatcagatttcttgaactgtcagtctctgatagctcctccagttggcatttgttgttggcaatcacacattctgagtccctgatgctgatgctgatcttgtgatcattgttgcttattgcttttcttatcaacccctgctgaatagtactactttctccattccaaaaatataaggatttttaggacttaaatttataccacaatataaacatccatgtacttattcctatgattcccatcatttcaatgaatccaaagccaatcacaaacttgaaaagggaatacaagaatttagattcaaaaaaaataaaatctgaactactgaagtgagtaaaaagaaatctttagacctaacattggaaaggagtatttgctaagcaacctagaaatctttatatttcggagtagatggattacttctaacctgcttttctggtgcatcgtatcaagctatttatatgctgctgatactatgtttctttcagcctgaagattgctgtcattttctctcatgtactctctctcactcaatcacgtttgcaaagaaaaaaaagagaggcatttgatgcaccgctagtgcacatcattttcatggatctctttacataaaaagaggaggaaaaggaggaaacatatttgcttttttcagagaacggcgttttaatgtgagccaatcacatgtcgctgctgtgatgatggatcgatcactgtacgatgaaaaggacacaggttggaggagaaaagagatgagaagtatgtggacagcaaaaaaaacacaacatgcagtgactgaaaaactattccaagatccgaagcgcgtgttctttttagcttattcataaaattatttaaacggattgttctactctattgcttaaatcactcgttgtaatgtaagctattagtaaagcttatttcttaaaatatttaatttattcctataatcaaatcaataatccacgaaaacaactctaaatttacaatcactggtttggcagcaattggagttttacaggaactggaggtgatagtgcttgaagaactaaaatcatggttgtatgcaatgtctgattttggctatacattcactttggatgtaaatgccggtttaatataaaccattatataaaaaaaatgcaatgtctgattctgcacgagcacatttcttcagaaattgaagtgctaacaagttcaagaaacatatttttttcagtttttgagcttgagaagtgatccgaaccgaagaaataaataaaaaagctgaaataaaagcacatcatgaacacttattgttgctattatatcttattatatcttacttgtgtacagctgctgtcctgattgtagggaaagaggttatcaagcaacagtaagtactaaacatgatcccctttaatgacaatggtattccacagggtggatgagtctttttttttccctctactcaacccaccaaatcaaatttccactaggaaatccaatgtgacaaaagttctctgaaataaaagcttcagcattttctaacaaccatgttgtaatcttgaaattttggctcttttcttctcttgaactaatcccagaattattatgtaactgaaaattttcacttttgtgatttgtatgtcatgtatttcttgcatccattgggctgtcactgtaccattccctcagtcacaagttcttgcaagccgcgccttaacctctcagcagcaagccttgtatccgattctttcaaccctccgaaagaaacccggatatatccgggacctccactggcgctcccggggatcacagccacaccatgcttgtttgcaagccatctgacaacttcaaaatcatctgagcatttctcgggtagttttgcccagaggtaaatggcaccctcaccacccttgacagagtccttgccaagcggagacatcgcttccatgagcaattcacggtttttcactagatctctcaccctttctctgatccattctggaccagcctctaatgcgtagagcgccaggcgctgcccgatgatggaagcacagataggtatgttatcttgcactttgagcagctgtgcatgaagaccgtcagcttcgtttgggtgggcaatctgcagcagtcagctcatcagttcttgtaagactcactgatcaacacagattgtgcagccactaagttacttatactgcattgctatggtgataatttaagggaatgccctggtaaaagattcaagtggatgcgggaaattcatgaaactgaaagaactcaatattgactcttacatcagcattttcaagcctaagcagaggatgaaagaaagagagagagagagagagagagagagagagagagaggcaaacttacgtatcctacacgccagcccatcattccgtaagccttcgagaatgagaagaggttgacaatgtgattaccctctaagcaatagtgctccattccatcatacataaagtacctggagaccacccaccaattttgcaagcaagttcaacatcaaagttatacagaatccaaaatagccccatatgtagaattattttacagaaagtaaaaggtcagtcaccttttatggaaaagaattcttccgagaaaatgttttcttgaatttcagtattcgtgcaaacatttgaatacagattatctaaaaatcaatgtgatgataattgaaagtttccaaattatacttttatcatatacaagatttacacatgtcag

SEQ ID NO: 59675 - DNA, 17141 bp, Oryza sativa
tcatccaggactcaacttcaagaagtcaagcacagttgctcaactgcttatggtgaactgtccttttaaactactacttaaggtgatcatgtccatgtgtagttcattctttcgtagtgcctcgtctttacaattgctttaagtaatatcaatttctgaagggactgaggagctttatcaacaacagaaagaaaagaagcaccaaaatgacgttgcagttgagcaataatcagtaattgagtactaacttactcataggtattgtcaactacaagccatgcaccagcatttctgcacagttctgaaattctctggaacaatggtgcaatattaagaaataattaaagtcacctcgaatgcaagtgtgcgtgaactgtgaatgagagagacaggttacttcgagcatcggcttcggaatgaaagctccagaggggtttccaggatttacaacactaacaagtttagggatagggttgttttcttgcagaaccttctccaaccaatctgcattttattaaacaaatataaattgtactaccagaatgaactattcttttacagtccttaagtgaaccaaatcgaatgatcaaaaaccatatagctctcaattgaactgagagaaaatgtatcaagtgatagaacttatcaacttacaaagtggaagatctcagaagcggaaaaaaagtggcaactagtttataattgactgttgataatagacatctaaccaatttctccaacaaaaagaaaaagggaagaactatcttaccgacatcaggatgaagagtctcaggattgcttgcaccaactaatatgtcagtaactcctgtcatctggaatgacatgtaggaattgaagtaatatggtgcaaacatgacaactgcatccccagcatcacaaagggtgaggaccacatttacaaaggcctgccaaaatttgatagaagacatcactttatttgacttttatttggctaacctagttggtaaacaaggtttaggtgaagcagtcatacagaaaagtaagaaagcatctcatagaactgaagaagaaaaacaaattggcatcctatagtctagctaaacaaggcaaaatacacagaggaaaaccggaataagatgacaaagctgtaataaatcaggtggaaactggaaagcatgtgcattacctgatttgcaccagaggtaaccataattgacgacttggttagcttattctctctgcgcagctgcaaaatgtatgctaaaaatttcaggaagaaaatagagggaaggcaacgaacatgtttataataattaccattcatattattagtttttcaataaaatattatcgcagtaagagaaatcagtgaatataacacccatctctacatgagggggcatcggtagtaccaagggcaatgtctcagaactgtgctactgcactgttacatggtagcattgaactattatagctctcaacagagcttagggcccctttgatttggaggaaaaacataggaattttggaggatttcaatcctataggaaaatttcctatgaagtcctttgaatcaaaggattgaatcctatccaatcctttaaaattcctatggaatgaacaatcctatagaaattttggaggaaattaagcaagagcttcaacctcttagtaacttttctttgagtctatctctctcatccaaatcctgcgtttttcctgcggttcaatcaaacggtcattcctgtgtttttcctgcgttttgtaatcctctattttacacttacattcctatcaaaatcctacgttttttctattactatgttttctcaatcctacgattcaaaggggcccttagcttccctcccccccaagcccccacagaagctgagagatactttctgaaactttctcgttgataaaattttgtaaggatagcatgtgattcctgatattaggctattcccaacccaatgactaggatagtgtccatagcattaaataagctgtcacataggatgaaaactgatgtggcaagtgaataaatgaggaaagaggaggaaactatgtcttgcatgagacatggtttctacacaacatccaagacattatgtgagataagtagcattaaatttaagtatgaaatagtagtgtttgcattggaagagtagtgtctagtacttatttcttgatgatgtggagtttatggaaactatgtctaatgttttgggttgggaatggccttactctcactctctcagtatcgaggtaaaaaaaattccagaatcaatttctcacatgacaaaggcttagtagtaggcacacaggttcctttgtctcacatgataaaggcttagcagtaggcaaccaagtgcatttgtctcacatggtaattgctttgtgataactgggaaggcttgataacatgggccatggaaaccattatctaacaaatcccaattgaaaaattaccttctcgagaagtgcttctcggagttcaggaagaccatcatcagagccatatttactgattgatggttcccatacaatttctttaatcttattcatagctgcctcaggaggctgccaataaacaactccctgcatccaagatttacattagtttaaaagaaagcaaataatttccagtaaatatcacatgttctgttggcagtaataggaggccagcacacacaccactgccactaatatatatatttggatatcttatttggctagcataagcagttaaacgccattttcaggaactaagcaggaatacaaccattttagtttccaaattccatgcttgataaatagttgtgttatacaaagcacaatatgttatcagatgtactaaactctcctgattcaccttacaacgtgaacagtttactgagacaattgacccaaacagtaaaggaacaatacaaatgatcatttcactaatccatttcgaacactcttcccaatcaaatgcaaacatcaaaatgcctgtgaccaagtaccaacaacaacacaaactcattggtactctcatgaaaacacacacacacacacacaatcattggacagataaccgaaagaaattgcgatccgatacctgcgcaagcgacatcacatccttgttccctcgaagcaattcctgcatctgaaaaaagagcacaaggcacaagagagatagaactcatcaatcaagaccaaagaaatcagaagggaaagatgcgatttcgacgaggcagggagcttcttctccatcaccttgaccatgaccggcgcttccgtctccacggccctcctcgccagcctcccgaagctacccatctcacctcctcctcctcctcttcctcacccctccaagaacaagaactggagaagttggatacgatgttagggtcagagatccaagaagaccaaagaacagcgcagcggcgagcccaagaagcagtataaggaagaagaggagagaagagaagagaagaggagaggttggggttaaagaattcggagacaacaacctctgaacttctcgagtcagtcaccaactgattccccccaagggctcaccaaccccaacatctaaacaagacagaggaagaaatgaaaaaacaaaaactgaaaaaaaaatcgctgctgatctagtatctacggagtatctatctatctatctatcactcttttattccgatttttctgtctcttttcctgatctttttggcttacgtttgcggagggtgcgccgcgaagttggaggataagcatgagacagaaaaaaaaagatcaaaaagggcttgaccaacaaataaaaagagaaactttattatggtgagaggacgaaaagatttcgtttttaaccccaccgctatcattcttcaacgaatttcgtcaaaattactgccaacctgccaactgaataactgatggccgagagattccaggacagagagcacaatattgcgtctgatgatctgacagagagcacaatattgatgcggtattcgtggtgaccgaattaaattcgttgtcaaaaaataaataaaataaatatttcgtcttaaaatgggatttgtaaatgaagtttactactcccttcatttcatattgtaagttattctaatattttccacattcataacatcaatataaatattaaaaatgctagaataatttacattgagaaaaacggagtgagtagaaacagtccatctattattctggtctcaccgcattttgctcttcccaagctgaaaccttttgggctttctgctcaaaagcgaggccgaacctgaacctgaagatagtatagtagatgagaacgtttcagatgagaagaggattttgtaatccacagctataaacaaaaattggctcggctaactagggatgacacggcgtcacctcggatatctttggatcgctcgcgctgcgggacctcagcctcgtgcgaatctagggctctacgacgataaggagttaaaaaaaaaaaaaaagacgatgaggaggagtgaaggcagatgagcaggactgcaggacagggtttcaaaaaccgccgggggcccggttaccgccacccggcggtacggcggttaccggcggtaaccgcggtaaccgcgcaaaaccgcgacaaatttacaaatcgaaatttgaattcaaaaattcgggcaaactgcgcggtttggcgcggttaccgcacggtttgacgcggtaaccacgcggtttggcgcggttaccgcgcgatgtgtaatgggttgcacagtaacgggccggcccatttttttttctttttccaattttcaaatttattctccgttttgctctcaaatttgaataaatattactcttttttgagaaatttcttcaccataaaacactataaatcaagcactaccttcactattttttttgatttttttcttttttttttaaatttttgaatttggatgaattttattaaaccgtaccgcgcggtacgggtaaccgtacccccgcggtacgggcggtaaccgcggtaaccgcgcggttaccggcggtttttcacaccctgctgcaggagcacttgttggcttgttgcccgcggctgcatgtccctgtgttcagccttccgagttcacattcatcatttcgctatgcttatggactaaaatttaaatttataactttaattttagagtttatgtttataaactaaaatttgaatttataagattttctagcatttgtttttaatagttaagaacacatatataaaagttttattcacaaattatattttatttacaaatatgccgtttctttttttttctttgaatctgccaaacgttgacactgaacgatactccaggtttgatgatccacttgagctttggggctaatttgatttcaagacaatttggtattagtgttggtgaaatttgacatcaaaccaaacattcatacgacactactgaaattatcaaaaattaatagattcaaccagaaaaaatattttgtttagatttagacttttcggttcttaagctgacttataattagtctaaacaacaaagccctaagcagtaagcaccacaaatgtccgctttccaactgctatggcgtataccacaaaacccgccttcacgtctcctaccctagcactctcccagacctcgccggagaacacttcgccccccgactgcgatggcggcggcggcggaaacgccggggtcgtcggcctcccctcatcaggagaggctccttcaatccctctccgcccgcgggtggtgcttccgtgaccccagcaacgagatcatccaggagctactccacgcctccccctcgccgtcgccggaggccgtggagaccgagctcgtcgacgtggacctgaggctcttcggcggcaagtcgctccctgaccgcgccgccgccgccgccacggggaggcggctttcctacctccatggccccatcgtcctacaggttccgatgacacccctcttttgtttcgatattagctcagtaattctaattaattttattcctggtaaaaaaaataagggaaagaaatgcctcatttaggaacagttcttagtctgctattgattctgtggctggggattgtatccagattgtggaagcggccagagtttgtagccgagtagactgacgaaaagatgttcttggctgttcttgtatggatatgtgtcaggcctttgtgaaacgatggtgttcttggctggacataaggttgagaatttgtgtctggatgctagggaatggccttacttaagatcgtttcaatcatgtggctggggcttgcgttgtatcattctcagtttgtggatgggtcgggttttgtatccgagcagatgaaaaagatgttcttggctgttccagggtggctatctgaacgtcctctgtggaacaatgatgtctagttgtctatctcaatggtgaaacatgggcttgtctttcctgatcatgattgaacctacatctagtgtttgtggagctgaactgttgtccttgtgttttggatttttttttttactgtttgatccctgcttaatgcaaacttgtttgcaggtagtatcagtaagagatatatatagaagcatcattgatgcgtcctttaagaacccacagcaacaccgccttctgcgctttgttctgactgatggaatttctgaagcagtagcgatagagtttttcccaatcccgtttatcattgaagatattgctccaggtactaaggttagtccaccatgttcttgatctaggttctagatgtgcactgatatttgtcattctgctttattttaggttagaggacatagtcagagtctctgcacatagtttcatctttgtctgaatttcatcttaggctcctaactagttcagtattgagttcccatgtcaccggaactagataaatagaaggagagatgctcagatagctcattgatcaatggtgtgtttctattccacacatcccacatgaataatgtttggaaaacaaaatgcaagaatgctccttgataacattgaatctgaaatcctccttagtaaatgctgcatgaggtttgtgtaagagctacctgtagagatggtgtatttatattgcatcatcaggatggggttgggagatagcattcctaattcccactgtttgtctgtctgtctctgtcctacagtctattgagtttcatccttaatcattgcttatgagcaaactgcagcatagttttgatacagaacagtagaatattttcttagtgattatttacacaatatataccttgtcaaataaacaatattgaaatccgtgattcagacctaaatgcttttgctatttactgactgttttacatcgtcatgtattttctccttctttacgactcatgtagatttgtcttgagaacaagattccaatacataatggcatattgtgcttaagtgcgaagaatataagtatcatggggggagttgtccaatcattgtatgaagagtggcagatgaaccagaaattctcagggttatctcgttcatccttgaggttgtctcaaaatgatgatggagttggacctccaccatttgagaagttagatgttgaagcacgtcctagtaggacatcccgttctcaaacctattctggtaattgttctgtcctctctctctctctctctctctctctctcacacacacacacacacacacacaccccttacccttagttatgtccactgtaaagttggcatttatgcgtggcagttgttatatatataaaggtaccaagggtttgaattcgattctcctggtgaaatctatatgcatgaattaagatgttcagaactatttcctctaaacgagggtgttccttttgggtgcaatatgggtgattatcagttgtgttactcactagtaagattttccctgtgttggaatctgactggagattattgtcaagtcctgcaaaattaaacaaataacattatttggataaaaaatactctttattctgaaaaacatggagctgaactgcacttttgcatgactttagttggaaaacctgatctgcatctggttattatgctgacaatatatttggattagcaagtgaatgtgtttttgacatacaaattacttcctttttttgtgtatatatggagttcatattgcttgtttccgtgacttgtggtccacttggactcctttcttatgtcatagcagataataaggctaggaaaccggaagtcggtcgtcagaatgtgtcagttagttccagtggcaaaccagtcaatgagagttcaagtgatgagaacaaagagtctgcagttgaacccaaacaatctatttcagatggcagaccaaaagagggttggcttccattcaaaatatttatatatatagtatattggtggcagttggttacaaaccttttgctttggcgttgcagtcagtgaagctattcctgttcaaaaccaagccactgcacagaagcttctgcagaaaatgacccaggctgcgcccgaagacagatatggtcggggccatagattcaagggtaaaggcaggcaagaagatactccagtatttaccctcgatgaatgggagaagcgaaaatccgctggtttgaagtccacagcacaaagctacatcgacgataccagccgagacgaggagctggcaaggcagctccaggagcaactagatcttgaagactcctatgtcggttcaacttccctgatcagaacccctttgtgtttcaaaacttccattaccgccattccaagaatgttgattcccatggcattgtgctattttgcagggagtgccagagagttcagacgcagatcgtttgcggatgagcatgttcagcttcagcggtcctgaagaaacgggaggcgggagaagagattttcgagggcgaggacgggggagaggaaggggccgaggacgagggcgagggcgaggcaggggaagattttagcccaatccaaacatccaatggcagtggcaatagcagttgtggtagaccaagtcatgttctttcctctggttcccttcagatgatgcttagctaaaagctaatgtctcaattcagaaacaacatgtactgtacactatcctggatagatttttagttttttgttcacagatgcatggaatcagcatatgattaggcccttttttgacatagctatggattcttttttttttttttgagcttggtattcctaactccacaaatttatagatctagacctgtgatctcgttgataacatttggataaatcattttgttcctattttagatgaaatttaaaattttaaaacaatataatttaatatacaaacttcaaatgtaccataaatatgagatctagagccctgccaaacacaaccttacatttttccttttttgaaattcagaacattattagtgtttttttaataagaatatgatttagaattaccagactatcttactatcaggattgggatttgcccaacgcaaccttatttcttctttatttttttttttgaaattctgaacattattagtgtttttttaagcagaatataatctagaattacaagactatcacctctcaaaaaaaaaagaattacaagactatcttaccatcaggattgggattctgccccgacctggaccgttggatgggtgcacgaaaaatgtttgtacggctgtgatgcgtcctcaggagatgaacgggtaggatcaggcccatcgattcgatgcaacacgcttacaaatacaagtctctcgcgactcgcgtgagagaaaagcatcaagctttcgtcagatctcacgcttatttcttctctcctacctccgcttcaccttcacctgcgcgattccggcgagcccaccgccgccggctcgccggcgatcctcccgaagcatctggtcggccgccaatttctacaccggagcacgcgccttcgcctcgaggcggaaaaaggcttcgtatcttttgcgggcgtcagtagtagtagtagcgtgtgtcggctgcactggcttggagttggaggaggagaggaggagatccatatccgttccgttcgcgagtggtttgatcgattcctttttggtgttcttcgctgctgtgcgcgatccggtttggtgaggtggaggtcgccggcaatggatcacggcggcggaggaggcggaggagtttggatccgggcggcggtggcggtggcggcgggcggcgccatcgcggcgcgcgcggtgcggcgcaagtccgtcgactccaccgcggtgttcgtcggcgttccggccatggtggcccacaccgtcgctgggtacaggtgaaagggcggctaatttctcttttttttaaaaaaaatattattgataaaaaaatcctgtttctgatgtgatttttttgagacgaatcatcatcgtaggttcgcggggatgctgctggtgttcttcttcacggcgtcgcggatgacgagggtcggcgagaagaggaagcgcgcgcttgatcccgacttcaaggaaggagggcagcgcaactggtgagtaagaagatggtctctgttcttcttcttcttcttcttttcttgttccgatggtgaccaagaaaaatagagaatgatgtgaaatctgaaattaatatcgtagagatcagagaggcctcggacatgtttgagattgcgctgtggcttttggtataattggcaggtttacattcagagtggaagcttcagattttggttctgattgtagtagagtaggggaatgtggtaaatctctagaaaggcaaaatagctatctggtagaacatatatgcgatttatttgtgcaacaagggaattgagggcctcatagtgctgctatatgataaaaagttggggttcgttgagttagatttaagtgattcatgtgatgtttctgtagtgtgtacagctaccatgttcgctggctcggtatagtttaaattgtgaaaaataaaaatgagctcgatttgatgatgaagtatgtagtttgacaacatttgaaactgtttaaactgttcaaattgtccttattaacttgaggtatgcctacttcctttcaagattcaactcggaacgcaatcccatttttcatgaagtttgtcttgttgtattttctcccaaatttatccaagaggcatttttcaaaggaaaaagaatcacctatttaaaagggatccaaagtttaaggactgttgtcaccgttattgagatgaataagatgcctttcagtttcagaaagtacccttctgaatctttctaatgcaggtgcacaccactcttattggcaggaagcaagttttgtcaaacagtggcattgcaagtgtcttggtagttttgatagcacttgtcacaggagggagcgataggtgcttggatacgagagaatctagtcttgtaactgccctcattggtggtgttattggacattatgcttgctgcaatggtgatacatggtcttctgagctcggcattctcagcaaagcggaaccacgaattatcacaacattcaaggtaaacattgcattttcctcttttaccaattagagaaatatcagtacatataatcactgttgcttttgacatggaacttcaccagagagtacggaagggtaccaatggcggggtaaccattgatggacttctcgcagcagcggctgctggattctcgattgggcttacatttgtgctactaggattcttaaccactcagtgttcttctgatgtattctggaggcagctgctggttatacccttagctacagcagctggcctatgtggaagtctgatcgattcgttgctgggcgcaacactccagtacagtgggtactgtagtcttcgtaaaaaggtatggtgctttctgcaattgatgttattagatgtctatataccctagttgcctttgaatcagaagttgattttttctttttattgcttctgaattttgtttatgcaggtggttggagtagacggtccgacggtcaccaggatttcaggacggaatatactggacaacaatggtgtcaatgtagtttctgtgttcttgactactctgatcactgcattggcgtgcgtatacatcttctgaggtcttagttgtgtagagtagtggtagaggcagtagcaacacatcacaggttctcatacaatacaactgatgaaattcagacagaaaatcttatgacagttgcttctttctgggcattcctaacaatagttgcaactgttgttttagcaatttttcacacagaatccaatttttgtatggatagattcagctctagtgatcttaatacagatgtcgcattgaatagagaaatctttctttgtatcagaaatgtgtgcgctttgtcatgaacatcccatttgtacaatatacgttatcccattgttatattagttggatgcttgttacggtctgattaataattttatctcggcaggcagcttaaatatatttattcattttatagatgggagcacaactaaaaagatcaaatcttgctgatacctaccaaattttcagaaagtttcatctaccatgatattgtcaccagtacacatacaacaacaaactatggtttgaaatcggaaaaataaattcctgcatttcaaacggcatattatatcttttattcctgactatatatgatatatcatcatcattattttgactgctgaaatgagataaggagatcagcagcagcagaggcattcgaggcagcactcgcaggtctcgtagcagcagaagcagcagcagagggtgaacaggctgcaacaaaaagggaaagagatcacaggtaaacagaggaaaaaaggtgtcaaatggtgaagaagccctcttgatcagggcaaaatctcacatgatctttggttttcttggacatgaaaatgaccactaactacttcagctcatccatctctgaatctagtaggactttaggagtgtgttcaatgctcacatgatgcagaaatcagcttgtctgaagaaactagatgaactatctgatgatttgagaaatgttgaacagtgcatccaagatgaacaaacatgtcctaatttctactttgaaaaataccttagatcacatcctaatctagagaatataacctagtttagatgacatccaaattaataagcaacataaaatagcatcaacagcttctctgaaagattagaagagcatgacagaagaagaggatcaccatgcatagaggcagcctttgtcctcatggcgcttcttgacatggtcggagtaggacatctcctgcgccgccggagggttgtacatcgccgcccgtgccgcggccgccggagacgaagtcgacgacgcagaagaggaggaagaaaccagcaagggggatagatagacagaaggcactaacagagcatgggtcacatgatgcccagcttgaggcttccttttataaggaaactcagctcaggtctgaactgaaaacatatcacttggaaacacgtcaaactgcgaccttccctagtagacatgaacactggtagataactccactgatgaatctctgtttggaacgctggaatttcttcaaatccttttaaaaactatactcttattatgtctttaaatatatgacgatattgatttttagataatgacgtttgacaattcattttgtttaaaaatttagcataaaatgtaaaatataagttatgcttaaagtgcatttgataatagaaaaagtaacactaaaataaatagtacttatatagacgaatgatcaaatattatttcttaagttaacaattaaaaccggtagtgctatttttttgtgaaactcaagctgtcaaaatggccacggattaacctcacaattaagggccaataattgcggccactaggcaggtaatcgagattcgagcagtttatccacctaagcataattgtgggtgctaaatatttatttaacagcgtctggtacacacttgtcaaggaattcttacttgaattccagcagcgtggtatccatactcaaggagacaggacgactgaatccgtgctttgaataacacaatatgtagtgcacatttgtaaccagatgtatcaatccgttaggctgctaatgtacagcattcaagtgtaggattataaaccatttccaatcttaaaaaagttcaagtgtaggcgcatcagagatgggcctagataatttccagaagattatgtatgtgttagtttgacgtcagggagtatacttgtccttgccatcattttcttctattatttgttttaggtttgatttgagcaacaaatcttgttttgtcaatgtttcagttagtcctctttttgaagagatgcttctcatgtggtttagcaaagaaaagtacttgaaaagaccaggcagataacctacaacaaatgttgaaagagatgttttttatttcttctgaaatctcagctactcttgttttcttctccatagaatccatccagatatagtccattgaacagaaataacaaatcaatttgtttaagctgttcccgaagccctttttgtttctatacaagtgcatctgatattattacactgtagctaaaaatgtgcctgttaaaaatagacagaagttcttagccacaaagaacggctgcaaacttgtcatttctctcacacaaaaatcattgttgtccacactttgacagatcactcactcaggatgaaccaatcaaagattttgcctagaaagcaatgcccattactcgagaatacaccacaaaaaaagaagaaaaaatcaagtgtcattttgtcctcaaaccatcaactattaattacagactttgacatgggggggccttacgaaggtaacaaaatgccttctgtatagtcccaggagaagcaagcaacttcatcatcatctagctagctaacaaataagtggaaatggagtatatttgatccacatgtcatgtcacagtgggagctaccagaggagttgatgaagggggtgaaggaaagcttgagtcagtagtggtgatcactggatgtggatggcatgccgcagcggcattccgctccagctgctcccacatcagccttcgccgctcctcggtcgcggctcgcttctcttcttccgcttggaagttgttctggcaggccaggagcaatctctcgtccatgtccaagaacattttcttgacattcagggtaacattgaggaccgactgattccagtgccaacgggtgttcctctccagagctggatatatgatcggtaggatcacctgacgattttgggagatcatatcgaacaagtgctcgttgttccacaagaataaggctctctcagcaacctgcccataattaaaatcagatctttagtttcctgggcaacttctttttcgggaagagaaattttaacatggtcaagaattaaaagatgaagaccgcagactgcagtgctatcacagctctggtcatgtttcagtcctaactcctaagggccctctcttattcaagaagtaaaaacgtttaacttaccgatgaaaggttttatcagctctaacagcatatgccagaaaaatagaatatcagtagataatagaaaattagggtccataatggggagagtgactgtcattagttgttccataaatcaaatggaatgacaatgggaattagaattgtacctaacctaattgattcttgtcatggttcatgagccaagatgcacagcagaactatataatttaaactactttcagctccagttgtatacttaattaacaatggtctgaagcctaccaaagggaagtgttagaggccaccaattgtgcttgagtgaacaagaagtgtgtatggtctcactttagccaacacagagaaagtttacctactgctgagatatcttctcaataatgactgtcataaaaaggtgaaggggaccgtgtaggtaacactaatatactagaaaaagcacagagaaaaaggaaagagatcccaaagcgattctcggattaaaataagaattagattccactgataaacagctttgcaactacttcatgaagcaattcagatgtttaggacaggatagttgcaaacataaatgcagagcgtgatacacagaagagaaacaattcatgaacaaacattaatcgatacctaattcaaattaaagttctgaatttggaaaggaacttacttgaaagtgagagctattcaggcaacttgcaatcctgcggaacagcggtaccatgcatttctgaaactcagccatgtcggtcaactcgagcacctcctccaactcccccaagaacatcatctccttctgactgtttgtaactggccagtacttcagcaggcctctgattacagtccctgcaagcttggtttccttctcgatgaactgtgtgatgcagtacgtcagctgcggaagatacacacccaccgtctttggcttgtgaagcgggatcaacgctttccataggaacaacttgtgctcttccttcaatggcttcgcaaacccgcttatcacactgccaaacacctccaacagctccgctatcccgttgtgatgatccgtctcgaacacgaacctatagaagatattgctgacggccttacgaatgaacggccgattccccatgaacttgccgtatatcctatgcaacactgtcttcaagctgtccctctctctggggtcatcggaatcgaagagatccagcagccgcgagatgaacgagctgtcgacatacttccgggccgccttcgcgtccaccatcggcgacgtcacgaaccggaggagcaattcatacacgacttggaggtggtaccacgaggggtcgaagaacggctcgtcctcctccgtctccgacgccgcggcgcccgacctcgccttgggcgggaacacccggaagaggttggcggcgaacatgcgcacgctcgccgcgatcatcgcctccgtgaggggctcctcggcggcgccgacgcagtcgacgagcgacatgagcacctgccgcttccgctccttctcggtggtgtccttcccgcggtcggagaagtcgaacaccgcgcagcagatgttcacgttctggacgaatgcctcctccctggacctcccctcggcgcccgcggcggccggcggcggcggcggcggcggcgaggcgctcggcttcgccgccgcc

SEQ ID NO: 59676 - DNA, 3219 bp, Oryza sativa
  unsure (1)..(3219): unsure at all n locations
aggcaccccccccccccccccccaaatcaaaccaccattgccagccagcaccaagaacacgacgccgcaaatcacaacaaaaaaaaataataataaaaacaacaaatccgcgcttgcaacgtgcgggggatcgcaagaacggatcgccgagtgccaggcgcgaaatgcgacggatcaagaacccaacccaaagaaagcacctcacaagaaatgggccaaaaaagaaaaaagaaaaaggggaaacgacaggacacctcaggaaatggcaggagggccaaaaatatccggcaatggcggcctcgtcagggccagatccgggggcgggaggcggccaccatggatgggatctcgcggggaggaggaggggaaagcagtggggagcagtgggggaaaaatttttggcgttttggagaggacggggggtggtggtcactggcaacgcgcatgcgcgttgcgcgccggatcatctcggccgtccgatcatggggaccggggaatcgtagccgttggatgttacggcttttttttctctctctttctttttttttattgcttccgttttgggaggggataattgggaaatcgggtgtaacggtcgagaaatgtcgtgtcatttccgtttcgtgtagtttaattcgtgtttttaaattcgttgctgcattgtaatccctcggtattagaaaaaataatataggccgtgtttagttccaaactttttcttcaaacttctaacttttttataacatcaactttcctacacacataaactttcaacttttccgtcacatcgtttcaatttcaatcaaactttcaattttggcgtgaactaaacacacccatagatgtgtacttcctccgtttcaaaaaaaaactcaacctaagatagtcaagattcattctcctattaaggatcacatcccccaactagattagtttttttttaggctggaaggagtatgactctacataaaataacgaatctggataaaaagttttgggtagaatcacatcccatctaaattggtttcttttttaaacagagagagcagtagattctgatggtaaatttgaaggacattatttgtggagggaaacagagggtatgtagcgttgccatagaatccagatagagaaacaattaacctatcatagatggtgctccacgtaaaatagttagatcatgttttttcctccgcgcaaatatgaaatatccacttgatgagaaattgtggtcaattcgttcattgttttctctctaatcaaatgatgggtatgtttgaccatggacattccaaatccctaatcatctcctctaataaactgtagcttgagtaagcatgaagtcctccaaacttttcttcgccccaaggtgaaaagatacagaacttttaaaccattgagtatcacgcaataaaaaagattcagcattagtcataaaaatttgatgtttagagtaatatttagtcaaactttaagatttctaacaatcaattttatactaaaaggattgtacgaatattaataagtttatgacattacgagagtgcttttcaaaacagttctccgcataatattttttaaaaaactaaaatataaggaattaatgatggttggattgtaaaagtgtccgaattttatcctaaacgtcaaatactatgtttatcaaagagactaatgttcaggaccaagttccaaataacggagcctgcagttaacaactcataacttttttattttttataaacaatggtattttttacctatcctctacatcgaattgaatatatacagccatttaaagtggtaacttactctctcaaataactcaatttgaaattctccatatccatcaagatataagatttaaactcgaaatcttgaagtgctatgcaggtgtatatatgccctctcgcaacaacttaaataattaagatcagatttataatttctaattttataccaccacaagtccatgtagcatcgctttctcgaagcagaaaaccaatgaagaaacgacggttgccgccgcagtataggccgacatggatcagagaggtcgttttcttctcacccatgcacaaaaaatagcaaagaaaattgagcaaccgtagtcgtcgatccgtcgccgccgccggcgaccatctccggccggtgaggtcacgccatggcccatcttgtggaaaaagcaggcgagttttgacagcgacctcgccgccgtccttaacgacgacggtgacctgtcgttcgatgatctgatcttatctgttcttcttttctgtccaaagcgtccatggaagaacatggcccggggtagggtaagctcatccatgaatccatcatcctttttcaactgaacaattattgctcttttttcagactaacacatctgatatgttcacatatgattcagagtaaaacactgaacattccaataacgtttttcagcctcaccaacaaactattttgttcgttacagaaaccagaatgcagcagcaatagatacgagctcatatcaatcagcgaagacactaacatccaagagatcatttcgtcagttacaacttagtacaataaccagaatacagcagcaaaagattatatatagatgaacaccaagctgattgcacatcatagagcacagaactatgaactccaaagcaagaccatcgcttaacatgataagatttttacgaaagtataaggccagagatgtccatcgcctatggtgcgacaaaaaactgcatatagcctgacgacacgcgagccgcagcaaagaacatcggtttttttgcgtatatggtcttattcataaagagacaaactgtaggtgtatatttcaagcttcagtgcttcattatctatatatggagagactacagacgagtaacgaaactacaacctttttctcaactcagcatcatcaaggaaccaaaagtagtaggagacaactgtacatgttcatatcacacgtgggcgaacatcggcggggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 59677 - DNA, 28831 bp, Oryza sativa
  unsure (1)..(28831): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagccaagaatccgcgaccaactatgcttaggttcagggcttccatctgttgattaagttcgggtggaatgccgcggacgttaagagtgttgcaatggctctttcgacttagggcgtcagcgaccacgttggccttaccaggatgatagtgaattcccacatcgtaatccttgatgagttctaaccatctcctttgccgaagattcaggtccgactgagtgaagatgtatttcaaactcttatgatcagtatatatttcacagcgattcccaatgagatagtgccaccagatttttagagcatgaaccaccgcagctaactccaaatcatgggtagggtagttgccttcatgaggccgtagctggcgtgaggcataggccaccacatgaccatcctgcatgagcacgcaccccaatccttggcgcgaagcgtcacaatacaccatgaagtccttgcgagtatccggcaagattaacactggcgaggaaaccagcctttctttgagagttttgaacgccttctcgcattgcgggctccacacaaatttctcttctttcttcaacaactgtgtcatgggtcgagcgattttggagaagttctcgatgaacctccggtagtatcctgccaaacctaagaaactgcggacttgagtgactgtcttgggttgcttccaatcagtgacggcggtcactgtttcggggtccacagcaactcctttagcagatatcacgtgccctaagaatttgacttcggacaaccagaactcacacttgctaagtttggcatacaattgatgttcccgcaactttcccaataccagacggagatggtgctgatggtcttcctctgattatgaatataccagaatgtcatcaatgaaaaccacaacaaatttatccaagtattccatgaacactttgttcattaagttcatgaaaaaggcaggtgcattggttaaaccgaacgacatcaccgtgaattcatacagtccgtatcgcgtggtgaatgcggtcttcggaatatcttcatcacgaatacgtaattggtgatatccggaacgaagatcgatcttggagaatacagtggcacctttaagctgatcgaacagatcatcgatccggggaagagggtacttgtttttgatggtgacttcattgagagctctgtagtcaacgcacatcctcttcgtcttgtctttcttctccacaaaaatcacaggagcaccccagggggaagtactcggacgtatataccccttttcttacaactcttctaactgtttgttaacttcagccagttcatttgctgccatacggtagggtcgcttgtacagaggagtggttcctggagcaagatctatccggaacttaatctctcgtttgggcggcataccgggtagttcttccggaaacacgtctccgaactctctgacgatggggatttctgacagtcctatctgatgaagttcggaactactgacagaggttgggggtgcaaagaaaacaaccggttgttccggccctcggtacagagtgacagtgcgtctcgcacaatccactactccttggaattgagccaaccaattcatcccaaggatcacatccaagttcttggtgtctagcagaatcagatccgagggaaaaggaatcccctgaatttctatggggacggcagggctataatactttgctgtcataacccctccaggggtggtgatgagcacagggttcctaagcctttctacccccaactgatttctccccacgaatggcacagatataaacgagtgggaagctccagagtcgaacagaatggtagcagggatggaatgaatgaggaacgtaccaacgatgacgtctggagttgtcagcacgtcctcggccgtcacgtggttcacccgaccccgaatgacatccttcccaccgttgttggagcggggaggcgcttggccttgctgacgcctcggctttgggcatttatccgcaaagtgcccgggctcgaagcagttgaagcacagacgctgcggaccttgagcgtccctgcggccttgaccaggctgcacagttggcgtaggaggacggggcgcacgagtcccttgttgattctgctgctgctgcggctgtgggacgcgcaccacgaattgaggtcgaggcgcggagcgaggttgctgctgctgttgttgctgctgcgaggaggatccccctggatagggattggtgtagcggaccctttggttagcaccctgttgattgcggaaattcgccaagcggcacttgtgcgactccagttccttgtgcttggcttccaagcggatgctcttgtccaccagacgttggaaatccggatagtccccggagactagacggacggacagctcagggtccattcctgccaagaacttctcttgcttctcctcatcttcccgcacatcctccggggcgtaacgggccaggttgttgaactcatgcaaatactccatcacggagcggttgccttgcttcaactctcggaattcccttttcttaagggccatgactccggcgggcacatgggttctccggaaagcggcagtgaagcgagcccaagtaataggttgcccctctggctgcgtagcctggaaatggtcccaccataaagatgcgggcccctgcagctggtgggcggcgaagatgactttctcctcatcgctgcactgcacagtgtctagctttttccccacggcatgcaaccaatccaacgcatccacggggttgttggagctagagaaggtaggtgggcggatgcggaggaactcggcgagtttagagtgttggggaggtggtggtggagcattatgttgtggcggattttggaggtggtggaggaaagcagtcatcatgttggcctgctgggcgaggatttggctgagaatggcgttggtgtctggtggtggtggtggaggcggaggaggaggtggaggtgggctgccctggtggtggtggttgctgccttcgggttggttgccatcaccggtggcagcacttctcctggtcgtcaccatctgaaaaccccacacagaaccagcaaacagagagagctgacaattaaagctaaccacccacgactaccataattcttgaatttattactgctattaaattggttcattaaagttcaagttgcttagtcaaataaaataaagacaggctccgacacagttatgccacacaccggcataaccatgccccacacaactccaacaagaagacaaacgagaaagaacacacgcgcaagcctactaactgctcgtctaccgctgcgacgggccaggacggaaggtgagcaacagcgcatcctccgtgctaccaacgccggaggcttccccctcctggggaaccacgggcgcgggctcggcacgaggggtctcgacgaagcaagtccacgctagggactgacgaacaagctcgggcctggaggtgctcttgcgggcggtgatcttctggctgcggcagacgcggcgacgcttggggcggcagacctctccctgggcgatcttgagctgatgcagctgcgcctccaccgcgtctaggtccttcttgagctgcaggttctcctgacgcagctccaggatcttcatgttgttctcgaccatcccacggcgcaccatctgatggaagtcgatacgagccgcgtcgtacgcctccaccatgcgcgccaggtgcatgatggtagcgtcatcctccgagctagcatcccggaaggtggcgtagtcgcgggctcctccgcggcgagggtggtagcggaagggcgagtgctgcaactcgtccgggtagcgctggtgaagagtgccgatggcgaggagagcggcgctctggcaagtggcggggaaagaatctccacccgcggtgactgccaacgaagtccgctcgggagagccagcgaggatcactgcagtgacctcccaagcagcgtggggctctgcatcgtcaccctcctgctccggaagcggcctgccctggtagtccaccccatgtggataccccaggacaacgcacatgccccgcagctccaagacgaaaccagtcatgtccaaaccacgacgggtgacgctgccggccatctacaaacaaaaagaaaagcaacactttaaaaaggtcagattttggagataaatgaagcagcaagacagagaaagactagagggttttcacaaataacagaggatttttatttcgaaaatactgctaaggcttgggatctacggcttgtcctagggtcaagggggctctgataccaacttgtcacgaccggaaataacccaacgggcgttccttacgtgcgtgcattaatccttgtcccaggaggcaaggtacaccaaaagttgatacaattcagagtttaacaagcggaagcgtaaatagttaatttattacatgggcagcgaaggcccagcacacacaaagacaaacgagaaacaacggaagactagggcgacgaccacaggcacttgacggcaggcacgagctagacaccaaagccttcatcctccaggaacccctcttctgggtttgggaaaaattgagcaagactgagtacaaccaccgtactcaacaagacacacccacaagtgcagaataaatgcaagggagtacaaaggagttatactataaagggttagggttgcagtaaacagcatttaaagacattagttgctcaaagctattttgtaaacacgattctagaactatacaattattaatcaaggccgtgaacccacatgaacctgccttaacccaaggcctacgatgattcagaccgaactggcaacccgaccctgggtcccagctcgtcccaagccaacccaggccaaccattccacattttagttgttaagcaggttttaagaattaaaacactaacttgggtacattgctcggcttgcccataaccgagggcgcggctattcgaatagattatactctgatcagaggtgtacatctttacccacaagacacatcttcctcacgtgtaaccacgtgccacataccaccacggtatatagacgaaagacgtgacatagtttccaacccatcctagccatagacaagagtactgacccaatcccacctacggccggaacccctgggacaggcaggcaggactgagcccctagcagcaggacaccggccctgtgccatgacatctcgactaccgggccgcagctcgtgtagccttcatttgtcctagagatgtccatcgacccccgacttcttccatctccatccgtgtacttttgtttataactagactaagccacaaactaagccttacccactagacatgtggaagtacggtagtgctttgcaacagaggcccgaagaccggtccttatatggccgaggtgctactatcaaaaccatgcaccccgagcccagcctaaaaccattttggggattttgaatagaaggagcggtgtgaagccaatttcacaataaccaaaccattccatagtgtccaggtgatacgaacattcccaaagtctagagttgtaaaaccgcctaatgttacctaattaaaagcgaagcatctacctaaaatcatactagtgataccatgagtagagtgtccactagttggggttttgtttattctagggtgaacaaggaaataataacaataacaataataataaggtcgtaacaaaggtaaataggcatggctaaataaaacagtgataacacgggaatttaaataaagcgataatgcaataatttaaatcaacataattttataaactgggattcaatatgttcaaagatgatgtgacttgccttgctcgctttcccaaacaccggcttcaacttccatgaagagcggatcttccgaagctgcagcgtctacacgaccaacggaaaagaaaaggcttttactctaataaactccatataacaagcagaaacaaagtacaaaaatgggttcttgacttcttaaggaaaaattagagacttgaacggtccaattccgagttcaaatggccatgttatggccatttgaagtttatatgctctttaaatggatatttgcgaatttcttcatttaaattttaatttaaaatcggatttattgcgtcagccgaggggaggagcgcgcggaccgggtccacgggagtggggcccacgcggcagcctctcggtccacggtggaccgggtgcacgcggctcacaccggccggcgccgtgggtcccacgcgtcagccgcacccgagggctcgggcggctgacggccgggtcccacatggcagccgcggggcgcgcccgaaggcggcctcgccggcacagccgacgggaggcggcgcgcccgcgcctctatggtcgccggcggcggccataggcacggcggagcggcggccgagagaggggaggggagggggaaacgaaatgggcggtccacggctcaccccggttcgatggcgacggcggaaacggcgaccggagcggaggaaggcggcggcgcggctcgggtagacgaggacggcggcgttccggcggtcggcgaccgaaacggagaggtggacgaggtcggcgaggttgcggcgaacccgaagaaggcgacgccgaagcgggagaaggtccggggcgacgacggcggcggaccggagctcggcggcgacggcggagagagaggggcgacggcgcgagctcgattccgacggggagagagagcggcgagtggcggaaacggtggagggaggcacggggagcgtttatatagggtcgggagggggagagagaggccggatgagggggaaaaaaggactttttagggtttttctttttataaaacctttttaactttgtttatttcttaataattattatttgtgctctgaaaattccactaaaatttatttacgcattttaggcttttaggaaatatacaaaaatcctctaagccttatttgacttttaactttgcacattttaattgttggaggctttcacatggattttacttattctatgcataattttgaggatgtattttagagtcgttttgggacgcgacaacttagctttgtagtattccctcggtgacagcaggagtagccgatgtgggaatgaagcagtccatcaatggtgacaaaaacaccagtcggcgctagtggaaccaagccagtggtgtagatgatgaagcccattaacggcggcggagtccgccaaccgtataggcgaaaacaccagttagtggcggcagaagcaagccggcggtgaagtcgtagacgcccaacagcggtggcataataggctagccgtgcaggcggaaacactagtcgacggcggcgaaggccagccggtcggtgaagacgtggacgcccatgaacagtggtgtgaccaaccaaccgtataggcaaggacaccagtcggcggcgacggaggcaggccggcggtgaagtcgtagacgcccaacaacagcagcataataggccagccatgcaggcgaaaacaccagtcggcggcggcgaaggccagccagtcggtgaagacgtggacgcccatgaacggtggtgtgaccaaccaaccgtttaggcgagggcaccagtcggcggcgacggaggcaggccggcggtgaagtcgtagacacccgacaacggcggcataataggccagccgtgcaggcggaaacaccagtcggcggcggcaaaggccagccggtcggtgaagacgtggacgcccatgaacggtggtgtgaccaaccaaccgtttgggtgagggcaccagtcggcggcgacgaaggcaggccggcggtgaagtcgtagacacccgacaacggcggcataataagccggccgtgcaagcggaaacaccagtcggcggtggcgaagtccagccagttggtgaagacatgaatgcctaaccacgttggtgcgaccaaccaaccaaccgtgtaggcgggaacaccagtcggcagcagccgaatcaaccggtccagatacatgcaaaatagatcaattaatagattaatctgattagtaccacaagcataaataaataaataaataaatatatatatatatatatatatatatatatatatatatatatatatatatatatatatatataagcccgcgtgtgtatatctggaacataaaaagcatgcttgatgaattaattgatgcatgattccggcgaggtgtcctggatgatcaaaatttgcatgttgattggtcaacacatgcatgtggatctggtggctggcgatctcaatcgtgtgcgagctgtaagcactgcctattgttccgcgccactcccgtgtcggattacatcggcatctgtacatggtgcattggggatcccgaggtgttgggcagacacaccgagatgacagccattgatcttgatctcagtcggcatgcaaaatcaagagaataacaggaaattaatctgccgttagaaaacaatctgactactgaaacggcaaagccagtgatattaaagattaaatcgatgaaatcgccgagactaatccctttggctggactgaatcctgttgagattatgggcagcatataatgatttaatttattccataaataaatcatgacattacagatgaaaactagcatgaacgcatcattagatctacacatgtaaactacgcagaataacatgaacagatcaaaaatgcgcaacatattgaacacgtaccgaggtgacgaaaagaccggctgcttggtcgaaacttttcgcaggtgtctacgaaggcacgaaacacgcgaacgaagaggaaggcgagccgtcgcgaacgaacagggagcagtcgcgcgaagcgcttcccaaaaaccttattgccgccttctcccggtgcaggacgtcaaaggcagaggttccggagacctgctctcccgatcgctggtgcacgccggcgagcgggatggagtagtctacgagcgacggcgcagtacagagtaggaggcaaaccctagattgattttcgcatatattgcgtgaagacggcggtcggtttatatagagaagggtcgcttgatcagggcgcccgcacgatctctactgcgcgtaaccgaaccggataagtcgcgcgtaacttatccggactccacgccgtttgcacgcaccggatttttcggaacgtttccaaaacaaaaacgaatccgaatttgcagcaaaacaaaactgcaaaaggaggctgcatctgcgcaagggtgaggagccaatttttcggaccattagacgcgtacgtcgtgcacgcgcgccgcctgccctgccaggccaggcgaggcgagcgagcgcgcgcgtgtgtttcccctcttctctccaccacacatgcttcaagtggctaggagggcatcctcccttttaaggaggtccccctctcctagaataagcaaggtggtactaaactccacatgcatgccatcccatgaggtgggcttttgtgattttccaaagaattaatcttcgagtgggctaaggcccattcattaattccaacaatcccccaccaaatctcaaaatcccactgagatttgccttttccaatgtactgtttatataccagcggttcgatggagaccaattaaggttgaacatccacctagaactccaagctacacttactcacaacttgaacaaacgccttgaattgcaaatcttgtgcaagcaagtttcactcaaagtcttatctggtactagaccgtctgtagactacccctcgggtggagcgtataagtcatactcctaggtctttagtaagcttcctagaagattcacccaaaatcttcatggactgcgaccaacagtcaagctcacaaaggtgagttccttcaagaatgctctgcaggacaacatctttgctaattaaagccaacagaactcattaaggcatagccaacctgccttgcagctcacgagagtatatgcatcttcacttggagagggtatatatattggtactctcctctagtttataaatggtttgttcttcccaggatctaattcacgggatctccgatcacatagactgggttaccaccatagtataactcacatgggtctcaaacccatctccttcgatgcattgtgtatcacatttcgtgatagtcccttcgtgaagggatctgccaggtttctcgctgtttggatgtaatccaacgttataactccggagtttcttaatttcctgacagacttcaatcgtcttttcacatgtctagacgatttcatattatccttagaactattcactttgacaattaccgtttgattgtcacagttcataaggatagccggcaccggtttttcaacaacaggcagatccattaatagatcacgcaaccattctgcctcaacagtagcagtatccagtgccgttagctctgcttccatggttgacctcgtcaaaattgtctgtttgcaagacctccatgaaacagcaccaccacccagtgtgaaaacatatccactagtggctttgatctcatccacatcagagatccagttagaatcactataaccctccagtaccgcaggatacctagtatagtgaagccccaattctacagtacctttcagatagcgcattactcgctcaagcgcacgccagtgatcatctcccggattagaggtaaatcggctcaacttgctcacagcaaaggagatatcaggcctagttgcactagccaggtacatcaacgagccaatgatttgggagtattccagttgattcctagcaattctcttgttcttgcgaagcaacaagctaggatcataaggtgttggagaaggcttactatcaatgtagccaaagcgattcaagatcttctccacataatgggactgcaagagtgtaatcccattctcacctctaattagcttaatgtttaagataacatcagctactcccaaatctttcatatcaaaattttgaaacaagaatgatttaacctcatttatcacctcaaggtttgtcccaaatatcagtatgtcgtcaacatacaagcacaaaataactccctcacccccaccatggcgatagtacacacatttatctgcctcattgactgcaaagcctgcagatgtcaatgttttgtcaaatttctcatgccattgcttaggagcttgtttcagaccatacaaagacttcaacaatttgcacactttgccttcttgaccttcaagtacaaacccatcaggttgatccatatagatctcctcatccagctctccattaagaaaagctgtcttaacgtccatttgatgaatgagaagaccatgtgaggctgctagggaaagtagcacacgaattgtggtcaatctagcaacaggtgagtaagtgtcaaagaaatcttcgccttctttctgagtatagcccttagcaacaagccgagccttgtacttttcaatagtaccgtcaggcctaagcttcttcttgaacacccacttgcaccccacaggtttacacccatagggtcgctctgtcacctcccaagtcccgttagcgataatggaatccatttcactacggacagcctccttccagtagtctgcatcaggagatgcatatgcttctgaaattgacttaggagtgtcatccacgaggtacacagtgaaatcatcaccaaaagacttagccgtcctttgtctcttactccttcgaggagcttcactgacatcctcctcagagacaagttcatgtgtatgttcagtttgttctggtggtgtgattgaactgggaattatttcagagggttggttcaaaccactatgtgtatccttcattgggaaaaagctctcaaagaaggtagcatcacgagactccataattgtaccaacatgcatgtccggtacctcggatttaactattaaaaatctataggcaatgctatgatgagcatatcccagaaaaacacagtccacagtcttaggtccaagtttgcgcttcttcgttattggtacattgactttcgccaagcacccccatgtgcgcaaataagaaagtgatggttttctaccaatctatatctcatatggtgttttgtccttgtttctgttaggaactctgtttaacacatgatttgaggtcaacaatgcctccccccaccatgccttaggcagtcccgcggtgtccaacatggcattcaccaagtcagtcagtgtgcggttcttcctttcagcaatcccattagactcgggagaatagggaggcgtcctctcatgtatgatgccatgttcctcacagaataagtcaaactcgttcgagaaaaactctccaccacgatcagacctaagcctttttatctttctgtcaagttgattttcaacttctgccttataaattttaaaatagtctagagcctcgtctttcgttttcaacaagtacacatagcaaaatctagtagcatcatcaatcaatgtcatgaaatatcgttttccacccttcgtcaacaccccattcatttcacaaagatctgaatgtaggagttctagtggtgccaagtttctctcctcggcagccttgtgaggcttgcgaggttgcttcgattgcacacaactatggcacttagaacctttgacaatggaaaacttaggaattaaacacatgctggaaagcagagacatcaagccaaaattaatatgacataaacgtgaatgccaaacattagcctcatcatccacactgccacaaatatggttcacagacttattgcagaaatcagaaagggaaaagcggaacaggcctccgcactcataacctttaccaataaaatatccatgtttagacacgactactttattagactcaaaaaccaacttaaatccgtctctagtcagacgggagccactaacaagattcctgtcgatagaagggacatgctgcacgttcttcagctgcacgatctttcccgaagtaaacttcagatctaccgtgccaacaccatgaacagaagcatgtgacccattccccattaggacggtggaaccccgtgcgacctgataagaagaaaacaatgagatgtcagcacaaacatgtacattggccccagtatcaacccaccaattagtagattgattaactgaaaaaacagtaggtaaattaccatacccgcttccatctccagtgttgccaatggtcacattagcagacttagaagtctgccctgcaggtgccttcatccccttgcgctgtggacacttcctagccagatgaccaacttggccacacacaaagcaagtcctctcatcctgattaggattgttgttgttcttcttctgcttcttgaagttggtggtctgctgagctttgtatttccccttgctcttgttctgggccttgtgcacaacattggcactggactgcccaccatcgcccttagacgcggcatctttttcccgagctttctcctcaacatcaagagacgcaatcaacccctcaacggagtattcctgtctcttgtgtttgagtgcagtaccgaaactcctccaagatggaggtagttttgcaataatgcacccggccacaaatttgtcgggtaagacacacttaaggagttcgagttccttagccatggtttgtatctcatgagcctgttcaactacagaacggttgtcagccattttgtagtcatgaaactgctccatgatatacagatcattgctagcatcagtagcaccgaatttagtattcagtgcatcccacaactccttagcgtcggtcatatgcatatacacctcgaccagacgatcgccaagaatgctaagaatgcatcccacaaagagagtagtggcttcctcgaattgcttctgctgttcagcagtaagaactccttcaggtttgccagtactcacccagaagcatttcatagctgtcagccacagagtgaccctgatctgccatctcttaaaatgcacaccggtgaatttatccggcctcagtgcatcggcaaaaccagccatagtaaaatcacagtgcctataataaggtttttggattgttgagattatgggcagcatataatgatttaatttattccataaataaatcatgacattacagatgaaaactagcatgaacgcatcattagatctacacatgtaaactacgcagaataacattaacagatcaaaaatgcgcaacatattgaacacgtaccgaggtgacgaaaagaccggctgcttggtcgaaacttttcgcaggtgtctacgaaggaacgaaacacgcgagcgaagaggaaggcgagccgtcgcgaacgaacagggagcagtcgcgcgaagcgcttcccaaaaaccttattgccgccttctcccggtgcaggacgtcaaaggcagaggttccggagacctgctctcccgatcgctgatgcacgccggcgagcgggatggagtagtctaggaggcaaaccctagattgattttcgcatatattgcgtgaagacggcggtcggtttatatagagaagggtcgcttgatcagggcgcccgcacgatctctactgcgcgtaaccgaaccggataagtcgcgcgtaacttatccggactccacgccgtttgcacgcaccggatttttcggaacgtttccaaaacaaaaacgaatccgaatttgcagcaaaacaaaactgcaaaaggaggctgcatctgcgcaagggtgaggagccaatttttcggaccattcgacgcatacgtcgtgcacgcgcgccgcctgccctgccctgccctgccaggccaggccaggcgaggcgagcgagcgcgcgcgtgtatttcccctcttctctccaccacacatgcttcaagtggctaggagggcatccccccttttaaggaggtctccctctcctagaataagcaaggtggtacaaaactccacatgcatgccatcccatgaggtgggcttttgtgattttccaaagaattaatcttcgagtgggctaaggcccattcattaattccaacaaatccgagacgaaaaggacatgcttgacgaatctggcaacgccggagattagttccatcgcactcatcgacgggaaactcgatgcacccctacctggcgcaccaactgtcgaaacatgaatttggcaataataaaagggggtagcgcacgagacctaaaaatggatggatgcggagacaaataatttagacaggttcatgccctctcaatgataagtaataccctactcctgtttggggatttgaatccaccgggtgtatattgatctgacgatcagtttgtgtcatgccccctagagggcctccttcccaccttatataggatggggggcaggattacaagatagaaatcttaaccaatacggtatcggtttcctaaatctattttacaatattatcaaatcaggactttaggccgctccataatataaaaggaaacgtaatacccaagtcatgatcggttacatattccatagatataaactatcccctatgactagtcggataaccatgccgtgtgggtatggggtacccataatctccacagtaggcgattgacacgagtgattcaagcggttccgatgaggaagagggaaaaagggaaagaatggaacaggacgggcaacgcttcataagtcgtggggggagctaggaatcgacaatccaatcgacgcagccgctgccctacctcgttgaccacgcgcctcagcatttgggccggccacccccctgtagagattatggataccccatacctacacggcatgtatatccgactgggtatgggaggccatgtatagatagaatatctttaaaaggactcgggttaaattccaaacttgtatgccaaggaaatacccgagattctagtcggttacgattatattttttctgtaactacctattccgttagggatatgggttgtactttgtaatatggacctcttcccctatataaggaggggtccgggtgccccttggggtacgatttttgctcccagatcatacgatcaacaatgcactcggcggatcaatcctcggacaggagtaggatattacttcttattaagaaggtctgaacctgtataaaattccttgtctctaaacccatccacttttccagcgtaatagccacacccttttattattgccgaaatcttgtttcgacacccccctcaccttggtctttttctcgcaagggatacactaagagcgtttccaagagatgcctagagagtgttcccataaggtcaaaacatggggttaaacagtaaaaacgtaaattgagccaggtgccagctgggaacccccttgtccattgggctccacccccaagtccaataactcacgggtttttggctacgtttgagaggaggtaggagtggagcttgaatttggcctaggcaagcctaaataaaactgccatccatatatgtaatatatctatacgctcattttattactgcttgaagaaaaaaaataatatgcatgtacatgaaaaaacaagatagttttattataatatggacgattcgtatgcttgatgattgagcgtatcacgttaatccttatgaagcaggcaagttgataaatgccaactggtggatactatgggccaattgcatgctacagggctgaaaggcctgccattggtggagaaggggattttactcccggtttgtaacccctgtagtcccgcttttcctaaagatcattatctttagttccgggtaaaaaaaatcgggagtaaaaatccatttttaagtcccggttggtgttaccaaccgggactaaagataaagcattttttaagtcctggttagtactaaacaggctagatccggttgctctttccagttccactttattcttttcttttcttcattgtttttaaatatattgatttcaccccatcccgttcccaaaatcccaaatcaatcatcctcaaattgcctccaaatccacaaatctatagtctcaaatactcaaatacatcacaaaatcttaaaaaaattacatcacaacttctacaaaatttatcacatattcagatcacacacaaatcaaatacatcccacaacaatctcagattctccaaaaaagaaaagaaaaagaaagaaagccgctgcctagacgtgcgccgccaccgctccggccggctggccctccacgccctgccgccgcgacaccgccagccgcccacgccggccggccctccgcgccccgccggccgccgcctcactgcgctctgccacgccgccctgccggccggccggcccaccgtgccccgctgccgcgcggccgccagccccagtcgccgccgcgtcggccggccctccacgccctaccgtcctcgtgccggcctggcagtagagaggagaaggagaggaataaagataaggagaagaatagataaggttgaggagaggagttaaaaaggagagggggagataaggttgaggagaggaggagatacctcgatccgatcgcgcacctctccgatcccctcgtcaatctttttccccagttggttttaccaaccgggtctataaatagatcttttgtcccggttggtagcaccaactgggagtaaagcgtatggcgatcttttttcccggttggtgttatcaaccgggactacaaatagatctttagtcccggttggtgttaccaaccgggactattaatatataatcccacatatcatacacacattgtgtcttggagttcgtgctacagcttggtacagatctatagcctgctgttctcctctctcattgtttatctcattaaaatatgtttatagccggctaataccttgctattgtacctgctctaagagaaaggacaagcgagtgactatttagcagctgggctgcacacaagcccccaagaaaaggtgggatccgctaactaggctaggagaggagttaatgacgtcacatgcagctataaggaaccgataaaggtaaagcgagagagagaatttaactttctcttagggcattcatagtgtaaggacgtgcggttccaccccacggcagaaaaccgaatattcggcgccacatcaacaatccgcggagccaaacgaagttctgggagccaaaactagacactcgttcttcacctcgcctgagggcttgtgaagcatggaggaatgtgtgcaaccacgttgtggaggacggagcctcgtgtggtgtgtcttcagcgagggaacacccccaacaccatcttttcctttcccgtgctcttcttcctctcacgccctcaccccgattaatcccacatccacggaaagagagaggaaggcattgccaacaaggctgccaccgccatcgccaccaccttacgtctggccggatctggagagtgagatagtctccgtgccggctacagtcgatttgcgccgccgcaggggagcacgtcggcctgccgcctcgatttgcatggaggggacgctggtgggggtgggggtacagtcgatgccacgagatctccccccgagctcgtcaccctacacgcgccaccccatcctatgacagaagcttgccggccacgctccgccgcaggatcccaccgccggggaaaggagcggcgctgccgatgacgaaaaaggagcggcagccggagtaggaggaggggaggcagcgttggctggaggaggaggggaggtggcgacggccggaggaagaggaggggacgcgcgcctggcaaagaaggggggagacgcacggtttctcgtgagggagaggataagggatagaggagagagggggagggggagtgggtggtttatttttttttctagattttagggtgttcggtgtaaattttgtatctctattcaaatagaaaaaaaaaatagaactaaaaaaaggtgttaggggctgaaatataaaattaagccactcatagagccacttgcactgtgaagaatctagattttagactcgtagcattggtctatgtggcattgtgaggctcctcagacttgtgtgacgcactgtgaatgcccttagatgtctcattttactgcagagatagcactccacctcaatggatttccctcgcacagcctaggcacaagactgcctaacaccaagccgtgaatccacaactacgaggaggggtaaccagcagaagaagaagatatgcaagagtattaagcatacaagaacatcaacaacacaagcaaggggacgggaggggagagcacagctgggccgccgccgccgcttctcctcccaccagatctggcgaaggggagggagtcgccgccgggctaaatattttgctaattaccaatataaaaaatatgcaattaccaatgtgacaaaatctggttggggtgaataggagttactcgatgcattggctcgaatcgagtaattggtaattggcttccgaagtaatctatttataccctagattacaaaatatgcaattaccaatgtgacaaaatctggttggggtgaataggagttactcgatgcattggctcgaatcgagccgatacatcgagccggccttttattttcattcctaggacctcaaaggtgctggttcttaaactaaaactaaaccaacacctttgagagaactcaaagatgctgcctgctgcctatctagggttgacaactggcacattgttaatgaccaaatttggtaatccaagtatcggagatgaagaaggaattgaaacggagttcaagatggagatcgttccggaaacagagtaaggatcggctggagtccgaatcggctgcaatcaggatcggcatagtccgagtaggacaaggttagccgattgattcgaatctgacaatatgacacgacatacattgtcgggttgggttgatgtacttcttgaggatgccacgcatggttagggtactaggaaggcaattgtatctattaattaggatatttcatgtaatttccttagagatatgtttgggcaaaattctgccgcaaagacttttggtatcttaaagtttgttagagataggagtcgtgtccgatatggacatattttgtaatctcgggtataaatagaccctgagccccatgtaatcaatctaacacacgttctatacaatctcggcgcatcgccacccttttactttcgttttgtttcgacgagttattgctttggggttgagctgcatcggtttcgatcttcaacaagaggtaaaatttgttatggcggcttgcgttctcgggattagtgcttctatttttatgatactctaatattggttatgtaattcattgaggtatcatatatcttacataatctttggcaatattgctatctaaccttcaatcggctagcgtctgttactagaaggtagccggttaggttatatattaacgttgacttatattatataagatatctaccactctatgaaacattcaacagcttgattatgtagatattgtctttcttttcatatttatagctgcatcagttgagtttgatcttatgaggcgtgattagaatctcaatctctagcctgcctttggttgccgattagggtagcatcggggtttcagccaatcttacctgatttaactaatatttatcttgtgtgcttaattgacatgttaaatctgccctttatgttaagatcttgttgcatttaaatatattaggcttcggtttggtatattctacttgctttaatatcttaatatatagtagtatcggagtattagctgatacatgctagatctatctgatcggttatgctacgaacatatatagtcttgttgttaatatatatttcgatccaagtgatttatactgtctcggcatggcgactgatctatcccaatcacttgatttaagtatatatcgacataaggattatatattgttaatatctacatccgatcgagtagatttagttcttttttacttattcatgattgccgatcgactcacatatgacatcggctcaaagataatatgatatgtcatcggcaactagccgatcggctatcgtttatggatttaaccgcggtttctttgtctttgtttcttgtcgattgcaggatcaaatcaactggcacgctcgtacacctaaaggcaagcttttggacctgcactggatttaagcagatctccaaggcctcatgtttttacatcaacacatgcataaagcctttttcttttagtagtgttgccatcaaaccttgaatattcatcttctcatcatgctaccctaagcgctgatcctagcgaaaaatattacttgaatacagatattggctttcattttgcgaattggaattgtatatcctaactcatccggtacgataatcattgttagtgcgacaagtctttatttgttttccatagcagtggtgcatcagcttcacgttcaccaggaaaggaaaaccaacaccactcaattttcgatactaccgtacattaatctctaggacattagttaagcagacagtacatttattttgttgagcagcgcagacaaaccggattgactggttacttgggcttggccatgttggttacaaatagaattcatatcatggcgtgcttagatgtggaatttgaggtggtgtttggatccagggatttaactttagtctctgtatttagacactaatttagagtattaaatatagactacttataaaactaattacataaataaaagctaatttgcgagacaaattttttaagcctaattaatctataattagagaatgtttattgtagcatcacataggctaatcatgaattaattaggctcaatagattcgtctcgcgaattagtccaaaattatgagttttattaatagtttacgtttaatatttataattaatgttcaaacatccgatgtgataggggacttaaaactaaaacagtcccatctaaaccgggtctgagtgctgcatgtgctcggaagtcggatgaaaaacagaagtcttgattccgcagatatcagctgacaatcaattagttaccagtccattcggtcatagtcccgcattgatgccgcctggagtccccacgtatatatatcaggctcatttatgcaacagtatcgacggtaatcatcatcatccccttccagtcgcaaacgggaagtttcgtacggggctgcgtattaaaacgctgccaataattacacgtatactttgaaacagaaattttgagagctcactggtttctctattctctatttattcgagtatgtgtgaagagaataaaatggcactcgcgtgcatgtatataatatggagtacgtaatctgtatgcccttgtagtatggagtttcaaagaaaagcaaataattagcatgtggtagttgcaaagtcagcagtcgacgataaatactgggaatgatgaacggtcgcgtctcgcgtgcctacggcgacgtcgccgtagatgccgacggatcaccggcagagaattcattccgcaggcagacgtccatcaatattgccctgacccaaaaaatggctccaacctcctggctgccgtgcgccactgttggctcgtcgcctgcaagcatatgctgcgggatggcgcgccaccgccaccgcgcgcttcctcctcaccgcaattcttgagcacgcccaagcctgcgcatgtcatcccgtccacaccaccgcgcgaataatatgcgtgaccgcggtatgtgggtgccatgcatcttcaccgcccataactaattaacgatcgatatcggatacagtttacgggcctaccaaaactggagtgatattctttcaaaatagtagatttcgtaacatatattttacactttgaatttcatatctgatactacataaatcttgtatatttttttagcaagggcgattgcccctatttctattaccagaaatgaaacttagggcatgttagttcgcgaaaagaaaattttttagatgttatatcagatgtttgaccggatgtcggaaggggttctcgaacatgaaagagaaaactaatttcataactcgtatggaaagcacgagacgaatcttttaagcctaattaatccatcattagcatatttgggttactgtagcacttatggctaattatagactaattaggcttaaaagattcgtctcacgatttcccctctaattgtgcaattattttttttaatctatatttaatgctccatacaggtgtacacagatttgatgtgatgttttttgaaaaatttttgggaactaaaccaggccatagtagcttacaaggttcagagaagaaagacaataagagacagcataaagactaaaaaagacagacaaaaggaaaaggaccaggttttttgcgcaacaggagttccacactatcaagcatatggccttccatcagccgaagcagaagacacacaaaaacagcccttcaatttagtttagtctggaccaaccttatctatacctgagtatgtgcttttacaacattttcatacgggtttaggtaaggtgtctacattctatctggacataaccgccggaggatcattcatgcataaaacgccgtcagaaggaaaagtaattctggaccgcattatagaaaatacttcctttatgacgccatgcgatgaacctccactagaggcatccgtgtctaagatagaggagcctttaacagtcgaatcacaccctgaaccttccacatcgaccgactcgactgatgaagaagttcccgagccgccattcgttgagaataaagaaattcagactccggatcgtgccgcaattccgttcagggatggttttgatgaagattacggcaacaccctgaattatttcagtaaaaagaagccgatcgttcctttgccacctaccgatcctttggaacttgggttcttaagggaaactgtccgggagctgacatccataatgagtgacgaatggctaagggaggcagagctttcatccgaagtaattctgataaataccgctccccgagttattccttgtcatctagaagggaacgatgtcagtatcctttacagcccaactgtcggggttaatctcgtcttcgacgcatttgcattcacttacctaagcgataaagcaataaccccgacaaacaaaatttgaagcacccgaatggaaatttttcaagccattcgtagaaggattcgggattgtacaagacataactgtctactttgaagatagggaggcagtcttggatttctatgtctttgaaatccaagactttgacattctgattgagctgccgattgagcaactcatcataaacatgccccgatcagatagcctcaagataactttgggagggaacgaatttccagttccattatcacgagcaaggttcgccttgaccgactcactcctagagaatgagtatgcggaggaggttacggcagttgcccctcacgagtctcccgagacccttctggaaaatgaagcggaacccaaagagactcgagcttccaatcatggaaccgccgcctcgacctccgattgagcttaaatatctgcctcaaggcatgcgctgtgctttcctccacaacgacaaagaagctcctgtcatcataagtgacaagctttctgaagacaagactcaacgtcttctatctatgttagaaaagcatcgtgccattcttggctattccctccaggatctcagagggattaatcccgcactttgcactcatcgtatccctattaagcctgagagtattccctccagggaacctcaatgacggcttaataatgcaatgcgagaagtcgtaaagaaagaggtcctaaaactcctgcatgccgggattatttataccgttccatacagtgagtgggtcagcacagtccaggttgggccgaagatgggacgaatgacggtcgttgcaaatgctcaaaataaacttatcccgcaacaaaccataaccggatggaggatgtgcatagactacaggaagctcaacaaggctacaaaataggatcatttttcgctacccttcattgacgaaatgttggaacggttagcaaattgttcattattttgtttccttgatgggtattctaggtaccatcaaattcccatccattcgaaggaccagagtaagaccacgttcacatgtccatacggcacctatgcttatcgtaggatgtccttcggactgtgcaacgctccttcatcttttcaaagatgtatgatgtccattttttcagacatgattaaggacattatggaagtcttcatggatgacttctctgtctatggaaagaccttcggtcattgtctatagaatttggacaaggtattgcaacgatgccaagaaaaagacctggtactcaattgggaaaagtgtcactttatggtccgtgaagggattgttcttggtcatcgagtgtcctagcgaggaatcgaagttgatcgtgctaaaatcgatatgattgatcaacttcctcctgctgtgaacatcaaggcgatccataacttcttgggagacgccgacttttatagaaggttcatcaaggacttctctacaattgcctgagcactgaccaacctgctagctaaggatgctccctttgagttcgacgatgcgtgcctaaaatcctttgaaatactcaaaaaggcactcgtctctgctccaatcatccaacctctcgattggacattacccttcaagattatgtgtgatgcaagcgactttgctgttggtgcggttttggaccaaaccaaggataaaaagcatcatgcaatctgttatgctagcaaaactctaacctgagctctgttgaattatgcaactactgaaatggagctgctcgcggttgtttttgctatcgataagtttagatcttacttggtgggagcaaaggtgataatttacactgatcatgctgctctaaaatacctgctcgctaagaaagatgctaaaccacgcctcttgcgatggattttgctactccaataatttgacatagaaattaactataaaaaggaagtagaaaatttagtagcagatcatttgtctaggctgcaaattattaacatgcgggaacaaccgataaatgattttctaaaagatgacatgctaatgacggtgcgcgactccaactccgtggtatgccaacatagtaaactacatggtctcaaagtacataccaccgggagaaaatcaaagaaaactgaaatccgagagctaccgtcatatataggatgagccatacctatacagggtctgctctgaaggtttattaagaagatgcgtgccaactgaagagcgacttaagatcatagaacgatgtcatgcctcgccttatggtggccattatggtgcattccgcaccaggcagagaattggcaatatggtttctactggccaacaatgtatgaggattcaaaggaatttgttagaagatacccaagctgccagcggcaaggaggaattactgctcatgatgcaatgcctcttacatacaacctataagttgagatattcgatgtatggagtattgactttacgggacctgttcccaaatcccgtaattgcgagtatattttggtagcagttgattatgtctccaagtgggttgaggctatgccgtgcagtgccacggatgcgaatcatgctaagaagatgttcatagaaatcatcttcccaaggtttggtaccccaaggatggtcataagtgacggaggatcacacttcatcgacaaaaccttccgagacctcctacgagacatgggagccaaacacaatgttgctataccttaccatccacagaccagcagtcaagcagaaacatcgaacaaacaaatcatgaacattctgcagaagacggtcaacaaaatgggaacgggatggaaggagaaattgtcggacgcactgtgggcataccggacaacatacaagacacccattggaatgtctccctatcagatcgtctacgggaagtcatgccgactccccgtagaacttgagcacagagcctactgggccatcagaaattggaacatggattttgagggagtaggagaatggaggaaaatgcagttagctgaactagaagaatggagagaaaaagcatatcacaactccaagatatacaaagagcggacaaagcgctggcatgataaacgaataaagaacaagaaattcaagccaggagacaaggtactgatgttcaactccagggttaagctattcggccatagaaaactacaaagcaaatgggaaggaccgttcgacgtcatcgacacctcttcgcacgaagcaatcacactccgcgacgactcaggtaacataattaaggtaaacggtcaacgtttaaagatttttcttgagccgaatgaaactttagatgaagtgggtattattgaactaattgattatgaaccatgatgatctcatctaaaacatgcttaatttcctgtatagttgtcatttttgtgcttagcttaggtttgtctgggcccaggagaaaattggcggccagccggacccaccagggttcggccaaaccacggcggcgcccgtttggtcccattttcaaatgatcgtttcccccgctcacttttagttcgtttagatgcgcgtttagaggtagaacgatcggatcacgcatcagagttagttcttcttcctcctcctttgcaaaagtttttccaccaatttgctcaatctcctctcaacccaatcctttgatccatcaacttgtgccattcatagctggcaaatctctcatgccatacattggctccaccttaaactacacctataaccttaaaggagagccaacacgggtgaatcaattgatcctggtgaaaaactacacgatcgaaggagtgaacgcactctgggctcaaccccttgcgacggtgccgggctccccagcaaatttggagcccgtcgatgagctccctcggtttggccgaacccatcacggcctcgtttggccccccgttcggcagtgcgctccctctccccccctccatgtcacaaagacaaaagtgcggggtgattcgcctgcacgatggccgacgatgggcgagctcagtcttttgaaggcgagacgtcttttccaagacgacgagaaggccgctccgccttccgctgagcggtatgtgggcactctttacactaaggtaggggatgaggtgctccacaagtataccacacccaccgccactccatccaccactaagggggactgtttttgcaattggggagtgcgaagtcccggcggtgggtatggcaatagcttactctggcctttgacgacatcggagaaggagggggcagcagagtcccgtagccctccacctatgaaggtgaagcgtcattcgatgcctcctcctatcatgagggcgcccgggcaattcgaagataatgaagtaaaatcgcaggagccctcggtccataagctcgctgctcaagtgaacaaacttcgcaaggagaatattgagcttagggacagcaacgcggagctagaggtagagcttgctgagcttaggaataatgtagatacccttagtcgcggtttgtgcgcttagataaagcgtgcattcatagagatggagaaggagaataagtattttgctaaatagatgtctcctttctcatgaataaagtagtagtaggtgcttggtcttttgttctcaaataatgtggctcattggttttaacaccaatgtttgccaagttgtttttgtttcatgattaataaagtttaggtttcaaataaaagtgggggagatacctcggctttttgacatgcaaattcaaaaaatgagactgaatatct

SEQ ID NO: 59678 - DNA, 7345 bp, Oryza sativa
  unsure (1)..(7345): unsure at all n locations
caccctcatttttcacaggtaagcaagtgagcacgtctactgcctatatatctccaccattgcatagtacaagggctgggaatttagaaaatatttggttcaagcaaaattgaaaagataaaatttccaactaatgaaattcttcctatgattaatcttgtatatattttattcttagctaaacttgttacttgtgaacaaccatccatgttagggaaccttatgcatctaagtaattgttatatgagagatggttaaagatgaaagaaaatcttgctacatttgccatgacttttgggaatttgtttttcaaaataaaaattctttttcaatgctcattcctctaattgacttcatcttatacctatcaaggccatatgcaagtatatcaatgataaaccttattacgcatatgattgcagctttgtcaaatttatatgactcgtgttagatatccttcatactctcatgatcaagaggccatttccactttcattttcatttccatatatataatcaagctaagcttctacattggaagttggcttcccaaaaaaaaatcattcaaataaactcctattcagactatgctttcttctcctaaaaaaccttggcaaaagaaagaaaatgaaaaaaaggagggaaaggcatggctataaaaaaagagagaaataaagcttgccctcaaaacattgagcatgatgaaaaaaaacagtagccatgccccttccatatttatgcaaggaaaagtggagaagaaagtataggaaaaaggagaaccatttctattccaccattacacaaaatatttaacttttctttttaccacctcaaataaagacccttgatctagaagtatgactaataatcttcctgagtctgtatatttggctttgcaatatatatgatgcaggtatgtcacaatttatccctaccgagcccaacatatcagcttgtaaaatagggataaaatatggcacaatctgccttggtgaggatccacaaagtcaaaaatacttgagtgatagagaaaaagtcattaagaggaaaagagttgttttgcgaaacttcataaaatcccaagagtttgatagatgaagtaagaaggactggaatcaagaccattccatttaccaattacccaagatggtaagttagccactgataaagttcacaggtataggtatggttttgaataatttatatgcttgagttatatcttggaaaacttcattctacaccaatatttactcagggatgagtaaaaagctaagtgtggggggttttgttggcggctgttaaatgccgattatataccaccaacatctgcataaagtccagataataaaacatccaacatactgataggtgttaaatctcacattttctacaagtgttagtatatatttgtatgtagatggtaaacctagaagttgggaggaaaatcagactaaagttggagaaggaacttattcattcaagagtaggctttttaacttccaaagaatcagcccgaaatttgcagaaaaggataaggcaggtcaggggaagtccacaggccaaatcctgggcttgttgggccaggccagggttcagccgaactcacatctccaccgtcgatcctatggtttggcatggacgtcccagatgcattcctaatggcggttgcagggcacttcggacaattccccatccacaaccgtcattacctgctctataaaaggagcttcactccttcacttcttcagacacttccgagcttcacctgaattacaagagactctattgtactatttgtatactagaattaggaagagagtagagtagaagaagtcgggagaattccggagctgtcggtaatcctctcttatttcttttattctattcataactctgatattaatagaattatttttcctgagtattttagatttatcttgtgagaattatctcttggttagttcgtaaatagcatatgggatttttgtcactataatcaactaactatagtgattgctttggtgagttataaacactaaggtatatattaattgcttagacgtggtgtttaggtaattattatccagtaattattacgtatcccacagtacgtttgaggtaggtagaggtggtgacagccctcaagagcacttaagtccttcctgtccaggtatgtagtagagcgatatctggaaatagcgggttcccagtgcctcaagtatcacgttacgattaaagttaagcttttcctagacactgtttctcactggtaaatcctctctatcctagcctattctttgcttggtgtccttagatgaaccggaggaagaattaatcacacacgttcccttcgattcgatacccttggaatactccgtaggtgaagtgctacattggtatatcagtgcgcttgcggattttatctgtgaccataagaattaccaatagggcatctaccactccctacgacgacgcgtctccgggtgccgccacgggttgcacataacgtgctcaaggtgtggcggtgagtttttctctttcctagcactctctttcctctgtcatagtatagaaatgacgtgttaacttttatagcccgtttatgcaggactaatgtacccgctttaagtgcatcttcactttcctcgtaaaggtaaccttaaacaataaattaatatttatagtacaattctttatattagaagataaacttaaattaagatgttgctatgggcgatcttaagcttaaggcaatgttacataccgttgatgtgaaaagatggcagcaaaattttgttgttaacacatactacattttcccaacttatgctcccttctttttcacgcgcatgtgttccctaactagtaaaccatgcatttttgtgaatagatatattgaaaagttgttttcaaaattcatattaatcaatttgtaaatgttttcactaatattgaattggtcatgtgctaattcatcgttccattgtgcatgcttggggtgagttcccaactcttattacccaacacaacctaaagctacaccacaaggtacaaacaattacgctatttttttatttttaaattgttcacgaagcaggttagaccgctgcttatggaccagtttgaccgacggtgtgtgggcggtcagaccggcaaagtctgaccccgactccactacatattgtcgggtcttgggtttccttgttccggaaggtatgtagagggggaccagttggactctaagtagaccaacccctatattagggacaaggtcagttcaatcggaggtataatctactctcagcacaatttagccaattgaatcaccttttcaatattgcatctacttttcgcctagttttagccaagttcgtccatctttgtcaatttgtgctgtaaatcgtccgccttcactgtgagagtgcgaaatccttttgtagttttgtcccgtacactttccgttcgcccatgagacgagtgttaccgcctgtttcatctaaatcggccctgctagccggtttaatctatcaaaactcatcttgagctaggttgagctggctagcctgtttatgtgtcccagtcatgattgtcttcttgtcaaaaaaaaattaccaacatatatacagtagtatttgccgataagtagaccgaatttattgtgttggataagtagaagttattgttttggattgaggacaactagaagaacgatttttcatagcgttaccctataattttcgctggcggcaatacgtacaaaccgccaacaaaaatataacgagggggggttacggaccgccaacgaaaaccgatttttgctgacgggcacactaagagatccgtcataaaagaaactctatttttcgtagtggacctcttaagtgtccgccacagaaaacctgattttaggtggcggaccaggaagagcaccactacaaaaaatatatgtttcaccgctattaaaaatgcaccgcctctcccccccccccaacgctccacgctattaaaaatccatgctccgtctcctcggctccccctcctctccggctttctccctcccacctctccccaacctccctcccacctcctcctagccttctccctcccacctctccccagcggcggctggctgtggcagatctaggggcgacggcagtggcaaggaagggcgatggcagcggtggggtggacggcggctggcagcggtggcgggcgatggtccggcggcgggctcttcgtctcccccgtggtggccggctgcggcaaagggcgacggcggccagatctgggggcgacggcagcagcggggaaggggcaacggctggctgcggtaaaggagacggtcgtccgggggcacggcatcgacgacgaagactgcgatggcgatggcagaaggagccgccagcggcggtgatgcttggcgatggggctcacacatcggtgctgctcggtcggcgacggcggcggggaggccgaggaggagcggcgagctcaggcgtgggtggcgacgaggaggcgtgtgggcggctgatctggcgacggcaaggtcccaggtctctctcccccactcccccgctcctccccggccctctccctctctcagatctggcgcagcgacggactgggcggtggtgaggcggatggatttttttgagagaacaatggatggaatgtttttttttggtattttattgtggtttgggaatggatatgttaatttgtgatttgtgaatgaatctgttgaatttattatgnaatggctagtatttntctcttgntggctggctcagtgtaacccactagcgaactacattttcgctggcggccaataaccgctagcgaaaatcttgatttttcactagcctttgctttgtggcggctccaaattccgccagcgaaaacccaaactgaccgccacgaaagatgattttcgtagaagtggagccctcttgctagtgcaacaactgtaagtactggctccatcttctgttgctgctgatgctgcttgcccatcatagtgattctcattctataggcgagacgagctgtagcagtgtactcggcgtgcattcatgacgcccatgatttggctcgtccgggtcgacaattaccgctcatcagctttattctccatgaggttgacaattgatcgactatttgtggcgactcccaaatcatatttattaccatccgatttggcatctactacttcactaacaatttataatgccatcatgcagctagtttacactacaaacctatcgctgcctagcaggggcaaatctagaatgagggcgacgaaagctcaagcctccacggctgacaataggaccaccataaaatccccaataaaactttttatcacatgcacatacagaatatacatacgaagaagagatatatatagctttctcaagtttactgaaacccctcgttattttcttcttgatccatcagtgtctagaatattaatttgggtcaacttgacggtccttcttagggtgtgtttaggaggtgagattgggaactcacctttcccgcacgcaaaataaagcaacacattttcttatgattaattaagtaatttattatttttttaaaaaaaattgattaatatgatttttaaaacaactttcttacgtaaaccttttttaaaaaaacacaccagttagcaatttgaaaaacgtgcacatggaaatgaagaaggtgagttgaaaaagatgggggaataacacagccttagacacagtacaaaacatatggatgtaactgtacaatattaattttagtgcgtctgctagctagatcgagtctgtttcgatcggttcttccattggtacacacacgtcctaatctatttataccgtgtacgtagcacaagtgcacaactggtgagattctgggctggacacatcaaattgacgagggccagcgggtctctcgtgcgcccgtgcttttgcctgtctctaaaacgttgatcgggttcatggtgccatgtgcattctatcccatgcactgcaatgaatgaacttaactgacaaccaccgtatcatgccaattgatagtagaagcagtattagctagctctggcccgtagttgcagaggagtactatactgactggcaagagctaaagaaaactgtactatatattcagtgctgtggcggcaggagaacgcacattccgctggtccaggcagagagaccaatggcgtcttgctgggagcagctgcagggcctctgcgccgccggccacttgcgtcgccgctgccgcggtagaagcttggtcctgctgcagcagctgcagctgctgggggttttggtggtggtggtggccggggttgcaccaggcatcagtgaggcacaggtgaggagccggttcaaggcgatcttcatgttcggcgactcgatcgtggatccagggaacaacaacgggcaactaacggaggcgagagccgacttcccgccgtacgggcaggatttccccggcggggtcgccaccggcagattctccaacggcaaggtccccggtgacttgataggtactactacgcacgtacacacgtactcctaaattaatttccgagaatagctccgaacaaatatttatctattggtctttgaattttttttttatggagggagtactccttcctatagacgatgcactctctggatactttctgctaattaagtaactgcacttaattgctctatttttagctatttcctctgttccaaaataagaacagctctattaatttaaactgtgtggggctacacttatttgcaacagagaaagtatataagctgtgacagcgtgttcgggcttattttgacactaaatagtcgtagcaccatcattttgtgtagcttcggtttacagcatgtttatttaaggagtactccacgtcctatggtttgcactatgtaacacaattaattattattctctaattctgtttttaagtaggagtatgtttttgagatagagatagagtactccctccgtcccaaaatataagcatttttaaacttgcatacagtttttgatatgctattttgaccaccaatatctataaaaatatgatattttaaataaaaagagttacatattatgatagtttgtttaataataaatctaataacatcaattttatatgattgatcttttttatttttttactactaatagttaaagttaaaaatatttgattttacagtatactaaaaatgcttgtattttgggacggatgaagtacctcttaattggtttgcaccacacgccctatgcaacacaattaattacacgcaccaagcgacacagttagtttgctcaccgtggg

SEQ ID NO: 59679 - DNA, 5325 bp, Oryza sativa
atttccgtaatatactacgactttactaaattgttctacaatatgccattgtattgcatttctttcaaaaatacctaaaatacccttataagaaggtttgaaaaaaatatgcctttttatacattatctttatactacatggaagtttgtgtataagtttttgtgtgcttttgttttttaatgtaaactagctaaatgcatgtgctttgctacagataaaatttatttttcatgaaatgttccacctgtcgtgttgctatggaaaacatttaccttaatttgattctatgcatcgatatccttagattgattgttattaatataaagaagctcagggggtgatttctaaaatttacaataggagtagctataaggtgacaaattcactattcccccactagatcctcttaaagtagcatagatcatctttcatatggtaaaaaaaatatttttgtgttgttatcttttgtgtaagcaatttcactatcataagccaaaaaaatttaaataaaaaataccaagaaaacttgaaagttatatacaaacttccaggttgtgtaagaaggctacactaaaatacgtagtttttcaaacttctactgagataaatcgattgttgacgtggtacatttttaagggtattttgggtgtctttgaaaatagtcagtccaatggtatattggagaccaattgatgaagccgtcggtatattatagaaaacatcaatatctatggcaaattattgaactgagacaaactcagtgacatggagtagattatccctaaaaattattatatgtctacaattaaaataatgttcattatatgatttgccacgatgatgtcattgaactacactaggattaaaaaaaataatggaaaggacttggtagctataaatgatacacactgctatggaacacatcttttacgtgaccaggcactccacctgtgactaaaggctttgaaaaatcgacgatcttcccagataggtcacaaaagttgatttttatagttacagcaggctatggttaagcggactacgtgagaaaattattttttacaggcaactatatgaagccaaccgactggaaaaaatattttcaacaaaaaaaaaacaatgtatgcagctgccttatgaatgacagttgccaaacccatatccatagatcaagacacaaattagagagagaacaattcacatgattggaaaatgaaacaaatcaagttgttccataataatttgtattcacaaatccaacccagattcacaagcatacataaacatcagaagcaggccagatcgggttcgaacatatttattctccccacacggatgaaggcacttgtagcagcagcagcagccctccttgctcacctcctcacagcagctggtcatcgtcgcagctaccattgccaccagttagcacagccctcgcatcgggcctggagtggcgcaaggccagcattgtcaccgccaaccaagggcttccccgcggccgctagttacgttcctcctcttcgtcgtgtcaccactagctcaggcagtatgaggctactcctccccttcaccatcactgacacccctacccttctccttcgccgcagtcgccttcaccaagccctccgccgaggctcgccctcgagcttcaaaggtgacctcattgtcgctgccctcttctgaaatcagttatgcctagatgtggttcgttgacagaggataacttagatgtggatatataagagaattgtggtggtaaaatttcctagtgggttgagtgaagggtggtcgagccaaaccataactttggtaagaaaaggtcaccaaaagtgcaattcactcattagtcattttaaaaccgccctctatgtgtcatcatacatcctagattagcctaactgcaatcggctacgaacaagacaacttgcaattttttttagaagcgtcatgcaagaataaaaaaaattaaagggtccatctgaagaaagatgagcaacaaacatacaagttctttacaattattacatattcggtcattccaaaatataacatactttgatttctaacgataccgtataattacaatatcagattgttttgtgttacatggttagcaaatcaggattgtagttatgtcttttttttctttgtccgtatattttttttactggattaatcattgattaagattaagtcagaacagaatgagtttattaccgtataaaaaataaccatgctatatgttgtatatatgacttcaatatttgttatcatacagcttctaagttgggcattaaagagctattgccagcttacaaagatcaggaccttgaactaaatgacctacttactggtgtggcctttgcctcaggaggcagtggatatgatcccctcacttctatatcggtatagttttgttattagctcaaaactctcagaaaatacttcgaaacaaatttatatttcctcataatgcaccataaaaaaagacatttcgttaattgtgaaataccaattgatgtatacatgtgcatatgtaatattttgttatgatcatgcagactgccatatcgagttcaggacaactcaatttattcagtgactacaagcagaagcttacatctttgatcggagaggaggcaatgacacgtattctctcagaagcagttttctttactgtcatgggagcaaatgacttgctcaacaattattttacgcttcctgtgaggcggcatcaatatgacattcctggctacgtggactttgttgtctctaacgcagttaactttactctggtaaatagttattctatttttcatccatattatttttaagccattttgattacatggaaaattaccatttatttcagttgtaatgtaagcactgcaacgtttaaatatcccatatatttctgtgatcagcagaatgtgtaagaatatcttcatctccctctgcttttaataattcgtatagttgactattacttgaatccttcaaatggattaaaaaggcccaataattctttcctcgtatttacgaaaaatacatcacacaattctataatgtagcattatttgtatatgttgttattaatttattgctaaaaaagagtaggcaaagtttaaaaccggaaagtccaataacatctctttgagagtggaggtggtatttcgtattttctatccctagcaaataaacattgttgtgttattacttccatgagtgatataaactcattttcagttaaaaagaacgagtgatatacacgcgtttttattacttgttctcgagttggtgttattagaattacttgacatgttatatttcaaccatctcgttgtcactaggttttcatcttattaatagaaacaatttaatttagcaagttaacaaatggaaattctcaccattaggaaattactttagttcgtcgttttcaacatgttttacaaacttgcaagctagctagattgggctacttgtcaccagatcattgtatgcattgagttatttaaaaaaaataatgccatcattttataaaataatatcgttataggtacatattttagataataaatattggcatttttacattgtagattatttcatgggatgatccatttattttcattctttcacactaaacctatctcttgtacagacaatgaatgagatgggtgctaagatgattgggttcgttggtgttccaccacttggttgttgtccctcacagagaactggtccatcaagagaatgcgaaccattacgaaatcaagcatcagaattatttaatactagaatgaagcaggaaatcgatcgactaaatgtcgaacataatattgatggtttaagggttgtttattttgacatatactacaatttgctcgacctgatccacaatcctggttattatggtaagtttgtaaattctctttagttattcttttcattttagataaacaatgagatctaaaaaaacatactactacaactatattagacacgataacgataagcgcaacactttccaaaaatagaaataccgcgtcttctccctcacacgtaacttgtgcatccacctgttagcaccatgcagtttatatgctacatcgtctagcactattgcactagtatttttaaaaccttttatggcttatatctttataactgtatatttttttaatcttattgagccatcgtactctatttaaaatatatgtgacgaacgagtacaatattaaatatattcagattatttaaaatttatttttgattttaactcttttagcagtgtttttacttcgaataccacgatgagttacttgcctctagcaacatagttacctttagtagcatgaagggttagtttcttctagcagtgtagtcacttttaataccatgaagagttacattaatttttagttaagttacttccctccagcagtgcagttccttctgacacagtgcaaaaagttacttcgaatatcaatagttacttctaatactgtgaatagttacatctattttctaaagaatcacttcctagatgaaataaattgcttttatcgaaaaacaaaaatctccctctctctctatatatatggcttacctcgaataaaaaatattatgtatttacttgtgaatctacacattacatacgaagatctttctgttaacacatatatgtaattacttataatgctataaaaagttacttccattttagaattcagttacttctagcatttaagtaaattacttctaaatattttaaaatatttaatattatactcatttcgtcatatattttgagtggagttcaacggatctgaaatatataagttaggtatataagttaggtaatatatggtttgaaatatataagttaggtatatttccactgaactctcgcaccaaaagtatgcattcatacaccacgcgtacatgatagcattaatcggacaacttcggcaggcgtcgcaccataagactaatctatgcacgcacacaaattagattttgcatactatatttataataatatacacatatactagatgtgtaattaacctactatataaccgccgattaaaaaaaatctaatcatgaccgaccaaatgtattgatcaaaacgagtgtatacttggcacatatgtatgattaagagcatgtatacaaaagacttttactccatttatatactatcaccgtacaaccctgacctcttaatatataggcatgtctacgaaaataaacatattttcacgtatagatctgcaaaatagattttcacatacgactctttactctttactggacat

SEQ ID NO: 59680 - DNA, 13761 bp, Oryza sativa
  unsure (1)..(13761): unsure at all n locations
aatttcgatcaagtaaatctctgctacaatttcacttctaatgaacctgctaatctctctccatgtctccagctcgtgccataagctcccactcccatacccccacataatccatcaactccttttcctggcaagtggctagtacaccaaggccacacgctagagtgatctaaagcctgccaaaatgaaatgagatgagaagccacatgaagaactttggaagcacgatagccaaaataaccaaaatttgtcaccttaaagcaattattggaacatttaaataaaaatgaatgtattgtgcaggcctatgttttgacaaacacatgaatttgaaaattttgcagtttgatagtttggagctaaaacttgggcttgtgcaggcctgcgttttgagataaattaagctagtaatgtgtgatgtcatgcataaatcattctgaactttaatagtctgaaacttgcacatgtattgattatgaaatctgaacatgggcatgcatttttttgtcaacctatctgcacagatagctcccatccactttgaaggaagatctgacaatgacatactacagtgcacagatgaacacagcactgcatattttggtccaaatataagaatgcttattacacaaacaccataagatggcacaatccagttcatgaaaggaaaacactgaattttcttcctttgaaaaacaaaaggtgcaattaaagaataaaaagcaacaaattttacctggaagcgcaaatgtgtcgaagcactcagcacccttcccctgccctcgcccttgatatgttggcaggttcttcactgcactgaattgaactttgcattcacctgtcaacttagcacttacagacagaaatatcccgaataggataatatgtcatttatgaattgtgccgctgcaataatccagctattgaaaggagaaagtgtaaaatatggttatcaaatcaagaagactgtcaagttaaatgagaagcgggaaaaattcatactcattagtcaactgaatagcgatttgagtaggaagcatatcatcctcctaggggaagaaacgtgcaaacatcagaaaaaccgtttcgcatcaaagtaaaaaactcatagatacactaccaggacaggcttaacagcatatgaagctaacaattaacagatacaaaatcctggaggtgtaatacactttctcattaggcatatattcaaacttcaactattctcaatgctcacaaatattgccttaaattacaaaattaggtgagaggaataaaaaaaccaaaccaaaatccatttagataggtcatgcctaactaaatgcaaaatccattgtttattagccaaaaagtaggtgatttttttagaagaataagcctctcagattaatccctctgtcaattgagacataaggctttcatttactacttaaaaaaaatcgtagtggcggtagtgactccaatcctgacagacacacgtaatatggatagtttgatcgccaaatccaatggttcggataacaggcaaacatgtgctttctctttgcatctacgcccatcacaatgcaaagcaactccccctctcgcttcctggtttttctccgcatctgctgccaccaccatcaccgcaagtctgcaacctagccatggcattgacagcctcccacaacgccttgccgccccttcctgccctcccccattgctccaagacaccacatccccgcccaagccgcttggccgaagcccgtgctgcgccgccactgccctccccctgttctccacgtcacctctccgcccaactcaaatcctccatgccatccccgcaacacaccgcttcgctgtggatgtttgagaaagcacatcttaaattaacagcatcccagaaattattagtagcagagtgtaaaattcactgtcgttcccctctatcaatgtcacaccctgaaaattgttaaattataaattgttgtgaaaaaggaatttttagaatttatttaataattaaagcaagtgtgtgaataaaatctatgaaaaaattgaacataaacttgatctagataaaattttattgaatactttgtatgcccaagtattctctggatttttttcagaattatttgagtattggaattatttttaataaatgaaagatcatttcagcaattatttaaattaaaaagttaattaaattctcttcctcagtctgggctgaatcctgcccactcctctctctcccttctcccttccgcagcccgtgcctctcccttggccgaagtctgcattagctccctcctccttctttctctctgacccctggggcccactaggctacagtgccatcttcctcctccagcatctctcccgtcccgtgaccgtgaagccgacgccgcatcctccgctcgatccggtgcatcccgtgctccgtttccaaaattggttgcaaaaacggattcccctcaatctcctctatcttatccctaagaaacccctttaaataccgttgtatattgcgtgaattcgacgcggtttcgagctccgtttttccggcgaatcctaactaatccgtcgccgattccatccgttcccgagccgacctctccctcttccggctataaatagcagcccctcgacctcctcttccgtttcctcctttttcccgaatttttccctaaccccttcttctccaccagtgttcgccgtaaagccgccgtcacagtcgtcccgatctcgccgccgctcgaagctcgtcgccggctgccgttcgtcgcccatcatcatgcaactgtgggtaaggactgtcttgttctcctcttcgctttagtgctctcgctttccaccgttgtgtcatcatttgtcgtcgccggccatctcccgttgccgtttttcgtcgccgtcaccattggtgagttcgtcgtcgcgtcttctctctcccggagctgtccccttatcgtcggagcgtcgccgttcagtcctcgttgctatccagagccatccgccggtgatgatgttatcgctgacatccacatcatctcaagccattgcaaaatcaatataaattttgttatctcttttcaatgacatattattcctttttaatatatgttacctacgatctaatctattttcggaggatgttttaatcttttgtctcagctataaatcatctgtaaattgtttaatcaatttggattagtcttttctttaataggtttaattggaattaaatcttgtaaaattcatatctaactcatacgaactcggaatgaggtcgttcaagtcccataattcatctaaattcaagctctacctatttatgaactttaattgtactgttcatttggtttttattagtgttataggtttagttttccgttgtttcggaggatcgttcgttcgttggagaagttcctgaagacgaattgaagacgctttttcgcaaggcaagcatgttgaatccgtttaaagctaatgttttatttcaagttatgcattattttagaatgtcatcgggtggtgaacctttctcatttaattatggccgaagatggctttattttcctatgggttataatttgactagcatcgaccttatatatcggattggttcagctagatgttatttatagttgcttagccgtgcttagaaacattagctcattaatgggataaattatgcttcactattacttatggttatatttaatggtagctcacgatggttaatcgtgttatgataattaattgataattaaaatatgatatatggtgggttgtgagcacatggttttgaaggtcgtgctcatgacaattaaggaccggttcgcgagctactgttgtaaaatattaaccgtgccaacaacatgccagcgtgggcaacagctttaccttttgtatagcctggttcattacggggtgccagactgagaagcggcgagaggtccgtgggggtcgctggggaatccatgcctctggtttttgagggggtgattatgatccaggaatggtgcactgtggtgagttgtgttgggcaaagggtattgtcacgatttccccatttgcagtgccgtggtggtacttcggggcatggcaacatgtgtggaatcgtgtcttgtgggtacagtggtacatctctggccagagtaaaactattcgaatagccgtgcccgcggttatgggcgggtctaacaatgtttttcgtgattagtcccacactactcattaatgataacaatgtgataattaatttgactcctggtttagaatggataattcctggtttggaggtttgatctgtacgaccggggttggttgttcaggtttggttgggcctgagcagcatgggtgtgctgttcagtgttgattaatattgatgattaattactctactgttttacaaatttttaaatctttgctaaatactgctttcgcaaatgaaccctatattatgccatcctttggtatccttgtgcacttgcatacttgctgtgtggcttgcggagtattccatgtactcaccttgcaataatcatcaaacctcagttgaagaaaaaggatccagaaggagaagacctttggtttagatcccagttgagctgcctgtgggagtggagctgaagcttcgctaggttttatttttccgctgcagttttcttcatggtaaggactaagtgcctcttatgtaagtatttatttgctttagttattttgatgaatctgtatattaaattgtcagtttgtgtacctcggttaagtcctggacgagggtcttaatgcacaaattagttcggaaattacttatgaatttctgggcgtgacaatcaactatccttctctcccatagtacccaaccttagaatcgtttccatgaccctgaaggctgaagcaatagaataaacacggagctactttgcattatcatttcggtttaactttgtaacatggtaaatcataaaggttacctatgggatgacaaatcccacatcatttccctggtggtctgcattacgattctgaattctaatacctcaaatttcctctacatagaaatgacaacaatatattagtcgagttctgcataatcagccgcactggtttaggcctcagatcaagattgttttcagttgcatggattgatccgaacagcaagtactgcaccaagagagggaacacttacgctagttgaggtcatcgaatttctgtgaaaggtcgtcgtacctctcaccttggcttaatggtgtaggaggatacgtggggcaaccagtattgcatgaataatgtctcgcggcgctaggtaggaatgagctcgcactccagaacggcctcgtggacctgccggacggtggccttgaggagaagatgggcaacggctaggagcggggtctcagggggtggatgcacgtcggtgagtgctgcggcgccgatggaatggaggtggcgtgagcaggtgcgtgggaaagcgcgaaggcagcggagaggagatggaggagaggacgatgggccaccggggagagctgtggcgccactcctccctccccttccaatctcagccaccgtcactcgagctcccgccaccttgtgaggccagatcgatggtgaagagagggttgttggcggcgttcctatcgatttgaggtcggcggcgcttgcatcgggagggacttgagatggcagtgcgacagtgatatgtgattgatgaaacttgaggcaactgcgaggcgaaggtggctatgagaggggagggagacggagcggtggccggcggcaaagactgaaggcctgcgaggtggcggtggctatgcagatcggcgagggcggaagaggcgatgcgcaacggaggtgaaggggaaagagcgcaaagaaggtgggggaggggtcgaggtgcgagtggcggagggggaggcgatccgtaaccgaggggatacgcgacgtaatctggaccgtttgatcctgtgatccaacaaccctgtgggttggggtgggggagcgggcggaggaggaggagagcgaagggatcgatctggccgttggatctggtgattgtacggatagaatggtgcgtgtccgtcagggttggagtcactgtcaccactacggaattttaaagtagtagagatataggtgatatccatcggaaatcagatatccgtcagatattatcgggtattttccatcggatatccgacttacacataaggcccataatacagcccaacccaaagaagaggcaaatcaaacttcttggcaaaaatgaatttcgatttgaattttatgatactaaatgaactcatatgaaaaagttgtcaaaaacaaagttgtagaactcatttctccatccgagtttgattgaactatataaaatttgaattttaaaatataagaaattcaaataatatttttgggtagtaactgatttcaaatggaaaaattgtcaaaaacaaagttgtattcttatcaagatctataacttttattttgatcatttttctatatgactttgtttgaacagtttgaatttaaatttaaaagtatgacaacttcaaacaatattttcaaatactaaatcatttcaactgaaaaagtcatcaacttcaagttgtataactcaacaagatctataacttttattttgatcatttcttcatccggtaaagtgatagtaatattgttcataaaatttgcatatctctcatttgcatatctctcatttggttttataaaatataagagagagatgtaaattttatgaacaatgttactatcactttgtcggattaagaaatgatcaaaataaaagttgtatgtcttgatgagttgtacaacttttatgttcatgacttttcagctgaaattatttactgcttcaaaatattatttgaagttttaaaattcaaatttttaattgataaaacaaagtcataagaaaaaatggccaaaataatagcagtaaaaacataataacatgatagagcataatttagaaacacaatagcaaaaatcgtttgttagtagtgaggggtttttatattctgattaatataatattcgtcaccgtattcgtttcgcttcgtattcgctccgtatttgtattcgataatattcgattccgttttcatatccagatttctgattccgatttcgatttcgaaaaaattatgaaaacgaatatgacagagcagtttccgatcgtattcgatccgcttttatccctatttatatgtagtggggtggactgctcacttgtacttccattgccatctattaattactcaactttttgttatgtgtggcagggagatggaaagctgaacgtatgggcgatagtcagatagggatcggaaagattcgaccaggatttagtttgattgtgaaaaaatcgggtccatctgctcaaaatctgacggttaatacatatatagtgatgatgtggggtgagctgtggaacaagctatgcctatgggtaccaaatattgaaagaaaggatatcgagagttttctcaccgtttcttgtatgcgacacgcgagggatgcaaacaaagcaaccgcatcctactatttgcgacacgcgtgcgtgacacagctgcatgcacgtcgcagcacgtccaagtaactaagcgtgttggctatacctatactccctccgtcccaaaatatagctatttttagcaagtgtcttgttccaaaatgaactatttcttcacctacctcctcctctcaaccaatcacaaccttcttcttcacctactttctcttttcaaccaatcacacacttcctccaatcattctcacctactttcttaatacccgtgccaacctcaaaaatggcttcattttgggacggaggaagtactatatatagtccctccatttcaaaatatttgacaccgttgactttttagtacgtgtttgaccattcgtcttattcaaaaaatttaagtaattatttattcttttcatatcatttgattcattgttaaatatattttcatgtacacatatagttttacatatttcataaattttttttaataagatgaataattaaatatatgctaaaaaatcaacggtgtcaaacattttaaaacgaagggagtactatatatatcatatatatctagtgcgcatcgatccctagtggagtggtagcacatgccccagagaggcgcacacaccagtgcagcaatgagaggctaaccgatcagatcatcaagctcaagcaagctaaaatcaatgatcgatgacgtgcctaagcaacagtcgccatggatgctgcctttttgttcgaccganntggcctgcgtgcnnctgngnntgcactgngtgncctggnnangnctganccgatatattgattccgccggctagctgtcttgcaagtccggttcggaacatctcggccatcttcatcttcggcgactcgaccgtcgatccaggcaacaacaacaaccgcctgacgccgtccaaggccaacttcccgccgtacggccaggacttccccggcggcgtggccacaggcaggttttccaacgggaaggccatgagggacatgataggtatgtgaaagtacttaattcggtggcacaaacaatctgtgagattaatatatacctctgtgcgtgtttttgttgtgtttgttttttctgttgtagtattgtcacctatatataaattaagtcttaatgaaaaagatacgcagcggctcatcgctcgagcgtattaataaatgattaagcatcctagctgactttagttcttctctagggcttgttcccttattcccttccgaaagggaattggagataatttagggcgaatatttccctcatgctcatatggtgactcgttgatcgatcaaatatggaattgtcctatgttagcatagaaaattatggtgaaattagggcgctttttttgcatataggttgtgggtgatcagctgcacgcaaaaccagaaatacgattaacatatgattagtttaatattaattattaaaaatttagaaaatagattttttgatttttttttcacgattaataacttattttttatgaaacacaccgtttagaaaatagaaaacgaggagtatctaattaagttcagttagctcttaagaacgttaccctagttggatacgctagttaattctcatccaaaatctcaagcccatgatatctatatggatttatatagcattttcttaggggaaaaaaacgtgagagagaattcattaaatcctattatcattaaatggactctgtagtttttattttattttaattcaagacatcaaaccgagtgtaactgaacttataacttctaaatttcacaattattgaattaagtaattgaaatgcactactataaaaagacacatagagacgacatcatagataccggaacagctaaaaccgacacttaaaatacttttcccacccacacaaaaaaccacaggggcacgcaccagccgcaaaaaccggcacctatcttccttgtcagagaaatgtacgctcacttcccattgtcaataaattccatgaataaacacacaagtatgtatacacaaaaaaatttaagaacaacgatcagatgcctactctattggtggagaaaacacctaggtagattgagcaggtcgggcggccacccagtgctacagagcactttttttcaagcaaatttgccaccgttttttcaattttgcaaggatgccactcgaatgataattccagtggtatttttgcattttttagtggcagttttacaataacgattcaaagcaatggtaaatttgtaattgacccttttttcaaacggccgaagtcagtctgcagccactagccagacgactgctcaatcgcctggagcatggtgtatgtggaaatctatattttgcccttacgggtataacaaccccatgtgaagaagtattttgcacgcgggcacgtaaagccgccatcctatgaaatgtttttggcgaaaaaaattaaaattcaaaaacacaaaatttccaaaaaccctagctcgatttgatcccatcaccaccggtagtcggtgaatctgccgtctttgctgtagttctccatctttgtagccaccgtcatcggatcctacgttcccatcaccggggccaccagatccgtccacgggggagacagagaagcaatggagggaagagggccccgccacatcaggttaagcccctcgcatcgccgccgccaccggatccgtgcaagagaactaggagaagtcatgttgtggagaggttgccactacctctgggtccgcccctcctgatggaagatggcggagaagcgatggacgggagaggctatcaccggacacgccctagctagggctgtagccgttggatctgtcgtctctaggctagccactgatggatccgctgtgcctcgcccctcatgtcatagccattggagagggagtgtcatggccgacctctgccgttgccactaaccaccactcaagccaccattgccgcccacctctgcgccggccgccatctccgccaccttccatcgctgaccaccgcatcggagagaacgggagggagtgagtgagaactagaggctaagaggaaaggagcatcgcagcaaagctccgacccagccgccgtcacctcagagttatgtagctaaccactacaccagacagaacgagagggagtgagtgagaacgagagataagataagatagcatgagatagtgaggagaagctcttaagaaaggccaatatgaaggaaggtggcggagatggtggcatgtctagaaaaatcaatttttatagctggacttttatggaacacaccggctaaaactttttttgtatgggtcatattttacgattttcgcatacgggcgtttaccgacaccgctaaactttttaaatatgggtcttattttaggctgtttgtaaaaataaaggagtgatgtatgtacaaaccataattatgcatacgtgctgtgataactcaaactcctccatccacacaataacataatttgacccatcatgccttgtccttgccatctgccaccatgctctatataaaattactgtaccaattttgtttctggtatctccatttacttgggcataatggtaaggtttacatgatgttttaatttttcttaaagtcaaatttctctaggtttgactaagtttataaaaaaaatattatcaaaatatatccaatgttagattcaatggtattaaattggtgttatagatattactgttttttctataaacttattagtcaatttgacttaaaaaaaagtcaaaaatgacttatagtatgagacagagggaatagttgagaccaatctttgttatgtttttatcaaacatgtatactgtacttgcaaacactaatctaatgtaagaagatttggaactctcagagagagtagtttgcaacccgaacaagaatttgtatttgtgtatcaagaattctattaggatttcaaaaacagttcactttgggatatgtaaatttgtgtatcttgtccattttaccatgaaaaatcaagttttgatgagttttttttatctgaacttatttactgatattattaattgattgaataacatggtaactccgtatgaatatctggtttattataattaagattatttcgaacagcttcaaaattgggtgttaaggagctaattcctccttatctcggcgatggtcttcaacttgatgatctactcagtggggtagcatttgcttctgggggcagtggatatgaccctctcacttctaaaataacggtacaattttacttcttagaacttatgtctcaatacaaactgctctctaattattatccagtttcaatttgcactgtaaagtaagattacagtgtaagacacacacacacacacgcatatacagctaatattacttcagacgtattttctgattttcagaccgcgatatcaagtagtcagcagcttcaattattcgaggaatataaggagaaactaaaatcattggttggagaagaggatatgacacaagttgtcgcagaagccgtctactttacctcaatggggggaaatgaccttgcaaacaattacttcttaattccttttaaacagcatcagtatgaccttggttcttatgtggacttccttgtatctttagcagtcaacttcacattggtaagaagtatggtcccatgaaatgcatgattttttaagacaatttacatatattgaatatttgaacgtttccaagataaatcacgctttgtgtacatctgattggaatttcttggttgtagttgctgatttagatttacagtgaatactccattagtcctaaaatttaagaagttgtggagttaggcgtaggaaagtaggtgggtaggtcactgtattccaagacagtgaatgctaaaaaatgatatattttgggatggattgagtagtccttttccattctaaattgttttatgcatctgagtttgaatatgtaatgtaacattatacttgtttgcatattatacagcaactgaatcaaatgggtgctaagaggattggattttttggaattcctccagttggttgtagcccttcacaaataatcctcggaggacatccttcagaaaaatgtgatccagaacgaaaccatgcgtcagagctatttaattctaaaatgaaaatggagatagctcgactaaatgcagaactgaacatttatgggctcaaattggcttatatggatttctaccgctatctgctagaacttgcccaaaaaccagctctttatggtacgttaaattacatattaaaataagagagagattaactgtttcgcacaaaaacaaataattacatacataattattatggagtgttaaaatattacatgttgagcaaccggaaaagtatgtggtgaatggatatgatataaatttccgaatgataattgatgatctgcatgagcgtgtcgcattcaactactaattattaattctgggaggtggtctgtacgaacatttttatactgacgccgatctgaaattttccattatacaggtttcaaggttgcagctgtgggatgctgtggtagtaccttgctcgatgctagcatatttattgcatatcacactgcatgcccaaatgtccttgattatatttactgggatggcttccatcccactgaaaaggcctatagcattgtggttgataatatgatgagggtaattaaagagcatttgatgtgaaggggataatactatcatatattgttagtgatatgtcctagaggcaatcatagagatgattgtatcacatactatgttttcatatttatccgacattcactggtggagaaaccatctttcgtcggtcggccgaattccacaatagtcccggatgcaataaaaaccggggctaaagatgatctttagtccccggttaaaaagagttacgggcatatttgatctttagtcccggttggtgatctttagtcccggttcaaatgctgtcagggcttgtcagcccccccggatctttagtcctggctagtaacaccaaccgggactaaagatcgtaactttagtctcggttggtgttactaaccggggctaaagtccgggggggctgacaagccctgacagcatttgaaccgggactaaagatcacctaccgggactaaagatcaaatatgcccgtatctctttttaaccggggactaaagatcatctttagccctggtttttaatgcatccgggac

SEQ ID NO: 59681 - DNA, 18100 bp, Oryza sativa
ggtgttactaaccggggctaaagtccggttagtaacaccaaccgggactaaagtcccacctctctaaaatatgtcttcttcctcctcagctgcccgagcaagcttcaaaatttcttcaaaaaagaggggaggtcatgccaaaatttctagtgaatttattttggtgattacatacaaatcggaggtgcctaaaaggtttgcaaactcatcgtccaatgtttttttttgtcatattacatttggagctatgttttgcacacttttttgtctccaaaatttagttgtaagttgatgagagagaaaatttgtgtggggaagaaagaatatatagaaatttagtttatttgctaaaaaaggttttataaaatagttgagaaggaaaatatagtgaaagttaatcttaaataatagaaacaaactaaaatgaaaattaaaagaagtaaaacacattaaaattagtttaaaactttagaaatagtaaataagtaaaacacgttgcggatgatcttggttagatgttgcaggacaccaagaaggactgcgaaagtgaaaaggagccccataaattgaacaagatgttagaggaccacagaacattgttgtacccaggttgcgagcaggggcataaaaagttggataccactctggagttcttgcaatggaaggcaaaaaatggggttagtgacaaggcatttggcgatttattgaaactcgtcaagaacattcttctggagggaaacaaattgcccgagacaacgtacgaggctaagaagatagtctgccctctaggattggaagttcagaagattcacgcatgtccgaatgattgtatcctatatcacggtgaggagtacgagaacctagaagcatgccctgtttgcaatgcactacgatacaagattagacgagacgatccaggagaagttgacgggcagctaacaagcaagagaattcctgctaaggtgatgtggtatttccctataataccatggctaaggcgtttgttcaagaacaaggggaatgctacaatgatgcgatggcacgctgaagagcgtcaacaggacgggatgccgagacaccccgccgatggttcgcagtgacgaaacatcgacagaaaatttaaagactttggaaaggacgcacgaaacatacagtttggtttgagtacggatggcatgaatccttttggagagatgagtagcggccatagcacttggcccgttacgatgtgtatcttcaacctcccccctggctatgcatgaagaggaagtacataatgatgccgattattattcaaggccccaagcaacctggtaatgacatcgatgtgtacctaagaccactggtcgaagatcttaaactgttgtggaagaaggaaggtgtccccgtgtgggacgaggacaaacaggaggagtttaacctacgagcgctgttgttcataaccatcaacgattggcctgcacttagcaacctatccggacagtccaacaaggggtacaaggcttgcactcactgtatggatgaaagagaaagtacgtatcttaagcactgtaggaaggttgtatacatgggtcatcgtcgattccttgcagcaaaccacccggtatggaagaaaggcaagcacttcgaacataaggctgacaatcgtaggaagcctaaacatcgcagcgggaaaacagtgtttgctatggttaaagatcttaaagtagtgttcggaaaggggcctggaagccagcctatagagagcaaagatggtcacgcggcgatgtggaaaaagaactctatattttgggagttaccctattgggaattcttggacgtccgccacgcaatcgacgtgatgcacctcactaagaacctttgcgtaaacctccttggcttcctaggtgtatacggaaagtcaaaagatacattggaagcacgtaatgatctaaagcatatggaacaacgcggcgaccttcacccggaaccaaaggagaaatgaagccattacttgagtccagccagctacactcttagcaaggcagagaaggaaagtatgtttgaatgcttggagagcataaaggtaccgtctggatactccacgaatatcaagcgaattataagcacgaaggagaagaagttcacaaacctaaagtctcatgactgtcacgtgttgatgacacaactgctaccagttgtaataaggggtatccttccagacaatgtccgggcaacaataacaaagctatgtgcattcatgaacgcaatttcgcggaaggtcatcgatccggatagattagaagcccttcagaatgatgtacttcaatgtctcgttagttttgagttgatatttccaccttcatttttcaatataatgacgcatctgctttgtcaccttgtgaaagagatcagtattctcgggcctgtgtacctacacaacatgtttcctttcgagaggtacatgggcgttctgaagaagtatgttcgtaaccgtgctcgtccagaagcaagcatcgccaagggttatggaacagaggagatcatcgaattttgcatagaatttattgaagaccttcgcccaatcgggatacctgaatcacgccatgaagggagactacggggaaagggaactctcggaaggaaagcaataatgacggtagacaacaatttattccgtaaagcccatttcacggttctgcaacaatcttcattggtagctccttacatcgaggagcacttggctctagttcgcgccaagaacatcggtaagtccgatgcatggattacacggcatcacattgatactttccccgcgtggctacgacaatatctcatgggtaacgagtcgatcaaccaacaacttgccttcctggcgaggggaccgtctgggtcgatcgcgacattctagggatatgagatcaatgggtacacattctacacgagagcccaagacatgaagagcacgaaccaaaacaacgctgttcgtgtcgatgccatgggacacgatgtaacaactgacacgtattacggtgccatcgaggacatatgggaacttgactatggtcctctcaaggttcctctgttccggtgccaatgggttaggttgactggtggaggcgtaatgattgatgacagtgggatgacaacggttgaccttaacaaggttggatactcggacgaaccttttgtccttgccaatgatgtaacgcaagtcttttacgtgaaggacatgtctagcaaaggaaagaagggcagagggcctgacgagcctaagcgtcacgtggttctcccaggcaaaagaaaaattgtcggagttgaggacaagactgacgaggattacgatgagttggatgggcaaccccctttcacggtgacgattgaccctagcatcctcctatcaaatgaagacaccccttactcatgtagcgatcacaaggagggaacgatagtgaggagaaagtacgtgcggtcaaccgtcaccgccgatgtattgccgtaattattgtgtacatgatgtaaactattttggatgtattgattatccatataaatcaattgttgtatggcatatgttaattacgcacgactattagaggttttaacaagtttaaatcatgtatatgctagttatatgcgataattacaatttttaaaagttttaaatcacgcaggtggcattttcatatgttaattagagtttttaacaattaatttaatatcattcatatgctaattatatatgactattcgaatttttaaaaggtttaaatcatgcatgtggcatttacatatgttaattagagtttttaacaattaatttactatcattcatatgctaattatatatgactatttgaatttttaaaagttttaaatcatgcatgtggcatttacatatgttgattagagtttttaacaattaatttaatgtcattcatatgctaattatatatgactattcgaatttttaaaatttttaaatcatgcatgtggcatttacatatgttaattagagtttttaacaattaatttaatattattcatatgctaattctatatgattatccaaatttttattaattttaaataatgccgtatgtatatacatatgttaattagagtttttaacaatttaatatcattaatatgctaagtatatatgattattagaatttttatttattttaaatcatatatttgcttattacgttttatcaacttaatttattacagacaacaataatttttcgaagtaattgtcattaatttttgtattttaaataattttagtgcattattttctattttagaaacacatatgtaatggaaatttatattcagtgcgcttatcagtagtcccggttcttatccctaaccgggtttaaaaagaatttggaaatagcgggaaaatatctttagtcccggttgatgagaacaactggctcccggttgttctcatcaaacgggaataaagatctaggggaccaacacttagaagtttttgcctgatcaatctctctcggcttctccttcgccgccactgcctagggcatccccgcaccgacaccgccgtcgtttctcgccgtcgtctcgcgctcgttgtcgtcgccgcctccgcctcctcctccgccgccgcatctctggggtgagagccgccgccgcctccctctcagctctctctctccgatctcgatctctctctctccctctcggttgacgccggccgcctcgttgccgacgccgacgccgacgtcgtcacgacacgacaccgcgccacgacaccgcggcggcatgaaacgccgagacgccacgacgccgccgcggcacatcactggcgccgcgccgccacgccgccgcgcaccgccgccgccgcgccgtgtcgtaggctctccggaccttccattataattgagagatgaagtgaataattcaaatcatcaaacaagcataatgaaatatccgacgcctcgagagaggaatattggagatattgctaggcctttagcctgccagtcaacttcagcctgagatgtgcccgtcaaaccactcgaaggcggcaaccagatgtgttacacattcaggagacttgacaaaaatggctaaagttctacaacatctcaaatattcctaactcatactcatgtgaatctagttcccaggatgtgcactagattcacactttcatctcaagcatgattagacatagcaaacacaaataagatgaaagcgattgtaaactacatctactttagttacattggccgactggccaaaaaaaaatatatatatatagaacagcggaagcttgtctacccaatccacaagcacaccgactaggggtttaccccattaagttcaagtcctagaagaagcagtcgatcacccgcatcactcaaaggctaagtctaaatcctgcaagcaaaagttaattcaacagcaagagtcagtacattattagaaataatgtactggctagcaccaagacaagcctaagaccctacttgcaaggcatataatcaaggaaggcataatatggttctttttagcataaagcaagttttatttgcataaaacacattcaaaacggatttgctttcaaataaaatttcagcaagctagtacttagcatatgggcatcaaagtaggcattaatcatgtataaatattcacctcattgccatccatggcagcaaggagatcattctcaaatctcatcacaatttgaaggtaaatttcagcatttaggagaataaacacaagtctatactcaatacatatccacacgccgctcatgaccgcgagcacggctaatcgattagttttaactctgcagagtttgtacactttacccacatgatgcgaaataataatcatgcaagagcatggcacgcgatacataagtacccgatttattacccacaacaaagtttttccaaaattcatgatttagccttacaccagcacgatacgtgttcctccatcctagtcatactagaaatatgacctagaaccgttaagtggcgggcccatgccttgaacttaacgccgtggtggcggacacaacgggaacccacccacgtggcacaataccgttgtattggacagacttagtcacctaaactaccacgtcggggtaaataggaagttcctctgagttatccgaactcatacacaccggcctaccagaatgtaaggctaaaccataaataatttactaagcttgggctatcccatactagcacatgtggttgtactgtatacgaaatgaactgacattgagtgaagtccttaggtcggtttgggcgcactctccccctatcggtatacaactaatcaccatatgtacaccacttgaggcccaaacctaaaatccatgttttccactattttatttatcaaaatcacaagttttaaagttctgtccagattaattaaaaatcaattttcatgtttgaaatgagcccataatgacaaggaagaccattctaagcatggctaagctttatagtaacctagtgtcaccaaaactcatatataaagtggtatagccatattgttcctaaggttaggaatgaggaatatggatatatgtggagttaaggtgataatgcaaataataggagtttatctaacaagtttaacaaaattttaatttattagtgtacaatcgacatgcaagatttgcaaacattttcaataacctccaaaagataggttcaaagtgatcaaagagagggagatgggacttgccttgaatcaggaaaatgtcagcacctaaatcacttcttcaccgattaagcaatcatctatacaaagtacacgttatgcaattaaacaccgaaatatgcgaaaaatccaaaatgttctaaaatgcgtgatttgtgcacagagaataggtactggtataaaatgaatttaggtgaaagaatttctattttatctcattttatttgggagttatgaattttagaagtttcgtcggtatagtgtaggatttacttagttactattgtgaaatgctgttgtaaggtgattcttattaagtttatgtttgctggggtgaatatatttgttttctaagactaacacatttggtttcataatttttagagttaatatgaattatttatgtattttacaagttttaacgtgttctaggcatatattccctatgtgtaaatggctttggagatttaggtccagaacttgctctaacttgctagtgttgtataaaatgtgtattttagttaactaatctaatcttagtttataaaatttagtgttcaaattactttacttcacattttataagctaggggatgttctatgttagaaacttaacatatcaatctggagattattatatgagttaaggatactaagttttggtggaaggggatggatctatgccttcactggttcaacaagttttatttggatttatttggagctaccatgcatatatatactttttcatatgtattgtttaaccactactatgtgtttagttcctattctaccaaattaaggttcagagccatggtctgtaaagagggtgctataattcactctactaagttgaagtatatcacttgctggttctatagaaaatttggttcacttcattttgactatagatgaattttctacaaatgttacaatttaaggtatgctccatgttgcttattccttacttaaatacttaggggttttcgttatactgtaagtatgtctttttattttataacattgaagtgcacaaccctatgattctactgaatttgggtttactcaaaaaggatctaagatgaattttatataaacttctaaagttcagcttatgcaaaactagtcattttaaaggtaatagttttagaggcattcgatgtatagtatgtatactatttcattttgctttataggagaacataagttggtggatctgtagaaactgagtttgctccaaaatgagttgaaatgaattttgtatgcattttataaatttgtgcatgctttatgtgtgatttaacttggataaattttagaggctaaatttgtactgtgagtgcaagtttttattccataacactaaagttcacaatttggtgagttgacagaaatttgtatcatcttaaaatgagctatatttaattttatatggattttacaagttttaggtactttccttttataatttcagatttttgtttccaaggggtccactgtcagtgaaagatcaatatacaaaaagatccctgaggtttctaagaatcaacccgcagacctagcctcatatgtcagtgagttgaaaagttgcacattaatccttatagttgtttaaattctcgaaacaaggtccctgacttcttttctcatgcacagaggcagaacagccatggctgagctcgatctcgagctcaccggcgacaaacgatggctcgtttgggggtgcaaccaaaatacaaaatgaagatcatgttattgcgattccattcctctacttttctcggtcagtggacatcggagtaacgccggcggcgagtccgaaaggaggatgttttcgggtggtgatgcatgtgcttctacaatcatgtattggttaattgggtgcatgcatgtatgttctataggctgaagggtgctcaccgagatgctagacatggctggggtagctaggttgatgacggcggctcgtgtaacggctcggcggcggcaagaacctccgggtgaacggcgatggctcaatcagctccaagaactatcatgcatgtgtgtccatgaggttagagaggccccagggatgctactgatgcatggaattgggttggtactcaccggagggggtggattcggcaacggcgacggtgaccggaggtggagaagacggtggacgatctccacactcgtagcaccatccttcgagattcttgaggggaaatggagaggaggtcgaggcgaagacgctggcgcgacagcttggcccggcttggtccagataagcgggaacggcgatgatgtcactgcggcggtgcacagagcgcgctccagagctccggtgtgcacggcagcgttcccgtcgattggctgcaccagagaggatgaaatcaaaaggagaaatattcggcatggtgaggagagtatggaacgcaagagaagaggaaacgaccgcggctcatcaacgattgcggccatcatcttcttcgcggccggcgatggagaaccagtggagaagagcagcgaggatgctctccctcggatggatcggcactggaatggtgggtgaagagtggcgacgcgtctgggagaggcagaaatggagctcgtcgtttttagggtgtcgacacgtcgtggccacgcgtcgcgcggcgtctagagccggtcggcgctcgatctctccctctcagtgtttctcggtcagctagggaagttgcacagaggaagggcaagccagagggactgacaagggggcccaggtcgaagtaaactaggtggaagagagatgtgtaggcagaaacatgggtgagcttggtttttggacgaatttccggaattattttctcctctaattttgtagcttcaatacttaatgtgttgatcagattagctagtattgattttactggaggtaggtgtatgtacctagtttccattttctttggttgcactcaaaaattatggatagattactcacagaaattagaggaatatgggttctttggaaactagttcgaatttttaggagacctaaacagagaagataaattctgaaaaaattatttttattcatgataaatgacctagtatttgaataaattattttacttatacacttttatgcagttaaatgcacttttagacaaagtatggttttagccgattaagaactacagttaatctagtttttattagtttgactgatttatttgaggtaccaaatttagttattaaattataccaaaattacagtgagttgtatgtgttgagtagagcctacatgaattttcccatgattttatcttgcatgaattattttagataattcgcaggacttatgtcttatatgtgtttctctttcctaaatgcatgtaaatgtttataaaagttatatttggactctcattaacctgaggtgatgttgatatgttagaatcacagtttaccttacacatgtcataagctccttccctatttatgcataagtttactttagtattaaattaagagaatgcttatagagatgattaagatagaatataccctatatgatataatttatttgttcactttcatgttcatgacatgtcttcagatggatgtccaaattagttttgtgaggcttgacattagccatgttgatattttttttaaggtgtatggtttttatgtattattttccattagttaacactaggccctaatggtttagttgtttatctagatcttagttaatattcatgagacctattatgaaatgcaaatcgaaaatccaaatgcataagaaggactcaagtcaaaatatgatttatgcacgtatgcatgctttcacttgggttgcatccaagtcctaggttaaagatgaaaaagtttttaatttgttctcaaattttattcatgcaagagttgaatcaactccacctaggtttaaaatggaaatttttggtttacaaaattgaagaacttccctttcaactagttttgatggaaattccttaatcctaaaattcaggtatgttacacgccgccacagcgcaacgcgtccgccgtgccgcgcgattcgccgcagccgcgaaacgacgcagccgtgccgcgcgtgtcgccacctctgtgcaacgccgccaacgggccgcgagccacgcctccaccgcgccgcgcgccgcacgccaatggcgcaccgccccgcccctgatccgctgccgccacaccgacggtttcgctgccgccacggcatcaaacgaattaacgtgaacgtgcacgaacgtgaacgaacgtgaactaacgaacgtaaacgtgaaatgcaatataggcaagtgaataaacgtgaacgaacgaacgtaggtgaatgaaacgtggccttaacgagaacgcgaacgtgaacgatcgtgaacgaaacgtgaacgtcaaatgcaatatatgttactttgcgtttatcctaatacatctttttgtatgttgcggaaaagacgttgtcggagtcgtccctcaagccggagtggtagctagccctcgaaggaattcacgcaggcaagtgacgatattatatcgcagaaggttatatttgtaatgcaattaagactattagatttaatatacgacacttagacttagttttaatataagattattatagttttaatacaagattattagatttgtaactagacttagcatataagattgtttagggttctaatatacgacagttagactacgcatatatcactatttgagttttagtataagattattagatttgtaattagacttagcatataagattgtgtagggttctaatttacgacatttacacttagcatatatgactatttgagttttagtataagattatttgagttttaatataagattattagatttgtaattagacttagtatataatttattgactagctagggtcctataatatacgtcacctagacttagcatttatcactatttaagttttagtataagattattagatttgtaattagacttagcatataagattgtgtagggttctaatatacgacagttacacttagcatacatgactatttgagttttagtataagattatttgagttttaatataagattattatatttgtaattagacttagtatataattattgactagctagggtcctataatatacgtcacctagacttagcatatatcactatttgagttttagtataagattatcacttagcatatacgtcacctagacttagcatatgattgttagcatataagattgttaaaacataaatgtctcatgacttagcatctgtttcctgtatgaacagatggctgatcgcgatgatgaacagatattgtacgatacaatcgcggagggaagcagccagtactggaacgaagaaaaggggaacaaggatccaaaccagtatttgaatgaggaagggaacgtggagagggatgcggaggggaaccaggaggggcacgtggaaagggatgtggaggggaaccaggaggaggaggctagtggaagtcaaccctccgctggacagaagagggcacgcgggcaacgaggtgccgcgaagaagcttgagggtcagcacatcataacggaagtggacgaagacggccgacctagtgccccggcagaagccgccaagaactatgtacgtcatagcggttgggttgtgcaggataacgtgcctgtcagtacggtgtactggcgcagaacaagggcatgcggagatcatgagagctttgtcccagattcggagaaagagatgctgtggaccacaatgctcgagacattcacccttcccgcgggtacagaggacaaagtgaaaaggtggactctgaagaaaatggcagaacagtttcagagcttcaagggagatctataccagaaatatatcctgaaggggaagacaccgaacttcgacacattcccaaagctaagggatcactgggacgagttcgttgcatataagacaggtgaacaagggcaggcgatgatggaaagaaacaaagaaaatgccgccaagaagaagtaccatcaccacttggggtcaggcggctatagcgtcgcgatgccgaagtgggaggagatggaggctagcttgcttgagtggggtatcgaaccggccaccgctaattggccggaacgatcgaagttctggtactatgctcacggtggaacgctcaacccagcagatggctccctggtcttcggcgatcagatacgcgaggctgcgcgttgattaacagacgcagtggaaggctcttctcagggcacgttccgaccggacagagagaaggacgagctgtcactcgccctgcagactccagagcatccaggacgaacatgagggaaatgggtgattccttggaatattgggttcaaggaggacatccacacatacaggagtcggatgaggagcaagagagataccgaggcgaagattgcagatcttgagttcagggtatcgagctacgagctcagcatgcaagaggaggtggcaaggaaggttgatgaacgcatggccgcacatcggtccaatgatccccagccgaccattcctcctgcaatggtgagcccgtcaggaaatcgtagcagttgcgcctcaacagggcaggtaggatcacagagcatggacgccatgcaaacccaggacaaaaccacctgccccgttgatgacatcactcagcggacaccatgtgagctgcatatccccttcaagaacttatcaataaaggtaagctcgtagtttatagatgttagatttggccattccgctagttgctgcttatatatgttgattactaataaataacctctcaccacatgaaggtggcgtcgggcatggccatcccaacggacccttcaggtacttaccactgcaggccgattccagcaggatactccaaggtcgaagttgagttggtcgaaggcgcgtactaggacttcgagctagattaccctggaggagacggtgaggcgcatctacgagacacaagccacgccattattctatggcgcaagcggtacatcatcctccctgggcgacaagcggcgtctcgtgcaccatctcctccggctcctgcaccgtctcctcctcatgctccagcaccgtctccacctcaggctcctgcaccgactcctcctcaggctcctgcaccaactcctcctcaggctcctacaccgactcctccgcaagctcctcttacggcaccttccaagtcaagggccccccaagctccaccgcctgcccccacaaaggcaacgaagaaggcgaaagttgacgccgccaagaacaaggacccggggtacgattgcacgcaagaggagcttgacgcttacgtggcatcagaagtcaggagacaattcaagcctcgaagtccagaaaagaagattcctatagacccgagtgtcaggaacttcttcaggggtatgtctgcacctgccaaggaggccataaagctatcggactatgagtgaacactcaagaaagcatgttctagaaagtccaaaccagtccctcagcttggagagcaaccaaaccaggagatcgagccgttagtgaccggtcaagattttggaatacaagactttattaatgacaccgggctaactacagatcaattgctaggagacgcaccaatcgaaaaggcggaagtgaaatacatgtacgaacttggtaaaccgcttgtcaagcctgagctgctgcagtccctacccacacaaatgtacaagttccatcaggtgtacatggagatgagcgccaccgatagagagatgatcggagcgaggattagggacacggacttcttgcaaggagatgacattctctggatcaatttcaaggcaatctacgaactataccagctggacgccctcggcgtctctattatgagttgctggattttgtaagtatatcgttcagttagatttcttactacgtctcctttaattaattaggtccttgtatataagtagactatatataatatatactcccttttatcgttgtagaatggagattcaaagagcccgacggcggggggttttcgatactggattcatcgaccctcgaaaagtaaacgtcgcaatgctcgaccaatatccgcaagccacagaggacaatctcgtccatctcctgaaggcgcagctttacaagacgttcatactgttgccgtacaacacagagttagtttaattttaactgtcttcctataccaaatttcattcccgtacgaacatgctaagtgtttcatatgtaatgcatcccacgcacattgcagattccactgggtgcttttactcttcgacctagaggcctgcaccgtcaacgtatatgactcaatggataaaaaagagtctacgtttgacaaggttttcgaacttatagacaggtactgtcataagttcctatgttaattaggaatcttgtaatagttaattgctactgcgaatcatagctttaaactccatgtagggattggtatcggttccgtcatttggtccgcggcaaatggagagaaacacttaggcggaagttcaaatctcctgtgagtacacatgctctacatttatatttctccgattcaaatacataaaagtgttatattaattagatctctcgtcgttcgtcatttatttatagtgcggaaagcaaaagcagggaactaacttgtgcggctactacgtgtgcgagtattgccactgccttgcagaccaaatcatcaccacaagagagctcgatgtacgtacaaataaattcaaaatttcattatgtatcgatttgttgtttaattactaatcaatttcatacattcatatagtttattcgcatgagggataacctgatcacacacaaggaatttatcgcggcggttcaagaacaactcatgggattcatcaacgaacaaatccttgatcccaagggtgaattctactacgacggaaaaacaattcataggtccttagcttctgagatagcgactactactacgtcgaaatcgtagctagctaggacatataaaggattgtaattaatacatgactatgtttctatatgcatgtgtagacattttctataatgtaaatatatattttggtcaaatatatatatatatatatatatatatatatatatatatatatatatatatatatatatatatatatataaaccatgcagcaaatgggccatgcaaaaaaaaaggtcagctcgatctttagtcccggttatttcacccgggactaaagatagcgatctttagtcccagattggtagtcccggtttggaaaccgggactaaagggggttacaaaccgggactacaaacgctttctccaccagtgattgttccttgaaatagataactccttattggttaatgaatatgtgattctttcatgagacctttatgttgtttgttactatttctaaaggatccctgatcaaatatcatatgtggaacaaatatgtttatatgatcagcacatgtattaattgatgatcatgtctcatggatcatggtatagagataccaaattaataatgcggacacatgttggtgatggcgtgtggataccggtagaggcccgtggtttgaggtgctgatcggcgtgggagtacggcgaggagaacgcacgaggaggagaaggtcgagccagtgcgatttactacttcctctacatcaacgtgcgctacttcgtgagagttccttcgacttctcagtgtcttcttccgctgcacagcgtatcgagtggtaacgatctatgatctaatacttgcatggttcctggtttacgcgatagaaaattttgatttatgctatcgtagcctacgcgtatcccaatagtggtatcaaagccgccatgtatagtttatgatctagatcaatgcatattgttgatgtgcgggtgtagtagatgagatctattatgttgtatatgagttcttaggtgatcggaacatgagatgaaccgatagccgatgggttgatgagatcaatcggtatgtgtgttggtgacttcactggaatgtctagtactcaccaaggccgagcgcgatagtccgatgtccactggaaccgcacgccaatgagaaaaacgagccaatgagattgactcggtttcggcataatttgattacaccgttaaggttttcacatggcgaatcgtagatgagatctatgtaccccgtgaccttttcagggagctgccctgaaacccgcggggggtggctcccccctcgaccccccgcccgctaaccggcgtgtgcgttgccccttagatttcgcttggggtttttatatctatcttactttattgctgttatatatttgatatgacatggtaggatagattacctcagaaaaattaagtgtaatttatgctcttccaataattgcacctattatggttgtgatcatatgtgatgggtttgccatagcaaagtgtcactttttatcatgataaaataggatagatgtcgaacatctatatgcggaaattattggtttacttgacaaggttatcaaaacagttttggaccttggggcataggttgggttggacatggagatgtcaccccaacagcacaagagtcacatatgatgtgattagctaggtgttgcttacctattttgatagttgtctagctgtgatgccaaagctcactagacactaataaaatgaggatcttgactcactatgttagtagagggaattttgtttcacaatacatagtgggagtatcttttgttaaattgtttaattaaaggttaaatgtaaacatggtgctgattttgcatacatatatttctattgtagatcatggcagctcctgcaccatccagttttaacttgcggtctattcttgagatagagaagttgactggaacaaacttcatggactggtatcgcaacctgagaatttttctcaggcaagagcacaaagagtttgtgcttatagagccttttccagctaacttgcccaacaatgctcctgctgctcaacgtagggagcatgaaaagcgatgcaatgattatcttgatataagctgtctcatgcttgctactatgtcccctgagcttcaaaggcaatatgaggcattggatgctcatacgataatcacgggactacgtaacatgtttgaggaccaagcaagagctgagaggtttaatacctcaaagtccttgtttgcgtgcaggcttgcagaaggtaatccagtgagcccacatgtgatcaaaatgattggttacaccgagagtctggataagcttggctttcctcttagccgagagttggctactgatttgattctccagtcgctctctcctagctttgagccgttcataatgaatttcaacatgaacaacctgaacaggaccttggcagaattgcatggga

SEQ ID NO: 59682 - DNA, 1703 bp, Oryza sativa
gccatgaaatccgaaatataatctatgcatgtcaatcaagtttggaacttggttgatccacctgatggtgtaaaagccattgagtgcaaatggatctttaagaaaaagacagatgtagatggaaatgttcacatctacaaggcacgattggtggtgaaaggtttcagacaaattcaaggtgttgattatgatgaaactttctcaccagttgccatgctaaaatctattcggattgtttaacgattgctgcctatttcaattatgagatatggcaaatggatgtcaaaacagctatcctcaatggaaatctcgatgaggatgtgtacatgacagaacccaagggatttgttgatccacaattagctaaaaagatatgcaaattgcagaaatccatttatgggttgaagcaagcatctcggagttggaatattcgttttgacgaagtagtcaaggcgttgggctttgtcaaaaacgaagaggagccttgtgtatacaagaagattagtgggagcgcactggtgtttctaatcctatatgtagatgacatattattgattgggaacgatattcctatgcttgaatccgttaagacatcgttgaaaaatagtttttcaatgaaggacttaggggaagcagcatatattctgggcataaggatctatagagatagatcaaagaggctaattggattaagccagagtacatacattgacaaggtgttgaagaggttcaatatgcaagattccaagaaaggtttcttaccgatgtcacatggcattaatcttggcaagaaccacgatgtcacatggcattaatcttggcaagaaccagtgtcctcaaacgattgatgagcgaaacaagatgagtgtgattccatatgcctcggcaatcggatccatcatgtatgctatgctatgtacacgtccagatgtttcatatgcacttagtgcaacaagccgataccaatcagatccaggtgagagtcactggatagctgtaaagaatatcctgaagtacttgagaagaactaaggatatgttcctagtctatggaggacaggaagagctcgttgtaaatggttacattgaagcaagcttccaaactgacaaagatgattttagatcgcaatctggatttctgttctgcctgaatggaggcgctgtgagttggaagagttccaagcaagatacagtggctgattctacaacagaagccgaatatattgccgcttttaaagcagcaaaggaggctgtttggataaaaaaattcgtttctcaactaggtgtgatgactagtgcttctagccctatggacctctattgcgataatagtggtgccattgcacaagcccaggagcctagatcgcatcaaaagtccaaacacattttacggcggtatcaccacattcgcgagatagtgggtagaggagatgtgaagatatgcaaaatacatatggatttgaatgttgcagatccgttgacaaagccactccctcagcctaagcatgaggcacacactagggcaatgggtataagatacatttatgattaactctagtgcaattggtagactgttagtgatatgcccaagaggcaatcatagagatgattgtatcacatactatgtttacatatttatccgacattgttccttgaaatagataactccttataggttaatgaatatgtgattctttcatgaga

SEQ ID NO: 59683 - DNA, 9553 bp, Oryza sativa
  unsure (1)..(9553): unsure at all n locations
ctattagaggatggcacatatctagccttgagcttaatcgatattgtgaggcaatttggttcatacaagtatacactagacgttcagccgatatgatctttatgtatgcccggtgggtcaatacgttctgctaggggccgctgttgacgcgtggaccgaaaaggagttttcgggttacagccaagtatatatgaacctacagggtcgcacgcttaatgggccggaataaggggattggatggagatccaatatgagcttacttcggataagggatccgaataggaatcctacaggccttggaggcccgagtgatggatcctatatattcgtgaggggtgtgaccggcggaggcattgcatcatgtgagaaaccctagccgtcacttccctccccgagcaaaaccctagccgcgcgcgggtgctagcacatctacgtgtggcgtttcgtccctgtacgtgttgataccggtagaggcgccgctggtttgcagtgctgatcggcgtgggagtacggcgaggagaacgcatgaggaggagaaggtcgagccggtgcgatcgactacttcctctacatcgacgcgcgctacttcgcgagagttccttcgacttctcagcgccttcttccgctgcacagcgcatcgagtggtaacgatcaatgatctaatacttgcatggttcctgatttacgcgatagaaaattttgatttatgctatcatagcctacgcgtatcccaacatatatatccccttattcatgaatttcccttccactatgaagtattttgtgtagcgtagtatatgctttagaatgttagttggactgctcttatttttatttatctctgtgttagaatgatgggccggtctcagttatcttaatatttatcaataaattggataggccaaagagcttgttgtaaaattgatctctaaaatttaaaaccttgtaaacgatacacatggttgaatgtactatttggcactttggaatttaaatttctactcttgcattcaaaacaatatccttatcagaattttcatggaaatcctagagctgataaattcttagatatatggtaaattttcaagcaaaccatagtactccacacattgataataacaacgtaggcaaattttactacagtagaccatcatttcatggttttagctcctggatatggtagaagtcaatctttaagagaaaaaaaacttttgaaatatggttatttgctgctggacaacatgctcattacaatatttattttcagtttaatagaaaagagaaacagtatgcaaacacaacattcccttggccccaattgtcatattctccgattggtatcgacggaagcaaatctacgcgtggatacatcggagttggcgatggagtcggtgaccagctagacagacaggaacaacttcaatcggtgtagcgccttccaccatgtgctcgctaaccatcttctccctctcgatcaccataatggctttggcctcacccacgcacgccgaccatggacaacctcgcctcatgcatgatgacgctttgttgtccctctgttccttccactgtggtctcccagggcaggagtattgagtaggcaggaagataaacggtatgacaagtagggtcaagactatttttttgactttttatactatttatctcttctatttagccagaaataaaaagttttatttatacagtgtacaacagtaaacaaccatattttttaagttttttcttcttaaaatttaactatagatatattcacaaactaaaaccgcgaggtaacaatgtccttgggcaaaattttccaaccatccctgttaaatttcttagtacggtatagcgaagcctgatgctgattgtaaatcaatcctttctcaaatctcaagccggcaggtttgccaattgatgattggtccacgtgtcattattcacttggcagataaatcagcatctaagagtaaaaaaaaatactgagacgagcagctggcgtactgtaaggaaatgaaaaataacagggttaccgcatgcagtgttctgctgctgtgttgcagctccgcatgcagacaacagaaaaatcaggatcaatcgagcggaaggagcccacatggctcacccttacattggttaaattactcatcatatagagagcgcgccattttcaaccttaccaaattttgataaggttgctaaaaaaagtaactacatttagtttgctgtcaaattttagtaactatataagaaatcctgccaaaattttggcaagtggcatagttggtaagctttttttttgcaacaaaggacttgttcactttgatgccatttttaaccttaccaaattttgttaagttgctaaaagtggctatatttagtttgctaccaaattttggtaactatataagaaatcctgctaaaattttggcaagttactaaaattttggcaactataccaaaatggtaaggttttttttggcatcaaagtaaacggtccagagttttggtttcaatgagcgtaataattgtaccctgcatttgcaataaaattgttgaaacaataatgcatctcatatatatttacacacttatctatactaatataaaaaacactagttcatcaaacacctctctttctaccgttagatctatttatccaaaggcttatatggaaagttaaatcaacctttaattagcgatcccacgtcgtgataagcagcagttgtagcgatcggtcaaaacgaaaaaataatttgtgttgccggccctagcccgtcggcgccgacgcctcctcctcgacgtcccctccattgctggcggcggagatgcagaaggtggtgagcctgacgagagggggagggggggagtgtcgtcgtcgcgggcggcgtcgatgtggtggagcacggacaacggggtgctcttgcggtcgagggcgtcgtcgaggggggaggaggacgacgacgacgaggaggcgctgcggtggacggcgctcgagaagttgcccacgtacgaccgggtgcgccgcgccgtcctgccggtggtggacgagggcggcggcggcggagggggatgggaggcggggaagaaggtggtggacgtgctcagcctcgacccgtaggagcggcgggcgctgctcgagcggctcgtgcgcgtcgccgaggacgacaacgagcgcttccttctcaagctcaaggagcgcatcgaccggtgcgtacagtacttgcacatttcgtcacgatgtcgccgtggcggtggtcgaggttgcgggttgcctgcagggtgtttgatgaattgcgcgtggtaatttgatgtgcagggtggggattgatattccgacgatcgaggtgcggttcgagcacctggaggcggaggtcgcgtcggcaacagcggcctccccaccgtcctcaactccataaccaacaacctcgaggagccgagaatgcgctggggattctacccaacaagaagcagaccatgcccatcctccacgtcgtcagtggcagcgtcaagcaccgcaggtgaaagaaagaaacataagcatcacattttcataatcgcttctgctttacataacgttacgtttgtgctgctctcatggtttatttgggaaattttgaaagattgtaaggtatttgcttgaacatatttttgtatgggatgccggttccaccggaaacgaaatgctttttccattagacatgtccctgcaaactgtaaagtttatttgtcttttgttggagcctagattaaccaagaacatttggaattcaatttctatgcttctcctataaaacacgcacctttgattatgcaggatgactctactgttaggaccgcccaggtctggcaagaccaccttgctacttgctttggctggaaggctcggcaaagacatcaaggtttcaaacaaattttctttacatattttgcaataactgcgatataacgatgcgtttgggcgtttggcaaaccagtccgtattcccacagatgtgtgcacttcatcttgaatatagtatatggttagccaaaatacagagaacatacttttgtatgtatatttgtgtattgcttgaaaatattcctaggagcaatagcgattgttgcgtgctttgccaatcagttaggtacatggacctatgttgaatgggagacgtagataatcttggcatcaaaacataatcttgaacttaccttttcagttacccattatagaatattaaaattgctaatatatactgttaataagtgaacatcaaatattccaatatattactattaaatcattcgggagcacagtgcttaggttgcttccgaattttctatattagtacacaggtcctcattctgaagcatttttcaggcaaaaaccaactgtacaggtttcacaattgaagagagaatctcatttgaaacaaaccttttttgtcaaaggctttgtggatacttgcataaaacagcacccaaatgatgctgcttttcttgaagaaacaacaattgttgagcattatgtgagattgttttgttctgttctgaactgtaaaccgcatctaattgtgtgtccctggcgcacttttgttttgttcatgtatgtatttgtatgtggtgtggatgcctatgcgctgaataggatcccccgtgttggtgcagatgtttgaactttgtggtggttcttacagacctgagtagcttggatccacttgtgatgtagtctatggcttttcataacattgtttgcactgacactatgacactatgcaactacttactgcagttgctttgtatatatatctcgacgaagtatgaaacgcaatatataccgacatggatgtatatcatattaacatttacattgttaaggttttttaccacggaaatacattcattgattatttaacatgatttcatcctatgtgattttttctcgttgcaacgcatgggcacctaactagttcctgtaaaaatacatgagcatctccaagaactgaacaatatattttaaaattgattaaataatcacactcaccagcaacacatatttcacctaccactagaaaaaaaataaataaatcgcaaatacaagcacacgtaccaaatttatgatttaaatctaggtggttaagttttaccacaagaaacaccatctaacacatatgtagcctatcgctggaaaatactaaactataaatacaaacgcactaaataagtcttgacttaaaactggttgcttgggttccacaacgaggaacataaacaactaagtattgttatgaatgatgaacattggaactcctcacaaaacaaaaatgtgaacactttattttttctaaaaaaaatatcaagacctaattttcattagtagataatttaattataattttagacaaatcaaggaaccatggaatagcatgggcgaaaaaatagataatttaagaattttctgaacaataagctctagtatattaaatagtaactcgaaatctcattcaacaatttatttcaatgtatgttttttcataagtttccagaaaatgaaattgattcctatggatttttgtgattgcactactcaataataggtacgggccataaagcgagcgcgccaattgacccgctgaatttctagtatttcctaagcctatcagcaggctatcagcctgcaaataacttttgcatcctgacggaggccgctatctcttgcacacaaagatgccaagtcatgtaatgtaccacgtagcgcttagcattttttaaaaaggaaaacaaaaggtagcctaagcctaatgcttaagtgtgctcagtagacgtaacccttttatgataaaataaaaaaataaataacagacttaaaagttttgcattttgatttgaattttttaatttaagttgaaagttttgagttttgagatgaacgttttgaaactttcaactcaattttgacaacttttaacataaacttcaaaactttcaacacaattagaatcttttaattcacttttgagaattttcaactcaaatttcaaaacattcaagccaatttatgaatctttcaattcaattttgaaaactcaaatttccaaaacattcaaataaaattttaaaatttcagccctatttttgaagcttccagttcaattttgaaaactttctggttaaattttaaatttttaactcaactgtgaactttcaacttaattttcaaattttaagttgaaaatttaaaaaaattgaattgaaagttttaaatttggagttgaaagttctaaaatttgggttgaaaatttaaaattttggatgatttttttttaattttgagttgggaagttttaaatttttttacgatggtgaaggcgtacaacgcgtcatacgcgtgccacgattgtatgtgtgatatggtgatgctcacgtctgctcccatgtgggccgacagtgtgccccttacgtggcaatgggtcggcgtgggactacgtatcggcgtatccatgtggcaaggaattctggagcctagcactgtttggtccatcacccacctaaagtgacatagcctacctccaagcacagtgcaataacaatacctaagactagagataggcccacattgcttgtctttttacaattccctccatcctagaaagcatgcactttcattgttcaaaatatatcccacaaaagttatcattttaaatcttgttaacaacccttcgctcctattcaaacaacaaccatatatgtttcaacactccagtattttggtggaacaaagaaggaaaaggggatacaagttgctagcaaacaggtgggacgagaaggaggaagagaaggagaatgagaagggttgccaccggcatccaagtcatcgccgccaccgccgcgagcctcagctcgccaattgatcaaacctccctttttcgatgctactcctgctgcttatatagtgctctccctttgcttgcttgggcatggctttgagagtggtgacagcccattggcagcacaattgggttcctaacaatctcctcttcttaaaattcgacttgtttgcaagacgatggcaagtaaaattctgaaagtgccaaccgcctaggtcccatggcacttgtagctcttggcagatcaaaatgctcaagtcatccttatcattattgctcttccttataaagaaaattttcctctgcaacttagtatctttgcttcctccatagtgctcatatttccaccagcttaactaatttgcctctaactttcagctttccagacataattgcctaattggtgtagcaacaggacatagcaaacnattggtaacatttgatttgtaattttgtagaattgcttgtcaatttccaagaatgatttgatggttggaatgaaaacattcttccatgctgaaattatattcttgattgcacttggcttgatcccttgcattctccacttcttttagtataatttgaattccatccttgcagccccaagtatcttgaaaaatgttgatatccaagctgttcccaacactaacaggcctttgctcaatagtctcaaagtattgtgcctcatataggagatgaatggatgtttagctgactgcaacaagtcatttttcttatcatcacttggatcttgagttattaacaccaacaagacaatctctaattcatgcatcaccacatatgatttgcttgcccgccttcagctcaaacaatttaaattgaaacagagagcgataacaatgaccaagctccatgcaggttctttatggttggcatcataatccattcactaatgtactgcatatgaccccaacaaattaacatcttcatctttgtctcagtggaacacaccctccctaatcgaagttgttgccttatcttgtaaattgagaaccccagcagtacataaaatccaaagtgcctaatagggggaaacgtgcactacaagtacctcattgatgtgtgtgagggtgtcccgatctttcaatgagagggataagtcaattgggggagcgacgttggcgatccgactacaactatccagggatgttgcgccttagcaatcgttacaccaactccagaggcggtcgtgaatctcgacagatgcacgatcagcccaaccacgagggtatttgttcctgcaagcaatcgagaaccagcaagaacaagatgaacaagcaactcaatttgcgaatcaaagatattagattgaatcaacagaagtaacaagtagggttcagtaacaagcaatccggcgaagtagcgatgttatactttgatctaaacaaaacccgagtgttcttggcggcggccataggtataagaagaggggacgaacgaccacagggtcgtgctccaaccctaggacgtgcccctaataggcccaacttgatacacagcccattgggctaaaagaggtgacgcagcaccacggacagaaaacaatcgggagtaaaatacaattgcggccgctccagaatagatatggacatgtggttggatccatttgaaagtagatttgataagctttccataaagtacttgcatgcccaaatcgaagttcgcatgaagtcgtggcggccgtcagaagttggcgttgtcctacagtccgaatccaccccgcgcgaatcctctccccttcggatcctctccatcgttcctgagtaaaataagagtgcacgcatctccggggtataaagaagagaaacatgaactcaagaaagaactcacctaatagttgagttgacgtgcacgtgtgcggataataggaccatgaagttatacttgtggggtgtggatgtatcgatggtgttgatgtcctcatcactcatgggccaatatccaatattagcattttgcattcaacacaaagaatcttttcctggtagcaagctcatgcattctagaaattccaaagatggtgcaggtcacgtaactaaccaaatcctgttgttccttccaaacaaatagagtaatagccactctaatttcccaggacttgcattgctcaagtcgaatcggtggtggccatggtgacatcaaacctacacttgtccaaaaagaatcgagtacataccatggaatgtgccatacctcccctctctaaccacacaacctaaccagggaggtggccaagggtttctcttgggatgccccaccagcaacttgttgttacctttgaggcatttcatcaaacactcactgggcatcaacttgataaggtccatttcagcaatcaaccatagcgaggagacttcggatgatgcatcaggtactagaacacccttagaaacacccatcatggtctggcacgtaaccctggcgtggtctgcaccaccctttgacatcaaggccaaccgtcaaacagttggtgagcatcgccttggtactatcaaggatgttgatgttggtgccgccaatggtgccatcagtagataacaactccattgatgacacggtagaggtgacacaagtaaccacgatagccacagtgtgatcggacttggcatcgtagctggaacatatcatcgaagagttggtgggcgtgaccttggggaggt

SEQ ID NO: 59684 - DNA, 1353 bp, Oryza sativa
atgcactagattcacactttcatcctaagcatgaaaatacatagcaaaatacacttaagacggaaatgatctaaatcacaactacttcatagttacataggccgaccggccaaataaatataagagaacagcggaagcttgactatccaatcctcaagcacaccgactaggggtttaccccatcaagttcaagtcttggaagaagcagtcgattacccgcatcactcaaacactaaatctaaaacctgcaagcaaaaggttaattcaacagcaagagtcagtacattattagaaataatgtactgacaagcaccaagacaagcctaacaccctacttgcaaggcatataatcaagaaaggcataatatggttctttttagcataaagcaagttttatttgcataaaacacattcaaatcagatttgatttcaaataaatttcagcaagctagtacttagcatatgggcatcaaagtaggcatttatcatgtataattattcacctaattgccatccatggcagcaaggagatcattctcaaatctcaacataatttgaaggtaaattcagcatttagaagaataaacacaagtctatactcaacacatatccacatgccgatcataaacgcgagcacggctaatcgattagtttttagactctacagagtttgtacagctttacccacatgatgtgaatcgctctagttcgtccggtacccgtcagtaccaccatactctacacattgagtacggtctagaggtcacaatgaggcttttacattaagtattgtctaaccttgcatgagcacgatacgtgttcctccatcctagaccatacttgatatatgatctagaaccgttaagtggcgggcccatgccttaaacttaacgccgtggtgacggatacaacgggaacccaccacgtggcacaatatcgttgtattggatagacttagacgcccatgccgtgaggcggaacagtacactcgtcccctcacggaaatcacacatgtatggaatttatcatcctacgatcacacgcttaggaacagtacactcgtcctaagattcaacacacacatgggtagttcctttaggtagcccacagtacactgatggcctctacctatactagaacggcctcccgaacgcaaggtcagacaagtgcttaacttaataggccaaggttccccataaaaacacatgtggatgtacggtaaatataatgaacagacattgagtgaaatccttagatcggtttaggcacactctccccctatcggtacacaactaattaccatatgtgcaccacttgaggcccaaacctaaaatccatgttttccatcatttt

SEQ ID NO: 59685 - DNA, 32432 bp, Oryza sativa
gtgggacttgccttgcaactggaaaatgttagcacctaaatcacttcttcatcggttaagcaatcatctatacaaagtacacgttatgcaattaaatactgaaatatgcgaaaaatccaaaatgctctaaaatgcatgatttgtgaacagtggactggtattggtctaaaaagaatttaggtgaaataatttttattttatcactttttatttgggagttatgaattttagaagtttactcgatatagggtagtatttacctaggtagtgttataaaatatttttacaaagtgattcttattaactttgactccacagagatgtagggatgtgttttctaagactaacacatttggtttcacatttttttggagttacaatgattttcttatgaattttacaagttataacgtgttgtaggcatatagtgtcttgagagttttatgtccttgattgagttgagtaaaaggaataatttggttaactaatccaatttttagttcataagcttatggtcttattatcatggttcatatttttatagactaggggagctctagtctatgctagcagtatattatattaacctagaaattactatatgagctatgttcttctaagttttggtggatggggatggaactatggctccactggtcctaataaattttatttggatttatttggagcatatgtattgtataaccactattatgtgtttagtacctatactaccaaattaaggtttagagctatgatctgaacagagggtgccatatttcactctaataggttgaagtatattactttctagttttatagaatcttggttcactccatttggactaaatatgaattttctacaaattttacaaattgaaggctgcttaatgttggttattccttacttaaatatttagaggcttttattatacgataagtataaaattttattttataacttggaagtatatgttttggtgattctacagaatttgggtttactcaaaaaggatctaagatgaattttatacaaacctctaaagttcagcttatctaaaactagtaattttaaaggtaatagttttagaggcatttgatgtaaagtgtgtatatgttttatttcactttgtttttagagaacatgttggtggatctgtagaaactaagtttgctctaaaatgagttgaaatgaattctgtatgcattttatgagtttgtataaagcatgatttatcttagatgaattatagaggctaaatttgtactgtgagtgcaagtttttatttcataactttaaattttataatttggtgatcacagaaatttgaatcatctcaaaataagctatatttgattttatatggattttacaagttctaggtatctctcttgtatattctcagattttatctccagggggtccactgtcagtctcttaccgtcttgcaaagaagtccctatactttatgtgaacttcacttaggtccatgggtctacatgtcattggtttgtatgttttcatatttaaccctatgattgttcaaattttcaaaaaagtccctgccttcctctccagtcgggcagagacagggcaggccatggccgagctcgatctcaagcttgccagcggcaaacggtggctcgtttgtgggtgcgacctaaagacaaaatgaaggtcatgttattgcgattctattcctctactttcctcggttagtggacatcggagtaacgccggcggcgagtccgagcggaaaacgttttcgggtggtggtgcatgtcgtgctatagacttgatctacccaaagagatgcatgcatgtatgttttataggctgcaggattctcaccgagatgctagacaaggttggcgaagcttggtcgtccgtaatagctcgcgaacaggtccggcggcggcaaactccttcgggttgacggcgacagctcaaactactccaagatctagcgtgcatgtgtgtccatgaggttattgaggtcccagggatagtgtatacgcgaataatcggacaatggctcaccggagaagatggattcggcaaatggcgacggtgaccggtgttgaggaggacgacggccgatctccttcctcgatgcgccattcttcaggatttttgaggggaaatggagaggacgacgacgcgaagctggtggcgtggtggctcgctccggcttggtctaaatcgacggcaacggcgacgatgtcgctgcggcggcgcccggtgcacgcactggaacacccgtgggcacggcgacgtttccgtcaaagggtaaagtggtaggcatgaagtgaggaatacggaacgagaaagagttggtgatgacaatgtctcgacgacgggttgcggcgtccttcttcttggcggccggcaacgaagagatggaagaggagagctggagctctccctctcggtttcttcggcttagaggtggaaaatgatgtgtggaaatgcagctgggaggaggtgaagcctcggctcggtgctgccacgtcgacgccgtccagagtgcgctcggcttcggcttctctttctccctctcgttctctctggtcggttgggggtgttgcatagggttggagctagtcaagacactgtcaactgggcccagaacgaagtacactaggctggagtgtgggggatgggtagaaaactgtgtgaaagagatttttggacgaattttcagattattttctcttccctaacttgttaattcatagattaatttgtgttgcatatgagttcatgtggattttattggaggtagatgaatgtacctagtttccattttctttgattgtactcatagtttagattactcacaaaaattaggagaagatgggctctttagaaactagtttgaatttctagaagacctaaacagtgaggataaatcctggaaaaattatatttattcatgataaattacctagtatttgaataaattatttcactcatacacttttatacagtctaatgcatattttggtgagggtaggttttagccgattagaaattataattagtgtactatttgactggtttgactgatttattcgaggtatcaaaatttagttattaaattgcaccaaaaatatagtgagttgtatgtgttgagtagagcctacttgaatttttcccatgattttatcttgcacaagttattttagataattagcaagactaatctcttaaatgtgtttccctttcctaaatgcatgtaaatgtttataaaagttatattcggactcttcttaacctgaggtgatgttgatatgttagaattacagtttaccttacacatgtcataagcttcttatctatttatgtataagtttactttagtattaaattaagagaatgcttatagagacgattaagatagaatttaccctatatgagttaatttatttgttcactttcatgttcatgacttgtcttcagatgagtggaaaaattagttttgtgaggcttgacattggccttgttgatatattttaaggtgtattatggttcctatgtattttttttccattagttagcactaggttctaatggtttagttgtttgtctagattttagttattattcatgagacctattatgaaatgcaaatcgaaaatccaaatgcacatgaaggactcaagtcaaaacacgtcatatgcaagtatacatgcttacacttgtgtttgcatttttttcctaggttataaataaaaaagttttaatttgccctcaaattttatttagttgcatgagttagatcaacttcccctaggtttaaaatggaaatttttggttcacaaaattgaagaactttcctttcaactagttttgattgaaattccttaatcctagaattcgggtatgttacaattccgtcaaacacttgggggacactggaggagacgaggtcgggggtgttgaaaatgatgcagaattgaagtcagcggtggtcgccttgatggaggcactcatctccttgaagaacttgttcctattagcttatatctcgtccaacttctccaaaattcaatcaatcttctcttcacacgtacgcttggcctccatttgttcaaacttcttcaatatcagatctagagctttgtctagctatttccctctttgttcatgatggaattgatggggacgagttcagatatcctctaatcttccttggacatgtcaggctgactaggcattccatcgaataggttgtgggcgtaagtgtcatgggcaccacccttgcccaaatccaacaaccacttgcatggggtgttgctgcaatactcccccatcgactccatgctagaaatcccacgaaccaacagctctgataccaaattgttaacaacccttcgctccgattcaaacagcaaccatatatgtttcaacactttagtagttttggtgaaacaaagaaggagaaggggatatagattgctaacaaacaggtgggacgaggaggaggaagagaagaagatcgacgagggttgccaccgaccacccaagtcatcgccgccgtcgtcatgagcctcagctcgccaattgatcaaacctcccttttctggtgttgctcctgctgtttatatagtgctctccctttgcttgcttgggcctggctttaagagtggctgacagcccataggcagcccaattgggttcctaacaaatcttcaccaagaaattggggaccttctaggagttttcagtaggacttgttctagcattcattaatcaattaaatgtaagaaattcactaattaattaatcacgatttttgtttacatcaacaattgcataactaacttaaatgaacattacatatccgaataagcaacttgtactatatataaaatatccacaattccacgccacgttgaccatctcaatcaggacagagtatatacgtcaattgtacaagtttacaagacaactaggagatgcaaagcacgcaagacaggaggcagcttctggaaaggaaaacatccacgtgggtcggatatcatattgttaataacccttcgcttcgattcaaacaacaaccatatatgtttcaacactccagtattttggtgaaacaaaaaggaaaaaggggagacaagtcactagcaaataggtgggacgagaataggggtggacaagaaagctcgaaactcgtggctcggatcggctcgtagcaagctcagctcggatccattcgaaatcgtagtcttaatgagtcgagtcgagctagccttttagctcgtgagcttaacgaggtagctcgcgagctgctcgtttagctcgttagtataaaatatcaccatatcttaatgaacttagtgtttctttactagtgcttagtcttttagttacatcaaatctattcatatttagtgagtattatattagttagtgtttattattacgttaatacataataaaatgttaaatttgaaattattaatatgatattaatgagatatagctcattaacaagcctaacgagcttacgagccagctcgtgaaccgagccgagctagccttttagctcgctaacattaacgagcccggctcgttaacacaactaactcaactgagccaagccttaacaaaccgagttggctcgttaacacaatgagctcaaatgagccaagccacccctagacgagaaggagaaagagaagaagatcgacaagggttgctaccggtcacctaggtcgccgccaccgcctccgtgagcctcagcacgccaattgatcaaacatcccttttctggtgctgctcctgctgcttaatagtgctctccctttgcttgcttgggcctggctttgagagtagctgacagcccacaggccgttcaattgggttcctaacaaatcttcactaggaaagtggggggcacctaggagtttacagtaggacatgttctagcaatcattaatcaattacatgtaataaatgggaccacatatacatttgttgataaattttctcctaaaaatttaacagatgtaattatagtacaattatagtgtaattacactgtaacttgcatgtaactacagtgtaacttgtatgtaagtttcacgtaattttgaatcgttaaatctattactccctctattttataatataagtcattttagcattttccacatttatatttatattaatgaatctagacagagtttatacgtcaattgtacaactttacaagacaactaggagatgcaaagcacgcaagacaggaggcagctgctggaaaggaaaacatccacgtgggtcggtcttattaagccacgtgtaccgggaaaccgatcccgtgccgcgtcgacgggaacgtcgcgaacagcatggttccgacgagccctccggcgagcggcacgtcggtgagcacctgcctcgtgtcgtaggacatcaccgggtagaagcaggcgccgacgttgtgatcgaacatggcgacggacaggaagacgatcagggacagcacggcgtggaagaagtcgatgaacctgaggcggtaggtcgcggccacgtccggcggcggcggcgcggtgccgtcgatgacccacaggccggcgcgcgtggccaccacgtaccgcaccgtccctttcccgtcgtggaagctgtccgtgaagcagaggaagaagcacgccgcggcgcagagccccaccagccacgccgtcatgacgcggttaacgtcctggcacttgccgccgttggtgaacaccggggacagcacctcgaagacgagcaccgcgcccgtgggcaggtgcttggcgagctccgccgtgctccggaacgcccgcgtgatggtccgctccagccgcgttgtctcgtcgtcagagccgccatcgccgtcgccgcccgccagcagcagcagaggctccgtctctggctgcacgttgtggcggttggttatgccaactgaaacgggtacagccgagctagaagctggcggcgcggtggcagctgctgccgatgaaacgctggccgccggagatgacgtcgccggcttctgggactcgagatcaatttgcttgtttgatgccatggcagatcaattcgatcttgattgatggaagaatatgtgcctaattaaatggtaagggtggatttatggaaggctcactttgtggagtgcacgtacgaattgtttaaagcacaagtaagatgaagccggcaagaaagcttaattgtttaagacttatcactggcacaagataggtcatcagtaagcctcatagcctcatctgtatcgggatagcgtaccggcacgaataccaaaagtcactgttacgaaaaatcatatgtatcgagtcccttgccatcacggatgacagtcacggatgatataccatgaagatcatcataggcttatcgtcagatagttgtttgtgacaggaagcgatcaaaagatttacagattatatatggagatgagattttgaatcttcttgatatgtgcttatatatattctaactgcaacgactgaaacttttgggtttgtttttgtgctaatagcgggaatggaacgttaattagatggccaaccgtagtttttataattcgaatggtttgatcgtgtccaaccttggttaagcatagtctatatagacttgtagcttgactttggcaaaataaaatatggcctcgtacacagtactttaattttatccgtataaaattaaatgtggaagtagcttgatgaggcacataataatgttttacgatgttggcaagctgcaactatatattctaggattatcggggtattcacttgttctcagcttatgtcacaaagattactttttgaatgtatcctgaatacaggtctgaattttggtgatctaccgaaataatcctgtgagcgaagttgcgtagtaaggaaaatctcacattttatatggtctgagttatagaaaaccacatgtgtaaagacatatagcacaaaaccacatgttttaaatttatggtctaaatgattcacaaaaccccacgtttattaaaatctagattaatttcagcatatgttaaacaatattttaaagtagtgaagatttaaattatcagtccaagtcaagaacttaataattacaaaattcgtataaactctacgaattagaattttaaataaattcgtgctcaaatgcataaggatggggttggtgaaactttagaaccataatgcacgggataaagtgtcgcacgtcttcaacttttacctaaaaacatggggtttttgaattttactaaaaaaaagtgttagaaacaaagattgttgcaatggatgatgagaaactagggtccagatcttctgttatgtggaagtaattctcgatgtggcgaaaacttgacacatacgatttgatttccgatcaacatggtttgaaccccgtaatggcggcaccacgtctcttcaggttattaaccgtgcaattcccggttaatctcatcgcgaaggttaatccctgcatatgaatcgaagaacactagcgggaataatgtaaattgcaactgaatatgtgaatgataaggatatcaaagttggggttttataaactgaactaactagtagtgaaactgcaatgatagaaataatctaagtaaaacctaactctaaactatgatggctactggatatgtatacatacatacatacatatatacatacatacagaagttaaattgcaccggttctaatggttgggggtcgagatatttggtattgtggttgaggaatacaaattagatttgacgactaattaagggagtcgaagtgaacttattatgtgttctccacaccggacgatcgtatagttaagcccacaaacaaaataaaaatgctggaagcacattagtggtactaacggccgaatacttggggcaagtctgttaaccagcccagcactatatcagcaaatcaagacatggattggcacaaaatgatatctcattcaaagcccataaaagtcacttcaccaagccgattaacggttgcaaaattttagccaaaaaagggaaaatcatccatggaaaaataatacttgatacctcctttgatcaagaaagcatctacacagccacgttttgcaagcatgattaattttcggcaaaatttgttacaagatatacaaaaatggtgtaattagccaggggacactgtaagaacacgtatttgccgtaagacattgcaaaaaatggtaattagctaatagacactcgcaccattattttattattttcggaagaataggttagagaaacaaccattaaggacaagtttgcacttggctcaaatgaatccaacgtgggccccacatttaagcccctctccctctctttccatatgggagggcggaccagcgagacaaggccccttcggccggctgaaggtaggcggtggtggtggcatagccgtcggtggtgaccacgacaaaactctcataggtgccggtttttaatttgtcggcacatattaggttttttatagtgtttattgatatgaaaaaaaacgaagaggaagaaaacacgaaatactattggtccaattattaacagtgagatgaaaaagatgtatttgtattaaagaggtctactcgacaaattcttttggataaaactacgtgtttagggacggcgggagtaccttttatgccatatatatactagcatcaaataaataatgtcgcttaattgttacattgtcaataattaagaagtgtgatcctcctgttggaagcttgggataaccggtcaaagtggtccaccgagagcggacactgatggcccggtcttcgaaccatgcgtgcatcagtacgctgttgcctatctcgtcgcgactagcgacgttcttcccgcagcacatacagcacatacagagatgcggaccaggactgtaaatatatacaatgcaaatatgcaatagttttctggctggtcccatctcttactcaaaaacatatattcatccaacgctgatgcaatgccaatccggaattgctatacatatgacgccatatttctttcccgtttacagtcaattttttcactgtgcaattagttcagagattcgtgcatgtcgagactctaatgccatcgtaactactactattgctgatactatctcaaatctctaatcattacggagtaaaaaacaagattccatgcacagatggcatgcaaaaggacaagaaaaggagaagcgaagatagggagctcaccgtcaatgtctgtttttaattacactgcagttacagatataattacagtataattgtactatagttacatgtgtaattcctatgtaactatagtagttacacctctcttatataccacttacatatgtaattagtatgtaattttgggatttacatatgtaattttagttcttacatatgtaattttggggcttacattgtaaatacactaaaattatatatgtaatttagggacttacaatgtaaatacatgccgactattttttgataaaaaatatgacgccataaatatagctactccctgccaatctggcacgcatgtcgcaagcagtctctgccatcattctaaacgaactactaccatcaactcggtatcagaatataaaattttacgagcttaactcggtttttgaaaatagatataattaaatgagaaaaatttgtgattggataaaaaagagttaggtagatggagtgggaagagaattggtggacaaattattatattttggcaaaattggttacaggacacttaaaaaaacgtgtaattagccgtgagacaccacaaaaacatgaatcggctgtagaacattgcaaaaagtggtaattagctattagacaccggacatattattttattatttttagtggaaacggagagagaaacaatcgaaaaaagccagattgccctatgtaggccaaggatgtcagcccctctaatttcttgtcctcttcgtcccgacgatcctttacaacgaccggcgcggcgcgtagagcagtgcgtctgggtcaagctcgctcgccgtgttgaacatggcggcacgcgcgtccttgccgagcttgtcttggtagaaggagccgtgcagcatctcgttgttgacatcgtagtgccggaacttgccttgtaccgggtgagcaggacgttgatgcggctgctcacggcggcgaagagctcgtcggcgggaagcgccttcacccactgctgcactgcgttgtccacctcacagaagatgcagtggccgcgcacgcagatgccgtgttcagagcagagcgggaagctgttcgacatcagccgcagccgcacctccacgcgtcggccgccttcaccttcaccaccacatcgcgcttgcgcacctggatgacgtacagcatcacgcgcgacgccggcttggactcgacgcggaacgacccgccgatctcgtaccaccgctcgtccagcgccaggacctgcccgccattgagccactggctgtcgacggcgacggcgacgttgatgttctgcggcttgcggtggcggtggacttgccggtgcttcccgatgacgcggaggagtgcgtcggcgtggcggagcgcgctctgctcgcggtgggtgcgtcgccgccgctgccgccaacgtcgcaggtgggagcgaacggtacgacggcagcatgcgacgtgccattctgctactgccaggtgaggctgaggcagccggcatgcgcggcgctggcggggagggcgatgaggaggctggagagggagtgctcgcggccaggggtatttcagtacttttaaaactctttctctttccgtttctactaaaaataataaaataatgtctcgagtgtcctatagctaattatcactcttttgcaatatcctacagctaattcacgtttttacagagtcccacagctaattacactttctttagtgtccggttgcaaattttgccttatattttagaacaaattaaaaaactaaaactattatattttgagaaggagaagtaattatattagccggctaaacaagcgccagctagtctagactggccttctcacacatcggtaagttttgctactggtctccactacgtcctataaaaaaataaatctagtattagatgtaacacattttaggactacggatctggactaagatatgtccagattcgttttactataatatgtaatatttagttatatatttgtttttttggcacggaagaagtattatggatgcagaacctcgtaagtactgttgatacagtagtgtctaacatgtgagtccgaacctacatatcaaacatctcctgctaactatcaggactgcagacatttactttaacctctgatcttttatatctttcatatttccatatctactactttcccatttaaaaatacaagcatttttattttttagcaaaatattagggttaatgaaaatattccatgtaagtcctatcggtgatcaaattttgaattttgaattgtttagattcctctttctagcacctgattaattggctaaagttgtatggactttcttgtattggattgggtgtcctagaaatgcttatattgttgaaacgaagatactacatattttaagtcctataaatgcttaattcctacaaatgttcatattttaaacgaaagatattttgtagtaaaatatttttctataaagtaaaatacctaagtcaactttcgtgatcatctttattaagtgattagcaatcattattttcttgcttgcatgtctgttcaaattttgtgagaagacatgagttatgtttactatagtaattatatcttgttactatgattcagtagtaatattatcgtagaagtgcagtagcacgatacattactgtgaaatttataggtgttactgcacgtttttagtaacatcatgattaaattaacatatggtagtaacgctactagtataatactactgcttgtgcatagctaaatttttaaatctaaatcttgtgcaaaatacagtgctaaaaagtgcatgtgcatgatcacaagttgacacaagtgctaaaaatacttctctttattcatataaagatacatactagcaagccaattacaagtgaacttttagaattctaatctttaaataacaatatctctcacacctaatcggatcaccaacatcgctgcatccaatcgacttatcctctcatcgaaggatcgggataccctcgctcatatcaagtggagattgggaaagacggtggtggcatggaggggaggctgatgatggcggcagcctagaaaggacacggaccagagccacggcggcgacacaagggtgaggtacgcaatgccgacgctggcacggaggtggaggatgggggcgggggcggcgtgaaggggaggccgaagagggtgagtggacagggcctcgattgaggtgtccaaaacataaggatgatacgatggcctagatcgaagctaatcggacggctacgaacagttgtgtcactgttttactgtagcaacgggaggaggccacgtagcaactggaaaaataataggttttatatgatatttttatccagatatcttccaagatagaaatgttttatctctttgcaatcataaattgcatccattttttgtgaagaacaaatcaaagttcaaaacattactatgaaattgtacacttaatcattattttactattgccactttgcttaaaacgttctaagctagacatcataaaaaaatatccatggttcaaacccttacaaaataaaatcaatttgcatgctttgacaaaatataaaaagtactttggactatccaaaacaacgtgttcatttctttacaaaagggaggagtgacaggagtcatccatcactaacatactttgatagtagaagtcatcaattcacattttgttgctgctaaagggtgaaagtgtatctaggcctccaacttattgtggtaattaataaatgctggttagagaggactaatctggtttgttgagtttgtattagataattagtcctcgttattgatgaaatgaatggttcccagtagatccaagaaaaccgtttcctttgctattgcttttgagtcatatgaaaatctctactataaggccttattcggttaatctccgtaagagagggattagagagaatttattccacatatattatggtgttaaattatttccccttaatcttcttcaaaccgaacaagggctaaagggatgccatttttgaaacttaaggttggaagttggtgctcaaaacttttgcaaagtattttttattctctgtgatttctgaaaaaaaaaactaattgggaatttggacggtcgcatcggaatatctgaccgatcagaaaatccgatttgagcaaacttctgatccttgatttggtttgagaaacttattggaaattctgatcatgtcaccggaaattccatttcgtcgggaaatcagaaattttgaaagttctgagtcacggtttgattttgaagaaaatattggatattccgatcgtcagacggaaattccagtagtactggaatatcccaaattctgtttttaactcagtctgtgcaggcaaaaactatctgaatatcctatacgacatcctatacaatttgagtttggagtaattaactcaggtgaatcaatctcaagatgctgtccaggactgcagggtctccactcaggacattcacagtgcgtcactcgcatatgaggaacctcgttgtaccacgtattctagaactacaagtccaaaatccaaattcttcaaagtacaagtagctctactagtaaccttaattttatattgcagcccctagtactttttctttcagttcacatattttcgttaatttgtgtggaggtccaaaatttgcaatcaacacccttgaatccaacaaagaatataatatccccctttcgccctctctcccttatcctcacgcccacttcctcttcccctcacgccggtgcacccgccgcccgggcagcgcctcgatctcctcccctggctggtgccctggctagcgcccccggctggcgcctctcctcccctttctcggccgacacccctgggcggtgcctctcctccccactgccagccctcactccccacatcagcggcggcggaggaccccgaggcgagtctcggcgacggcgtctgtgtagtggcctcgcacggccatgcggatcgagcctagcgcggctagtaagctctcagcagcgtggatctaggccggcctcactagcgggcgcggctgactaccccaaccggcggtagtcctcgcggagccaggcggagcagcggcagcgctgtttggagtgacaactcgccgaatctccctttctctctgagttcgccggcgccaaatcgatcttcaccaccgccgacgctttccccattgagcctgtgagcttctccggcgaggacggcgtccggtcgccctcctccctgggcaacgcagcagtgtggagtatggggatgacgacacatccctctcatcttctctctttctcccttgctgcacggctcgctagtgtgggccacttatgcaaaaactgacgacgaaccggtggcaaacttgggctacgcggtcttggcaaagctccgctggtggaggaggtggcaccgaatattctgttcggcgtactcaggctaaatgccacatgggagcattgtgaatggcctcatgaaaccagaccttgaaagccacaagcccacaacaccctgcccctcaatgcacttcattcaccgcacccacgttttcaccaaaacacctgactagatcactgacaccctgcagggttcacgctctgtacgatggatcgaccactgtaaaaatcaatctgccaaacagcgatccggccagccacactggtggagaaacttttttactcccggttggtacccttgtagtcctgggtttccaaccgggagtagtaatccgggactaaagatggacatctttaatcccggttgaaatagccgagactaaagatccatctttagttcagattggtaacaacaaccgggttggttgttgttatcaaccgagactgaacaggagtagtgggcagtccagatgatccccttttcttttttttcttttttattttctcccgaatcgagtggcatgcacatccccaaatcaaaccccaaatccccaaatcaaaataacatcccaactccacatcacaaattttaaagttacttatactcacaaatcaaatacatcacaaatcctaaaaaaagtacaaagcaaatcaaatacatcacagattatacatctcagatccatacaaatgtccaatgaattacaaaattatacatcttaataatcacagattatatataaaaaaaaaagctggctgcctcctcccgccgctcgtcgccgcgaggcgcggccccgctagccgccgccgtgggccccccttcccccccctcccgcggccacaggccgcctgctcggcgccgcccacctgcccgccgctggatgggagggaaggagggggagtagaggggaggaggaggcttggatcggatgtgaggaaattggagagggacgatcttatctctaaatagctggatgggagggaaggagggggagtagaggggaggaggaggaaggggagaaaggagaggaggagaggggaggggatgaggaggcttagatcggatctgagggaattggagagggacgatcttatctctaaatatttagtctggaacttaaccgatcagagatgggagtaaatatatttactctaaccgggactaaagatagatttttagtcccggtttgtagtaccaatcgggaataaagatctaaataaactttacttccggttgttactaccaaccgggactaaagtgataatctttagtcccggttgatactaccaaccgggactaaagatcctcagccccctgacatggctctgacagagcataaaccgggactaaaatgatctttagttaccgggactaaagatcaaaatttttataaccgggactaaaaacaatttttagttccggtttttattagaaccgagactattgtagaaatcagccgaccgagcaaaagatcatttctccagtagtgccagaccagacgtttaacccttcatccgtttcacagccacgctcacgtatcagctaccccggatgactggtgatgaaattggtggtgcgcagcgaagcaaaaacgtccagaatccagagggatttagggtggattcaggtgtgggctccgatatcaccatcagccaagcgcaccgggaggggtcctcccctacccggcggcagcatgattgcgcagggcgaagtggccggcagggcagggcaggaggtgtgatggggcgttgatggatatgacctccccctcccgggggtcacgtcgttgcagcgatgcgacgggctcccgtcgccccttttggtttgggtttatttgtgtagcggtaaagcgtatttgcgttttttgcaatgccctcttgaattggtttcatctcttgttattaacagttcatcattaagtctagctgtcgtacagccgtagtagctttgctagaataggcctgactgatcagagtgttttgttcaattgttgcaatcatgggtggcggacgcacctgctcatgaaaatactatgttttaggggataagaataatgacataggagttatctgaaatactacatgatcccccccctctccccacccacacacacccttttttttaaccaggaaacaaacgttattttgtttttgaaagaaactgttggtcagtagcgacccgactcaaatagtgtcaagcataaaaatgtaatgtttaaataaaaaaatgagacatgttataatctatatggtgttatcattccacttttcttctcgttttcatcaaacaaaattttagtatattttctttctttggtaaaattactatttgataactagtcaacatctcgtatgttggtgccaaaagtataaatattaaaattttaatcatataccaaatacatcggttatatttagaatcatagtgacttaccctctatctcaaaaaaccttacgtttatatacatttcctattaattgcagttaactgatatccaagacaatatcagtcgattgcctcattcgtcggattattgtcatccgatggtccatgacatgtcttctgcctccagctgaatcaacttttatatctcattaactatgtgctgtcgatcaatcacccaaccactagagacgatgttaattgaagagggggagaaaaccgatgacttcctcgacgagccatatgccgccgacgcccacaccttcagcaagcttacttcatattaggccgagtttacataaaaactttttctttaaacttctaacttttctatcacattaatactttcctacacacacaaactttcaactttttcatcacatcgttccaattttaaccaaactttcaattttaccgtgaagtaaacacacccttagagttttggaattggaattggagatgcacaatttttattatggtgtccaatccaatctaaattctttgaaataaaggttcaaggatgattttactctacatatgtttagagtaaaagaagtagaaagacctatttggaaatcatgaataaacacaatgatgtagtagcattgtaaattatttccctttttctctttatatatatatatagagagagatagcagaactattctacaaccggggttctataccccctccctcccaaaagccaaacccaccacccatccctccttcccaaggtctaaaatccacctcccatatcagttaaagggtggtcaaaagcctcctcgcgctaatcagacctcggtcaatgcgcctactaacttcccccaccatgcatctcttctcagctctcgtcgtgcatgaacggtgcagtaacatgatggccattgtgcactaacactatgttttatatatagtaacaacgctaaaaaatagttaatatatagttatgacggatctacttttaataagtatttttttctagcatcatggtacaaacgtttttttaaaaaaatagtacaacacgtgagagattttattcttcaaagattcacttcattggaattcgactctccacaagcggtaataccatagcatagcattattatttctattgtctgttatgtattactgcaatcccatcacgacattactgcaatagtgcagtaaggactaagtttcaagtaacacaacatgttactgctatttcttgataatgttaccgtaagaacatatgttaacaaccaacactactacgtaaagcatttttccgtgtggtcaaaatgatttttccttgcggaggatttgtccgtctgcacccaaatgtctggaaaaatcaatttttttgcttacgggtggcccaaccgcatgggataatcattttcccgtgcggtccacttatcctgtgcggtcaaattataccgcccacatggaacaaaagaaaaccaaaaataaaaaaaaaacgaaaattgtgggcctgcacgcaaccggccaccgcaactcgtcggatctgggcggggcccgttcgtcgccgcctcgccggtcgctgcctcgccacgcccgcctggtcaccgttgtcgctgttgtgcccgtccgctgcgacagcgaaggtgaaggtggcgctgttgggccgctgcggggagtccgggcggcagagccagtggatgatggaggcggcctcgcggacgcggcggcgcaaaaggaggtgccctaggagcggcgcggcgaggggcagcggcaaggtgcggagtaggtggtggcggatggtggtgaggaggcggccggcggcggggacgttccccgcagagacaacgacgacggccgctgcctcgacgacgtccgccgccttgacgacgacaatgtccgctgccttgacgacgcccgcttgccgccttgacaacgcacgcaacgatagcgtcgtcgtcgatggagccgagcgacgacgtgcgcgacaaggacgacgaccaggaggaggtctcgccgccgccttcctgttcggcatctcatccggtcaccgcctcatccggtcaccgccgcgcccggccgccgccatcgtcggcccgatagaggggaaggggaggagttaaggtggggaaaggtgtggggatgccaggtgtgtggttgggaaaggagaataaaaggaagagataaagtagagagagagatgggagtggttgagggagaaaaacggaaaaaaggaagagagaggatgtgaaaattttgaagtgggttggagggaaaggagggaggtattttcctgtgtgtaccacttaaaaagcccacacacaaaaattgatttttccgtgcggtcctcttaagtcccgtgcggtcggattaggacgtctgtacgggaaaatcgattttcccgtgtgggcgaaagcctagcgcctgtccccttattgtcccatgcggttccacttacagaccgcatggaaacaaaagggggcggcgtccagaaaaatctatcctgtagtagtgcgaaccaccttgcttaatactagtcaaaacgaatccatcgtatccaatcttggtcaaatccctaagtggacgcaacattcgtttcgtgaaaattgtgcagtaacactagtgcttgaacatatgcattttgtagtaaccaagcgagttacgacagttccctgaaagcgttactgctaaaaggaagggggagtatgtagatggagggaggaggctggttttcttgaggggagggaggataattttctgggaagagagagatatatcgggaaaagatagagcagagggatcatgaggggcaaagagagattgggattatattttggtactacagtataattttgttactatatttatttcacgatgttaatataggtttggaataacacatagtacaactggtagtaacatgtgagagtaaatactataatttaggaatggtagttgtatggacaaaaaatcaatagtgtggcggtggcttctactcatgagaattaaatgatgatgtgtcttatgttactctagtaatctataattcacatggtgatgttgctgtagcagtgcattaatatttttgcgatagtgcaacaagacggtttcaagtgtacaataacaaccattacagtatcattactacatgtgccaatactatacggattagcacatgttagaagataaaattttactaaaaaaaaaattcatcacaagaaacatagtctactggttaatgatttgtggtgattaagttttttttgaccgggaactatcagagctttgcctagtagtgtattttcattaaaaagaataaagtatgtacaagttgtggtgattaagttgaagatcttacgttcatttccgattgaatgcaattttaatttatccaatagaaaacgaggacagagagaggaatcgagacttctctctcctcaaaagaagagaggcgtgagactgagtacggatcgggagggaagaagggagcgcgatagagagttacgtgaccacgactactacggatataaccgttgctcacatcatgtatgaacaagatgatatcaagatcaagtattccaagtgcgggaaaccgattcggccacctcctacactgctgactttaaatggctgtcgaatctgcatacaatctccgcttttgacccgagagtacttgatggaaagctctcagagtcctctttgcaacgcatccagcctcatcgccaaattccatcctagtcatctgcagatgaagaaacaatgtgctacgtcacctgtcatgggcctttgggcttgtaactttgtttgagacccggcccaagtggggcccatgtggggtgcatcccaaccaggggagcatgaccttaggcacccccaggtcctccttccctctcttgggccgaatccggcccatttccctccccctctctctcctctccctgcggcccactcggcctctccccgcgcgcgcgccactgacgggcgggcccgcccgccaccctcgctgacgggtggggcccacccatcatccccttcctcccgccgctccgcccgcgcctagcgccgccgccgccgccaaatccgccacgctccgccgctcccgttcaaaattgaatggggaaatatttcccccgattccctctccctttccccacattttcctctctctctctctctctatttcagatggaaaccccccctaatcccgccggcgccattaatggcggccggatctcccgcaccggtttccttccccgccggccgccctctctcactcccaaccctatataaaccctccccgcacctcccttgtctgtttccgccactcgccgccctttctccccgccggaatcgagctcgcaccgtcgccgttgacctccggccggccctatctgctcgccgggaccatcgcccgcctcggcgtcgtctcctccggcttcgccgcaccactgccgaccccgtccaccgccttgccgagctcgccgaccgccggaacgccaccgtccccgtcaacccgagccgcgccaccgcctccctccactctggccgcctcctccgtcgccgccgtcaacccggggtgagccgttgaccgccgcctctttcccccttcccttcccctctcttggccgccgcttcgccgtgcctatggccgctgccggcgaccataggggcatgggcgctgcctcccgccggccgcgccgacgtggccgcctccgagcgcgccgtgtggccgcctcgtggggcccggccgtcagccgcccatgctctcaggtgcggctgacgcgtggggcccacggcgccggctggtgagctgcgggtgctcccggtccaccgtggaccgagaggctgccgcgtggggcccaccacccctgtggacccggccgcgcgccccctcccctcggctgacgcaataaaccctatttttaattaaaatttaaatgaagaaattcacaaatattcacttaaagagcatataaacttcaaatggccataacttggccgtttgaactcgaaattggaccgttcaagtctctaatttttccttatgaagtcaagaacccatttttgtactttgtttcttcttgttatatggagtttattagagtaaaatcctttttcttttcattggtcgtgtagacgctgcagcttcggaagatccgctctacgtggaggttgaagccgacgttggggaaagcgagcaaggcaagtcacatcatccttgaacatattgaatcctaggttataaaattattttggtttaaattactgcattatcgctttatttaaattcccgcgttatcactgttttgtttagccatgcctatttatctttgttatgaccttattattattattgtcattgttattattaccttgttcacccttggacaaataaaaccccaactagtgggtactctattcatggttccactagtatgaacttaggtagatgcttcgcggattaattaggcaacattaggtggttttataaccttagactttgggaatgctcatatcatttggacactatagaatggttggactatgtggaaatggacacacaccttcccctctgttcaaaacccccaaaatggttttcgattgggctcgaggtgcgtggttttgatagaagcacctcggccactataaggaccggtcttcgggcctctgttgcaaagcactaccgtactttcacatgtctactgggtaaggcttagtttgtggcttagtctggttataaacaaaggtacacggatggagatggacgaagtcggggcttgatggacatctctaggacaaataaaggctacacgagctgcgcccggtagtcgagatgtcatggcacagggccggtgtcctgctgctaggggctcaatcctgcctacctgtcccgggggttccggccgtaggcggggttgggtcggtactcttgtttatggctaggatgggttgggaactatgtcacgtctttcgtccgtatgccgtggtggtatgtggcacgtggttacacgtgaggaagatgtgtcttgtgggtaaagatgtacacctctgatcagagtataatctattcgaatagtcgcgccctcggttatgggcaagcctagcaatgtacccaagttagtgttttaaattcttaaaacctgcttaacaactaaaatgtggaatggttggcctgggttggcttgggacgagctgggacctgggtttggttgccagttcggtctgaatcatcgtaggccttgggttaaggcaggttcgtgtaggttcacggccttgtttaataacattgtgtagctctaggatcgtgtttacaaaatggccctgagcaactaaaagtctttttaatgctgtttactgcaaaccctaacccctttattataactcccttgtactcctttgcatttattctgcattcgtgggtgtgtcttgttgagtacggtggttgtactcaatcttgctcaatttttccccaaacccagaagaggagttcctggaagatgaaggctttggtgtctagctcgtgcctgccgtcaagtgcccgtagtcgtcgccctagtcttctactgttttccgtttatctttgtgtgtgctgggccttcgtcgcccatgtaataaattaactatttacgcttccgcttgttaaactctgaattgtatcaacttttagtgtaccttgcctcctgggacaaggaataataaacgcacgtaaggaatgcccgttgggttaattccggtcgtgacatgattctagggttttgtttgattaaagtttaaccattgctacttgcctgcagcgggcgtgtcagctagacttcccgtctgcttgttcttcgaaaccccaacttatcatttgtattcaattcctatttgcaattcagattgcttttatcttttttgcttgtttttttgatttgcttgtaggaataaggttgatctgcaccggcaagatcaataacccacagagaggtgtatcgatcgcaaaggcacaacacaatgtctcgtacggttgtaatcgggtcatcaatgtttctcccaaatcgtatttatcatcaactcaccgaaagatcgggccaacaacagccttgggtgtctcgagtggagctcagggttcatcaagtggtatcagagctttcgttgctcggtatgtttttatctacatattaccagaaaatagccacaaaaaaatattgcatccattacctagccatctttgtgccactgcattgttcttttcagtttttgctttgttgagttttctgttgcattgtcgcgtcaagttgctggacttagcgtagtacgtttaggctttcgagttcttgtcatgtctattaccactgtcgtcgtcgtcgccctgtctttgttgtcgtcgggacctatgaaaacaaaatcatctttccgccagggttctatttttctagttttcaaaagtttatgtcggttagttttagagttgttgagttgcacctagggtttgtagatcctgccgtgtgtttgtttttgccgtgcatgtgtacgctagaagaaggaagggggagagatttttgtagattggattcggcttccataagtgaggacgaaggaaggtgaaagtcatttctttgattggatttggtttccacttgtgggggcccaggccgaaccttccactctgtcgactccctccctcccagccgacaactcccctacctcccactgtacctccacctcccaaccggttgtgccgagttgcaccttggtgaaattttttggagtgtcagattgaagatccgtttgcaaaaatggaacttatgcaatgagagcattacatttttgtatagttctaattttgggtttggacttttgcatttgagtccctataatttttgtatttacatttgagtccctgtaatcttgcattcaggtccttgagtcatttttgctaaaaaaagtgagaaaaagcagaaaggtgcttacaaaattgaaaaaaaaattccgcaccaaaaagaaaagaaaaaaaaaggaagaagaaaagaaagaagaaaaagaaataaagaaaaaatagaaaataagttgttatctttgagccgaatttgatatatcagagttgtgcttgaattatttctagtgctatcttgtggtaccgttcgtgtctaggctcgcgtctctagtccgttctagcctaggaccagcacggtactgactttgaacgattattcaactttgtattctctaatttgagcatctgttattcctttgctacatatttaagcctaccaagagctccacagatttgattgcagccgcacagcaagtgtttgccaaggcatcgatacatccaacctccattagggtgcttggttgagtcggtgtacgtcaccattccgctagctttggtaagaacttgtaagagcttggtaaaatgcttaagtgtgtgtgatattggagcttccactacctagtagttgataggagtgtgcatattcttgtgtatgtttcttgtttgctactaaccatattgattgggagctagcagtagacaatgaatttgacaaatatgatttttctaatgctcaaatgattaaggccgctagtaataagttcacctcttctacattatattggtggagttatgtgagtaacaaacctgaaaattgggatgaatgctaaaacatgatgagaaagtgttttgtgagtttatattacaaatgtactcttcatgataaactagaacatctgaaacaatgtgatagaactgttagagagtacatccatgaatctaaagtttgtatcatctacagtgatctaaaagagtgagatgaaaacataatgcgcagatttttcaaggggcttaattctgaagttcaggttatgcttactaatgtgacataatcatattgaacacctattcattcttgtttgtagcattgagagtcagatcatatcaaatgcgagtaagcatgaacaatgtgatttatctgctatttctgaatctcctatatccttatgcaaagatgatgtgcaaacattggaggaaaaatcttttgtctcccctgttactaacgttttgcagggagttcagcacattcaacaaaaggaggagaatggtgtacttgagaagaaagatgatgaagcacctgcgatatctaaagaaagtttgcaaggtaaattaaatggtgctgagataaatgaaggtgagtattctcaagctgagctacacaagtccacttttcatgctatagtagagcaaccattagtggaaccatttgctgagatgtctttgtcacaagttgatttacttgttgtttcttgtgataaagaagagttgtgtgataatgcttcacttatatccatgccacaactagtgaatgaacatgctattcctactgttaattcttattgcgctgattttaagcatgttgttcacattgctgatgaagtagaggaacgtgaattgacatcttctttaaatactttgagctatgtttagtttgatgattcttgtaagctcgataatttgaaggagaaattacttgctaaatctgatttcccatgtccaactaaagctattttttatatctttggcgaatatgatcatagaggattatatttggtgcatagaatttttatctgttcggatttagggagacatgttattgctaatcacactacttcgagtttctctagttttgatcggatgaaataggttgttttgtatggactatgtgaagagcaccatatggaaaaaccgaggatggttttccatgaagaaggggaggatgatgtgaccaaggctactacggataacatcatggatgaacaagatgatatcaagatcaagtactccaagtgctgaaatccgattcggccacctcctacactgttgacttcaaacggccgcaaataaagaaacaaggtgttgtgtcacctgcaacagatgaagcctcattgccaaattccatctcaatcatccgcagatgaagaaataaggtgttacgtcacctgtcatgggcctttgggcttgtaattttgtttggttcctcggcccaagtgggacccatatcaggtgtgccccaactagggggggcacgaccctaggcacccctaggttgtcctcccacctccataaatagctaggtaccccttaagggattcttgggttttgttagattaaagtttagccattgctacttgcttgcagcgcgcgtgtcggctagaccgcccgtctgcttgttctttggaaccccaacttattatttgtattcaattcctatttgcaattcatattgcttttaccttgttcttgcttgtttcttcgatttgcttgcaggaataaggttgatctgcaccggcaagatcaacaacctacggagaggtgtatcgatcacaaaggcgcatcacaacatctcgtacgtttatagtcgagtcatcaacgtttctcccaaatcgtagttatcattaactcaccgaaagatcggaccaacaacagccttgagtgtctccagtggagctcagggttcatcaaagagtggatcgagaggggattgagggcatgaaagagcgcgaggagagagtagagagaagaggaggaggaggataggcgcacatgaggggatgggagggaggagtgatggtgggacagaggtaaacaatagttattctaggggtcggcgtatagtcttgtccttaaaatatatatatactagcaaaaatacatatgtgttgcgacaggtggagataattttcacaattgataaaaattctaccaatttaaacggcaaactaaaacaagacaaacaaaacaatggtaaaacaaagtcagaaatcatactccctctatccaaaaatctaagacctatttctttttgcaccaagaccaaaaagcaattaattcattcaccatgtgataaaaccaatggacatgcaaccaataagtactaaaatgacttcttggattctgataaacaatttaatttagcacataatggcggttgtcgatttctaggaacagcaataaaatttatctggtggggaaaatcaaggagagatggtgacacagatgtttatactggtttaggccctcgatgtgagctaataccctagtccaattatatgtggattggatctatgtccggtatgaagtggagaatgcgtatgccgggttgtgatgaccggcttgccccagatctcgtgacccctaccccctcttatataggatgaggaggagggtttacaaggaaagtatctagctgattacaactagatctccctattctatctataaaagataggtatatttccaggatttatatcttatcccaagaatatctctttctttatttaaaggatagccgcatgggcctagggctcttggcccaccctatgccacatggcccaaaggcctctccttgggtacccaggtaccgtgtaactcatagtgactagctacaaataggacttagacttttcgaaaaaccaaagaatagaataagtctcagacttttggatggagagagtatatagtattgaacccggttgcgctcgcttcatacgtcatcacacgaagaatcccttatgtacacatttccatagcctcacaaatctattgggtgaatattccataagttgatgcatgtctattctgctatacgtcatttattaaagattgaagttttgattattcaagtagtgaaagtttttttttacttgtagatgaaaagcatttgcaaaataacaaacttgcgacatacacaccttaatggtaatttcaatagaaaaatatttgtgagtagagaaatttgaaacagaaaaaaaagagaaaaggaggaaaaagggaggagattggaaacggaaggagaggtcaggatgatcgggagaagagaaaaggagaaataggggaaaaaagagagaaaaagacactgattaggggaggggcgtgtggcgctgagtggaggcacgctggatggggcggtgggatggtgtgggctggctggttgggtgcactaggagagggagagggagagggaggcgttgggctaggaagggggtgtataatagttgttctagagtcacgtcgaaatggataccgtgatatagaaccaactcaaacacggatgacgtatcaaaattttggtagaaacatctataatttttataatgctagtagagatatatattaaaataattggggtaccatggggtcccggacctagcaatcaaattgagaatatacccaatcggactgaatctgaatttctttaaaaattactaacatgtttgaacaagtttgaattgaatttggatattttgttagattttgattctaggtatgtactatcaaaacatataattagttagatatgtataaatagattgtgaatttgagtaggaatcaaattcttatatataggtatatactccaaagtattttttaaaaaaaatcagatgtttgagtcaatttaagtattgcataccttggtgcctaggcaccatattgccccatctatatagagagcacagtaagagtgtctcctattgtttattgtaaaaaaaaggtggtacgaggggtaggggtggtgaggtgtggttttagagggatgtctagggtggtggaagaagggcggggtgctgatgatgatagcacggaaaccatggggatgggggtgggcggtgagccagtggcaaaggcggggttgcctcgccgctacttagagcaaggaggagtaaggggagtgagaagggagatcctagttggttgggtagggcttgccagcaacgttggcgactttcttgcaccggcgagccagggaggggggcgccccactgacggtagggagatgatggcacggggagatcgtgaactgtgagaaacttggaaggtgaggcatgatcggagaggttcattagcaactgtaagagcaccggaagaaagaaaagaaagaaccaaatcttgtggccggaggtggaagaagacctcaacaaccttagatgatgaccgatggaggagagaaagtcaactcacaaaacttaaaaaaaaaatcaatcgcctaactcataacaagcacaagcctactccttccgtcccatagaaaccaacctagtactagatatgacacatcctaatactattaatctgaacatatatttatttagattcattgtactagaatgtgtcgtatctaattctaaattcgtttatttttggaacggagcgagtagtttttgatcgacgggactacacaatgcgtgtgcactaattagttctaatcactatcatcctgtcaaatgaacttaccatgtataatagatgaactataatgttatctctatttttcttcttctctctatctctcaccttcttccttcaaggcttcttgaaagaaaaagaacgcttggaaattgaagtgcatcaatggctcggattaaaagttaattaacagggacaagacaaacgtcactagaggggaattttcgtccatgggaaagttcagcccatctccagccatgcccgtcctcaagagcgatggcgatcactgcatttggaggtcagtcgatatccagccgcctcatctatcgacgagacaagacgacgatcgatttgcgacggcagtttggctggcgatgccttcctccgtcaagcagcactggcccctcctctgctagccacgccgccgccgattcctccgccccgctcggccgctccttccgtctcgctgctaccgcgcgcgcgtgcccaaccgcctgtgaagcgggtccaaggtacgcaatgctaactgtgtcccctccctttgtccgccgcgatgccgccttcctccgctaatgaacactgaagctcgcttttcctcctctgatgaacaccggaagtctggaactcgcgtcagcagttcgctaatgacgccacactcattcacttccctatggacggaaatacccctcgataacttttaatctgagccggtgacatgctttaccctctgcgtgcgtttttttttggttgaggagcgtagaagcacacctctgtatgcatttaccaatcatttttatttttcaaattgtctgtactccatataagattatagttcattatagcctagttttaaacttgctctaacgatattttgcgcggctgataattagagccaaccaatagtccaatagtagtattgtactacgaatgtcatttactactggtgtctaaagattgaattggccgacatatattcattgatagcacctgcatcagactgtagaagcgagtgcacagcctgttgagaaatatgttgaaaggtgcataactctcagtcattatctaaagaaacatcacccagctcaagaaacatcacccagctctgttctttggcctcctttgaattttggcaaaggaattgaatttgaagttggtcttgtattttgtgtttcat

SEQ ID NO: 59686 - DNA, 33762 bp, Oryza sativa
agatgcatgccatcaaaactagcagtggtagtagtctagcagagatcagatcaccatttgtttggtatttttcctctgaccaattcgggatgactgacctcaagccagagtgttccatggagctaacagcctctggtcagttaattactattatgcacaattacacatgggtgcacccccatggtcgcgtttaagttacttcacgttggagaaaactgatttggcctagaaccttacgccattggtgtgaaattgcaccatggtgcatgtctgatgaatctgtttaaatccattgaaatacattgaaagaattctatcagaaaccccgctacaaaaataggaaataatgtcctaaagatgggctttcagggaaaagcttgcaaagagtttagtgtaactttttttgtataaaagaaagtatttttggctaagaaggcgaagagcatctctgtcatcatcggcgacaacccaacatctcacactagcttcactttggaccatgttctaacacaaacttgcttttatggaacgaacaaattagagaggtaaagggaaaagaaactctctagcaatcagaccaacattatggataaggcttttcactgagtaggatccgtgctagcatcatcaatttggaatcaaaataatctaccaatccagacacatttgaaagctgcatgattacccaacttcacgcagtaatgatgatttctccgcagcatctgtgccacgagtgaagagtgacaagcttaaaggctcaatataaacctctgaagttgcatgatcaagttacaacttagctggcccggttgaccccatcgattttgctacatgtataaaggttaagaaaaaaaattatttcgacacacaattgcaaaatcccatgaagtatgattaattttgggtatgtttaaagcacccttggagagatatgaaccgtccatttaatttaatataacacaccacaattagttctagtacatctgataaaatggtaggtttggaaaaaaaataaaatgcatggtaaataagtaatttattccatctgtagagtaaatcgactgaattttagctaactacatgtgtgtttcttcgtccgtaatgcacgcttgttccctaatgccatgcatatatctttcctgatttgttggcttattatttgtttttaatttgaggaacgcatataacaagtagccatgaaactactccgcttctttcttcctctttccttcttcgatccgatcgaacatgatttatataagttaatttacagtctaattaaatcaattggtgatcctcagataacatggttgcatgcaaaattcagtttccacatgcattattaaggatgtttacggaagctggcattatttagcatcacaatattgagagagagataccggcaacctcaccggcggcgctcatcgaccgagtcgcaagtctacgacggatggacaagataaccttcgcgggattggatttagaaaagtaatttcaacatacccctattactactattttaacaaaatatccaaaataaccctataaatcaacgggacatgttaattccactgccttactaacactaagtaatttattattattgtcaaagtactgtaaaagcaccctaattattaatgatatatgtactgttgcagtaatttgggaacaggccggggaaaaacggagagtgtcaggtaccgtaaaatctcgattgttggtatcctcttaaactgcacgtaggggcggagctacagactacagtgacaggggtgcacaggaacccggtcgaaaaatcaattacctgtagttatctcatgttcaccacttgacaccccctcagagctcctgcgtgtacccccaaccatcaggccgagcagcaagccaaagagaagcttgcattcttgtagctaattaagtattctcgtggctgcatcatactcctatatgctctcagctctgttatatcacaggacacaggtctacaaattggccatgcatggagtgtagccgtcaatttcatccagcatttcttaacctctctttttgcatttacaatcactatcaaacaaatggaatatccttacccaccacactaccaaaggtctcatcagccattgattgtagtaagcatagtcaggcatgttgcatcccttataattttctcacgatcattctgatttattgcaagcaaattaagttaacaactttgcatgttaattagggtctcaatgggatgatattggttgctcttatcaaaattgagggttacttttcaattaagcattttagatgataaattaattggaggaaagcttgggtttagttgaggcccttaacgcttgagatgcaatgtcaagtaagttgcttgactttgcaagaatcaaactatggtatagcatacaggacaatttcatagcttttaaaatatgatgtatttacattaggaaattctgtagtttatgtagtataatataataaagcattatttttctgtttctttaagccaatgggttggactaagtacttatccaattctgggaaccttctttgcttttgattttattctcaacatgttcgttgcactatactaatcgatgttttcattgtgttctccattttggtaagcactttttgtcactgcatttttctttctgcacagactctttctcacattgaatttgctgatgctaaaatgtaatggatatactactatttactacaacactgctagaagaaaacatataccactaaactatatgaagctatggtgtactccctccgtcccaaaaaaaaaaaagacaaaccctgggttttcatatccaatttgaccgtccatcttatttgaaaaaattatgaaaaaaattaaaaagataagttacgcataaagtattaatcatgttttatctagggatggcaatgggttgggtcgggcacgggtagagcaaaaccatgcccgacccgatgcccaacattgcccgccgaaaccctacccattagagttagcgggcaaaactccatgcccgtactcatgcccggcgggcgcgggtatgtctggcgggtacccaatggatctcacatgaataataacttaaaagatatgtaatttaaccaagaaaaataaaatcaataatttaccaaattattggttatcaacgataatttgaattacatcacaacttagtatcagttagcatcacgaatgaaccaagagaaatggtataagaattaaaaaatgagtcaaaattagataatacatatgtatcgggtcgggcatggattacccacgggtaaaaaataaaacccgcctattacccataatatcttcgggtctcgggcgggagtgtccatgggtaaaaagtcacacccacacccgtacccatcgggtcgggtatccacggatacccggagggtatccacggatacccggacccatgggtaaaattgccatccctagttttatcatctaacaacaatgaaaatactaattataaaagaatttcatataagacggacagtcaaacattggacacggaaatctagggtttggcttttttttgggacggagggagtgtagtactaccttcgtcccaaaataagtgcagccataggtatccgtgtccaacgtttgaccgtccgtcttatttgaaaaatttataaaaaaaaattaaaaaaatagtcacacataaagcactattcatcttttacatttaataacaataaaaatattaataataaaaagttttcaaataagaaaaatgtcaaaagttggacataaacaatgtaaaattacacttattttgggatggagaaagtacggatgcacccctctatgttgctctagctcttttttttaagtggaaatgaatttaactttgaaagccggtatttgaaaaaaaacactcaaaatagaactggggaaacaaacatgcaacacgctcctaacgatgcttgtttctacaacgacaaattcaggttactagtagaatatttgccaattggaaaatatcatcccaattggtcgtacgtatcctacctaccacgcaggaggcaccgtggcaccgaacagaaaagtgacgctgctgctcacttgcttgcaccggtcgagcacaaagtttctccatttttgtaagactcgcaccaaagtttctcaaaagctataacgtgcaagggaacacgacgtcacaccgcaccaaagcaacgctacgccgccggtggcgacaaagccaccgagtccgagaccaagaccgacgtgacatatcccaacgtcgccttgatgatctccccgttctttccgcggtcaagtcggaaaagagtcgcgaattacgcagagggatcttgaccgcgatcggccatgtgtagatcgatccgacacaacacaaggtcgaaaggtttcgtgagaaaaggttgccgggaatcaaccggaggagcgatcggtttttggacgtttggtccttgcaatgccggtggtcagaggttaccaagctccagtcaacacacatgacgcagggcatctcgcgagcgcacgaaagcgaagggagaatttagaatttaggacgggctcgtgggatggggaaactggcatcgtactacagtttttgaggcagggtgatcagatttgctggcttttggtctctctctctctctctcccgatacggtgacatgttttgctatatagcctataggtatattttattctaacttttttgtatttgtaccgttgctaacattagggtgaaaatttttagcgtgtcacattggatatacggatgcacatttaaaatattaaatatatactaataacaaaataaattacagattccgcctgtaaactatgagacgaatttattaagcctaattaatttatcattagcaaatatttactgtagcaccacattgtcagaccatggagcaattaagctcacaatttacacgcaatctgtgtaattagtttttttcctatattcaatgtgacagggtaaaaacttttgccagaggatctaaacaggctcgaagttgaattgaagttgtcctacaattggaattagtatgtaaaaacaacacaattaattactaacagattaaaacaaatagatgcctttggatcgaaggttttttgaattgcagaaaacaggtattgagtactataggaaattttaccgttcatccctttggaacaaaggtattgagccccccatttttttttaatttcctttgcttatacccaaggctcttatataagctatagtgtcaaatgacgataacttcacagctcattagtaagattccatgacttgacgactttaattacccgttgcaaacttgcttatgttgttccttcaaaatacgtgcttagggcatggccaacggtggcagcctacgttacctacatatgggatacggatacacgatacggtgatacgggatatgatatttttcggaaaataaagatacggggatacgtttgtatatatataataaaaatacagaaaattataaattgaattggggaaactatagtattagtgtagccgattggtgattacaatgtagcaatcatctctaattcccttttgtagctaattcacgttgattaagcccaaactaccagcttccaataattcaaacaaaaaaaatcaacacatacacgtttataactaaaagactaaataactgatgaatctgcaggaacattagcagccgaactaccgctggattgctagatgtgctagggactgaacttccagttccaaaacccattgcatcttttaaaacaaaacatagttattgttgtgcccagaaaataaggacattgcagtcttgcggattcattcaagaaaaaagctgaagagcgttgtaaatctgaaaggctaaaagatgggatttatcttttattacctcgtatggggaacaagaaaagaagagctcggttgtgatggagcgctttgctcagcatcagaggcgttgtgttggtggcagcggccctaacccctggcagggcatgacggcggtcggcggagatgctgcctgcgtctggcagcagcggccctaccagtacggggaggttctacaagctgaccccgaggaactggaagttgggggtgactatttccctgttggggccggaacacccgggcctgcgggggtgggttggatttttggacccatgggtgagcctccaaaacaaaccgaactatccccactccactccaaaccctacactccccgcacgcgcctgtgcgcggtgcaccgccgcgcactgccgccgccgccgccacaaccgcgcgccgtcaccgccgcgtgccgtcactgccgttcgctgccaccgccgagcgccgtcaccgccgttcgccgccacagtcgccggactcactcaagaaggtgactcatctttcatgtttcttgaagtggcgttctctctctgcttggtcgagctccgctgatatatgttcttgctgtgggcagggaggtggcagatctgcggttgcgtgacctccatcttggatctcggtgagctggggggactgttcttggaagtggttcttgggagcatcctggtatggtaccttggctatttttgtgctttttctttgtttcaatttttagataatgtgggttggttcgattggagatgctgaagagtggtgggtttctgttgggtttaatgccgcagctggtgtcccatcttagttgtctcatgtgatacatactctgctggattgtagtatgtgtgccatcagacatcaggattagtcacaataattaggtcttaactcttgaaaggtaaagacttatgaagctattgccaaattagcagtaccaatgtctcatctaaccttgagaagtcatctagatctctggtatactgcaatgctactgaaaaagaaaaaaaaaagatgttggagatttgaacaaattggaattacacaaattgattgctagcaatgttctattattcgcaattaattctgtcagatggttgtttataatatatcagtgcaattgcaccctttcccaagtcccaacctctaagtcatgtttattaagcatgcagcttttttgctgcttaatggtgactgttgagcgcatctagaaaatccagcacttaaacttttaagctgttggtcaaaggataaaacattttgaatgtcagttcattcagttccatataactactaatctgttgatttaggtggctgtctttcactgtagtattaagtagctaactattttatgtgttgacatgacatgaggcctgtctttcttgttcaaagatgtgatttgatattcattatgttattagtggagtttcaaaaggtgaaaaaaaagtgcacaagaatatttatgcacggttctttgaaaagaaacatgtccagcccccaaatgctagatgcatgattacggtgtataacaggttgctgttgggtatgcttatcatttcactagtttttagcacaagtagtaaatgtaaatattaattctgcacaagtagcaaatgtagatattaattttctattcttgtcaaacataggtttattaaacatgtctatgcaaaattctgaaagttcatctgccaatagttctagtcatgagctgccttcacaaacacgtaagagagcaaaagtgtgggaacattttgagcaggagcttgtcatgatagatggtcttccaaaagcacaatgcaaatattgtggcttaatgttgtcagcgactagaaaatcaggaactagccatctcataaaccatatttgcgaatcttgtccactagttgatggtgaagttagaaataggtttatatcaacagttaggaaacaacccgtggaaaattttatgtttgatcctaaaaagactgaagagttgatgataaaatatttcatccatgctgagataccattccataaaattgaggatccctacttggatgattggatggcatccatgcagccaacttttaaacttgtgggtcgtcaatcaatccgcgacaagatttacaactattacaataggctgaaacaagaattgcatgctgaattagagaatcttgattcgcgtgtatgcctaacatcggacatgtggacctcaaatcaaaacctaggatacatggttgtcacagcccactatgttgatgctgaattcaaaatgaaaaagaaaattataagtttgaagcctgtgaagtatccacacactagctttgcaattgaagaagccatgatgaggtgtttgactgagtggggcttgagtagcaaactgttcaccttaactttagacaatgctagtaacaacaccgctgcttgtcaagaattagtgaaaactctcaaggatgagttggttttggaaggcaaacattttcatgtgaggtgttgtgcacacatcctcaatttgttggttcaagatgggatgagggtgattcgtgcagcaatagataagatctgtgagatcctaaagtacattgagcattcaccctcacgcattcaagcgtttaattcaattgcttctagtaaaagtcttcctccaaaatctggtttcactcttgatgtaccaacccgttggaactcgaccttcaagatgattagagaaatattgccttacaaggctatcctcaatagctatgcctctgaaaattgtgaacttctaccaactaatgaagaatggttgcatgctgaatcaatttgtgaatttcttaaggcttttgaagaggctactagaggtgtatcagctcataggacaccaactgcacacacattcttgccccatgttctttgtatccgtcatgctttgagtgatcctgattggcaaaccagcgatcttttaaaacgattggctgctcctatgcacaccaagtttgcaaaatattgggatgaaaaattggcaaacaacttcaatttggcacttgtcattaccactgtgttagatccaagaaggaaaagagactatttggatttcttttatgagaaggtgtctccccatggttctaatgttgaaagtaaagtggactctattatagaggagatgaaatcatactttcatgtatatgaaggaattgcaagaagaaggggtgtatcctacatgtcacagtctagtgagagagttagtgttgtaggctcacctgttttgggaaaaagaaagctagagcatgaattcaccctcttcaagtcaaaccgaaaggttgcacatactcagaagtcagagattgatacatatttagaagaagtatgtgaggatgatagtgaggattttgatgttttggcatggtggaagaaaaattccaaaaagtttcctgtgttggcaattatggctcgagactttcttgcaattccacttagcaccgtgccctcagagtccgctttcagcagtggaggaaggattcttggagacacaagaagctcattgacaccagagatgctcgaggcacttgtttgtgcaaaagattggctacatagagccaaaaaacaaggggattaaaggtataatatctcacgccttgtatttcgtctcagactttgtggtctgtgccatacaaatagtaattgtagatgtgttttcattttatattgtttgattagtcacaaaatctagattaatttgtctgagtgcccaccagtattactaatatttgtgccaaattttctttgatctaggttcgtactgagtactgaccatatgatgttttgtgaagaaggtttggtatgatggctgttttttttttacaatggtggggtccctgtgctcagtaacttaatgttgttttttgttcatcagttggtgaaatgttaggcggaatttgtaacaccttgcaatgccttttatatctattagttgtatccttacttgtatatattcttatttgagcagctagagcatgttcaggagatagatgagagcattgtgtatgtgaaggataagcaaggaaggtggcctctctcttctcccagaggggcaaaaaaggccccaaccttgttttcttcctctctttttttttccatttcttgaaagtccttgtggttgtatatagtagtatagatatttagttgaatagtggggatggatggattcattcttcattcttactagtgtgtccactaactcatgctagtcatatcttatagaaataataatattcaacttgtaatcattcaatgttatttctgaaatataaatttctgatggcttctttctcttccagattatctacaactgcatatggatcaaggcatagatgatgttttggtagtttttgttgaagatataaaccttattatggcccttattattgctgtagtagtgagcaattgacttaattgtaattatatgacatcattagtcttctggtattcatttcagtgctggatcagctaacaaacaatgcgatgcgtatcattctgagtatttttttttgtttcattttcttgtttttgcccaattttcagtgtttcagcaagcaatgatgttcttttaatatatctgttttgaattaattgtctgcacgtgtgtctacactgctgctctctatactgtagctgagatccatggctaaagaagtaacgaggcctcctggctccaagctctctgtagtgtagctgggatccatggattgaatccattccagtgaagtgggctgaacccattttagtgtaatggtttggggtgggttggactgaaatctgatgcggggtgggttggtttggattttggaggagaggaaatggggtgggttggtttggcatgccattccatgaggaggtgggctggggtggattcaaattggatctcaacccactggcaggcttaggtgagtggtggtgaggccccacaaaatttcgggtgtggggacagggatggaaagctcagggcctgtttggtatagctccaactcctaaatttagctccaggagttgggtctggagtggagttgtagaactgcctaaacccagcttcacaactctagttcattttgtgagagagctccacccaactccactcctaattttggtggagctaaaactgtttggctgagctccagctccagtaggggtggagctggagctggagctgtgccaaacatgccctcaattgaagcagtaggtggaatcatatataaagtaaaccaaaccctaagtcctttcttctactctttcacaaccacaagcccctaagaaatcaatcctatccttatttgtcacataggaaaaaaaggttgctgggagctaggacgccaacatctgcttctctgcctcggctcatctccactagctggcgccccacaccatgccaccctcccaccttcctcatcactgcgtcacctcgaagtcacccgcctcatcccttcatcaccagcacaagccgcctcactagtcgtcgctcgttgccacatcacctcgacgccacgccattggctcgtcgccacccagcagccactgcctcaactctggtggtgctggccggccaccgctaccttgacgctcgcatcctacttgtctcgacgtcacgctatcaacccaccaccatcccgcgtgtcttgctcctctcgccatcagagggagactagttccatgcaagatagcagggccctagaggtgtcgccgccacgggctgattttcacccactcagtcatccggggccgggggttggtcaacccgaagggaaaagtgagcagggatgttcttatcctccccactaaacgatggagctaggtaggaggggggttcctttagcatgtatgcacccctcaatctaaattcagacacttatatcagtctaaatttaatcaaaagtatattaaaacaagcgagtgatatcactctccattttgttctaactccaattgccacccctaatcgggagacacaccgtggctggtggcgtgccaccgtagagtacagtgcgtgccgcatccaaatccggactggcgcattacccaaccatggaatgcagcggtggtcgcgtccccaagcagaggagaccgcgtccccgaacccaaccaccgctgcgacccaaacaaaaggctgcagggcccaacccctagctacggctcagagatgcctggccccagccctactccctcgccccagcacatgtgttgacgcccaggctcaggctcagcacacacccaaatacccaatggccatggatagattcatcatccaaacatagataatgagagtgcttagctgttgcaagtggcagacagggaggggctagtcaatggcgactgctttgctttgcacccagcggaaaagcagtttttcactagtgcagcggatggcagctccctactagtactcggctgggtgggagggacccaaaagctgcaagatctgggaggcgttttagggtggctgtcgaccttgtagctaagctagcttgctgtccggttaattgattgatctaccagctaggtcgtgtggatgttgtagtggagctgtactccagttgtgtttgtctttgtccctcatgaaccagcgccaattggacgacctgcacttggttgatacgagtacaatagtaatgataacaacaatatgattaacctgaaaaacaatccaggatttgcctgtctataactaaggatttgtcaatcatcgccttcaggctgcaggaagaatccaactgattaataagtgattttatattctacttacgtggattgctgacatgacatgtatcccagccgtctatacatccaggtctaagcagaacaaacacttcgtcaaaggagagttattcgactccgtacagcaatttggtcctgtacggttgccgtacacgtccgtttggacctgccacgacaaaccccgaaacgaactgtacagaccacaactttcaagcggttgagaaataacgcgaccaagcaaggaacgggaaaaaccccaaacggcaagacagtgtcatggcagaataaaggtggaatgaaattgaacgacgatgcgacaccattcacagtttcacagccaattgggataagtatctaattgtgcaatatgtaatggatcaacaatgctactaaagtttgactggatggcattttttataaatcaagccatgtgaacctaccaacttggcagtgtggatcaataacttatttgcaaggaaatgaaggaatgatgaagctgaatgttgaaggaagacctaacatgtggcaaaaacaagcagatgttgatggggggaaagaaagaactatagctgcactgcacaacatcatgatcatcaacgaaaaaaggaatttagcacacacatgaagcaaccccaagagatttacatatactcctccctaatctatctgatgtaacttaacatgctattatttgtttgtccacatcacataacagcaccaagcatgaaagaacttcatcactattacacgacaaagcttgaaaactctcaactcactcgttagctaactaggcataccagaggttgtgttcggctggaatcaaaagccaactccggtggcattgaggggcctatgccggtccttccagaagcaggcatcgggcgccagccgtgccgaggatcgcatcggctcggatttgcagcgcttcagaacaaacggtgcatatgttgcagcgccagtaaccagtggcagctctatcttgaacttctgctccgcagcttctttgagtggtgatttctgcacaaccggaggtggcatagacaccaagtttgctgatgcaggcgctacactctcttctgtgttcttagcatcactggttccttcagcattgtctgtatccttgagctcctccgctggagcggcattgcaaccagccttttgttggcggcggttgcggcggttctggccctggtaagacttccagtggacgaagtccgtgctgcagacccatgtctccttggagacctccatagagagcttaggctcatacatcatcaagaggaggcaatctggcaattcaccacttttctttcttctctgcttctgttcttcgaccacatcttgtgcctcaacacctccgacttctaccttctcacccttctcatcaacttgtgtctcttgtgttgttccttcttcctgtccatccaatgttgcttcttcctttccgtcgtcatgagattcaagagtttcctctgcactgtttggggcagcatgaacagcgcaatctttttccgactctggctcagatgaaattttctggccctttctggatcccatcagcaccttaggctctgcaacaagatgttcctgctcaatagagaagctccatctgcggccatccctgtcgatggagaaactagctctccttgagtccttcaagctcgagaagcttgaccgacgtgcttctgtctcggctgagaagctgtgccgccgcccaaccctgtcactgcccgatgaggccctactactgctacctacccgtctgcggctgctcaaccgtcgcagtttcctgtcctccttcagtgctgtcgatggggagcagcaattgcttgacctcctgcccttcatctcttgctcctctttctcaggtcctggaacagaaacttcttcctgagcttccgccacagtctccaccatctccagcaacggcaattggatatccctccctgtagcttctcctgacaaagctacctccaaaactgagtccttccgaacaattggtgcttcctctggctcaatcttctcttcatcctctctgcagtcaccgtactcgctcgcttcttcaccaagatctccgcattcagaggtctccactgcttccgtctccagtggatctacttgtcctgcttcacaaccatcatgtagggaaccatcacactcacggcatccagcttctttagtggaaaccgctgaatcacgagcttgctctttgcattccttatctgtgtcagcaccatcttcgtcttcctcatcctcttcctcctcttcgtcgtcgtcgttttcgttttcatccttgacattgtcaacctgactgacatttgccgctgcaggggagccccagaagcgagtggctaatgcagccatacgaacagggtccgacctgcagcgcatcagcagcagcgcgtttcgcggcgggatgcagacgctgaccctcccttcctcctccttcccaaccaccaagatctcgtccttcttctccacttccacctccccgactaccaccgtgctctcctcctcctccacgtcccacccttgcatcacgagaccgacctctgaagcctttacatcctcggccggcacgacggctgctcccttgccgatctcatcgtcttcctcctcctggatcgccaagaggcacctggccacggcggctccgcagagccagctcccgctggcaggcgggcgccgacgcttcttgtcggcggcagagagagagccgcgctcgccggcgccggcggcgcgagacggcgagcagagcgaccggccaccgcaggagccgaatgtcttgagcgcctcgcagatgttgactgggatctggtacacccagccctggttcttccccgcaggaccgtcccggtcgtctccggcgcggcggaagctggcctccgcgctaccgccgccgccgacacccccgcgcctggaccgcgagcgcagcgcggcggcggaggcgtgcttgggcttgcgctttcctcccttgacgcggacctggccgatgcaggtgaccttgggcgacgaggctcggctggctcgaacccgccccggccgcggcggccgccggaggaccccgaggggaacatgggggactgcccacctttcaggctcccgctgttgcggaggcgacggctgagggaggggtggagcggcggaaccggcgcgctgtcggcgccagcaacggcaccggctccgccgccggtgcggccggggctgagaagcttggaggagctggaagggcgcagggtggcgggcgcgccagaggatgcggaggcggtggaggggcgggaggtgaagcagatgaagagctcagtgccaccgccgccgccgccgccgccccggtccgagtgcttcttgcggcgcatgagggggggaggggatgtgaggcgtgtgacctcgctgtttttttctcctctctgtatttatgagaggagtgaggcgttgctgctgtggctggctgcgctagcgtgttagatgcggtggaggggaataaattagggtttgttggtggtggcgctggcagcggagagttggagaccggagaggagaggcgaggtgtgcgctgtgcgggaggaggagaggggaggtggtggaagatacagataatggtggtggtctcgggtgggtctgggtctggatggccatgggactgtgggaggcaggagcagcgcccgcgccacgctgggtttgtcctcctccggcttggcgatggaaagttaaaaggaaaaataatatatatacctatttttaacctttttaaaattaggcatcgttacattatcaagttttggtaattatagattaaatatgatattgtcaaattctttagacatgaccaatatatcgtaataaactaaacaccgccttaaattttgtcgattttaccaaacaatggtataatttaaaatggcatgaatctgaataggcccaaaatgtttttcccattttgtttcttttttctttttgtttttctttggaggactgatttgcccatagttttcggattgagatcatatacattactaagtcaaaaagaagtggacctatccatgaataattttttttttgcatatgcatcatgtcgcctatccaaaataaaaggttgaaatgtatgaacaaaaagttttcaaaataagttgttatgtatcccgtcgtctattcaagctttacttcactgcctccgctctggagccatcatcgagttatcgaaaatgcttacgatcggacgaccgatccagcgcaaactatcggacacttggacgatggacgcaccgtacaactcttttttcagattatgagccaacatgcatattgtctctttttcaataccaaaacctttctctcacataagatagcacacatactactcttgccctctctcccctacacatgcatgcattttttttaataagctttaaatgtttttttccaataatcatctatcaaatttgtgattcgattacaccattaattcattttaattaaatctgtataataagatatcacatgactatattctgatcgaaatattttatttttatttttttttgcaataaatgttttttaagtttttcacattattttatttatatatttcaataagtattcgattatcctacgcctcggtcgccgagggaggggaaaaatcggtcgctcccccctccccccatgacgcgcgtgcgcacgtgcgccctgggccccacgatgtgtcactgactacctactacgtgtctccaccacatactccgttgcaacaaattacccatatattttggaaactctctattaagggaattcgttttattttttttccaaaaaaaatgtttcacctagtgtactcacaatgtttcactatgtatatatctaatattgcagagaaccgaaatattcttttgcaacaaatcacccacatattttggaaaccctctattaagggaattcgtttcattttttgttccacaaaaaatgtttcacctagtgtactcacaatgtttcactatgtatagatctaatgttgcagtgaactgaaacattctttcgctatttgctgaaacattgttttcatgtaaggtgaaagaacgtccgatttaaacgattgaaacattttcgatctacttagtgaaacaatctcgatatacttagtggaacattgtgcaacatttcaaaagaaaatcaataataagcttaaaaaaattcgttggaatatatccacgtgtggtcttgttttaaagatttaattgcgataaatatagtgatataatcggatcatgcatcggataaatattttaggataaaaaatagtttagagttagtagattttcatactgcatgagggaagagagagcaactgtgatagtgtgtatgcatgactgcatgctgcagagagagcagagacctataactagagacagctagaaagcgcatttgcatgcggcatagaccatagagacagaaagactagtgcatgggcgtccgatttttcgctattcctcggacgtccgacgcgtagttatctcctcgagttatgacatcatattttgagttttgtagcatatatccataattatcatcttccccgacgtgacgttgatttcaaacctacctgacggccattgctattataccaagctgcagtcaggggatttggaacatgaaaaacatatcgcgtgatcgattgccccaggcgatcagtttccctccccccacgcagtttcccttgttagcaccgctttactttcctattttagtaagtttatacatctaaaatttgtgcacctaaagtttatacgtctgaagtttatatacctaaagtttatagatccaaagtttataagtcaaaagtttacatacccaattcaaatttgaatttgaattcaaatattttttatatatagtatttctatgcataaagtttatatgtactaagtttacggtataaagtctatacttatctatacataagtatagagtctatgaacataaataagagtattaaaaaaatttttctaacttatgttttcttattttttaaaaaatttatggtgtagtaggaagagaagaagagagggggaaggggagaggatgcgggctttcccgatcgcgcgccctcggcgcggcgcgggcgatcgatcgcgcattaggaagaccggaacaataatattttctcttctcgcatctcttcgatttgttctatatctttggaatgtaataatagcgtttgcaacatagattaaaacaaaaatagtctgcaaaatgtctaaaaatagttacgctaaatgagattatcttaatccatccaaaaaccaaattgaaccctcactattttgcttcaaaacctgatttgaccaaaacccaaccattcgccaacccaaaacccaaccgtctccctctgctcatcatactatgccgctaatccacaccataggtccacgttttctttttttttttttagtatttgttgcaatctgactagccactagcccactatacatcttcaaccagcgacaaacattattgagttcttctacatcatgttgctgacaaaagatccacgctcccatccgccctaacaccttgaaaatttcgattctaaaatatgaaagcgaaaatttgaaataattaaaaactttttccaaaatttcgtcatgctaatatttattaaatttcctttttcttttcctggttgtgccggtgcaaaaaaaaataataaataattccaaaggataatttaaaaaggaataaaattcaaacacattaaaataaccatgagtataaattaacatagattaagaaaatactttgcaataaaatcaaacaataactagttactaaaaccttcttttaactaaatcttttaagaaataagcttttcagcaaaagtataatttcgatccttcattggactggcctagcccaacaagacccaaaccctaatccttttaaactctataagtttaaattagttcccttaacttgttcctttttcctttcaaaaaagtacaccgaaggtcccttaacttgtcattgagctacaaaattgtcccccagtcgtaaaactagattatttgacatccctaacgtacaaaaccattcactttaagttcttcggtggttttaacaccgatttcgtccgacttggcggctgagtcagcataggacccacgtgggccccacatgtcaggatgccacgtcaacaccctttctcttccccctcctctcccttcctcctcctcctcctcctcctctctctctctctctctcacttttctcctctctaggcaagcaggccggtaggtggggaagaggtcgccgggacaagccaggagaggaggaggtggcgggcgatgaggcgatgatggcggtggctgcgacgcgggaggggaggctgccgtgccgaggtcagagtgtccctttctcctctctttctctctctctctctcactcttctcgtttggacagggcagctgacgggtggggaagaggctgattgtcagcgatgcaagataggaggtttggcggccgacgacgtgggggaggcggcagcagcgaggtgggagaaggggagggcgtcggtggcaagagcactggcggggagagtgaggacaatggggatgcaccgctgccatcgtccatgggcgcggatccccttgtgtatgccatcgaggtaggctactgccgctgccaccataggctagttggcgaggaggaggatgggaggggtcctcaggcaatcgtgtggctggccgccgtcggccaccatgctcctctccccaccttccaccaccgcactcaccggtgcaggcgctggctccagatccacgagctccctgtgggacgaagatggtgatgatgtgctcccaccgttctctttgctgtcccccgtgctcccgccgccgtcgctttcccctcctcccacgttgccggccgctggacctctttcccacctgccggctgacttgcccagagaggagaagagagagagagagagggagagagagagagagaaagagagagagagagagaggaggaggaggaggaggaggaagggagaggaggggaagagaaagagtgctaacgtggtatccttgcatgtggggcccacgtgggtcccacactgactcagccaccatgttggagaaaaccagggtgaaaatgtcacaccctgaagttctttccccaagcctaaattgaatttataaatcaccttgagaaaataccggagtcaaagcaagagaaaccctaatatattaatgctaataataatcggaattggcatgtgggatttttcttgagttctacatgtcgaaatatgctaacaagatttttattggaattttcagagctctagaaataattttaaccaattaaaaaggagcacaagcattatttaattccctggaaattcttttcctcctttttctctttttttcttttttcctctttttcttttcggaatgggccgccggcccattctctcctctctctccttcccgctgggccgaccgaaggccgaggcccagctgagccggccacccgagccctcctctctcccggggtcgccgacaggtggggcccacctgtcgggtcctcccccaacctccagccgccgccaccgcgccctgcaaccgccgccgcgtccatgctcccgcctcctccgggccacgtcagccacgcccgcgcatgctcccgcgtctcccgcacccactctccctctctcccgcccgcgcccgcgctcgagacagtcaggattcgattttcgaaacccgcctctctctcctctcccacttcccccacgtcggctggcgattcccgcctctcccggccacgtccgagctccctctcccctatttaagcatccccactctcccctctttctttttccccatttcgccaagctctcccgtgccctctaacgccctagtgccgtcgccctcctctccgccgccgccgccgccgccgctccggtcgccgctagccgccgtgccaagccacgccgttgacgccgtcgcgttcgccgtcgtgcgggccatctcgtccacccctcctccgttggaatccgccgccggaacccactccgcatcgtgcgtcggtgagcatcgccatggccgccgccttcggccagcgtcctcgccctctcccttttgcctctctccctctgttccctaggtggttccggacctcgtcccgccgtcgccatcgccctccgtcgctcaccgtcgtcgatcgtcgtcggtgaggcccctcctccccttctccctctctcccgcgccgcttagccgccgcgccgccgcctagccgcttagccgccgctatcgccgcccgcatcgccgcgacgccgtcgctctctgccgccggccggttgccgccggtcgccgcctcgcgtcgccactgcacgcgcgccgcgccgctgcgtgccatggccgccgggccggcttgagccgtgcccgcgcgcgccggccgcgagccgcatccgccgtccaatctaccggatggtagatcgaggccgtttgttcggccgcccatgtggctgccgcgtggccgccgcgtcggcgccacatcagcgccacgtggtgcgccgttcccattcccggtccgtggacccagtccactgcggaccgccacccgtgtcactgccatgtggggcccgcatgtcggcgccgcccatctctctccccgggatatatttattgcgcaataattcaattaaggatttttctgtttatagtaaaaacacagtgaatattctaaaattcatatttaattcatccgagctccgtttgagcccattcaagtatcagtaaatcaagaagtagaatccattaaaaatggttctgttctctgttttagtagtcttatagcctgtttgtattgtttgctttgtatgtcgcttagattccggctctcccgacgctccggtgtactttgagatagtcgccgaggttcctccagcagcagagcaaggcaagtcatgcttgtcacttgaacatgttgatcctatattgcaaacggtctattgttttccttcaaatactgcattgttttgcaataatactatgggatgtttacctactgttacagccatgctatttttggtaccttgctgctatttttggtaccttgctcctttgatagcttgggttataaacatgactagagattggattagggattgcttagccatgcttagttcaactagcacataatggggaaaatcatattaatgtatagactgtaggctctaatgttaatgttggattagtgccaccgcttcggtgttggttaattaaaataaatcacatggtgggctgtgggtgcatggttttgttggtcgcgcccatggcgtataaggaccggttcgcgggatgccctggaagaacttatcgtacttaccacaagccagcgtgggcaacggctgggcttgtagtgtagctttcctctagttaacgcatctaggcaagggtgggcgtgatggagcggggcgggccctgcgacggcctctgtcgcttctggattcacctaggcacgagaggggactgcccgttgcccgctggggacgggggtgaaacctgaggtgtggtgtgcttggctagagggggttatgcgaagggtcctgtcatggcctctttccggtatgtcgtggtggcatgtcggtgcacggaaacgtgtcgtggggctgtgtcttgtgggtacagttgtacacctctgatcagagtaaaactattcgaatagccgtgcccgcggttatgggcggtcaaccagattcaccgtgattagtctcaccctagtgtagtctgatggaaccgattagttcaggtggttggttgggcctgttgcaacgtggtgtagtgttgaacagtggatggttaatattgattaattattacaattattttaccgctttcaactactctttataaatgctcgtgttatgcaaaagcacctctcttgctatcctttggtaatatcctgcatcatacccccgttccggtatgacttgctgagtacagtgggtagtactcagtcttgctctattttccccaacccaagagttggagtatgcgttagatggtggtttctccgaggagtaggcttcgtccgtgccgtcgaggatgcctgtggagtggtgttcccgctgccgttcaagtcaaggcttagctccagttatcttttgtttttccgctgcatttatgtaagacttttataatgtttgtaagacgtggatctgtatgtcaactttgtcgtttgtgtaccccggccggtcctggacggggattttaatgcacattctgcttggaattctattcgggaatttcttggcgtgacagaaaaccactaaaggacctaaagtgaacggttctaaaagtagtgggatgtcatatatatatggtttttgattaggggacgattttgtaactcgatgacaagttgagcgaacttcggtgtactttttcctagccctgtcccaattattttctccttccgacctagcccactgctcaccagccgaaccctcctgcagccctagccagcttgctcaatgggtcgggcaaactgagccgagccgttggcctcggcttgttccccttcaccttgatggcgacctgccgccgcccaatccaccagagtccaggctggcctgtccgccaacaagctcatcgacagaatccattgtacctgccgctcctcgccacaattagaaatcgcagcgcattaaaaaccggcacctttgaggctacataggtatccattcatcaaaatggcatcccacgagtgtgcgctctggcgggaaaaaacactataggtgttctttctagtattttcggcatctatagtgccatctttttttatgttatgttgtagtgacagctacatgaatgtattttgtcctttcttggcctatttggtctatgtggacagtgattgggccagtacgcctatcaaaacctacttttgctttctccctacgctctagccacccctaaaggcttataatcttaccgtgccatgactctttcacagtttcactgtcctgtaaccttcgacagccctttgtcatcttgcacacttcaccatagcccacaggcatggctttgcatactcccgccactcttcgctagtgctcaattgcttctactattatggccaaggccttgtgaccttcgtgttagagtatatggataagatcgtattgtatccggtttgttatggtaggataggattagtttccatctctatctctttgagtttacttaagatacaatccatgtactcctatatatatcggcccctgaggctcgatacaatgtgcgatctgaggacgtggtcaacctccataaaatccacgtcctgccgtcgccaacctcgtccacgtcggccatcccccgtcggttccccgtagcctgcctccgtgccatgcacctcgccgtcgttgcccgagatcaccgcacaggaccacgacgtggtcaacctccataaaatccacgtcctgccgtcgccaacctcgtccacgtcggccatcccccgtcggttccccacagcctgcctccgtgccatgcacctcgccgtcgctgcccgagatccccgcacaggaccacctccacccgctgtcggcgccatctccatcaagttccaccgtcgtcgccatggtcgttgcggcatcgtcggcgcggcacagggtacggggggacccatccctgccggctcctcctccgcggcggccgccgccgcctagggagctcgtggccgccgccgccacctacgcccgcaggccaccggttcaccatcgacaccccttccgttgacgccccctcacgggatctggaggtcgtcgtcgttgcaattgatgctatctggccaagcaatggcctcgccatcgtcacctctccgcccgaggaccgccatcctctgcatcccaggtcgtctccgcccattcctcgtcgtcctcctccggccaccgacactaccatctcctcctcggactactcctgacgtgagctcgcatcagcctcgaccatccactggttgtcgccgctgtggtgggccacctcccggcgtcccctgttagccaacacacctggagtccctgcgctgtcaccggactgtgaggtcctctcctccatcgacctagagaccggcctgccgaactcctctctctctctgtttctctcgttgagagcagggaaaggtggggatgaggttgtttgactaaaggtctatggacttggtgtatggaccatcgaggtggaccagctgcacaggtgctgctagcctgctaccgtggactactgctgctgctgtaccttttctttttctcccgatcagagatcgggtttgtgttgcctaccgcctcatcaacatctacgtgactccgacatcggcatttactttgtcgtcctaccccacgcatcatcggcttgaggacccgttcaagcgctcggctacgacgataccttgccgccgatcatctttgactacgcgtctgcgctatcaaacttcgggttgccggcttgccgctgcgtcaccccctcgggccacagtgtcgccgcgcctggtccacctccactagttgttggaatgctgagaggcgccctcctcagcgtggcctcaccaccagtggagttctcgccgctgcattgacatcgagccacacctatgtcgccccttcgggtcatagcgttgtcgctcttgtcgtcttcatcgtcgactgcgtatcgacatcctcgttgtctgcactggtcatcttcagccgttgggttcttctttgtctacttcgagaatcactgctgcatctccgggatgccactgttgccattctaggctggtggttcagccgcccctacttcggctaccaacatcgtcgtccaggtcattggtcccactccatcgccttctacttcgtccgtcatgattcattgccagtgtcgctgtatcttcctcgactacacttcgctcttctctggcaactgcgtgttgctccggcaattattcctctacgccgttctcgcgccgcaaccgtcttggaggccttctctactagtcctctccgacattggcgtatgattcatggtggtcccctatctcgcctgtgcggtattggcaacactggtgcgcacgttcgtcccaagttgtcccggggtctggcaaaccctgtgtgatgtctcgtccttcacggttcgattacatcggctcttcagcatcatcatcctcaatgactgccacgatcgtgtcaccttcatcttcttcagcgcgtcctcgctcacgactactctacagcgccccaagcacgccttgccgctcggctacctcgacatcagcttccccacttcggctacattgaccacggctactctacgcacggcttcatcgaccacggctccctcgcatccttcgcttcagctacatcggcaatagaaaaaagggctatccaagtgtccgcattgctcacgcttgggctagggggggaggggttgttagagtacatagataatatcgtattatatccgatttgatatggtaggataggattagtttccatctctatctctctaagtttacttaagatccaattcatgcactcctatatatatcggcccttggggctcaatgcaatgtgtcaatatttgctgcattcctctctccctatactatccaacactgcctccaacatgagatgtttcctatttattttaatttggaaacatttattggatagtatttttctttgtctagattaaatattttcgaagtctatttgtgtgaccgatttctgaggtctattctctctctttcatacaaattttggttcagtccattccctcctaaatgtatctaaagtcgacaaatatatcctgtcatagtgttctttgggttttatatctattttcctttgtactttccatttatttgtttttgtttcattgtatgtatgtttgtgcttcagagcttcaagaagcagattttgttcatggatttgaggaggctagttgggcttacttttatgtagcacatactttttgttcaaattatttcgtacttataaaactagatatccatatgattttagatcacttatttattggttataccctgaatcatggtaaccattggttcatctatcatgatcacgtctgatcaacatgggctaggtgagagtagctcgtcctgttgaatcatatctcatgaacgatgaagtagattctcatgtcaagaagtactagtatatgttaccagcattatatttctgaaaggtttgatcacgatttgcaggagaaacagactgaaacaaatgaacaggaatgggccaagggaattttgtcacgcccagaaattcacgaacgagaatttcaagcagaatgtgtaataaaaacccctgtctaggaccagccagggtacacaattgacaaagttgatacacatatccacgtcttacaaaaatatgaataaatcttacatatgcaatggaatttaaataatcgagctaactagccaattgagctctcaggtaagcgtagcatctcgaaatccacaacatcctcgatgacagcaacatacctacccctccaagtaatcaccatccgtataatactctgcttctgaggattaggggaaataaagcaagactgagtactacctgtttacacccaaatttggcacttagggataaaataggagaaattgccaaagtttggaagtctgccggttttcctctgtggggccggtctgaccgccgtgtgtgggccggtcagaccggctgtatgtggccggtctgaccggcagagtcctagtccaggtctgtttcgccgggtctcgaagtttccttactcgggaaggcatgtttcgggtttcctttggattctatcccgagttggacgtgaagagggcctgtagagggcaagaccaacctctatataagggacatggccggttcaattgtaactaacaaatctacaatcaatcaatcgaatcgtttttcatattgcttttagttttctcttagtttgtccatctttgtcgatttgcgccgtaaatcatccgttgtcgctacgagagtgcgacacctctttgtaggttgtcctgaaaaccttccgttttacccatgagacgggtagttatctagaatcggctccgctagccggtttatttatcaaaaaccatcttggtttagcttttgctagatcgaggtggttggtgactctaggatcatcgcaaggcgttaggtgctgcgatcgtgcttgtcaacttgtcataaaaagttaccaacacgatttttggtgactccactagggaaatctgctcaacgtcatctcaacttcgacttcgccatgacgaagcccccgtcatccaaggcggaggtggaaccgtccaatgtgataccaattacattggaggagctcgatagggaagcgcgcaagtccatggaggagtaccttaaggaggtcacacatgaggcattgatgagggcgtgcactaggactcgtcaaagtgtgatcgtcaagcctggaccgcgcattaagcctaatttcaatgtggtaagttctaaagaggtatcacaatctatctaacaacaaattgcatctacaatagattcatctatagctacattgaatactaagttaaatgcatctattgagaatcatgttgaaggatttttgaggactaaattcagccctctcatggccgattttatgttcaaagataaagcctctaccagtgctagccaagcccctatagatcaaataagtagtaaaaccgatggggcgaagacacaacaaaccggtgaggggtggacggcgcatatagccggtctgatcgggctagatggccggtcagaccgcgacttcgccgccggtcagactggccagatggccggtcagaccgggtattaccccagcggtcagaccggtcctcatattggtctgaccgtgcctctggacgccggtcagaccggcgcaatcatcccaatacagggggtagatccaatgacaaacaatgcgtatttgtatcatcttagaacatttgatccccctgtatctaaaggcactactagttcccaaatccccccccacatgttcccaatgcttacaatgatgtttccagggggtatcctcccgatactaggcaaggccaatataattatattgcgccgcaaccacaacctattaggccaccaaatccaccaccaaaccaacataggcctgataatatggaggaattgattagtgggatcattatggataaattcgggattgaagctaggaatcgtgctaaggtttaccaaaagccgtatcctgaccaccatatcctcgtggttatagagttcccggatttaccaagtttagtggtgaggatagtaggaccacatgggagcatgtaggtcaattcttagtgcaatgtggagaggctagtagttccgatacttttaaattgcgcttgttttctttatctttgtccggtactgcttttacatggtttacttctttaccggcaaattctattcatacttcggctcaattagaacaaagatttcatgattagttctatactggtgaaactgagcttaggttatctgatttaacatcggttaagcaaaagtataatgaatctgtcattgattatgttaagagatttagggatgttagaaactgatgttatagcttgaatataactgatagagatttggctgatcttgcttttaatggtttaattgctcctattaaagaaagattagatggccaacaatttcttgatgttagtcaactcatgcaaaaggctctagctcaggaaagccgggttaaggatagtaaaatatttgttagaccatatgaggagaagcctaatgttaattcaattgattaccctgaggctagtgatagtgatggtgagagtgatcatgatatgtatgttgttgagtgttcatggacaaacaaaaataagccttttgtttgttctaatttaattctgactcctcggaaatatcggcaaagtgaggttaggtgtagttttgatgtggccaaatgtaacaacatttttgactatcttttgcaaggaaaacaaattagattacctaaaggccatgtcataccatctcaagaagaattgaagcgtcgagcttattgtaaatggcatgattctcattctcactctactaatgattgcaatgtgtttcgacgacaggttcaatcggccatagatgaaggacgattgaagtttaccgatggttccaagatgaagcttaatcatgatccttttccggtgaacacaattaattttgatgataagaaggtattgattcggccggctggagcaagccgaatctgctatggggaaaggagtgatcattggagagcctaggccaaagatgatggtgctaaagaatccggaggttggtgtctggaaggagaataggagtgaagcttctagttctaaagttcctaaaaagactaaggtgaccttcgatatgcttttggataaacatgagaagtaaggtggtgagaaggcttgtaataaaggaaaaagaccaagatcatctcctagggaatgatttggtcattcaccaagatggttggaatcatctacatatcatcgtcctcaagacatgtcatggggaccttacccaatgccgccgccgggttatcattatccttactacatgccatggggggcaacactgccaatgttcaatcacatgcctccaatgcaatacagccaaggatggggaggaccaaggaggctagttcatgagcgtttgtcttcaccaaacaatggccagttttatggtaagaaccgggccaatgaagaaaagagggaaggaaagcgcgttaaagtggagactaggacttcggaggtgattaccatcaaagtggggtctcatgatgcgccaataccttctggagatgaagttggagagtcttcaagcaacaaatccgaagccgggaccagctcatcacagtcggccggtctgaccgcagccctacagccggtctgaccgggccatctggccggtctgaccgtcggcctaacatcggtctgaccggtccatctggccggtctgaccgacgacccaatgtcggtttgaccggcgcttctggccggtttgaccaatggtctaagtccggtctgaccgggcttcagcgctggatcgataggagatttgcaaagagttgtgcggggggcttcatcatcttcgagtagactcaacagggggcattatttacctcctagaacagagccgaaacagaggtagattcctaaggatttaacggctactcaaatgaggaggttgcaacatcttcgggcccaagaattaagagaaagagaggtcaaagagcgaagggatagaaggttcaatgagttgcgaccaccgcctacaaagttgtggaggcgtaagtccatagacattgaagaatcggttgttgtagaggagaaggaagaacaatcggttgttaaagatgagtcatctccaaaggaagacatggatatcaacatggtatgtatgttacctatggagttttgcgctatggatgaagccgaagttgctcaattttcactaggtactaaagatgtggtttttgagaagcccgatgagtcaaaccgtcatatgaagcctctatatctcaaaggtcatattgatgggaagccggtctctaggatgctagtggatggaggtgccgccatgaatttgatgccatactcgttgttcgagaagttggggcgtggagatgatgagttgaagaagatcaatatgattctcaatggcttcaatggtgaaccaacggaagcgaagggtatcttttcggtggagcttaccgtgggaaacaaggcgctaccaaccgctttcttcatcgtcgatgtgcaaggtaactacaatgttattttgggtcattgttggatccatgccaattgttgtgtgccttataccttgcatcaatgtttaattcaatgggatggcgatgatgttgaaattgttcaagcggatacatcggctgaagttgcaatggccgatgctacttttgagtggcgtcatgggaatattcaatgcttgtcggggatggatctttctagctatgatttcattagtatctccaatggcaactttgtacctatttctgtaaagccggctagtttagcacggctaggccatataaatttatgtaatgagtaaagaagctaatttagagtggagggtgcaagaatatcgatctacagagaacgatattggtgaagctattgaagattttgatgaagtagagaagcttggtcaagggtttacatcggctgatccgttggaagaggttggcatatgtgatggaactaagccaaggccgacttttgtaaacaaaaatatgagagccgattataaggtgaaaataatcgagctacttaaggagtatgtggattgcttcgcatgggagtatcatgagatgccgggtcttagccgtgagcttgttgagcataggcttccaattaagccgggttttaggccttataaacaaccacctcgtcgtttaactcctttgctatatgaccgagtcaaagaggagattgatcggttattgaaggcggggtttattatgccatgtcgttatgtggagtgggtgtctagtatagtcccggtggagaagaaggggggtgggaagattagagtttgcatagactttagagatttgaataaagctactcccaaagatgaatatcctatgcctatagccaacatgatgatcaatgatgcattaggtcattatttctgatactagaagagccggtgcttgattttaaatctttgtgcgaaattggcaaaattgcagaccaggggcggtctgaccgtgattgcacggccggtctgaccggtgaccaggggcggtccgaccggccacatgccgccggtctgaccggccgtgcacggccggtctgaccggttctggacagagcgctggggggcacgccgcaattgattcaaaggctaaattaattgtaaattcggacatttgtgcccaagaaacagaagaagattggaggattcctttgattagatatttgaaagacactgcacttaaggttgattgaagaattcggcggcaagcgttcaaatatacattgcttgatggagatttatatcactaaaatatagatggagttctattgaagtgtttagatgatgatgaa

SEQ ID NO: 59687 - DNA, 710 bp, Oryza sativa
gggatggccatgcccgacgccaccttcatgtggtgagaggttatttattagtaatcaacatatataagcagcaacaagcggaatggccaaatctaaaatctataaactacgagcttacctttattgataagttcttgaaggggatatgcagctcacatggtgtccgctgagtgatgtcatcaacggggcaggtggttttgtcctgggtttgcatggcgtccatgctctgtgatcctacctgccctgttgaggcgcaactgctacgatttcctgacgggctcaccattgcaggaggaatggtcggctggggatcattggaccgatgtgcggccatgcgttcatcaaccttccttgccacctcctcttgcatgctgagctcgtagctcgataccctgaactcaagatctgcaatcttcgcctcggtatctctcttgctcctcatccgactcctgtatgtgtggatgtcctccttgaacccaatattccaaggaatcacccatttccctcatgttcgtcctggatgctctggagtctgcagggcgagtgacagctcgtccttctctctgtccggtcggaacgtgccctgagaagagcttccactgcgtctgttaatcaacgcgcagcctcgcgtatctgatcgccgaagaccagggagccatctgctgggttgagcgttccaccgtgagcatagtaccagaacttcgatcgtt

SEQ ID NO: 59688 - DNA, 1008 bp, Oryza sativa
attcctgcagccctatccctaggagcacatccgaaagactgggccgatatattttgaaattaacgaagtcatcgcgggcgtctcgctgtcggtgagtacgtcacctaccactaaaataataattagccataaatataaacacccacactactaggaaaatcattttcccaagaggccaaaaatattttttccaggcgggagaaatgaccgcttgtaagcaaaggcttacgaaaatagatgatttttacagacgttagatccacccacctgcaaaaatattttcagcgaacaaaaaaaatccgccgccaccacccctacctgccggcgctggcgccggcgctagcctccccatctggcccttccccctccgaccgatggctctcctcctccgtccgccgctgctgccggctggctcgcctcttccgtccagatctaggaggggatggggcgacgctctctgcggtggccgccgccgtcggctcctcccccgccactgtcgcctccaccgctggtagacggatctgggaggaagggagggaggattggagcgccgctgccaccaccccttctcgtcgccaagctgctgctagccctccttgtcgctgctgtcaccgggccaggagagggaggagctgaaccaccgcctcacctccttgttgtgaccgacgcctccactcctcatcattgagccaccgccatcggctggagagggagcagccgagccgctgcctcacctcctcgtcgccgcggcctcccctccccctcccctagaccggtcgctggcggatccgtgtgcccggggcgagccagtagtggatctaggaggagtcattgtcatcgtcgtagctggcggcgagaccaaggtgtccgcgtcgtcgtcgtcgtcgcagccagtggtgaacctccttggagccgccgacgctcctcagccgatgtgtgatgagagagagaagggggcggaaaatgagtggtggagaggataaggatggtgaaggagaagataaggat

SEQ ID NO: 59689 - DNA, 8698 bp, Oryza sativa
ctacgtgggtatgaaggagtattccatgaactaacaacaatcttgatagagtggcatctattactgatgttgattttgttctctgttgcttctgatgatttattttgtccccttgctgaacttgatctcagtcccatgtacattgaatcttgtctagaatcccggcttgattcgtccgatggttttatgtggtacatttatcggaacacgaatcagcacatgcatgtgcaccaaattcctggcttcattcatcgacctcaagaactatccacggtcttaggaaccattgccgcaagaagtaatttagagtgaattccgtcttcattctttcataagatggcatttcctctattatgattatggatcgacagatctactctcaggaaagcgtggattgatcgtttttatgtacttgacgcgtctttcagtctgtcaattaattcacttcataattgatgccgtttctctcacccccactgtttctagcacttgatgattaatacattatccaaattatttcttattttttattaatacatgatccaaattatttcttttttttctcataaagcaatatcacctttgttttgcttttgaatgaccaatctatattgtctccttcctttttgttttttcttttatgaagccaactcaccttaattttactttttgaaatattatcaccttagtttttttaaatgattaatcaaaagatgcaaattatttaaggctatatcgtctagctatcttaaaatttgtttatactattatcatacaaaactcaaacaacaccacgtgcggggttttatttagttggacataacttgcacacggagaaagatcatgcaaacttatatgtgaatagaaataacgctattaccatcttttttttaaaaaaaaactgacaattgagtcttagaaaatccaacataatggcatgacaatggaaaatgaacaaaactaacgtttgaggtatcaaaattcaaatgtagctaagaagtgaagaaaatgagaaacgaacatgctttgtggtaaaagattttcctaagaaaaaagcaagaagaggaggtaattattttttttatttgtgcaaaattcagttataaccattaattaattctaaggccttttttttcaagcttgttcatgatgtcagtgcaatagattatttgctctagagctctaaatatatgttttctcaaagaaaaattattttacttacattatttagactatttggtttaagcttttctttcaattttgtttcctaaaatatttaatttatccgtataataagtatataatcagcataaatagtttaccaataatttatttccaccatactaaaatatagcaaatattggattagacacaacgtacttgattattatatctaattcattactagttggcatattttggtacggatagagaaaataaaaatagctgaaatttatcatctttgagcgtatgtaagtgttgtagtataaataaatttattttgcccgtcggtttttggatgaagcaaataaactccctccctctccctccctccctccgtatacccaaatatataaactaggatttgtatttgtttcacatgattgaatacattaatgtcgaagctttaagaaacgggaagagactagtaattgagaatatactagagcatgcactaaacagcacaaatctggaggggaatggatgtctgcagttggatagggtcgtcgcaataatgaaaatagtgacaaaaattcctctaatcatatcgatcgatggatgatgctggatcactgccacgtctgcactgcacgcccacatgcgtgtgtacacctccgcaccacacaactctgacttttcgtctctcttctcttccttaatttcttcctagagtatacgtatgtctagatcatgcatgtatacatatatacgtagtagaagatcgctgtacacgctatcacgctgacgctggtgagtcagatcgcgatgtatacacgtgctcatatgagtattaggcgtggactagggatggcaacgggggcgggttgggctagaactcctccgaccccgacccccgacttcacctcccgcccccggccctgactatggatgcgggatgaaaacatcacccgcccctgaccctgcggggccccgcaaacccgaccggggccccgcatttggtagcatctctatccaatcagctcaaaaaatacaacacaattatcatttcagcaaaaacaaatattgtgcatagttaacacaccatcaaaaatagcatgaatacttaaatatcatcataaaaattcagccaaggaattagctgtaagtttacattacctattatatgggttttttggctttctttgacctatactttaaagtttatatgtacccccgggccccacgggtcacccgcgggtgaaattagtcccccgtcccctccccgcccaaatgcggggctccatacccgacgcacccgtgggtcgaaaatctcctccgcccccgtcctacccccgtaggggcgggtccccgcaggggactcggccccgcgggggaaattgtcatccctagtgtggacccactaaggcatgctgtggcgtgtgccccccaccccagcttcctgtaggtgttttgtagctcctatgaggagaagttgaataggtgttagattattttcgattcattgtgtcacatttttttaattagatatggggatatattctaacccatctcagttgttacaacttacaaatattctcttaacaagtgtctaaaatttaactttttaaatatttaatcaataatattttattacaaattaagttttatttgataaaataatttcattgtattaacatttaaatttacttttatatatgattttaatttttacatttgaagggtcttataataacatgtatagcatatctatcctatccaaattttaccacctatcaaatagtaatatcaaggcgactgtacctcccaaatctctcgttcaagctctctattagagaaaaagatagaccatccaaactgctatacaataaataccgttcggacgaaatgataccggagaaaaagatagaccatccaaactgctatacaataaataccgttcggacagaatgataccggttaagtatcaggacttaatacctattaagtatcagggcatttaaccagtatcatcatgtcatgatacttaattggtatcaggcaatttctgccaggtatcaggtaatacttacccattggtacttgatgttgatacctgttaataccacctgatactcgtcgataccagagcgcaatacctgccagatatcatgtgtttcttactaggtatcaggagctaggcaccgagacatcgtcactgctagccttgtcctccacatcgagcccgtcctccgctgtccaagccccatgccgaggctcgacgccggcgaccgaatcttccgctgtcatgccccacgccagggctggtcgccggtggccgcgtcttccatcgtacacgcccacgccgaggctcgttagtcccatgctagaactcatcacccgtggcgccgcatatcttctccggtgatgtgctccccgacgaagcagtgaggcgaggcagcgggggccttctccagtgagctcccttctctcccttcttcttctgctgttgcatgcccgatgccagcgttgctccgttgccgcatgcctgtgcttgtgctctggggaatgagggagacggataccgtcgcaggtgctaggcgtgagataccggtatctagcttttccaaattgctaatccggaaatactatataacagtctcccgtccgaacatggcgactgaataatcatctacttaaacatcttatccatatcagtataccaagtatttggtcttatcctatccctgtatttcttcttcccctcccccccttcccccctctcaccctcatggctcatcagcggtgagcaccatgtggtcatcggtccgtgtggtcaacagcgacttgtgctgttgtggaaaaccaactcaacttgaggtggagaaatcgcaggggccattcttgaggctttttcgaggtggtggcaaatcggattggcgagctttttattagttttccgtgtggtttttaagcattttttaaggtgatttctcaggctagttttgctcattgatttgagttagctagtcatattgaaggactttgcgtgctttttcctacgcttgattgtttgtttttaggggcaatggaatatgtaggaattttctggctataggggtagtttgttgttattttttattagatttttcctagaattgaaattatttctattgattttccttgagttttctcttgatacattgtgttttacgtgtagttggctagttgcttacgcaggtagagaaaagagaagggtttattgaagtatacctttctaactatatcttgtactacctccgttttaggttacaagactttctagcattgctcatatttatatagatgttaatgaatctaggcagatatatatgattcattaacatatatatgaatgtggataatgctagaaaatatctagatttattttaatatatatataaatgtagacaatagtagaaaatagtataacttcttgaacatatatgatcacgtaaaagagcaatcgtccatcagtgcttccaatttttcttccagacgtttcttcttttttctttttttttttgtgggggtggggtggggggggggggggttcaaacaaattaagccgaaagaaacctttttttttattttaagaaacaaaatctcttcagatgatgatctaaacatgagcagcaggcggtacattggaaggaggagaagcatggtgaggcggcggcgcaggtggtggtgatgaagcaggggggaggggcatgtggcggcagagagggcaggtgttgtggttggcgagccaccggtagatgcattccttgtggaactcgtgcctgcacgccaccagcgtgcagcacctctccccctcctccaactcccccaggcatatgctgcactccgacgattcatcccgctgccggcgatggtgcgtgtggtccggcagccagatcttcggatcgggcggcggcgcaccggcatgtcgacgttggcgatcgacacagcagaggaggacgacgcacacggcgtacagggtgctgccggcgagggctcctgtgagcaaggagaacccgaacgcctgccagatgggcagctctttcaagaacagcatcgcgcaactatatcttgatatttctgttttttccaattccacttgaattgtgttcgttctgcgccgcccatgcatatatgcgtaataatgtgttgcaagcatcaaacagttattattatatgttgcaccctttatatatatgcagatccaaaaatagtagcatcagtgtattttaggtatctgtgtgcacaatatatggatctcttgttagctcggacttgatttttaatccttttgagatgagataaaaatattgttatgatccagcagtccatgcatacatacaagaaagaaatggatcaactacgatattattattgcctgttgattggatctttaattaatcgccggagaaaaaaaaagatcgatctgtgatgtgagatgctctggtccatgtatgaggaggcgaagcaagggtcgccgtggctgtggcgcaggacaggaggacggtcacgtgtcagaaacggatttactttttgctaatccaattcagagtcgatgatcgatccatcgacatatacgtacgtacgtacacaagaaaatcgagacatatcgatcgactcgagtgtgtgcagtgcatggacgcggaggatttcatggacagctggctcatgtggggcaacatctttttcttcttcctcgccctcgccatcaccgtggaggtcgatctcatccgcctccgccgcaacgacgacggcaataacaagtcggcgcaccagtacgacatgctgatcgagaggctgctgctgctacgacctaaagacgaccaagacaacgagcagtgcgtcatctgtctgtcggagaacgaggacgatgtcgacggcggcggcggcgagcgggggagagggaggatgctgccggggtgcgcgcacgcgtttcacaaggattgcgtcgtcaagtggctgcgcaaccgcacaacatgcccgctctgccgttctgacgtcgccgtcgccgccgccgccgccgcagataacatggtctgacgctatctcagatttcactaactatctctcacctccgtcttaaaataaattaacctagaaacagtagaaacagtagatagtatcttatccaatcatactttgatttattttgagacggagagagaagtactaactcatttgattgagagcatatatatatatatatatatatatatatatatatatgcatctgacctctatacgtatgtccagtcagtgcttatgtatgctgctagtatttttatacaagtatattttgagatgtataattgatagatgtatttcatgcaagagtatattgagatgtatagctgacatttttctatttttagaaaagatatgtaattaattgtttggaagcttcggaagtttggttacatacacttaattactgtattattatgacaactagcagaatggcccgcgcaaagcatccatagataatcatctattttttacattattttctttaaaattgtcaatagtcatagcgttgttttggaattttttttaaaaaacccaaccttatcttcatcgagtttttttttcaacttataaaagttagaccaactatcaccccttgctcctttgccgcttcgtcacggcttttattcatcctcattgggacctttaagaaattaggcctatcattttctcattggttccttttatagtattttaaagtcttaaagaaaacacggtcaccctactcctttatggctgcccgctatcccatgccctttattattttcattgggattttaaaaattaaacccaatcattgtcggggttcatttttttactttctaaatgtcccgtttgtgaacctgctactttacgatctactcgttgccctcccctttatcattattggggttctaaaatcgttattgaaattctgttttatagtttttagatgtcccatcaacatgtcactctactccaatatggctcacctgccaccccctctttattgtcatttgctgcccctctgctcgctctcccatgccaatcaccatctccgtactcctttgtcgcctatcgactcgttagcccgtgtcgtctctcttcttcgttgttgtcgctacctaacaaaatcaaaatttattgtcgacgtgattaggttagatatcccgccaactattgttgatatacctccttccctatcttactcgttttacacctatcgaatcacccattcatagctcctaatattcgttactttagcagctcgccctctcgccaccctagcaggacttagcccaatgtgtatttttaattgtcaatcttcgattttatcattttggtaatcaaaatagattacataagtactgtaattcttacggaactcttcatttatctgttttcttaatctacagtcttaaaatctagtagatataaaaaaataaatgtaattcttacagaactcttcatttatctggttttcttaatctacaatcttaaaatctagtttcatcattttcaataaaccaaagtgaacattggtacttgttttaggtcctatatatccatcacaacagcccacttcgtttgcttaaatatttttatttagaatttcaattatttctagattatattattactttaaatttcatttttttaaagtttatttataattagtttgaaccaaatttcagaatttattttatttttattcagaattttagttactcttacttttggatatttatatattgcattatactatgtacaattcttcatatgcggcatttactttttaaaaatttttatgttattttttttcctaattttagtgatgttttaattttatttggagttagaattaataatattcttttataatttttttaattatgaattttaattaatcttgtgttgggttctatgtgaaatgttcttccaaaattccttatactttattccgaacattttattatttctaaattgtattcctatttgaactctcatttttatttttctaatttcagaatttattttattttttattccgaaatttaatactcgtgttatgttctaaatgatctcttctttcaatagtccttaattattattttaaattgattatttctaagcctctaaagtgaccatggtatcttatttttgagttattttgaactgcatgtctttaaaatgtatggttcatggattattgctttgagttaggacatgttatttattaacactcttcgctttttaactaaccaaaatcatgtaaaaaataaaaatggaagtatttctttaaaaataaaaattgacaaatataggctttgtagtatttacgattagaaacttgaaagcaaaagcgaaccatctatatgaaccacacgtatatttgaaaagtagcatgtgctagtcaataaaaactttttgtaattatattagtgaatgaataggattacggctagtcacttttagattgaagggctgcaggaat

SEQ ID NO: 59690 - DNA, 1656 bp, Oryza sativa
  unsure (1)..(1656): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctctatagaaaacacatactacaataaataagagaaaatttcatgagcatgagaaaacttcatgttgaagaaactatgagtgtgtgataggcaaggtggccattctaacataacaaatggttccatttcaaaacctaggacaatatattggacaataaaactaaatactagactctctttcttgaaagcaacccatagtatttgacaaacactttgatttaacaatggaaagtgaacattttgtgtacacttttagaaagcatgtgcttaattactcaataggtgttataatacattaatactatggatgttaatataattaaaacaatatttaggaccatggtagtatgatacacttaaaaatatgatgatatccaaatattgcatttataaacaagatcttaactggcagccttatttctttcttggtgtaggagatgaatcctatttttatatattcttttcactgacttgtaatacactactatgtaaatactatactcttaaattaagagaagaacaaacatgtactcacttttagttatacacatagggagaactacagtacttcacattcttttcttgatctcttaaaaaaggaagctctataaagaaagtaaagctaaggataaggataaaaagaaagtactatgatgaatagcttggaagaacctagtatatgctaatattagttgaattgaaaacaactattaaaacaagaataaaatgttgcattaatagtcaaaggctgagacaaagcacataagcatactctagaatatacgaaacttttaggaaatctgaaaaattttcaatacaacttctatgttaaaaaaattatatattgtgttttcttttaattgtgtagtactagtagtcggagtaaggagaagcaaaacatgaggagggagcgacacaaaattaaccagaggaaagaaagcaaaaatggcaaagaaggaagaaaaaagaaaagggaagaagaagaagagacgctggcagcagctgcgtcgagacgctttatcccttgcctcgcgagaacagaaaaaagaaaaaaaaagaagaggaagaggggaaggcaatccgaaaggaaattaggctagggttttcgccatggctaccacccaccacctcgagctccccctctccattcccaatctctccgactcctcctaattaatcccgtattcccaccccccaagccaaggacagcatctcgcatccgcgtccttcaattgatttgattgggttccccccctccatttcagggtttcgtttcgcatcgcagcaatcttcccgacccagcaagcttcttcttcccttgggtccgttagggtttgagattgagaggggcggcgctggcgatcg

SEQ ID NO: 59691 - DNA, 2713 bp, Oryza sativa
gccgctccgcccgcctccgcgaggagcgccgcgcccacgccctccagctccacaagctccgcaagaccgccacccgccgctgccgcaactgcaacaacccctaccgcgaccagaaccccggcggcggcaagttcatgtgctcctactgcggccatgtctccaagcgccccgtcctcgacctcggccctgccgggaccctccccaccggctggccctgcacccaggattggccaaatgctgccggtgaccctgcctactggctcgacctccgctgctcctccgataacctgtactcggggttctcgtggcgcttgttctcttccttctgcgtcagcatgaggtggttctggagggaagtgctcagatttggctcctcgggggacggcgatggcttgggccgagatggtaaaagattagcaaaagaaggggagaacggagcaaaggctgaggagagcagagtcgagaaggcgaaaaggaaggcggaggagaagaggttggcgaggctggagaaggaaatgctagaggaggaggaacgcaagcaacgggaggagatggcaaagctcgtggaggagcggaggaggctaagggatgagaaagcagaggctgaagagagatccaaaggcgccacacctgttggggagaaggatcctcggaaggaagtggaacgtagacggcaggagaggaggaggaaggacgagaaggataagggatcaagcaagagcaattcagattgcgaggatatcgagagaagagtaaccagggaaggggagagaaagcgggattctgatagaagaaatgagccagagaagcgggatgcaacaagagttggcgctgagggtcataagccctataattttgatgctaacaaccagggtagtaagacagtacagagcaaggcaaagtactttggccgtatgacaggcggtctattatcttcttcaagaggttttggtggcggctccttttttggtagaagtgctcagacctctgctcctcaagttaacaaggtgactaaaccgcttgttactgtaactgaccagagtaatgtagtcaaaagagatacccaacctcctgcaacagccaaatctgctactgctggaggaacgacaaattcatggactaatgttcatcgacctgtgagtaacaaaggcattattaattgctgcagcagtctatctgttacgattacgacatatgtcattaattgttttcaccctgactatcgtcttacaaataccatttgcatttttgttatgcttttatgcaggttagtccaaatgtgcagtcacagcctactggccttaaaaagtcatggcaccagctgtttagtcgctcagcatctgtgtcaccttgtcctgatgttcctgctgcagcccgtgaaatgaacgggcaaccagaaccatatggagcacaaattagcaatgctcaaatcttcctatcgcagtatccccctctggacagtaaccctagttcaagccgctgtatgcaatttccaggttttccaccagtgaatggagcacctgccaacatgtcactctctcattttccagctggacatgtgccctactattgtgagccagaaccaacagtgtttgaagaaccagaacaatttgaggacccatgctatgatcctgatgcaattgcgttgcttgggccagtttcagagtccctagataactttcctctcgacttggatagcgggttcatctctagtgacatcaccaaggaaacacatacgaagccttcaccaatcgaatctcctctttcaagatcacgtacattcgaggataatcctattaggcactcaactggaaaagggcctaatggttctattttgcctgaggctagcaatgaacaggggggcacatggcaaatgtggggcacgccattagttcaagaaagtttaggtctacgaggtcctcagactgagtggctcctaccaaacgcaaatcaatttaaccatggtgtcagtcatttgaatggtggaacaagaagctcagtgggttctggtttggatgacaatgatttatggctgcagaaagcgcctttccagcaaatgcctcttgatacaaggagtctgttcctttcacatgatgtctcagagaatgctatacacaacaatttggattttggatcaccaaacaaatcagcccgtttgcaccccattgggccacctggtcattcttggtccaagtaagtatgttgtgacattcttgtaccgctttcagtattttctgcagcaatgaagcatttgcttccattatagacaacaattcgataaccttggtttgagctagaaacatggtcataacttacaacagaattaccctaccccacactttgattatgtgagcataattttcatttaggtcataaaaaatcattacgaatgtagcttcgtgtatcaatacacataaggaccaaatgagatcaaattcacagagtattcttacaaggaataatcatatgccataggggactcctaaatttcttttgtcataatgactaggatgggtgctaccactttatctataaaaaatggggcaagagtgataccagttaagagcaaacaatacactctgagtctccaatttagaaggaatcaagggagcaaatacataaatttccataatagcaatttttgcccccaaaagctggggaccatggcccagtttgaccatgccttgcagtggttgcatccttatatggatgg

SEQ ID NO: 59692 - DNA, 894 bp, Oryza sativa
ccggcggcgagcgcggtgacatgcgggcaggtggtgagcatgctggcaccgtgcatcatgtacgcgacggggagggtgtccgcccccaccggcggctgctgcgacggggtcaggaccctcaattctgctgccgccaccaccgccgaccgccagaccacctgcgcctgcctcaagcagcagaccagcgccatgggcggcctgaggcccgacctcgtcgccggcatcccctccaagtgcgacgtcaacatcccctacgccatcagcccttccaccgactgctccaggtaattcatttgccatcaataacggttttgatctgtacgttattagctgcagcttaattaaccattgttaatctgcctatgtatttgtgcgttaattcgcacgcagggtgcactgatgagcggatcaacgtcgacaagtgatgcgacaataataaaggagagatcgatccatcgatctccagctctcatttcgcggttgctatgtgcatgcgccgtcgtcaatgatcgagctagaaatatatatgcatgttgctccttcgttgtgttacttcctgcttacctgctgcggtttgatagttagctagtgtgagagactgtgagggttgattttggggcagacgaatcatgaatctcagaggaccttgtaccactgcacgcttcaatatatatccatcaaatgcagggtcttttaataatgcatcttgtcaattagtatttcagttcattagctggatctgcatataatgctcctccagattctggcatgttttcatttatacctgttgggctggagccccttcggccgcgtgcagcctataaatctgggctggcctggaacgggaatggggctcaagcgcggcccgttatgtgtgtcgtgcgacccatgttg

SEQ ID NO: 59693 - DNA, 2857 bp, Oryza sativa
gccctttgaactggtcaaactctaatactgattgctcagtatatctcggtaatctataatagatgcatgggcacaaaactcggtaagggtgaaaaaggcattatattagttagcactaacctccaggctttccaatattgacaagattaacatagaagcatgaatatggtctggtataacacactttccttaatttgtcatattcctttttcatataaggatttttctatgacttgaggaagtaaataacaatacaattaattcttgaacatgcaaaacagtatgaagcaaaatacaatctacatatggaattttgcacattttatcatgaaaataatttctcactgtagtttatcttatcaaaagaagtaacacagagcatgagagatgcaccgctaattgtgcctcctgcaaggaagaaagttagtagagctaatcgtttgatagtatcttttagagaattttattactatgtatgtaattctatactaagtaattctgcaatatttttcatgcacaaatcctccttatcttcagtctctcatatactcaatcctgaaacaaggagggcaaagatggctacctcctcaatcactctgaaagctttcaaaaatttgatgaagctactctaaaacttcagtctgaagacctgaaacaccaaaaacaattgatagtttgactccgaattgatttgtgaaactattctaaactcaattgcgtaaattactaaattggatcaaatacaggattggttacagggcattgagtaaaactactgaaacatttgcaaactcaaaattgtaatcataaaacctaaacagatgcataaaccattcagtaaagaacgcaaggcaagcttaattaacctttgcccgtgctgtcgcagtaatttgttgcatgcccagtattgatccagtccaaaccatttctccatgtactcatctaggcttgcatgctctgtggcaaccggaattcactaataaactggtaaattgttcctttagagtttagacaatacatcgaaagtgcttgcacattactaatgcacgacattttacatattcaggtgtcatgaataaaaatgtaaaccggaaaaattgtcactgcatgcacaaatcagaactttccgtgtgtgtgcaagcatgccattcattaatatatgcaaagacaaacttaaacgacacaaggtaaactacagtatgaatacaagtggttcaatagagcacaattccagaattgaggtaaattctcattatgtatataaccttcggtacacatcacagaataatgtatacaacggaaagtaaaagaagctctcaatattggcatcatgatttagataattaaattcttctttttaatttggatgtcaatttggatggtgatctctaaagagagcacacaacatgtgtatcaatttaattggtttcctgggctatgttgctgaccaagcaattaatgaagttcaaaagaaattctctgaattttcatatataaacatcccaataatgacttaccttgttgcagtgcgaggccgatgccggggttgagaaatccgaccgcggggacttggaatgtcggactcacacacggccggaggaaggggctggtgccgggatcgaccacgaaaatcgggcggcaacacttaggccagatcggagcaaggagggaggagcgccaaaaatcaaatggaagacatcaaacccaaaaatcggttgtgatctgtcgacgaatctggcttgtcggtccttactgatctgtctcttgatcccaatccccatctctctaattctttttgttcgctctaattctttttgttcgtcctttgagcaatagggatttggtgacggccgcaagagggatgcagtagggggaggaggagcgacggcgacgatgtgaaggcagtacggcgaggaggaggggatggaggcgccggagaggcggtgcgacgattagggtttgggaggcgcgccggttgggcgaaggagggagcgagcgggttttggggagagaacacacacgcgggggaggaggagtgatctagaccgttagatgatcgggagatattctggtccgttggatttgatgaatgagtaatgtaggtataagagtgagttggtgaattatagggtagactattgtccacacttgatgatatgacattgacatatgcatgcaggaaatgcaaacactatatgtaaaccgtaatagcatatacttcctccgtcccctaatataagggattttgatattttacttgtactgtttgaccactcgtcttattcaaaatatttgtgcaaatataaaaacgaaaaattatgtttaaagtactttcgataataaagtaagacacaaataaaataaataataatttaaaaaaaaattgaataagacgaatggtcaaacagtataaataaaatgttaaaattccttatattagcggacatagggagtactaatatataaactctctctggatggctggatgcatgtgccatgaatttatcctaaattagggtactgcaaattaaagttggcaagtagtaaatgaaacaattcaacaaccaccaactcatgatcaaaagtcatatgtacaattaacaaaaagcacacggtgttttaattttagctttccaccgccctgcacatgtaactgcacgtgtaaggtatcaactgatgtgtcggacactcggactcgatcggaagtcctcttttctctaggattgaaacactgcgcttcttcaaaaattaccgggaagcacataaacgatttcactaattactctctaggatgaaaaccaactccaacttaatataggcctatcatcgatatgatctccggctgggctgcaggaat

SEQ ID NO: 59694 - DNA, 10558 bp, Oryza sativa
  unsure (1)..(10558): unsure at all n locations
atgttaccgagagattcttgaaagttacatacaagttacattatagttacagtgtaattacatgcaagttacagtgtaattacactacgattgtactgtaattacatctgacaaatattagggggagaaatttgatgacaaatatctagcaaaatcgaataggaatattgtttgcacgcttggttggagcgacagactgaaggaaaagttcactttatgagtcccagtttcattcccgttgacattttttcgtggccaacacaagatccccagtattaaaatccattcgctcggcggtttggatgacgattttatcaaatgtaaagtgtttactagatctacataaggatgaattctagatgctcgctctggaacattttttttttttttgaaaaataaccaccggagggagagattctccgcctgaattatattgaaaagaggaagggggttacaatcaacatgatgtcaacaactttcgtagttaatcagcagccttcgatctccaacactccgcgaggatgcaagcaggaagctcggctatatgtgctgagcgcctcaaacaagaagatatatatagggctgtagctctccgttggcaagatgtattttctatttttcttcctccttttaaccctgcaatctgtactgagcttccttgtaaaaccttcacaaccttgacttgtaaaaaaattactcagtagctaaatttaattaagtaactaactttagcttttataacataaaaaagaataagatgatacctaaatttgttttgcaatctgtaatctatataattaatatagacattgaacacctctccgaacaggtacaatagtagactactaagcaagctataaacacatatcgagaacataaatgagaagagaaaagagcaaagtgttatagatttatagccagctgtagcacaaactataagactcaatgtgtgtatgataggtgggaccagatattactagtttataggtaactattgtatgaattagctattaaattaactatagatgatttagagttagtagttgactatactctatagttggctatagattattcggagctagtagttggaagaagtccatctacggagtgaaaagacacaacataacagtggtagccatatcccttggcgatgacatccggcacttagtcgctgagccactccggtcgggcgcctgccaaacaacgctcctgtattgggcgggcctcgagtgctgagatggcatggttcagcgccattttccttagcactgatctgcttagtccatggctcggctctcaacgctagctgtaatggcgctgagctctgactactcagcgccatttttgctggcgctgagatccggccctggttccagcaatccatccattcacagattccagcaatccgtccatccattcacaagcaggttcacaagcagcaagcagccaacacaagcagttcacaagccggttcattaacaagttcacaagcatccatctattcacaagttcacatccacacacagccaacatacacatccatccatccattcacaagtttacaagccgcaagtagcaagcacagaacacatccatccatccatctatatatccacaacacacataggcaacacacatccagcacacatccatccaacacacatccatccatccatcacacatccattcacaaagttcacagaatataggttcacaagttcacaaaatataggttcataggttcacaagatcacaactaaagaggctatcgactgtgacacctacttcttcctaccccttggagcacgaggttgatcgggagtgtacctccagttgaaacatgagctatcttgtgttgtggtcgagatggcccctgcaacgactgtggagcgtcctacagctaggagggaccgagctccacttgctcctcctcttcctcctcctctctttcttcctcctcctctccctcttgtacaccctcttgagccactcctcgacttgtcccctgctcagcccgtcgaggtggttcgaaggcatcgtcggccctgcatcccagacatgccgccaacttctgcatcgctgtcatagagtctagcaccaacagaaggaagcagttagttccaattatgtgtgcggtgcacgaattttacaaatctacctgtaatgcattccgaagaatgctgctctcttgttgcgagctagggggcatgccaagtgccacgcccgcatcgttgactgtcctgatcagctcccgtgtctgtaggagaagttataagcacgaagtacagaaattggaaaacgagtaaatagaacccatactcaccactttgtctcgaaccggacccatcccgaccgtgctacctctatgggtacttgtatcgtacttgttctgctcctccacctcaatcaggtcatccagtatgtcggttagcgtccaagccagacgtagggcactgcggtagttcctcgcgagccaggctaagtacgcgtcgaactcttacctgttgtgcatcgcgttatccggcatgcggttggcttcgaactggttccatcgatcgatgtgtgtctgatgataagcagtccaatcggtggtcttcttgtttttccttctgtccaccctacacgcaagacatagtaatatgcaattttttaatgacaaatgtgtaaataggaccgactagatgaattatccaagaattgaacctgatttctacgtatggttatcggaggcaactggacttacttatgaagttcgatacttgtagagaatctttgcgggatcgttggcgctgagggtgggcatctcagcgctgaagcggttggcgctgaggttgggcaacacagtgccgaagcgattggcgctgaggttcttgccacgtcggcaggggggtcggctcggccgccacgctggcacgaggtcagcgtcaggtccagtggcgctgctatttacaacctcagcgctgagccgacggaaatagttgaagtttttggcagtggctagtttcgaaataagttttttaaaaagatcaatttgtcaaaaaaaaaatggtgaagtccattcgcggagtgaaaagacgcaagataacagtggtggcaattaagaaggttgttcctgagcatgcaaacaaagatggatggatcacatgcgtgcattcacgcacgtatcgacagatcccgagggtcccaatacgcaaccaccggctggtacatatgcatatgcatgcacgctctatactattagctaaacacagtagatcatctcccatctccggccggccggccgatctggaagtttcctatcgctaaccagctaagctaacctaattaacccggccttaatttctttcttctccacctccatctatcgctagctatttataccacccctcctcgacagctttgctcactccagtactccaccacaagctctagcttacagctcactaccagtgtacattgttgctagttagctagagctagatctcgatcgagacaatggcgggtgctcgcaggacgatggcgctggttgcgttggtggcggtggtggcggcggcggtggtggcggagagggcgtcggcggcggtgagctgcggcgacgtgacgtcgtcgatcgcgccgtgcctgtcgtacgtgatggggagggagagctcgccgtcgtcgtcgtgctgcagcggggtgaggaccctcaacggcaaggcctcgtcgtcggccgaccgccgcaccgcctgcagctgcctcaagaacatggcctcctccttcaggaacctcaacatgggcaacgccgcctccatccccagcaaatgcggcgtctccgtcgccttccccatcagcacctccgtcgactgctccaagtattctacattttctctctctctatcttcatttgctccatccatgtgttggcctaattaagctaatttcctctttccttttttatgcaggatcaactaattactagcttgatcatctccagctgagatcgatatgtatgggaagatctagagagtgactgttcactgctagctttgtttattttcttgctgcatgcgtacgtgcactatataatgtaataatgcgtttcaatgtttacatgtagtgtactatgtacactacttatatatttttcatatataataatctaataatgataataatgtcgtactgatacatgcgtacacacacttgaacttgctgtgccccgtttttttacttcaataagtaatagtatatggatggaatgatatgagctgttattaatttgaaaaaatgccaaatggaattctggaatataatgatggatcagtgacgaggctccatgcgaccacgtagtgatgaacgtacttccgtacatacgttttttatgggccggcagcacaccatgcctgaaaactgaaagaaaaaaaaacgtaatgcagacatgcatatatggcccatcaattcatttcttggatcctagcccattaaacaatccaaagggagaaggaaaaagtgcactgaaggtccctcaacttgtcatcgagttacaaaatcatcctccaaccacaaaaccagatatataacatctctcaattaacaaaaccgggtcactttagatcctctagcggttttaaccccggttttatcctacgtggcagctgagtcagcatgggacccacgtgaaccccgcatgtcagggtgaccacgtcatcacacaccatctctctctctctttctcagtttctcccctcttctcgtcttgaagacctgggcaagctcctggaggacatccgcttcttggtcgccgccagcggcggcggcgctcgctccggcgcgacatcggccgcatcgtccgatccctccagacgcggcggggcggtggcggtgcgacggttccacggccactgcagaccccgctgaggtgaaccgctgatgcccacgccgtcagtgaagcggtagggcggccttctcctcgtccgacgataggggtgtccggcgccgcgggtgggggcgacgaggcagggttcttggagcagcggaggaggcggtgggtgccccagctgaggttggggaacgagaagcggtgaagccacgtgcgcgacagcgacggcgtcctcgctctccctgtcccctacccgccaggccccgacgcggcacgatggcagcggctgctcggtcgccgccttgcatgactgcgcaggtccggggatgtcgcatggacggccatccgcacggcgtcgatgacctccgcggcgccgctcgggccgggggacttcaagcttgtgcgacgcatcggcggccgcgacatcgggtgtaacaccctacctccaaaatccgcattagtccgctctacacgttgagcggacccacgtttgcatggtatcccgcttacactttcgtcctcgcttcgtgtaaaagggttaacccggggataccatggttggagcaccaaggcttataagcaggccctcacccacctaaacttccaaggtggtactaaaccaccactatacaaccacttctgggccacatgggccaaatacacactactaggcttcaaacgggctggggtgttacatcgggacggtgtacctgtgccgcctccggagctcaccggcatccgcggcagtgagggagagctgtgcctgtacgcgatgaaggtggtggaccggtgggcggtggcgaggaagcagaagctagagcgtgcggcggcaaagaagcggatcttgcggcagctcgaccaccccttcttcctccaccctcttcgccgacttcgacgccacgactcacttctcctgtgtcgtcatggagttttgcgccggcggcgacctccactctctcatccaccgcatgccatcccgccgcttcccgctccctccgcccacttctacgcagccgaggtgctcctcgccatcaagtacctccacatgataggcgacatcgacgacgagcaggatgacacggctggcggtggcgcgtcctgcttcccagaccacctcctccagttcaagcggcggcggcggcgcctctgcggttcgtggccgagccggtgaaggcgaggtcgtgctcgtttgtcgggacgcacgactcacgaatatgtcgcccccaaggtggcgagcggcgacgcacatggcaccgccgtggagtcgtgcaaggcggcgttcgcaacgccgccacgaagccggcctgcccagagtccagagtccagagagaagagagagagaggaggaggaggaaaggagaggctggcctacttacgtagcagcttgacatgtggggcccacatgggtcccaccctgactcaaccgccacgtcggacaaaaccgggatcaaaaccaccgagggacctagtttgcactggttttgtaagttgtgggatgcgctgtatctggttttgcggttgagggactattttgtaactcgatgacaagttgagggaccttcggtgtactttttccaagggagaatgctctatatccttttacctccttttgccaggcccatgccacacaaaatttgattagttaatcagaaaaaaaggggtaaaatggaaaaaaagaagaagaaaagaacaaaacaaagaactattgtacacagttcaatgggatgtttattgtaagtagtagtcctcacataagtttgtgtatacccactccccttctctcgccttaattattatgaaaaaaaaactactctcacctttatgtgatacattagttctgtatagcaggctcttcatttgtcccctctactccccactccatagttattaagaccggaccggagaattaaccagtcgagctctcggttcactagtctggtggttcgaccattggttaggccggtccaaccgcggtttaatgtacaatatagcgcaaatgctgggtaccttcaagagtgtaaagataaagtgtgtggtagtggatgctattctcagcgatgccacccaaggtccattttttatgtagtttgctcagtgggctaaggcttttgatggagtttgctcattgggcctcgcatcagcccatcaacaaaagcgtagtagcttgttaccctgtctgaccacttcggttcaaagccgggtttatataaanatcgcccggttcaatgggttttccccggtttaaggggactggaccggccgaggtcttaccactccggttcaaagctcggtttatataaaaactgcacgattcaatgggtctccccggttcaattgcgcagtcgatcttttaaggggaccagaccgaccgaggccatggttagggtttttcccggtcggaccgccagtccggtcctaataactatgccccactctttcctcttaatgtgaaagaatatttttgtcaccaagatttatattctttttatgttcataaacaagggatacttcttttttcatcgtaagaggatgaggtggcctctcaaaaaaaaagagcgggtgtggggaaggggagttacaagataatttttatactctagaaaggttgagagtaatcttttttttcgtcaggaggttagagagtgccaaagaggagggtaggaacgagagggacaggaggggtccgaggggagtttggagagtgtaggacaaaaccaatgcttgtgagagtatattttttttacatcacgagggaaagggagggaagagggataggtgggcaactatgaggctcaatgtgttatttaccgctaaaataaaacttatcgctttttttatttctccccttatttttcttatctacttgtgttctattcattgacctgggtcctagttggctagctagcattttgtaataaatctatcatatatttattgagtttcaacccaataaaaagattaaaggacttgtttgggatggaaaaaaaaccctagcccatatattcgtaaggacatcccaagaatttatttcaatttactggtgcacctcaaatcataatttcaactctcatcgtttgatatatagctaatagccgtaaaaaaaaagaacagagcaactaaaataatttacaggataaaacttgtatatccatgttggcaatttaaaacacaatggcaaaaaacaaaccaagatagaggaaacctgaaaatcaactctcgaattatggttgaaaattcaaatttttgatgtggttgataagccaatttgcaaacgcgcggtgataatattgtaaacgctacaaactgatagttaaggtccttgtgttcgggtggctgcctaggttctgtcgttgacatctccactgcaaatagccattgatgtcacgaaaaattggtcgaccactggaaaacattattagtcatccagacttcatgataacgctctttctcttgtgatagaacctttttatcttggttcaagccatagtataggcacatatgcttgtttcttttagatttaatctcttgagagaatatatatatatatactctacctacatatacagatacgttcaacagtaaaacgtgtgcccaccgaagttatgtgagttaggcctctaatcttatttatcatatgctagtgagcgtgtgacgtccaattcttttttttcaaactctctgtattaggcctagtttagttcccaactttttcttcaaacttccaacttttccatcacatcaaaactttctacacacataaacttctaacttttccatcacatcattccaatttcaatcaaacttctaattttgacgtgaactaagcacacccttatttcaaagggaatagtgctctatcatacaagcctgatgaaaacaccaaggttgtgtttagttcacactaaaattaaaagtttggttaaaattggaacgatgtggcggaaaagttagaagtttgtgtatgcaggaaaattttgatgtgatgaaaaaattaaaaatttgaagaaatattttgaaactaacacgggccaagatgaaccgatggtagccctctttaatttgtctaacgtctacatagaaagttggccatgggttgctgtaggtggcatcatgatatgcattaatacctaggaggaggagtaacggttggcaggtagatcgatacgagaatgacatgaacataatggatcgtcggcttcaatttggaagccacctgctggcgaccgacagccgtcccggccgggagggataacctacgtcaacgataaataaatactcctactaactggagtagctagcagcttggtcttgtgaaaaagaaagataaaattctactactccatagtgtacgtggtcttatctagagcttaattggattgcaaaatagcatacagctgattgattaaaaactacgttaaacttagtaactgaaaattcttagatttaattaattgatcgatctgctgagagctttgcattgtggagcacatgccaagccagctagtacatttttgtgataagaaacatgaagtttcggtttaacctcttaaatacatgcatgcatggttgatacaatacacgtcctgaacatgaataaatactactaaatatatgttatccgaattttatcatataatatatttggattagtttcttaatatgacttttattcttttatcccaattgtatatcaatctcttgtgcactaacactggtggagaagtgttttttagtcccgttttataacccccttagtcccggtttttaaaccgggactaccaattcgagactaaagatcgctatctttagttccgggtgaaaaaaccgggactaaagatcgatctttagtcccggttggtgttatcaaccaggactaaagagagggtagcggcggtccagctggtcctttttttcttttttattttctcccgaatcgagtggtatgcatatcgtcaaatcaaaccccaaatccacatcacaactccacagcacgattcacaaattcatcacaaattcattcacaatatccattcacaatatcacaaatatattcacaatattgattcacaggttcattgacaacatcgagtcacatactcattcacaacatcccagattcattcacaacatcgattcatagattcattcacagatcaaaacatccaaaccacaaataaaaaaaacaaaaaaaatcgactcaccgggcggcctccaatcccgtcgccggccggccacccatctcgccgcttcccctccggccggatctgggggaggggagggcgaggccgcaggcgactggcctccatcccgccggcccgcgccgggccgccgctggccggcttccatcccgctggcccacgcccggccgccgtcggctgcctctgcaagggggaggggaggaggagagggggtgagagaagagcaaggggaggatggaaggagaagaaaaagagataagcatggagagatgttgcgcatgcacatgattcagagagagaagcgtgggctggtgcatgcgctttcttcccggttggtgttaccaaccgggactaaagatccgggggcctgacaaggtatgataggtttagaaccgatatcaaatatatccgctgtagccaccaaccgggactaaatctttagtcccggtttttagtggaaccgagactattgtaaatttcggtcgaccgattaaagatg

SEQ ID NO: 59695 - DNA, 11909 bp, Oryza sativa
gctgatatgatggcacttggatccaaacatcatgaatgcgctcaactacttgcatgttccaagtgtacaacatgcatgctagctgctacaaacgactagctctgttaggccgctgctaatcattttctcatcactaatactaacactgtgtgactagctagctaaaccagccctaacaaccaaccaccctgattcaattgaattgaattgaataacattagacgcaccgacgactaagtgcagtcccaaccctccacctaaaatggtgtctatatatggcattaactaaattgtcatgtatgacttttaacttatgtggcactatattaatatattaattaagaaggagagtgaagagaggaagaaactgggtctcatgcaagacacagcttcaacacgagaatctatgcactagacactatcaagttttgcattggaagagaatagtgtctttataatagttgaagaataaatatgattggtagagaagagagatgatgtatttattaatggcccactttaagaaatcatgggttgtggagtgtagtttttattgtgatgtcttattgacatgacaccatagacactgcttatggacattatgggttggaactgccctaagaacggtgcctaaacactagcactccaagcttaattacactatgtgtacgccaattagaaaatgtcatgaaacattctataaacaaattagatatttactcctaatagtattatacatatctggaaagtctcatactcaaatttaatatattttagctgtaacataaagtgaaaaaacccgacagttttaagggtaaaaatgtcaggattttatctttcttgttatggctaaaatataatgaaactaaagataagatttcacatataggtgtaaaactattggaagtatgtgtctaattttttctagaacttttgtggcatttgctaattgatatgtatagtgtgtacataagtaaagcttctgtgtataggatatgttctctaattataattataggtggactatatattccacgtagtaactacatttgacttggtcgatgcatcggcacagatgaaatcatagctacttaaagccccctacattcccgggaattctcatcgatcgatctcacctgcagcagcaaacgagcaccacacaccagcagcagcagcaagtcgatcgatcgtcagcacacacgaccaagatcgagatggcccgtgcacagctggtgttggtcgccctcgtggcagcggctctgctcctggcgggcccacacaccaccatggccgccatcagctgcggccaggtcaactccgccgtgtcgccctgcctcagctacgcccgcggcggctccggcccgtcggcggcctgctgcagcggcgtcaggagcctcaactccgccgccagcaccaccgccgaccgccgcaccgcctgcaactgcctcaagaacgtggccggcagcatcagcggcctcaacgccggcaatgccgccagcatcccctccaagtgcggcgtcagcatcccctacaccatcagcccctccatcgactgctccaggtaatcaaattttatatcgttttgcatgatcgatcatctaattaactaagtacatataaattaatttgtgcgtgtacgtttaattgcagcgtgaactaatctgatcgatcgatcgctaccggccggagggtgtgacatcgcaggccgtacatgcacctgtcgtcgtctcacgctttgtatcttgtgttatctgtgtttatgctgaataaaatgagagctagctagctaggtcgatcgatcgatcgccatgcatgacgagactagctagcattgctgctagatcgatgcatgcatatggttgatcgcccggtcactacgctatctgtttccttaatttattcgtcgatcgactacgtacgtacctgagagctagagatcagtttttgtaccatgcatatgcatatgaacttctgcatgtacatgcagtactacttgtactacgtgcgtgtacgttgtggattatacattatatagacagcttcttttggtatacatatacatgttctacaccgattcctccatcttcctggcattacacatatatacaaacttgggtaaaaaaacagtactgtgttaatttgtcttgaaatatgtatactctaataatcaattaataaattactccctccatcccaaaatatataagcatttttaaaatagcgtcaagtcaaatatttttaactttgattattaatagcaaaaaatcaataatgtaaaattgatattactagatttatcattaaacaaactgtcgtaatatgcaactcttttcatttaaaatatgttgagtttaagaggagaagaaaagagaagattgagaagatacgcaacatgaggtgtgtcattagcgcatgattaattgagtattaactattttagtagtgtaaaacacaccgtttagtagtgtaaaaaaacacaccgctaacgagacaaactttctctctttcacatgttgtcgaaagcagccctactttaacaaatattgttagtcaaagtagcatcgttaagacaatgtcgaagtacaacaatacttatatttttggatggaattattaatatagtcaaagccgcactttgaaagactattgaaaggggtaaaactatgacaacacttaattaagttgttcaacgaatacaatgttggagtattgtattaattagatagccaacagatatcttgcaatcatctgaccaagctttatatctctaccccgcaaaaaaaaaagaaagaagatatgtccagttataacttacctcacacattttataggctcgcagagtgtgagaatgattatcctatctgctgcataataaaaagatgcttatttttctagacctttagagtgaatatgataactttttcaatttactcttattcttttgatataatataatgtttgaaaagatggatggacgatatatatacaggcaggccggtgtactactatatatagttcctaaagtttcttgttcttcatttgaatcggatgcactgcaggccggccttgtttcatttctcctggcgaagatgcccttggcccaaatacacgtcaaaataatctcaaatatggaaaagaagctatgccatgcataaatatttatccatttggatcatactccctccatcccacaaaatatcaattccaatcccaagaagaaagtagtggagagtaaaaatgaccaaaatacctcttattgttgcaaaaggcagtagtagtgataggtaggtaaaaggtatttaagggataaaacttctcattttatgcgttgagagtaggtaggatgatagaagttgatttctttgggacaaaatttaaactctagaagataagttttatttggatagagggagtatatacaagggaaagggcttcatggcccatacatccttacttatccactactacagaagcactaatcggtgccagttgagaaacccccttaggtgccggttttcccaaccagcaccacggaggcggcattgattactcgggtcaaaaccgacacctttgaggcatacacgagccaaaaaaaaaacggcttgatgtatcgagccgtcaagctgatcccaaataataaccaaatcccaaaattgtgtcaaatccatgaacacgtgaactaaattgcgtcaaatccatgaacacatgaactatagtaaaaaaatccctagaaaaacaatacatctagatcaaataatacacatctagatcacatcaacatgaacaaatcacaaagagggaggagaagagatggatccgtggccgccaacatcgtcgcacctccagccggctctctcctaccgccgcatgccgcctcccgccgctgggccgcccctccgggctgccactgggtcatcgtctccactcttgccatgtaacatcctgaaaatccctaataataaaaatcactaaaatttcaaactttttaaaacttttgcatcatgctggatgttatggttgctattgcttgccaaactataaattgtcacgattgaagattaagctaaagccgtacaactaagaagtaattagaataagataattattattaatcctataaatatttgtgtacatgatagcaagccaaataaaacacaagtcaattattaataattacaaattgtatgttaaatacttgaaccatatcgacaagtgtcatgacatctaagtaaccacgaagtagtcaccactacaatgattttatatatataggagtgttccactagaataattaaattaatatttataactttcatcgagtctctcatgggatgaattcactcatgtaaaataatttgtcatgcaaataaattgaactttatatataaaatatgtttatgtgagtgtttaattaaacatttaggtcaatactgtaccaagtatcaatttacttttatggaataatagattaaacgtgtccttgtaaaatacattgttatacaaataaactcgactaatgtgctattgtattattaaggtcacattagaatatttaattagtttttaataaatatcaaagcttataggttatattggataatttttggataatttaatggaaagcaaattcatttgggaactaatgaataaccaaataaatattcaaatcaaacatttgaattctcaaaaccaaaatatattgattacatttcaattcaaattcaatcccattcacttttgcagattagcccctccctttccttcctttccctttttcttccttttctctcttttctcagccgctactattcactgtccgccaaccgttcgatcccgtctaccgcgtgcaccacatcgcttccggccgtgccagtcacgcccgtgctgcaccgcaaccgcgcctccttcccctcagccgcgtccgaccccaaccctagccgcaccgcacttgccgctccgcaaccgcatcgcgttgtatcgcgccatgcgtcgcatcgcgccggacccacgcccgcgcccgcgtcgtcccttccgtgccgcgtcgtgccagggcccgcgccacgccaagccgcacctctaaccgctctcctggattctctccaggaaacacggagctgcgccatcgcccatgtgcgcgcgtcgccgtcgccacgcttgccttcatcacccagacacgcgcgtcccatcgcccctatccatgcccaatggataaaacggagccctctcctccagctagcacccagacctgcagtctataggttataggtgtgatgattaagccacagaaccttaatggagaaggagatgaatctcagccgcgtcatccacctcattgctcttatccgatcaccattagtactctagctcgcctaggcatgtgctggtgatcttatccccatagtttgcttgcatcctaagcgaagccctcaacaaaatccccatccctctcagccttcttctcgtatgcatttcatcgaacaccttgcaatcaccctctcaccaccgctagagatcaccattgtgaggctccccggccggagctggaggttggagggagtggaggaagagccgtgctgccgccgtcgccatgggggaagccaggtagccgctggacatcaagaaacgccgtcgagcaccttacatcgccgctgtctgcccctgtcctgcaccgcgtcgagctccacttcgccgcgtttcgccatctcgccgtctcgcggtacaccctcgcgcccgtagcgtcctccatacatctaattgctagcgccggctccaaaatcggcgattagcgcccatggccgtgccgccccggccgccgtttcgtcgccggcgagctctccgtgggtaggctatcccggcagctcccctctccatatagttcgtgaaatcgaatccccataccccgtagatgctcccgcacccttcaattcggccggaggatgtccctagcaccgaagccccttgtagccgagctcgggcatggcgtcgcctgatggcgccgcgcgcccccgtctcctcgcgcgccggctgccatcggcgggagatcgccggagctcctccgcgcctcaccccggccctcgccgagccgcccgccgccgtcccggctcgggccggccacgccggctgcgccgagtcacgcctctgcctcgctcggtaacgggcgagaggaagaagaagatgaggagagagagaaaccatgtgggacccacatgtcattagcgcacagtaatcctatccctaacggtgattatcccactcaatggcaggtggggtccctatagttaaaatctaagaaaacacaattatatattttattcctatgacaggcgggacccaatggtaattaaacaagcaggtttgaccctaagtcaaccagggccggtcccacatgtcaaccacagtgggttttggataatgtttccgattaaaaataaatcatttatgaacagtgcatttttacaatttctcggattaactcaaatttgaatctttaaattagtataacttattcattttagctccgattcgagtgaaacttgaacctaaattcatctaaattcataagctttccaatggtatataactcactatttaataaaatatattaatatcaaatgattagattatggtcaacttaaaaatgtgctaataaataaaattgatattgtacagtagagtagagtagatgtcaaataaatatatttaacatgttttttcactgtagcaaccacataaactaagtataagtgatgtctcaaatgaatggatgtataggaaaatactagtgcttatttaatattcgatggccatataattaaattcatgacttaaaaattagttacataaagtttagctttatattttgtaactaaaatattaatactcatagatgaatctttaacttgtttatgagaaataataacagagctagtgtgattaaatcacctatacgaaattaattacttaacgtcatgttccttggaatagtatcttttaagttggtaatcaatcttaagttgataaacagtaccaactcgccaaatccacctgcatcacatatactgtatagcttacagtaaatagctcatgcttagtaaatgatctaatattaatatgttattgcactcacaactactgtacagtccatttaaatcatacacaagaacaataacctacctttttcatatattaaactgaggagtctatgataagcgtgtatagtagataaaacattaattataaatcttgacctcacacaattatagtttgaccgtgacttaggattatttatggtaaaattatgcattgagataaactttaactataatattatagaccacactaatctaacctacatagcatgtaattcgttggaaccctaatacagtaatatttgtagagccatgcttagataatccatcctgttagaactcttgttatgattaaattatccactgagccttggtaaatctcctgtagggtgtcaccatttaaattacgatcaaagctggtttagccatgaactccacatagcaatagttgatagataattccgtagtcctgagtattgagttctgtatgtgagcagccatagtttagacttcatagcaccttacaatccattagcaagcacgagtgatatgaatagccctaggtatattccgaacaattatattttgtttgtgcatatttgattgttgcttgaatattggttttctcgcatattatagaaattgtatatcggttagtcgtgaggcaacgtatgcagcttccaggaggtgaaggttgatcaagatcatatcaagaataagaactatcctgagcaggcaagtcatcaccccattccttgagcatgttgatcccaattgtgaaattgttttgtttacaaataaaattgcatgcagtgatgaatatcctacttgttattatgccatgcctttgattattgcttatctcattattcccttgtacccataattacaatgagtccctagtcacttatgacaaatgcttagtaatgctaatttagattcatgcattctcatatttatcaaatgctttatacttgggaaactaccttggggaggtagttgagatacggcatgtggagacatgagtgccacgttgccatgacattgatgagatgatttgtgaaagaaaatgaaaactaaacaaatgttttcgactagggcggctggaggacttgggtggtgtccggaaaaggctagtgccgtccctagtcagttaaggaccgagccatgaagctaagcatgaaacgacccccgtaaaaccgtacttctcgtatgggtatagacctagcagagtaaatagccgagcggaggcagtatccctgcatagtggttttcttgatgtgtgtgaggtagggcctacggtggggcagccattggtaggactgcgaggggcgggtgcctacagtggtgtcgtcatcggtaggactgccatatgtaaacctaaacttaactataacttaatgcatgtgtgagtcttcctttcccgggagcgccagaactcctctcactgttagaaaccttggacgcctagagtgcatgaggactaaagttcatggagcgggtactgccaaagtgaggttgttgaaaggctttgccatggcaagtctcattcgttgggacttaggctcatgtgttgggcaagtcgcggagtacgggtaaagtgtacatccactgcagtgtgagtaaactaaatctattcgaatagccgtgctcgcggttattgagcaccgagacgtgtattacacttggctagactctaaattcttaaactggttaggtgggatgttgcatgatgattttgtactggtggatcaacttctcgagaggcgagaaggggtaaaccccagaaaaccatgacgaccagtggcgggaagctatccttgggaacacaatggatggtggacagaaccgtcgctgtttaatgaacaatagaattaaaacttgatcagtttatactaggtcttaggtttgtgaaatgatatttgaaaactcagctttacgcaaagtaaccatagccactccttgtattatcctgtacattattgcattttctgtggtggcttgctgagtacttttgtactcattgttgctctatgtatatcttttagcagagtattgaagagaagcccttgttagtacgcttgcgtacctaacaagatgatcggagtgcggttctgttctaggtctcgttccccagtcgactgcttgtggcatgtcaactgagcccttgtattattttgtcttccactgttgtttctctgatagttgttggcctgcctggccctaatgtaagtatttaactctcttagcctgaattcattcgtgatatgttgtgattcggctatgtatgtgtgtaccaactactgatccagggattggtactgataaacacagaagatttccgatttacaaaatcgggggtcgacatgccagatctggcggaggggagggccccgccatgttgccgcctcccttcccgctggatctggcggagaggagggtgccgccgcttccgggccgcttcctcccctcccgtcggctctggcataggggagcacgccgccgtgctgccgctggaccaccgcctcccctcccatcggatctggcagaggggagggccccgccatggtggatggaggaggaggagaggagtgctgccactgttgtggatggaagaggaggagagaggagaaggaagaaatggagagaaagaaggaagaagaagagaggaggaagtggattgcgggtgcgggagatagagttcgagagagagggaggggaggaagagataaggatgggagtagatagggtggctcagctcggctcggttagttcggcagataggtgtcggttttaaaaaaaccggcacttataatatattataggtctcggtttttaattaaccgacacctataatatattacagatgccggttttttcttaaaaaccgacacccatagtataagtgtcgatttttctttagaaccaacacctatagttgtttaaaggtgtcggtttttttatgttttcatcccgttgaggtttgaaaaacattatatataggtgccagttttagcacgtccggtacctatagtgccgatatatatgtccctttttgtagtagtgatccctcggaataatagtaaccaaacaatattcttattctgcaggtgtgaacaaattaaacttagttttgtcttgatcatctgccaactattctttttaaggttaactgtcgactactcgcatttctcatatacccatcctcctcgtggaaaacagttctcctcctagactatgtttagttcctaaaaaaagttgaaagtttagggaaagttagtagtttggaaaaaaaattgaaagttcatgtgtgtaggagagatttggatgtgatgtgatggaaagctggaagttgggggtgaactaaacacggccctagtgttctctcgttccccaaaattaatataaatatatttactctttctacacatttacatcaacacaattcgcaatatgcgaagatcgtttcatattgccttccacgtgtaccgtaaaaggggagcaaatacagtcgacagtggatggaggggaatagctctggttttcccaacagccaaccaccagctgctaagctagctcccaatcgtattgaatgaacgtatggacacatgcaccgtttaaacaccacaaacccatccttgctttgttaattgctcgatctcttgcagctgcgtgcaccgcatctgtgcatgcatccacactagcaactctacctatttaagcccctgcattcccgcgtattctcctcatccatctcatcagcaacgaaccaattcacaccgatcgatcgagcaacagtagtaggaaccatggcccgtgcacagttggtgttggtcgccgttgtggcagctctgctcctcgccgccccgcacgccgccgtggccatcacctgcggccaggtcaactccgccgttgggccctgcctcacctacgcccgcggcggcgccggcccgtcggcggcctgctgcagcggcgtgaggagcctcaaggccgcagccagcagcaccgctgacaggcgcaccgcgtgcaactgcctcaagaacgcggcccgcggcatcaaggggctcaacgccggcaacgccgccagcatcccctctaagtgcggcgtcagcgtcccctacaccatcagcgcttccatcgactgctccaggtattcatctcatcatctctaattatatatattctgttaaatataattaattaagcatggctaattgcatgatatatactccatcatctaatatatatatgtgcatgtgtgcagggtgagctgagctatcgatcggatggatcatttatatgcatacagaagcgcgacggtgggtcgatgtgtggagccgatcgaattctgtatccaatattagtagtatctgtacgtattctggaataaaaagatgagctagctaaggtcgatcaatcaccatgcatgcatgtgtgtgcatccatggttgatcggcccggccggtcaggctagctagctttcttcttcttgtgtgttcatctcgtacgttttgctccttctcgaggtgtacgtgtaccagagagagctagctagagattctacatgcatgtactgcaactccttgtactacgtgcttgttttggaatattacacatacatatagctctttttggtacatatatagctctttgtagagctccacactagtatagatactctcatctgtgacgtcctctaacatgcctagaattagcgggctgtcacaagaaagtcatttcaatcgggccgaaaaaacgcccgattgagatatggtcataaaactcacgcctgtcatggatgacacctatttgtgacgggcc

SEQ ID NO: 59696 - DNA, 4875 bp, Oryza sativa
cgccctcccagcccgaccccccaatcgacgacgacgagtggggccgggacgacccctcgtcctccggcaccgggtggggcgagccgggtgtgtccgaaccccaatccacctccgccgccgacgacgagtagggtggggaactggggatccggcgccaccgccaccaccacctcctgccaccggcggggatggaccgtggtgggggtgggggtgatgcctccgtggcggcgctgctgctgccgtcggcgccgatggcgtacgcggtggtgactgacccggggacggtcgacacccctgacatgcccagctaccagccatacgtgtacggccgcctcgaccccctgcgctgatcccgctccagatgaaggaggtcgacctgtccgtcgactgcgcgctcggcgaggccgccgtcatccgtccgcgcgcggtggtggctgcacttcatcacccgcagccgcgactgtgacgtccgcgtcgtcgtgcccatgggcgaccaggtaaatctcgatcggatcaaatttggagagcgaatgttgtttaatttggtactacttggttgacgtgcatgaatcaaatgcttcttgaatgatggagtgcaaaccaaatatttctggtgggaactggcgtattgcagtgttatacatgctgaggttacttgcagatcagagataatgaaactttttatgcactgaaatgtgctttgtactgtgagtcactctgaagatatttctcctgtttgcaactatgagacatgctcaattttgtatttattttacgctcttaaattagttcttttgctatatttctggatagatcgagtaggtttcatttttaagaattttgtttctggatttttggctagcgattagttcggatactccaatgttaatgttgtgtagaggaagatagaactacatgagcagaacatctaccagtcacttatccatttatctcttcagaattttttggtctcagatcaaatgacaggagaaaataatggacgccttctctatttttcaatagatatagactcagaaagggaaaaacccatagcttatttcagtttcattttggtttatgcctcatgaacttgttgttctctgaattttctaaagataattaaactggcaaactgcttgtgtatatgtgtgtgtctctccaataatgcctgccatttcatggtttatcatgtcatgttcctgaagtcaaaattcttatggcataagcaagtgaaagtaatcccttgctttgtccagtggaaatcaaatacaacaaggaatgtgctggtttagcagagtggtaacctgacttgtgtatcaaaattttggcttcgatctgtattatgtgattgcccagtagtagatctagagttcgacacaattagtggctagggatttggttattggcccttgaccagaagtttaatgattgccagtggaatgtcagtagatctagattgggttcttgtgtcaaaccctggctcgcttcatttatcaggtagcaaaccatccatccgttactattgttgccaattactattttttctcagagctctgattcccagacattaagctagacaagttgattcccatattagtctacattgtgtgatttggtccataagagtaatttaatttctataatagagatttaattttcttggattagtcctagcttataatatttattttacatctaaatgatttgtttcttgtttcagccttctaagacaattatgtcaggaccaactaattttcctccctctggccattttgtgaagacctaatgttgtggcaccacaggtactttcacactagagtccctgctactcataaaactttgtttgtgtctggtagtgaattgtttggcatggaattaatcgatcagtgtcttatcatacactatgcttttcttggtcacatttagttagaatgcagatgttggttaatatcttccctagaaaaacaaatttaattagaatgtagatgcttttcttatgctatttttgccttgcaattcatcgtaaggattgtgtgaataattagtgttacagtgttttgttttctctgtttcagtaactaagaaaacatatttttagctcagtttgtatgcatgaaaacattagagctttctagcctctagaagtgcaaatacatacttcacaagtctaagtccttgtatatcttttggcaagacacatgctgctacatgtgttggatagatacatgccatccaaataataaattagttttagtctcttgtttttttcttatttacaaaccttttataatttaccttgttcacggcacttcgtatttttcttagcaggccatagtttgaatctaaagtgctgcagttaaatatctacagaatgttgcacatcatgaaaatcagggtatgcttctcattcaggccatagcttgaatctaaagtgtatgcagttaattcagaatgttacccaaggttgaagcaccacagaacacggactgttggaagacaattttcttgtacatgtgtttgatgaattgtaactgaacacatttaattttcctatggaccatttgtatatttctaaatccgatttgaatgaatttgttggtactgaacttagatggactatttttgtaaactttagaaacttgaattttgatgtatgaattgagatcgatgttcatatatttatccaaattgctagcaaaggcctgaggctagctaaaaaaacaatttttttttgtggattatactcatctgtgacgggcattaactcagagcccgtttgagatgagagtcatccatgacaggctatactttaggcccgttagagatgagagtcatctgtgacgggctatactttaggcccgttagagatgagagtcatctgtgacgagctatagtttaggcccgattgagataagagtcatttgtgacgggctatagtttaggcctgttagagatgagagttatctgtgacgggcttttgtgttggcccgattgagatgtgtgtcatccgtgacggccggatgtccgattgagatattttaccacatcagtgacctttacttagtgacgggtgacgggggctatattcgaaagagatgaggcttttagcccgttagagatgactgatcctgttctagtgccatctatctctacggcattggcgcctgtattgcaatttccataagccattttctcgatacataattgctactatctcatcccataatataagaagttttagagttcgatacgtcattaagaaagtaaagtaaaattaaatggaggatgagtgtaattagttgaaaattggatgtaggtgggaaaattgaatggtgaaaagttatgattggttggggacataatgttggtgaagaagatgttatattttgggataaattctaaatcctagaagttgttatattttgggacggacgcagcgggtctgggaggccagcggcaggcaagcgtcgcagcggtcggcgagcggcggcagtaggtggcaagcggaggtggccagaggaggagcgtagcgggcggtggacgagctccgccgggctactctgcccgccgcgtcatcgtcgtcctcaccatcggccgcgccatcatcccctacggcgcgcaccatcatcctctatgccgccatcatcctcggaggtgctccgctccttcaaggagctatgcctgcgttttgagctcctcgccgatgagcccaccatggtagaaggcgtgttgcccgggtctcctctgcaccccaccgccgctaccccgcccccttgcctccagctccggctatcgtcgttcctcctacctgcttcgtgcgtggccgctccgcccgatgccaccccgcttgccctgctcctggctgagagaggatagagagaagagaattagagtgaggatgatatctgggccccataatttttattccctctttgctaattaggaagccacatcagctaaaccacccatatatactgccacagaacctattttgcacggttttgaacatttaaggggtagacatatctagtattggggattgaggatgtcatataaactcgatgtaaagttaagggatggtaggtgaacttattccttttgaaaacggctaggattggcccatccaatattggtaataggattgaaggcgatttaaaatatggcccatggcccactacaaattataattatattggcctactgatgaatgctaccactgagagctgccgagctttgcttgtgtgatagcacaatcctatagctgtagatgtttaattcaagttaatggtgtcttatttagcatttatatatgctttttaaagaaacaaagttgataaagtactcttgtttctttaatatggacaccttcttatgtttatctgcatgttatattttcccgcaattaaaacatattaattctttcttgagtaaaattaaacttaaggtggatactaataagtgcaacgaaacactttttgcgatgtgacaacttgcttagtccgtactaactttaaaccgaccactcaagtgaaaatgatcttacaagacgctctctataacacgcttgtacgttccaacccatgctagcaggatagtactaattaattgttattttgcaggaaaaaaaacccataacttgcactgtataactttatataagtatttaaggtccctgcatttttcaatggctatttttattggagaatttgggcttgaggactaatgttgtcatacattttaactaaggttgaggacaaagtagagttgtgacaggaaccgaacaatatctattaaaattattacttccttaaggttaggtgtggaaaattagttgccaagtaaaattccatgggggtccatgcatgctagctagca

SEQ ID NO: 59697 - DNA, 2438 bp, Oryza sativa
tggattttttttctttttctacaaaaatactacaaatttctagcacggcatatacttccttcatcccaaaataaacatgtgagtcctctacgagctatatgtttgaatctgcatatgtttgcatggcctaaacaggttattatattgtacataaatgaatgttttataagttgctatatttatttccaccatatacgtttgtatatcataagtgtaatttatctatatttattcttgcttggtagcttgaattaattgaaggtcatggtataatttatataactgaaacaatcaaatgcggcagagatatgcgtacagttggaattaattgaagctaatatatgtgttgcactgttgcatggttgagaagatttggcgggtcattatcgatcgatcagagcaaatattaatggtgagaattaatgtttacctttaaaatgtcctgctactgcgaaaactatatacatttttcctccgcacgctgaaaaagatagaaggtgtgcatatagccttttgttacagtttccaaattccaactttaataattaaaacttttaaatatattgtcactaaccacgaaatcaattgaaagtaatacaaatccaatacatgtcacctatatgaccctaaatatatattactagaaaaaatgcctatgctttacaacgggtaaagtcctttttttatatacaataactgttaggagctaagtaataaattaaaatattataatcgctaaacattataattaaaaagttaatgaaaattattcttgtttttggtcgaaagcccatttcttttttccttttcagtctcggcctactacgctacatgttttcgccccagcccacaagtgaagctgcagtcccagcttgtacactctactaagtcttcaacctcgcgaaagtattctcgtgcccatgaaataccagagctgatcctcctcgtcaaattcggccgaatcttttttgatctctcaaaattaatagagggcttttgatccactcgatctgctctatccgtttttccaatattagaatgaaccaaactcaccgatcggccttatcagagcaaattagaggcggcgcgtgcggatcggactggaggagattgaataaaaaggaaaaaaactcgtgacccactaaaaaatcgaatgaaaaaaaggcaagtggagaagggaaaaaaccaggcccacaaaaaaacgaaaaaaaaccaaaagaactaatcgtatggtgggaaaaaaaccaggcacacaaaaaccggacggaaaaaaggcaggttgagaagggaaacacaccgggcccacaaaaacgcaaaaaaaccaatccaacggtggaaaaaaaggggaaaaaaccaagacagagagaaacggcgcacggataaaaaaaaggagtcggacaaaaaaaaatcgtgcgttgtgttggtgtgctgaacggagtcggaaaataaaatcccgtgttattgggctgacgtacgaaactcacgggcaaaaacaccttgaatttttataataggtaaagatttttgaaaaaaaacattagtatcagcttataattatttttggaaaactacaaatgttacttctccaaatacgtgttcaacgatcgcgcgaggagcgatcgagcggggcaacattattacaacaatgacttttcaacagaaaaatttaaagctatgactgttagccatatttaatgaagtcattgaatatcaactgaagacctgctggccagattgttgattggctgtaacaggatagccatcgatcgacgccggtaaaatcgtgaatcctagacacaaactattttatcatgattgcggttgggcaaatttagcttggcatgcagatcgacatcgtgttgactgatcatgagtcgtcgcatgagcacacagatcgacaccagatgagtccatttctgatggctgtagaggtaccgcaccctgagggaaccggtagagaataaccgcacacacacgatcgcttccatacacgttgcagtatacttatatccgttttaattaaatatatggtacggttaacttttgaaaataatgttagatcgatcattcgtttccttcaaaaccttaatttatatgtgcatcgttttttttaaaaaaaacttttacactaaaggttactttattcaagatttattttttcatatttacactaatttttaaaataaaaacaatcaaatataatgtctaaaagtgaataaaaccttatattacaaaactgagagagtatgccagttacttaattttcctagctaaatatatataattgtaactgatcaacatttatcagttcaaccgaaacaaagctcgatatatatattattagcgaaaaatcaaatctaatgttcaaaagaataattaattgccttaattagaagatgaatgctctatagagctagaagcaagtatagtagtagtga

SEQ ID NO: 59698 - DNA, 4431 bp, Oryza sativa
agcaggtagaataacaagttactccctccgttccactatacaaggcgtaattgctttgatgtaaaaaccaaggaagctcatataactaccgcagaattagggggctttaaaacaagcagagcaaccaaccaatagttttcactgcatgcatgcatgtgcatggatgagaattacaggattcaaagaggcgcctctgcagcttccttcaatgcatgcatgcgcatgaacgagaataatggagtcaaggaggtgcggctgcatgtgccgccctatattgtactggaacttgtgaaaaaaaacagttacgccttgtataatggaacggagggagtacataattaagtaagctgaacgaagctatacgagagacactctcactgaacgacgagtagtagtgattactactcgccggttaattaagtactagtcgaacactaagggcaccaacaatgattatctataggctctctacaagagatccatgtcagcatattttcctatttgaaaggtattaaatgaagagagagagcaaagctatctactaacttagagatagtctatagagaaaaacgaggcaatacatgagagagctactaacttagcaaaactatctactaacttagagatagtctattaagatggtttactattaatcgagtctattgctgagatgtacatattttatagataacaccttactttactattacggatgcttaagagtattatatgtatatgagagaggaatcaagtattaatggtgctgtttgattagctatagaaaattttaagatggcatttaattagctatactattatcaaacttattttaatggaacacatattagagcaagtttaatagtatagccaactactagctccaattcatctatagccaatctaatagctcatttgcacaatagttacatactatactattaatactgatcccacttgttatacatacaccgtgtcttggagtccgtgctatagctggctacaaatctgtagcccgctgcttttctctttttatttatctccttaaaatatgtttgcagctggtttatagcttgctattgtactgctcttagtatatacatcattgagattgagaagagtctagtatagctagctcgatggagtccaactcccaacgacttagcagcgactgccatcaatggatgtatatatgattccatctatcatccgcatctcagctcgttgcccagcatcttcctatttataccctccacccatcgaccgacgatccatcgatcaccggcgacgagagacactctcactgaacgaagctacctagcttaattacctagctactcgatcgatcatcagtctagatatggcggctttgaacggtaaggtggtggtggcggtgatggtggtggcgatggtggtggcggcgccgggggcgtcggcggcgatcacgtgcgggcaggtggggtcggcgatcgcgccgtgcatctcgtacgtgacggggaggggcggcctcacccagggatgctgcaacggcgtcaaggggctgaacaacgccgcccgcaccaccgccgaccgccaggccgcctgccggtgcctcaagaccctcgccggcaccatcaagtctctcaacctcggcgccgccgccggcatccccggcaagtgcggcgtcaacgtcggcttccccatcagcctctccactgactgcagcaagtaaattaatcatccatgcatatgcatgctactttttttcaagttaattcaacttaatttactgactaatccactgtatatatgcatgattatttcattggtgcagggtcagctagatcgattaatcctgcttggaccgaccgatcgatatatcgatcgatgctggctcgcagttgatcaactagccaaaataatagctacagtaaaaataacagctggggcatatcaatgcagcgctggtcatctctctctctatctctgtatactttatgttgcacgctccgtgcgtgcatgctatcttaattttcttgactctgtacaccgctctgtgtacgtgtaatcctacgttgatgaattgcatcttgtccagacttggacctagctaactacgtactccagcttggcagcttcttgccgaggcaatctgtagtaatttccttgttacattcccctgtcccctctactccctctatcccataaaaacaaacctaatatactaaatatgacacatatattctagtactacaaatctagacagatgtatatttagatttgttatactagaatatgtcacatccagtcttatgttcgtttttttggacggagagtatgtcatatgcaaaaattgataaatgcacatcatgctccctagctctgcactttattattatttttaatttacatgacagctgtacacacatacacaccactatacacacaacattacactcatacctccgtgaatacgtcctctaacacatgtttcaagagacaaaaaccaacagcacatccctaatatcactaaagtcatgttgaaatcctatccgcatctgtgtaatactcgtggccactctattacttgattgttcacaaggaagaatgatactctgaaattgattctaccgaaatatgaaaaatattatatattagaattgataaagggagaagaatgaacataaaaacagataataaatcattttctatcgtcggaatcacacatctccaacggatggtgtgtgatgttatagcctgatccaacggtttaaaatggtgataataagatctatgtctactagctagtagcactttcataagaaaacagctgggttatgactggatggatagacggttcggtcgttgtacacccaaactcaccagggttaaagtactactatatatatatgtttgaaactagtgttcactaattctaagagtacatagtggagtatatgtgcttattcagtggttatatatactcctccgtttagatattagcggtgaaaacggatgtgatagtttctgatccgatactctccgaatttggttggagcaagatatggtatatgtttgtttaaatccctcggatgcgaattgtatggtgcaggtgtggatcggatgtggtattgcaaaaaatcggtggatataattattcggtatttcgaacatattatccgatgaaccgtttagcaaattaaataatccgaatttttcagcccaccagctcactagccgactatctgcccatgaaaacggtaaattagctcaacccacaaattcaggacatcaattaacccttgaccttaactcaccatctcaacttctgtctatttcgcttgtgcatctcacggatgctgctgccatgcacaccaaaatggagatcatgcatgtatatatgttatattgttactgtgttgatgtatgtacattatactgagtccgcaccatgtgaaaatgtagtgaggttgacacgtaggttgtagtattttatttctttattttgctgctatctatttatattgattgttatcttgatgtcatcactactctggactctgtatatgttgacaccacgtcatcgataacgatcccagttcaggtacagagataaaacggaattaattggtttggatgggactaaaaatttttaggcatcatgtcggatgtttagacactaattataagtattacacgtagactattgacaaaatccattccataaccctgggactaattcgcgagacgaatctattgagcctaattaatccatgattagtctatgtgatgctacagtaaatatgtactaattatagattaattaggcttaaaattttttttacacgaattagctatcaattatgtaattagtttcgtaagtagtctatgtttaatactccaaattagtgtccaaacatccgatatgacatggactaaaatttagtcccggatccaaacaccccccaacatcagaaagctaacaaagtactctcgtttctaaaatactaggtgatcctcgcgctttgctgcgggaattactaagtaatttttaatatttttttcgattatcgagctaggattaaaaagaaaaaaaaatgaaacgcgagggttcatgaggacttatcataaaacaaacagatgatacccacgatttaacgtggaacatgtatatgttaaatattataaatgatagatatatttgttaaaatattgtggaaatgatgtgaagaataatgattagagatatacttgcatgctggtttgtagaattaaataaattatagatgattttatatgtttgtatgaggttaaatatataattattgttagtgggtgatgatgcatgtgacatggttacatgttgagattcagaagttagggggcattaactttatagtaagatagtattaacatatatctttttaaattatcagtctgttatattttcccggg

SEQ ID NO: 59699 - DNA, 5017 bp, Oryza sativa
tgttgaagatgaattcgctcgatagagagatcatattaattccaactggatcgcccatgatgtaattaaatcacctgatactgatagagaacacatgctgtagtacatcattgagattgagaagactctagtagagtacctatggcgatctgagtccaactcccaacgacctagcagcgactgccatcaatggatgtatatatgattccatctatcatccgcatctcagctcgttgcccagcatcttcctatttataccctccacccatcgaccgacgatccatcaccggcgacgaggagacactcactgatataatcaagctagctagcttaatcacctagctatccgtcagtttagctagatatggctgcagttaactgcaaggtggtggtcgccgtgattgtggtggcgatggtggttgcggcgccgggggcgtcggcggcgataacgtgcgggcaggtgggatcggcgatcgcgccgtgcatctcgtacgtgacggggaggagcggcctcacgcagggatgctgcaacggagtgaaggggctgaacaacgccgcccgcaccaccgccgaccgccaggcggcctgccgctgcctcaagagcctcgccggcagcatcaagtcgctcaacctcggcaccgtcgccggcgtccccggcaagtgcggcgtcaacgtcggcttccccatcagcctctccaccgactgcaacaagtatatcatctctctatgactcctctctctctctctatatatatatatacacgcatatatctctttattttttacgtgctatctaaatactccctccgtttcaggttataagacgttttaactttggttaaagttaaacttctctaagtttaactaattctgtagaaaaaagtaataatatttaaataccatcatagtttcattaaatccataattgaataaattttcataatatatttgtcatgggttaaaaaagatactacttttttactacaaaatcagtaaaacttacagtattttaactttaaccaaagtcaaaacgtcttataatctaaaatggagcaatagttaataaaaacttttacaagttaagatagattaccatatgtgagatatatctcacttcatagacataaaagattaaattcaacttatacaagttaaattaaaaaacaaactaaactaacactagttaacgtattttcgctattatatctgttattattgttacaacttgtacaagtttaatttaaacatgtatatttatggacatgcatatttaatattaatctatcttatcattttgttttactttttaatggctattaaggtggggggatgaaagcaacaatgagatatttctcgagatatgaaacattttcccataaaataactacctatatatatgcattttttttctttggtgcagggtcagctagatcaattaatcctgcttggatcgatcgatcgagcttaacacgctagctcgatcggagttgatcagctagtaattaagcacgtatttgctacagcatatatgaacaaagtaattaaaataacacctgcggcagacatgcagcgctccattctctctctgtatcagctgtatactttatgttgcacgctccctgtgtgcatgttctatcttaattttcttcagtatgtacacgatctgtgtgtactacgtgtaatcctatacgttttatgaattgcatgttgtccaaatgtctttgtcctagctactagctactccagcttcttgctgaggaaatctgcagtagtagtaatccctcgttgtgatacgcaacaaaattgtttaatgtgatcctgctatatatatagaaaatcatctctattattttacaggcataaaacaagtccactctaaaaacaattagtgcggccgttgtcttaatagacccgtatgtgaaaatcgtttttcacaagcagttccttaagacaacttcatgtatcattattgtagtatgtcaaaaagatgcaccacactatgcacagtcatacaaaatggcactactacacaactgatcttttatcgggatatccatttcggatagatttagaacgggtattagagatatttttaagcaccggttaccaaaaacatctttaattccgattggtgttataaccggtactaaagatgcctacagggctagtttaaaaagaaaacatccatatccatgtctgatgggtggagttggtggatggttacacgcgtgagggctgaggtgagagatcttgagttcgaatcacatatcccacacattttttttatttcgtatgcatctttagtaccggttatttcaactggtactaaagatcgagatatttagtctcgatttgttagaaccggttctacatctaaaacggttcccaactggtgctaaaaatgggttctccactagtgtggcaatacatttacattcacacattaaggattcacatcgtcacccatattcacgttgacactgtcttttaatgtataatttaaatgttcacattgtgaatattcgacaatgatagggagcccgatccctatctacaagtctaaacctaagattaatttgatcgacatgagctaatgaatagataagcgcactatctattgcttgaaatggtagatccattaatttccttttcatatatagattattgtaaaaagttgtcgttggctgattggaaatagacttgggcatgaaacctataccctctgcaactccacgtaatcgaaaatcatcctggaatagacccaaggatgaaatttagaccaaggaacgaaattgggcatctataagtgtggggagacaaaaataaacggtttcatagagttaaatgatcaaagttggaacaatattgcaatagttgatgattaaattaattaatgtggacttctttaaaccatatatagactgtgttcggcagcgctgttcctaacactaccagtacgcacgaaaaatgaaacggtccattagcgcgtgattaattaagtattagctattttttttaaaaaaaatgaattaatttgattttttttcaaacaactttcgtatagaaactttttaaaaaaacacaccgtttagcagtttcaaaagcgtgcgcacgaaaaacaagggaggagggttgagaaaaagggtgccgaagtattgtgcgctagatactggtaggggcattgttgtccatcctcggaagtggctcaaatataacgtgccacgacattagcgccatttcttacacgaaaacgaaacagggaaaactaattgaacaaatagagagatatgtagctagctagctttcagagtccactttttgagagagctcaatccaatgtgtggtttggctgcagcgacgaaccagaataatctcactctgctggtgcacccaatcaccaaatccaaaggaaattcaatgtacaacaaaattaaaaagaacatcttataatttgtctcctcctcctgcatatgcttgactcctagcttaactagaggtacctgcagccagccatgcggcggctgggtgacgtcgtggaggcgcctgcgctggtgctgacgccggcctccatgcagcaggccggcgggagggggagctccggcgccttggacgccagcatggtcgtcatcctcgccgcgctgctctgcgtcgtcatctgcgccctcggcctcacctccctcatccgctgcgcgctccactgcgcccgcggcctctcccccaccacggcgacgccgacgccgtcggtgtcgacagctgccacggccgggctgaagaagacggagctgaggaggattccggtggaggtgtacggcgccaagcaggccggcgtccccgacggcgagtgcgccatctgcctgggcgacttcgccgacggcgacaaggtgcgcgtgctcccgaggtgccaccacggcttccacgtccgctgcatcgacacgtggctcgccgcgcacacgtcctgccctacttgccgggactccattctctccgtccatggagtcgtcgccggcggccaaacatagctagtaatataatttcttgaacagaagaggtctaaaatgtaaatagaatataggtggtaaagtactccaaaattgggattgcgtaaatgcaagggattggacacaatgtttgaagtgtctctgtcacttggattatccatctgtttagctgtttctatgagttttctcctttaatttgtgtgctagcacatgatatttcccccaagattcgctgttcgtttgttctgggcataattttgtcaccactcaacaacaaaacgaaaggagagaaagcactgaattggtattttcttttggaagaattgcattggtattttggatgcatgttcagccaaacttttcccccaagtgacaagtccttttctcaaattggtgttgtccagcatctaatcacctcccatgccagagaccttcttcctttccccttttcttcacgttgccaactagtactagtagctaagaataagatggctccatgccaacgttctgcgctcgagttatggcacaagcattggagtaaaaactcagaaaatgttcaattgttctgttcaaataatgcttcaaaaaaataacgtaggattttggggagagggtgcctggggtggcacatagtaatacgtcttcggtgatgctaaatcttatgtttggattcctctaaaattctctacggatatattaagtcattccatataggtttctaattgattatcttttcttcttgttagagtttgtgtgaatatgtatataaagtcggtttcagtttagaactttaagtttaataggagtagggtagagttagagtcaaactctttcagctctcttaaatagagaggcaaacttattataattaaccacatgacaacttagcataggcgagagggaatggctgtcgacgatgtccgaccgaagtttgttgtacctctgatacgctgtaattatgctacatctagtacgagtgttcataatcagtgtccagagatataggattcggttgaatt

SEQ ID NO: 59700 - DNA, 3309 bp, Oryza sativa
tatagtacttccagtagcaatagctagtgttcaaataatcttttctgccatgaattatgtgaagaataaattgagaaacaggctgggggatcaatacttgaatcattgcttggtcacatttattgagcgtgagatgtttttgaaagtcaaggactgtgatattataaaccgctttcaagtcatgaaggaacgtagaattaaagctactcttccaaaccatgaatgaaccgaaatagaaaattagaggtaccatgtaataatttgtagttttatttcttcgattatcggtattgacatactgtgaaccattgatttttttttactatgaacttttttttgttaaacgggaatacccaacttcgaaatgctggctccgccactgcttagaagaagttaaagcagaacatctctaatttatttatttgttggagtaggtaacttgtatgggttggttgattccaaaatgagtacaacactgaaaggaggttttaaaggatgtacaagactgaagactgcacaccaaactatggcagtacagtactattcatgaatttgtgtcatgatgttgctctcaaagatattctggtgtcgttttccagcttcattttgcaagctcaatacacaagttggaagttggaaccactggtggacttaattcgaacatgagcagtacagggacagattcctaccttcacttctatcactgtcttaggctgcttgcatcagatacacaagtaaatttgaaacatatacatttgagtatgtttcctctgctttggagcaagtaaatcatgcatttgaagtagtagggaaatcaataccattatcaattgtagcatgcacatgagagcagctggacaaatcaaagcatgatcgaattaaaaatgaaagggaaacgggcaacattactacagtagtttattactccatgcctcatgcagagagcagtgctgcgaattgatctgccaggctcttcacagtcgtcggagaaactgcagattctccacccaggtaccacttctgaatcatctcggccacattcttgttctccactgtcagcttcgcctcgcccttgccttctgtcacaaatgatatctgcacacatatatgcatgattcaattaggtttgcaagaacaaagatttgatcacttgatatcttaaccaaacccagctgaatataaggagtactctacaagattatacctctgcaattccaggggtggtaggaaagtggaaggtgatgacggagttgggcttgaaatacttggactgaaagaattcggtgaccttctccagagcctcttcttcatcctcctcgtacttgtctactgacacgagacggtcacgcactgaactctccagctgcacgccgtattgtgatcctttgatctccttgatcaccactatcctcaacaatttctccaccggagctaccacacgtaaacatcatcaatcagcatgattcaaatgaaataatgaaaaaaaaaagttattgctgtaatgcatgagctgtcgagctgaagctgaaccttactctgttttattttataggatataacaatgttctataaactctacagagaaaatactactatttgtgatcagccacttgatatgggagaatggtattgacatactgcagaacatgcatttctaaatcagcttttacagattctgaagtgcaaaatctgaatgatgggggtcattttagttaccagaaactagggcctgaaagaagccatcatcctgcacaagctcctcggccttcttgcccttccaactctccaaatgcgctagcacattgcccttttcaagatacaccccgatggcgttgtatttgatctggagggaaaggattctaatggctgggaaggctggcattgggttatttcaaaggcgttaaaaggctggtgtggtactgataatctgatattagttaacagcttaattcgttagtagattaattaattaccattagcaagcagtgacaatggcttactgacggttatctcctgaggaaatgggatgccctccacctccacggtggctatctctgtgcccactgcacttacaacaatcatgcaaaatgcaactaattgggcattgaaatcttgtaattaccagtacatgtatggtcatgttttgtatataagcatatttcaacaaccttcacatactactttcagaatttctctaaatgtacaagctagtgcaaagtccgaagtgggtatgaagctaccaccagagtttcagatggaattagatacattcattcatgagaaagtctttttgagttcttgatatcccttttttttagaaccatgagaatgtcttttcttgatatccctcaagacggacgaaagacagaaggcctgtttggttggtgacctgagcaccacgcctgaagaatttgcactccaacaaactcatgggttccacctgacgagttgcttgtttggtttgctgctgctgcctgatcgagtagatgattactgctaactcaagtattagacgggaagaacaaaaatctcgacaaaacggcttggcgtctcgggaaaaatctcacaaaatccatatgctacatacctaactttccaaaaatatccccaaagtcgcaataacgatcagcaaaatcagcagcatcagctgaattgaagcttcgctctaagctggatccggcaaaggggatcacgcgaagcttcgtacaaactcgaccaacgcggggacttcgctcaacgacgaccacggcagtggcttcgcttgccggcggtggcgattgaggtaggtgtgggcttcacgcagtggcgtcagatcaggggcagcctcgtgcgatggcggcacgcggtgatgacttcgtacagttgagatttcgatggtaaagcacgcatttgtttacgcctggagcctcgggcgacagaaatcggccgcgctaattgcacgcctctatggctggagtatgcgtcaggccaggccagtggagaacagtcttgggtagcaaccaatcaagatcgacacaaatcttttaagcctaattactccatgatttaataatatggtgttacagtaaatattttctaatgatgaattagttaggtttaataaattcgtctcgcaatttacaggcgaaatctgtaatttgttttgttattagactacgtttaatacttcaaatgtatgtccgtatattcgatgtaacacggtaaaacttttcacccctggatctaaacacagcctaaaactttagtccctatcacattagatgtttagatgctattttagagtattaaacatagactaattacaaaact

SEQ ID NO: 59701 - DNA, 2061 bp, Oryza sativa
tgagacgaatttttaggctaattaatccatgattatagtctatgtgatgctagcattaaatatgtgctaattatagattaattaggcttaaaaaatttatctcgtgaattagctctcatttatgcaattagttttctaattagtctatatttaatactcgaaattagcgtctaaacatccgatgtgacaaggactatatttgacactaactagaagtattaaatataaattaataataaaacaaattacataaatgagagttaatttgcgatacaaattttataagcctaattaatccataattagcatatttttacggtagcttcacataggctaatcatgaattaattaggctcaatagatttatctcgcgaattagtctaagattatagaataggttttgtcattagtctacgtttaatacttctaattaatatcaaacattctatgtgatttagtccctggattcaaacaggacataagtccaggcatgcttctctcaggtagcaaccaaattaaacatgctcggagtaatactactactagcaaggatccatcagaaggaagcaagaaagagagattaacttacttcttagcaatggaaccagaaggaggttggaactgaaactgcttttgctccttgcgatgaatagagagcgctaattgttgacgagagaaatagagaggagctgaagatcgaaagagcgtgagtagggaaatgtttttattcgccaaggacaacatatgagggttgatgcaggcaggggttaggtaggagatgaagacaggacagaagaaaagaggcgtggcacatctcagactttcagatacacctaccactccgaaagttccaagctccccacgaacttaaggaaaaaaaaacaagaagagcagctaaattgctaatagaaggggtaggtaccatgttctagatcgtggccaaaacatatacaggttcacaccgaacgatgcatttagcttcagatgtttagcttgatgtcattttaaatcatatctttttttaagttgttaaatatgtacattaatttagttttttttatcaaactttagtactccctccgttccaaaatataggtatttttagactttgacacggtcaacgagatattatttttgaccaataatatctataaaagtaaaatattttaaataaaaagagttatacattattgatagtttgtttaatgataaatctaataacattaattttatatgaatgatcttttttatcttttctattaatagtcaaagttgaaaatgtctgacttgtcactatgctaaaaatgcttatattttgggatgcagggagtaaatacgtaataaatcatgtcaaaacttggcaatattgccaaattgacaaaatttgataaggtttattttggctacaatctaaggcatagcggcacgacacctccctccactgcgcagtgcctcatccctcgccctcgagccacacgcatacaagcttagctcccgaggaggcctcaccgaccaagcaagcagcggggtgcacatccaccggcgcacgggtgctcgctagctcacgccgcgttcgtcgaccgcgcctgcaccgtctcctccctcccaccgtacatccccacggcgggtcagttcctcgtctccggtccctgactagcgctcgcggaggtccagggcggccgcgttcgcctccctcagctgcctcttctccgcccctctctcgccgtgcggatccgcggcggtggccccaaaccaagtgcttaactagcgctctcctcgccaccacctccccgcggacggtggagttgaccgtggctgtgtgcacgctagcctcgcatggcttgcgttaggaggctaggcattgaggtcgacattgtcggtgccaggagctccgccgcgagctggtcatggctcatcaagcagtgagagaagcaatttggtctcatcaaaccgcattctagcgaaaatggagaaaatagctaagtggctgtgatcacacactctatattggcattttagcgaaaccttttttttttaacgtggcgaaatgtccattttctc

SEQ ID NO: 59702 - DNA, 1410 bp, Oryza sativa
attcctggttggagtctcccagtggatacagtagctttgttgaacatacctcatgtagccacaaatttcattatttcaaggcacattattatctgcattgcatatataggaccagatggggggacgaaagctgctaccttgatttctttatcacattttaggaagaataacaactcccttttatacaactgcaatccatgttgttcataagcaatgtgacactctagtgctataaaaaccaattattttcttgcttgttacatccactgtttcagaagaattacctcctttcatacctttcagtgtgtacttgagcaaatttgcttctgttggttcgatttttcaaacttcacatatagcttagcttgccacaatatgtgaatgttatttgctttcccaagtattccccgcttttcagatcactcactgctatgtttctttcagttactagaatggaatggtaaagcatactctagtacctataaaatgagcttaagagtttcatttgttacgtttgatctaaataaaattatgtgtttttcaaaaaaattccagacaaatctatatctgtgaaaaaacaaatgttgaaatgtcatagagtattctgacagatgtatataatttcttgccatctattgctcatctattccattttactttagatgctcgatataagaaatatagcatataaaactttctgtcttcatgcaacaacagaatttctccatgtcaagcctggaaaaggtgctgcttttgtaaggacaaaaatgcgtaattatatcactggcaacacagttgacaaaacctttcgagctggaagtacggtaatccaagcagaaactcacctttctaaacctgtagaaattactctctccgtttcaggttataagacgttttgactttggtcaaagttagattgctttaagttttaccaagtttgtagaaaaaagtagtaacattttcaacccaagacaaatttattatgaaaatatattcaattattgatttgatgaaactaatttagtattatcaatattactatatttgtctataaatttagtcaaatttaaagcagtttgattttgaccaaagtcaaaatgtcttataacctagaacggagggagtaccattctgtgactgtatcagatcatgctttagcttatgtaatcagaagcaactgatatgatactcatcaactctccttcaatgtgttctaacaaagaagagcacttattttgtcacttttgttttagatcccagaggcatccatttcaaaggaaactaagcaatttacctacaaggatggagcccagtttgtgttcatggatctggtacatgtttcagtttttcattcaaacatatcatgaaaagagtagtcgctagctgtctgtatgcttcagtaatcagtat

SEQ ID NO: 59703 - DNA, 710 bp, Oryza sativa
aattcctgcagccctaatttgcccttcttaacccttctgtacttaaaatgacttgacaccaacatcaagataaaaatgaagctaccaacattaaaattattggagctacagcccagcaaaactcaagagctagggcttctagaattaagaatgatcattatttcctatagtttcaggcagatgtattgcttacattacgtccatttgactatgtgcagcatgcttcaaagcactgttgcgtctcaccttcattctcagatgctcaacatcatcccatctcttcgcttctgcataaacatttgatattgtgacaagtcctccattatcagttagaatcagctcatgtagttaatgaaaaaacttgtaagcaagatcgatgtgcccatgcactcggcaagctgccaacaacatcttccacagaacagagtttgctgttgaagggttttctttaatcatcagataagcttcttcaattcttccatagcggcaaagcatatcaatcatgcagccataatgcttaacatcaggaacaattctgtagtcctcaatcatgctattaaaatatttcctcccctcattcactaggccaccatggctgcaggcagtcaagacacccaaaaatgtgacaggatttggctcaattttcatcgaatcaaagagctctagagcctcatatgagcagccatgtactgagaaaccaatgatcatcg

SEQ ID NO: 59704 - DNA, 1034 bp, Oryza sativa
taatttatatggaattaaggagataagattagatatgccaatgacaaaggagattataatttataagatcagtcattttatataccttcttgcccattaattcagctcttactgtgagaactgagtctccagaactgttttcatttatgcccatataaatttccattgctccatatacaccgaaacttaaaacttttactggaatgtcgttcaccagcattgtatagcaaatattacagttaccatctggcaatatgaagccaagaaagaatgcattctgcaatcctatttgtgtttgcccatctggatcagcttctcgagctcctcaccatggtacttgctttggtacttgctgaatattccacctttcatgggctactgatctagcgaagcgtccacattgaaatttagttcatcacttctaggcagaggacagagttcaacttcattctccttttctgcatttcagtagccaatttagccagtgcagtttactgacaacagacattcagtggagtagacatccaaaatttcacatattgcaatggaaatggatagaaacccaatattttcattttgtctgatgcatgttgggaaacaatgcacttctccaaagtcctaaccacaatgattgtgacatactcaaaaacgaggactctcagtggaacaggcacatttcagaacaagaagaagattatctcccatctgctgcgtatcaatacattaatagtttaatacgactcaaagttcttacgaaattcacagttcagcagtcttcactttgagaattagcagcagtattggcctaaacaccacagaaggtaattttagaaatatgaaattatgaataaacaatattcagatagataaaaaagttacttgagaaacgtgaactcacccgttggaactacagtctagcggtaaaaccgaagtgtagcaaagtggacttctggaaatgaagctgaatattacactgtacagcttgtggcgggtttattggctacctaaaattaacttggctgtttgcagcatgc

SEQ ID NO: 59705 - DNA, 3315 bp, Oryza sativa
cgagatccaacctcccacattttgcatacatatcaatgagtgcattgccaaccaagccatcagatacaatgcccttgctctgaaggtttatgtggatgtctgtccccagctccagcttgccatcctttgcacaagccccaaggattaatacaagtgtaagctccgtaggttcaatggcattctccttcatttcttgaaaaatctccaatgctttggtatatttgccgagctttgtgtagccacttatcaaagagttcaatgaaacaacatccctctgtggcatttccctgaaaagccttgatgcctcatccatatacccgatactaacatttcgtgcgatctcagcattccaccatgacaagttcctctctggcatggcttgagagacgcgctctgcacccatccagtctgcagcggcacgatgagccccgaccaacgcattccacgagacggcgttcttgtcaggcatttcatcgaacgccttccgtgcatccccgaggcgaccgaacttgccatacatggagacgagcgcattccgcacgtatcgatccttcccgcagccaagcttcaagacacggcaatgcagctccatccccttggagacgaagaccgacgcgacaccggcgcgagagctgcggttgaatgcgcgagcgcaggatttgagtaacgcagggaaggtgggtagcggggtggggagggagcacgaggaggcatggttgaagaggatgagcgcggacgacggggccggagaggaggagaaggcgacgatgaccgggcagacgagcgacggcgagaggacggccggggaggcctcgagcagaagggagagcgccgacggcgaaggcgggatgcgagagaggagagcggagaggaattcagggtggtggagcaggccgagcttggcgagcagcgcgtggagctggtgaccgccggcggcgcaggaggcggtggtaggaggcagtcgtggtcgtggatgtggaacgcattggtgggctcgcctagtgggccgtggtttggttagtgggctaagaaaaagcccacgaggccagcgaatggtcgcagggggaaaggaggaaaccgtggcttgaagccgcaggcagagacagcgtcgtctcctcttcctcttcgtcttcctgccgccgccgaggagccgagcaaaatccaataatccatcatcggagacgagcaggagcacgcgcatcaatcatcgtagagtgactcatcggaggaggcgtgaattccacctatccttttcttttccccccttgtattctcttattattgaaatcccaaccccataatccgaccgtacccacccgccccccatcgccggcggcgcccagatcgccaccgatcgcctccaccaggggcgcggcgcctcttccgccctctctcagcggcggttgctccacgtctccggattccggaagaggagggagggagggagggagggagggagggaggaggcaactcggggcgttggaccgggctcccacggcgacgcccatggtcgacaaccagggctgctcgccggcgctcgagcccgtgcccacgccgcccaaccccgacccctcatccatctcgccggaggcctgggatcccctcgaggccgccgccggagccgtcgtcgcccggatccagcccaacccgccctccgaggaccgccgcgccgccgtcatagcctacgtccagcacctcctcaggtgcaccgttggctgccaggttcatctctcactttcctcacgcctgcctttctagtattccgcaataactactactctacctttcctttgtgcgtcaatggcatgtccacaacacctagtatgtgcttactacatgtgaatcttattcagtcgtgtaattattccccttcgatcatctctatgtacacagctgctctggagtgtttaggaggattcttttattactgtttcacaagttatttccattctctgtttggatatggaaatgtagtaaggacaacatgctacatacattgttgcctctgatttggctaattaccatactcggagtttcatatacctacactatgatggcccaagtatgattttgctaacactagcgatagcgccaaactgatgtacaagttcatataaatacaaatacttcccgcggccagggtcgcaggtgttaaatgtttattccctatgaatgttttgatatcccttgtcataactgggcttgattttcagcagcataaatctgataatctaattatgcaaaacaataatatatcgacacatgttaatgtcctgcatttaacgacagttaacttgcaggtactgggttggagagttgggtatatggtatatgcactttagtgtccttttttatgacctgggtctccatagcttgctcatcttgtatgctccttttggataagtgcctcttctctactatatctgtgctcacaagaaaatggaatagggaaaagtctactgtaacacctccagaccgtggcgggaaactggcatagttttttttttagtttagtaaggagtacttccttcctgttatatggttagttattttggatctttgttcatgtcaaacacaagagatctggtgaccatagtgtattttaggggatttgtagaatattcactgaacaactatagagcatgtacgaggcatccaaaaaaaggaaaacgtacctgtatgcaatcttgcattagcacctaagcatatgttccgatatcaatactactttgccaagtatatgttactgtctggtgtgtgtccaccatgtctagtatcagcaagcaagtcatccacatcgttgctcatacttgttgttcacggacctgtttaagctacactatgtgcggatggagctaatatcaaactgttaattatggcaataatagacatcaaacgcgtacatggtctattctttgatgtgccaaaccatgccttttcaacctttgtttatacctaattactagaattactgtcgtgcacagatgcacttggtagatcacgaattttcaagacaaaggtgaataataaaaatagaaaagaagtcaaacaaaaaaaatcagaaaacaagcagtttattgctttatttcaatccaattcttaactggaacccttagccactgtgaggtgtacatctgacaaatcaatactgaaaactgcatagaaaattgaggtttatttatttaatatcgttcatgtaatatgtgatatgtttactaccttggcatcatgttctttaggagccaaacacatgttccaatggtgcataacatgctcactgctagttgttctatgaggagtgctccttagtgctca

SEQ ID NO: 59706 - DNA, 813 bp, Oryza sativa
cgttcatgtaatatgtgatatgtttactaccttggcatcatgttctttaggagccaaacacatgttccaatggtgcataacatgctcactgctagttgttctatgaggagtgctccttagtgctcaaccctaggaattggcatggcattagataggcaatatgggattctctgattttgttgtgacttatgtacaatacttgaaaaagaattattgcttgcgcttttagtcctctgcgagcactggtctctctctctgtgtgtgtgtgttgaatcatccgacatcgtgctattaaaaactacaactttaacctttttctttctgtaaagcacaggtctttccatttggatctgttccgttgaaaacttatcttcctgatggagatattgatttgactgcctttggccattcaagtgatgaaattttagcaaaacaagtacaggctgttttagaatcagaagaggcaaggaaagacgctgaatttgaagtcaaggatgtccaatatattcatgcagaggtttttctcttgatgctctttgttttttagtttatatattagttagtgtctaattcatatgcgtttatgtttctggtagtggtgtctacttatgtgtgcttatctattgtgtttattatataagatcacatgaaaccatccatgtgattcattaatacatgaattcttttcttttttcttttactccccttcttatagctgcaatcaaacatttcgcagtattcttatcctactataaaacgggaaacaacaatagagaaatccatcgtattcacatgacatcaatgaagcctgtg

SEQ ID NO: 59707 - DNA, 4484 bp, Oryza sativa
  unsure (1)..(4484): unsure at all n locations
tgcaaatgcatcatagcttggcaaatctcctacacacccagcataacggccatgaagagccaaaacagctggtggtggcttgcgagagcctttctcttgcttgttcaaatttatgaatttcgtcactgtaagctgatgacggttgaagaacgggttcttgcttccaatgccgagaccttggtccatctgtagccgacaagaaaactttgttcagagagtttactttagcatggagaattttgtataaaaacatgctacttttgaacaaaacttattagcccaaatatcatcaatatgtttgcaaaaatgttttttttcccaataacgcacaaattacttgttcactattcctttgaaactcttgaacaaatgtaccgaaacatttcctaaaattttccaaaatatcgatcagtctcattggtcttttcaggtgacaactttttgctacagagctacctggcaatgagtaaaggttgagtttgtgttcctagaaccagggtacaaataagcatacctggaatatacatctgtcaccgattgttgcaccattgacgaactctgtattgtctcgagttatattagcttgtagaaacgccattcggtctacgccagtcccacttaaggttgtgggaggtccaatcatgctcaaggcgccactaggcaattgtcgagaacgatgtgtacatatattgttattctcatcgcgtgttgtaatctcttccactatgaggccatacgtgaatttgctctgctttgtgaagctctgaataaaagatccaaaatgcagtttcctatatgttgttaataactgtccatgatagttaaaaggagtggaaggtaatatcaattgtgcaaacctctgttatattggctttaaatccaattctatcaacccagataggtggagcttcatacatattgggaccagcaacgaatataggactcaatttcctggagttgaaacagctaattttgaaggtgcggttcctactaaggttgtcgataccatccagataaggatgggcatactccagcttgaacgaaagatcatcctaatactcaccaaaataccatactatcatgtatgactgatataacagcagccaaaagcagcatcgaagctgatgggaaaaagaaaaaaaaaactaactaccaactcacctcagggttgagcaagttgctggatgtaacagaaccaatgagagacctttttagaccacagatgttgcggtgctcaaatgacacagttcctcctggttgaatggacgcctaagaggaagttgtgaggttatacaaaatgacttgcagtgatgagggaatgtatatattcacaatggtgtctagcatgttaagtacatattcgatctggaagaacaaaaggttgcacattaccagagttggtcttccttgagagccaggcacaatgctccaatctgtgatcacctgagctgattttgggtcatgttccttgagcttaattgcaactattactcccccttgatttgtctcatcagggcgaggctgtacttctatagtggagaacaaaccaagcgaatcgatattcttcagagcctgcttccccgccccattgttgtagatatgcccaggacgaagctgtaagatatcaacagccattttattgcacaacagtcacattggcacaactggtacaattatcagagaatcataatcaaatatacgcaaagccaagaaatttgttgcaaaatcaaacaacaaaatcatagccatctgctattaaaaatgttagtttttcttgttagacatggagcttgacagtgatactagcaacattaacaaaacttggatcaagagacattttattgcaaaacagtcacgttggctcaaccagtataattatcggagaaatcggctaagaaattcgtcgcaaaattaaacaacaaaatcatagccatctgctattgaaaatctgaacattaatttagacattgagctcgacagtgatagatactagcaaaattatttgtacgcaaacctgttgaggaagctccctgtcaatgagagggatgctggtgttgccgtcgacgacattgccgagcttgtccaggaactggtactccaccttggtgatgtccccctccaccacctcgcacaccacctcgccggcgtcgaggttgccgtggtagctgaccacctgcgcgcaatggaacccctcgtcgtggtaccacctctcgatgcgccccgccatcctcttgagcagcccggagctcaccttcctctgcctcttcaccatcccttgcagctccctctgcaacttctccggcagtacgcacggcttggcgcggcggacgagctgctggtactcgcgctcctgcctccggaggtgttccatcctctccctcgccgtcatgtcgtcgtcgagctcgagctcatcgccgtccggccgcgccatggggccgcccacgttgatgcacttgaagtgttcgaccgcgggccactcggtctcggcgtaggagacggtgaggccgagcgtgccgtccggcttgggcttggtttggagggtgacgtggtcgaacatgccggaggtggcgagcgcgtcgagctcgtcgcgcagctgcgccctggtgtagacgccgccggggcgcagcgcgtcgaagaggggggcctccgcggcggcggcggcggcggcgcgggtgcggcagttgaggaaggtgagatccgagaccttgtacctcttcttgccgtccagcctggagagcggcaccggcagcgcgctagccgcgaggccgtgcgcgtcccagtccggcgacggcttccctccgtccgcgcgcgccgcgccggcggagaagaagccggacaggaagccaccgactccggcgggccatccctggccctgggcagtgcttcttccatcatcggaggcggagtcgagggtgaagcagcttggcattgcgattgcggttgttaaggttggcgccaatggcgcgagagcaccacgacgacgacgacgacggatgcttctgaataatcgatcgcgcaaccagtttatgtttggaatgccagatttttctttttccgcaagaaccaagcaaaactgattcacacgaaaattctatacaaaattcatgctttccaaacaggtctttttgggtggggaatgccatacttgtgttcttcctcgagatcacaaacttgcctaattttgcaatctccatatttccccagcgctatatgggagcaaagcagccaggtacgatttgaaactatgcggccacaggataatccagaaatttacaatgggctaaatttgctaaacataagatcctcagagtgatactaccacacatatcgtcaggctgtgtgttcatttgcagctcatgatctccagtttttcacctcttctcatcccatttgagcaacatggggggaagttgcatgttttcctccctcttttcatagctcgatatggtgagaatgattgggaacatctccttggttgtccaggggcatgtactgggccatgatggcgcggatctctgaatccatgtacctctgtacacaggcacaaccaatgcaaaagaaaaagcgagaatttagatgccaattcagagttatcaacagagttaacctgaacaaagttacccatatcatacccggatcctgtatttgtatactgcgtatcctgcaatgcctgctaccactaggccaaagaagatcacccacaagaagttccatcctacctctgttgctgcatttttgcctaaatacagacaaagacaaattagtctactcacttaagtaaaatttcttctataatctatacactgacattctacactttcaatggttgcagaatgctgatcatgatttatgtgggtccgtcaaatagatcagacagaccgcaaaagtatatgaatgcacaagtagtggactgtttgatatgaagaaagagcaacatatgcatgaggagccgggagggacatacttatgcatgtatcatgctccttcatataaagcaagccgccactgcaaccgcattcatagcttccccatgtgttcttgcatttgcattccttgcactggcatgcagtcctttccttgcattcatcaatatctttcacaaaatatttcacatcagtacaaggggtcaagtgcacaacaagggtgtattgcaagtgatatttcactaaaactannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 59708 - DNA, 768 bp, Oryza sativa
tgggttatgcactggccaggtgatatacaggggtttccaatgtgctaacgtggatgttgttttgaattgtttattgttgtcatcacttgaaactgccgataaattcaccattcgttttttcccttgcctgtactgctctggtgggttgaacatatatgagatttagttttttttttgacatatatgccttgggcctaactattaactaagaaattgcatttacatggtctgagctaaaccatgaatatatcctcgaatagttggattggacgagttgctagcttggaactaagtacagggccctatacaaatggaatacatgattgtgtaatccttgttcttttaccccttcctccccaccttggtttgtggccgttgggattttatggttggcttggctcttggctgtactgcattttcagaagttgcatggtgaactgtgtatacctgaacttttctggtattcttcgacatgtgtttggtgttgaaaatattgttctaggcaactaataataatttgtatgctgcaactgatggttcaatttttattacatctgttgactagtcatgcattattaaaaacagattcgttcatcttcgtggaactcagactttgtctggttatgatttatgcagggaggcagtggtgctgaatggacctcaggaagctagtaagatttgctcatcaacaggggcacatgttggcggtggctttttttcaactaatcctgatgtacagtcagtttggtcgttcaatcaaaaagagac

SEQ ID NO: 59709 - DNA, 6240 bp, Oryza sativa
aattcctgcagccctccatcttccagaagaaaatcttgcttgtaaaaggctcatttagttacttgctttctacccgtcatggaagaaaacgtggagaccactgtgacatatatagtgataaaaaaaacaaggacaattaattaaaaggactaaagggatgaaaatcatatactaagataaggttcccctgactatgaatgacacatggccatatgttactttagcccaaacacttgagatatattaattattaaattcttttcactgtctactacttgttccgtcctaaaatccagatttattgtgttaagatgtgtcaaatttcattctaggtaataaatttttgggacgaaattcgtatactagcagtaataacttttcgtgtaaaaccaaatgggtgtggtaaagaattatatgaaaaaagattgggttatagcttaatgaaaagtatgtaattcaaagttttacaagtgatacaacaacgtggtttgcataatgcgtcaaagagagaaaaaaaagaagaggtcaacaggagagagaggggggctggtttggcttggctgttacaaagacaaagaatgacatgcgggcccagagaggcggaccgcgtcccttttgacgacatctcatctcaccctctcctcggccgcgtaaatcccataaataaattcttcttcttctttttgtttccttgccaaatcccatctccattttcctctctttctcgttgcgatttgagaattcaccttcttcttcctcctctcgcctcctacctcttgctgcagcgcacggcgccgcgccgtcatctcgtgcttgtatccttgttcttcatcttctctcaccttcccttgagaagatttgttattactagtttaatatttctaggaaagaggagaagaggagaggagaggagagggtggtaacgcagcgttaggtgggggcgtgctagggagtcaagaacagaaggaagggaggcccaactgctccatcctccctttccccaaatccactccttcctttcgatttgcctccttccttccttggttcattcattgatttttgcaccgcatttgaggaagaatgtgcccgctgagggtgatcctaatcttcctctccgccaccatcgccggattcttcctcatccggggcctcaacgccgatcccgacctccacgacgatgccgacgcctccgaatccccaagggaaaggccccccgtgcccctccattccaaggtaatcaaaccaaaaaaaggggaaaaaaaaccattctttcttggtcgctccatactattcttgggttaggttacctcacacacacgtttcatgacatcccttgctagaggactaacgcttcaattctactgcttaattcctgctacgagccccatgtaccccgtctcatatggcaaatcacaacattgtcttgtctttgacttctagtttgctgttgctggatatggaagctagcgattctaggaatgctttcttcttacggctgaaaaaaaagaaatcttctagctaactttcctatgaaaggggacgaaaatcatgtgctttggaaatgtttctggcatatgcctaattttcagataaatcacaaccatatgtttctttttagtgcacacaacatgttctctcttgtttttgttttttcacagcagtacttcactacacataatcgactcatgcacagcaacaacaaaaaaaatccaatggctttcatgctaatttttagattcacggcttcattttcggtcatttttttcagccttataacaattagaacaaatgtttcagtacagtattgttggttcctgctgattgtctagagcttggaggttgaaaaggaactaacacccgccattccaaacttatatgcaaccactgttataatacgataagcaaagatattgcctgttcttattccaaagaaaaaaaactgcatgcaaattatcaggaatcatactaaaaaatgagctattttgaagtatttctatagttgcagtatgcttgataacaaatcttacttaaacagcgacatgtagttggctagttggcagtgcttcttacattgtgttaaaccatggtatcatggttttacattgtgaacctgtccttatggattatgtaagcataatagtttatacactggagatgctggattgttgaaagaagtactagggaaaagattgggttgttgtcctgttgacgatgcctgaaatttatatttccaggcccacaaacttataaccctctcttttttttcttaaaaaaaaatttatagcggaagaagattttttcttcagggtggagcgcatcagaacgccgtacgtaccacctacgaataataggtagccccaccccagacagagtttgtgagccgtgtaattggcgaccatttcgcgcggttcgggtcagatagcaagcgaatcgtcctatatcgcggaagctggattattacgggccatatttggtcttgagccccagtttttgttccagtgttgaatcttttgatgtatgtagtaaaaatgggtgctggcatcatatcttcatgcttcctaaccaagctacagcataatattggattttatttcgttgcttgccacataactttctctctattgaagtataattttgcatgaaactgtaggttgggtcggctttgaaaacaggattctggacgatggtggacatggcaagtgggaaatacctttggcgcactcttgtttcaccaccaacaaaatgtgaatctgagaaggcccagtgatggagttctgatatttatatcattgttgatttgggaatagacgtaacccctattgtggttagattctgttcttgaagtgtaatatgatggcaactgtaacatgaggattacatcttgaagtaaatgtacaaaatagttcacgtttgagccttttcgtgtaacctaaaacaatgagtggagaattgtattaatacatgagatttggactgaagtttctgaatacaatagttggacactattctttattttcctgttgaaatgatgcttgttttgttttgttgaaatgatacttcaatattatctttcttcctttctatgtgttgtttgaagtatctggtccaggactgtgtttctgaaatgtcctgttaggtgcctggtatttgtgatggcgcttataaagcaagggcaacaatttcatggttgatgtcacatcttatggtaagttcttcaggtaagatatatggctgtgatgtgcaaaagaaaattagctgtactcatcctggtaagattactggtattgctggaggctggagcatatacatacatgcttcaaaacacgtatatatatgctgccgcctgccggaagattaggtagggggttgcaaatcaaatcacagtgtctgcaatgcaagcagaaggcacagttgtaccctcctaattacagtccagcagaaatgtggacgacaaaatgcatcgtagcagataaaagcattgcttcatagaaaccaaaacgatactcactagtttcagaaaacccgttttatgttatagtagccaaatgggtagcatatggacttgtgcttgaccatccagggggcttgttgatcatctttggtaccacggggaggcaccatctgcagggcagtgaggacagcaaactccatgtgaatttcgtcatcttgcatcatagaagagaacatcttggcgacgcaaaatctgccagagccgaggctgatgaggtcgagccgaatcggcgaccaggatgcaggtatgtcgaggtccaactaagtgtgtagctgaccctgtgcaatattggtgagatcacaagcgcacaagctatgggggtggtggcatgatagtccgaaccagagcttgagctccggcacatattgagctttgcctaagaatggcattgaccagaggctgcttataggccgccattgacggctcaccgtgtcaaaggcgtgagtgccacagagcttggaagaaacgtagatagtgttgtgtaggaggtaattgtagtttgggtggtcgttgtgaagggcggcggcggtagagaacgccatatggggatcctttcacaaaaaaccccatagctgagcacctcgaagcaatggttgctggtagtggggtggtgtctgaggttgaggacgtagaggcagtccggttcttggttgatggagacggccatggcatcataccccttggaacaattgaggttggggaagtggacgacggagtaggaggcggcgtcgaagagcacggtgtgtccatggttgtcggcggtgaggatcttggtctcgtcgtcgccgagaagggtgaccaagtcgagagatctttcgtttcggtgatgcattggggtgggctggaggttgagcaagggacatgggaaattgcggaacctgtccatgaaatgcagcgcccctggatgcggcctcttgccatcgtgatcgatgtaggacttggccatggctgctgcttcggctgctctcgctgatgggtagaagagacgattggcgggtatgcggcgcagagaatacaagtcgtcgtggttgttgtgcaccaacagattcagatatcgccgtcgacccatcgatctccaaataccctactgccctgatcaatcgaattaaagagaacaagttattagcaggaggcggcggtgaagtcagatggattagatgaaggcgaaacagagaactcgtgcctttgggctatatatggcccgacaggccacagcctagggccttcttcttggttcttgcacggtagctgacaaccaacaagaaagttgattattttctgattggattgctcccctatcatctactctatatatatgctgataactgtacaaactctgatgctgattaaatgtgcccttctcagctgatttgccccccctttccccttttttttcctgaaaaaaaagagaggagttttgatgcttttattgagagaaacatagtaaggtttttttttggtaccactaggtaattgcagaggacaccaccttacaaggagataatagatagaacattttaactatcaatcctaaaccaaaagataacagcccaaatataaagtggaaattagataaggtggcaagctataagataaactactccagaagacaaccgaaccacttgggccttttagagggttaaatcagatataatatttacacggtctgaaaataagcaagttacttatatattctcaatgttttaattttatttttctaccctatcacatgagacattcttacattggctctcaccctttaggttggttttacttcatcttcacatgttccaggaaggagaactgtgcaggcattgcaagaggcaacaaatttatatcatatctatcaagcactccaactaattatcccttctccatgaataaatttgttttcctccaagtaatcagcttatgaagcggagacaacacatgactttgtactgatgcaaggaattcagaacttgtatttgctcaacaacatatacggataaggcttctggttgcagagaggtagtgaaatccaggagatgacagtaagatacatattgttgtaccactaactagctagcaaaatgacacgccagcccagtaatgtcattcagttaggaccaaaaaacactggaatattacatgccactagctagtttagaattccaatcctacttaactggtaagtataccaccactaatttacttgatcattagtctcttatagtccactagaaatgtggacgcaaaattgcatatcagataaaagcattgcttcagccttcagagtatcaaaatgaataagattaggccatatgggctgattcatagaaatcataacgataatttagtttcagatagaacactcggccaaatttagttcagctgacaaggaaaaatcttcagtctccactgttttcgctgcctttccatttctgacaagatagctctcttgaagatacaaccagcaagagtgatactgcttcatacaattagcaaagtagactcttacagaccatgcactaatttagagttccaaattttcaatcctactcactagtcccttacagtccactggaaatatggatgataaattgcatatcaaacgaagcatattgtttcatatgaaaatgaaatcagtttaggcgaacccattctgcttcatatatagcaaaatgatattagtttcagaaccaattcgatttgcgttagaatgggtacacacatatcaggtactaatc

SEQ ID NO: 59710 - DNA, 2320 bp, Oryza sativa
agtccattgtgtcatcgtcatcgtaatcggagaaacccaatgtgcagtcacctgcaatagaacggaaaatcttgacgacgcaaaacctgccacagcccaggttgatgaggtcaatgttatagggcaaccaggattcaggtatgtcgaggccacccaagtgtgctgctgctgcaccgtgggtggctttgctgcatcggagaggagatcacaagcgcataagctgtaggggtggtcgacggatagtccgaaccacagcttgagctccggcacatactcagctttgccatcgaatggcattgtccagcagcccaggcgacgccactgacgccccactgtgtcaaaggcataagtagcatctggctccatggaagaaacatagatagtggagctgtcaaccaccgtgtaggaagtaatgtcggcatgcatgtagttggcaaagggcggcggctgtagagaactccaacagggagtcctcccacggaaatccttacaagaagaagtgtagttgagcacttcaaagcagtaatccttggtttcagggtcaacactctgggacatcacgtagaggctgtcttcatcccacatgtcgccactaatgttcttgttggagttgttgtttttgatggagagggaaatggctgcacaacccttgtcagaaatgaggttgggaaaggcaaaacggtggaggagtcggcgtcaaagacgatggtatgtccactgtggtcggcaatgaggatcctgttctcattgccgaggagagaggcgaactcgagattcctatgtcgacgctggccatcccagggggttggttcgaagttgaacatgggagagggaagcttccccaacatctccaaggtgtggaggcctggatgtttcctgccatggtgctccttaacgtacgcgttgaatgattcttgggactttgccgtggcctcttcagctgctcttgttgatgggtagaagagatgatttgcaggtatgcggcgcagagaatacagtccactgcgggcgttctccaccacaaggtttagaaatcgcctccccatatctttttccgaaccaaaactgatcttcttatctgacgggatgattctattgttgggtgggagtgcctatataacagttgccacaatttcagcctaaaaacagttagtttttcaccattacagatcaacggccaggacaaaacaaaagctcattactgatgaaacaatttgacactaaacttatagcataagtactagctgcatagctaaaaaccaaagctagaaggcaaggtctgtgcaaaaatagataaaaatataaatttacatgcacatagaactaaacctacatttttaaatacggtgtaactgtaatgtaagtgacatgtaattgtagttcaaatgtgatgtgagtaccttttaaccttaactttatcatacactacattgaccgaagaaaaataccagctaagagcagttggtaactcggcattcaaaacgggcttgcatgcttgcaatagaacgaatctgagaatcgatatgatgttgataaatcttactataatcagccaagaattgtggagacacaattttagtaattccgtaaaggaataaaagaaacaaaatacgacgaacgaccagacggaccaatagaacgaaacagcaatggatggagcaaaataaacccatacctgcagcagcagcagcaaaggatgtggatttcctttcaattccttgcaatctgtgacagtcggccgggatgcagatcagatggaagctgctgatctacaggggcagcgtgcaatctacaggaaggaaggaggagggttggacaagtcaggaaggatggcggcggctgccgaggctcagcctcagcgcgatggcacggattagggccgtctgggtcctgctagtcgcgatttctttatttttatattatttttttaaaaaataaaaattaaattacccttattaatcgccataccatacaaggggaagtgcgagacgtggcaaatgacggaaggggcgcgcgtcgtgtggcaattttgtaggcgccccttctcactcttccgtagaacgatttattactggggcactttcaaatatccgtggtcaccccacttgttattttttttaagataaaccattgcaacagtagattgtcctaataaatggtgatttatcatgcctttttggaggcagcaccctgcccgtaaaatttcaataacacgcctcttcggtcgtcctccatgtcacatttctcgtcctaacataggatgatttatatgtcctatcctatggtaggacataaggagtacatttctacaaaacttcag

SEQ ID NO: 59711 - DNA, 3750 bp, Oryza sativa
aaatgcaatagagatccctcatcttgtcacattacaaaatcatccttgaacggcaaaaccggacataacgcatccccaaacttataaaccagtgcaaaggaagtcctctggcggtattgtccctggttttgattgatgtggtgcctacatgcctcctttaactaggtcttcgtctcatgtgacattgatatgacgcttattaggtactaataatttagaaatgttaattacttagataccactagtaacttagaagagtctcttacaatcaatcctactaattattccaatcaaattaagtagagtctctgatagacaactaggtagctagaaacatggacatatgtataggagattaaagctagcattgcttcaaataccaaagtgaaattagggcacatatgctagctgcttgatagcaaaataaccatcagcttcagataacccattcgatgtaatcatcgaaaaattggtagtacatgaacttgtgcttgatcatctggacatcatcatgtttaccacgagggcgaaccatgtgaaggccagtgaagatagcgaaactcccatgaattgggtcagagtcttcaattgtgccatcgtcactctcagagtaggaacaaaatgtgccatcacccgaaatagaatggaacatcttggcgatgcaaaacctgccacagccaaggttgatgagattaatgttccatggcaaccaggactgaggtatgacaaggtccacccaagtatgctgcaccgtgggtggttttgctgcgacggatgagtcgtcggagggaagatcaaaagcacataagctgtagggatggtcagcagacaggccaaaccagaggttgagctctggcacatactcagctctgccatggaatggcattgtccaggagcccagccggcgccactcacggctaaccgtgtcgaaggcgtaagtagaatggattggcttattgcaagaaatgtagatggtggtgccgtgaaccaccgtgtaggaggtaatttcggcgttcatgcagccggcgaagggcggtggtggcagagaaacccaatgaggggtcatctcacggaaatcggcagaggaagaagagtagttgagcacctcaaagcaaccatccttgattctgtggacgtcgggactccgggtcatcacgtagaggccgtcctccggcggtggttccaacccgttgttgttgttgctgccatcgttgttgataatggagagggatatggcgttatacctcttgggagaaatgaggttggggaaggcgaggacggaggaggagtcggcgtcgaagacgacggtgtttcccctgttgtctgcagtgagcatcctgctctcgtggccgaggagacaggcgaagtcgagagacctaagatggtagcgatccacgggggccggctcgaaggcgaacgtcgaacggggaagcttctccaacatctccatggtgtggaggcctggatgcttcctgccaccgtgctcctccatgaatgattcttgtgactttgccgttgcttcttcagctgctcttgttgatgggtagaagagacgattcgcgggtatgcggcgcagagaatagagtccaccggcgccctgcaccaccaggttcacaaatcgtcgtcgtcccatggtacgtatctgctccaaattccaaacgccgagacgacctgattctaatgtagattagacaccatgcaacagctcgcaacgaagaagaagatcaatatggtgtggagagagaaattaaagaagatcgaagaaccctctatatatacgtcgaaaagcagtaagtaatccttggagtttatagcaatggccggaggtattcgatgcatgcagtggagttggagacggcgggcggcggcggaggtgccggcatggatggagtagatgaaggtaaatctgcggcagctcgcgtctttgggcccgttggcccgattaacatgagtaatatttttcctccttaatgggtccaacgggccggttcaagtaggccagtaattcctttttctttttacaagtccgcatgacaccttgcaaatttcatttcaatttcatccttgcgacagagatttttttttttactagtaaatggttcgactgtaacctctagttttgtcgaaatgatgcttgttggttggacagtggcgttttattgttaaaatgagactgtactacagaaatatagggtcgttcttactttcttcattttctattcaaagtactgatgcaacttgtaaaagctagcgtctgcaagacgaatcacagttgcacaccggaaaaaccatccttaaactttgtgttacgcataagaatgaagtggtaagcggtggatggtttcaaccctgaaatctcatatttaattcttaataagctcacactttcttttaaaaaaatatttgaagggacttttccccctccaaatctcgtttcatgcatatacctaaatgccattgcacataggtataaaaatacttttcggcccaaataggatgcacatgacactactcctgtattgcacatgcacctctaatttattagagctccaacaactactgagtagtcagtactctcctaccgtccaccggaaattaactaaggtggatgataaatatatttccatagaaagaaaatcatattgattcatagaaaaataatattactttcaacacaccaattctcatctataaaaactcgaaattagtttcttagagaacaaattcaatgttataggcgttgaaaatgtaatacatggacttgtgcttgatcatccgaacctctcttggatcatctttaccacgggggcgcaccatctgcaggccagtgaaaacagcaaaatccgcagcaaaatcagagtgaatcatgtcatcatcagagtcgttgagtaaccaccagaagtgaagatcttaacggcgcaaaatctgccagagacgaggttgatgagcttcagctgaaacgtcaaccaggacctgaaacggcacacaagctgtacagatcaaagcctagttccttccatctcctctccgagaggataataaggtcaaggtgacaggaaagcagagcaggtcaaggtttttctccatctcttgcaaattcagactactattccctctgttctgctttactggttataaaggattacctcatcatcatcatcacatattgtcggccaaggcttttttttagcatatcctatcaagacaaacactactgtatataaactggcaacagctgaaagatatataaatgtatagtagtagaactgaattttgcatgaccacatgacttatcttaaaacgttttttttctctctctctctaatttacagcgatcttatcaggaatctatcattgatatctcagtattatttctcaaagcaaaaaaaaattctcaaatcttacaaaggacaaaagcatctaggtgggaaattcgcaagttgcaatctgaagagtatagcctttgtcatatgtacaacttgtcacagctacaattgggttgttgagattaaccaaatccagtcgacatttggacagtctgattagcagtattattaacatcttggaaagttgttgggtgatcaattaggaccgtgaaaaatgagctcttggatgttggatctatcctcagtgacagggacaatttattttcctcacaactcacaactggtgtttaaatagcttttgttcagacttttcaacatgtgtattatattttcttttgtttaccaataacttcgctctctgtgg

SEQ ID NO: 59712 - DNA, 2567 bp, Oryza sativa
  unsure (1)..(2567): unsure at all n locations
tttgtttgataaaaacttatgttcaatatctgataaggtatacctctgtagcactattgatatgagaattttcatcaacaagatgataataaaaagttaaaaactctagaaattcttgagtgcctggtgaataccaagaattgcatacttcatgctgcagaaaccttgctaatggtgtcacaacattgcacccaaacatagctttatgacagtatcaggacgaatatctgaagaaagcttgaaaggctcaaagccaatttttatattgcagctcaatttctcataaaattactctcgacagactccatctaaattgtgcataaattgcctaaacatcaactctccaaatacaattgcatacattgtctcaacatgaactctccagatacaaaaacatagatgctaaaaagaacacaggcaagacaaataaattcatttgagctaaaacctaatgaatttgaggagcggaaactaaatgcttgagacatcaaaatctactcttgcgactgctgctattcatctccatgctaggccaagacaatgtccttcagagctggccggatgccctcctccagtagctgtcggtactccaatgaatcgccacttgtttgtttcatctcgatgatatgataggaagtggtaacctcaaatatctctatgtcaaactgaagaacaccattccttccctccttcctcccttgcatcttcactacaccattgtctttcttccttaccctgagatttagcgcctttgctacatcttctagctttgagattatggttgaggcagatttatctgaagtgaaccttgcctcatttctccattcctttacaatgaacatgccagagagatcaaatcccttggagaaagagataatttcaaaagcatttaagtttgtcactgacatgggcttcacatcttcatgagcatttttcttgcgtctcacaccaagcaccggagcaacatttttggtggtgttttcattcaaagttctttccttcaaaatacggttctcctcaggacctttccggaaccaggtagactcctttatcttctggattgaaatccttgtgcttgggttggggtccatgatcttgtacaacaacttctggagtttgcgtgaaaannnnnggggcacctgaattcaccgtgttgtatcttccgatacatttccatcaagtttgggccctggaaaggaaggtaaccagcaacaagaacaaacaggataacaccacaagaccaaatatctgactttgcaccatcatagcctatcttgctaatcacctctggagctacatatgcaggtgttccacaggtggtatggagtaagccatcttgcctcttcgactctgaaagcgcactcaatccaaagtctgagactttcaggttctcattctcatccaacagtaggttctcaggcttcaagtcccggtgatacacacctcgactgtggcagtaatccactgcactaatgagttgctggaaatacttatgtgcaacaacctctgtaagctttccacgctttgcaaccttttcaaatagctcaccacctttcacatactccatcacaaagtagatcttgttccgtgttgccatgacctcatgaagctgaacaatgttcttatgagccaccaaccgcatggttgtgatctcacgtctgatctgctccgaaagcccgaccttcaatatctgctgtttgtccatcatctttatggccacactctggtttgactccagattccttgcatagtgcaccttgccaaatgttcctttccccaacaatctccccaactcatacctctccattagaatcttccctctactctccatgcccacaaagatataaatctcagcactatgttttgaccaccaatcagatggactgcaattctttagccatcctccccaaggtcatgatcgtggatggagaacaacattcttatatcatcgtcgtttcggagtctaaatggtgtagaattagtgcaggaaagttgatcactcacatcaagacttgagtagatcagtagcactggtgaaccagcaatctgttttatctcacacggaaaatttcttctatgcaagcacatctttcagcattccttgaggctttcactgcttgttttttttattgattcccctgtataaacaaaaccaggcatcagatttagtaattgaatgtcctaggatatgcactcaagtgctaacaaggtacgtataataatctgaaagtctgtaagaactttaaccaaacaaaagttaatgcgaagaattttgaaggcttattgtaatactaaatgcatttttgtacctactacttatataatataagtgttccctagaatcaatcagaacttacatgagttcaacgtgttatgtaatagataattaatataataaggaacttcaactaagtacttatcagaaatctaggacagtaaatcagaagctaacaaaataaaactagtcaattacgaattaaaatttgcaaccgatgtgaattattctacatctttcgttcaagttcagaaaggtgattaataaaactagtcaattacgaattcagaga

SEQ ID NO: 59713 - DNA, 1437 bp, Oryza sativa
cctgcagccctcaagaattagtagaaagaaacgctagaagatgatatggagagaggaactgcataccttccggtgacaggaagaagaggagattcaggtaacaaaaggtgaactttttggatctgtccctcacttctttctcaacacctgtttgggtagagagagagagtttttgagtggtagtatcaggagtggatgcgaggacagcgagaagacggggttctcttttatacagggggaaccgatcaagaagaggagaggaggcagccgccagttggagaagaaacagtggtgccttgcattattagcagagattgatttgacgttaatgaccctgatttggctgcgccgcgtttcctgggcaccgcatcgcataaagagcatatccatccgactcacccctgactagtcgcccttcaccacagcaatcattcatttggcttggcttggattggtttggcttggcttggggcttaatgataatttaattaattatttcacaattgatgatggtacagctcatcattgtgttcttgaaacaggtacagcacataatgtaccactaatcaccttgcctaatcctatttatagatctgaaggctgtgatgctgtcttacagaaaatgagcacttgtttccttctttaatctgattccgttaactgcaacttttattttctgaggaaccaatgttaattgaggcatttgttagagtagttttccatgtgatgttgtgtttaatttggtttggagttactcaaatgcatggcattggctcatctctcatgatctgatcctttgctgactcatcaatgggttggctgttcttcaggtattggaccaccggaaatggttggtgacttgcagccatttatccgtgtgctactagctggatctttggtgagcggtattcaattatcaccgtatatacttatttcctccattcaaaaataaatttattttttacataaatatgaatatagtcaaattcatgtatagaactgaacttatttaattttagcatggatgtagacatgtagtatttgtttcggtcaggcatcattggtttttattgacatcggcctgtctatattttaccaatgaataatcagcttatccataagtttttcagaatatgttgttatgcatattgaccttagatttaaaaataattacttaagttactagaagaaaaacatacttacaaattaacctcaaagaaaaccgatcaatacaaacttggcagctgtacagataatgtacagatagccgatgacggctcaattggtttgcatcaatcaagcctttcatgagagcgaaaaaaaatctgtgccacttccaagaaatgtctttgtccaaaattaattatctgcacacgatatgtggagtccatgcgttgtgttgcctgcgtgtgacaaaaggaattacattggaatttg

SEQ ID NO: 59714 - DNA, 11033 bp, Oryza sativa
tattcctgtaatccattatctaaaaagaaaaaaacctatcaagtactcctcaagtagtctgaagatgcttactttttaatactactcatttagtttcacaatgtaagtcattctaacatttctcatattcatattgatgttaatgatttagattcattaacattaatatgaatgtggtaaatgctagaatgacttacattgtgaaacggggaaagtactatttaattagttaattaggtgtcaatcttaggagaagtgtgtgttcaggttgaagccggtggtggtgttactagcaccctggcctacaagggaggttggacatgacaaggactccaggaaggagaacctgaaacccaaaatgaagatagaaaaaggaaaagagaaatgatcgtttgtctgaattcaagatacaatattcagtctagtcaaggaaaggaatactaccatttataacaatttattaggcatggtctaaaatttgtgaatactcaaaggtgttttttttttcaaaataagagtatataagatacccctgacattacttaagctaagataaaacgtgaaaagaatatgtcagattttttacgaaaaaataagcaaagtcaaatacggatcatgtgaacatattctgaaaattcagttgtggttggtcttgtgctgttccaacgtaaccaacctttcctcctcttccctctgcacatctgaattgtcaagcaaccacaactcttgtccatcctctccaatcttaagcaggataacacaaagaattcttccttcacattcccattcacaatccttccttattcaacaatttgtctgatacttgcatgcccacaggcagctcaaaaagctagctacttgtttctgacttgtatcatttctacatagatagctcaaagcctctcaaaatcctgcatttcttgctcaaatggatttttcaaggcatagattcttcaaattcagatcagcagctgtctccttcctctccatgtaactaatttcaagctctcaagatcagcaagttcagcaatcactagactagctaggctcactccttccacatatagtcacagctgctctcatcaatcaatctatctttccagcttccaggtgacaatcgagacctgaatttctgaactttttttccctctcgtcacttcgtcagtagaaatccaaggtttatattcctctgtactactacacaacagagtgagcgtagtacgtgtctcatcagcatcaaaaagtgacatactgaaagcacgccacaattgaggccgattgatagaatcgaattccactcaaaattgcacggtggaagagaatcccctgcgtgcttgatttgatcaggatttatattggaggcatccaattccatcactcaaccggagctgtctgtctgtagctatcgccctatttctgctagctcgtggcgtgccagtttaatttcttccaaaattctccggcctcacctcgcgtcgcgtcgcgtcgcttgcgttaggaggtgcctaagtagtggcttgtcggcgtcagatgagtgcagggacgtgctgctcggaggcgtccatggcgtggatcgactgctccctcctcgcctggctcctcttccgcgtcgtcttcttctcctgccacgccaagcagttcagcatcttctagcactcgatcagctaggctgaatccacatatactccagcatatatatacagcaactgattaagtaagctgttgctcgccgacgacggtggccgagcatgtccggtgcacggcggtgcggtggccggacgtcggagagaagctcggtggtgggcgacaacaggaatggatacgtcgagaccgacccaactgggcgctatggccgggtaatttattcacttcttcttcttcttcttccaaagagaaatttgacttgtttcctttcaaagttcaatcttatcatgattgccaaatgatcagcaagcaattccgagctattcagggtcaattcagttcattgctttttcgttcaaaagaaaaaaaaatcagttagttgcttttgattctacttggacatggattgtgcctatcatgcatgagtttagttgttcagctctatcatgttctttagatgtgggctggtacttggtaattacatttcaatacacgttgtaagcatcagttaaaacatgttggcttcattctctttcagaaaagcatgtaggctttatgttctttagcataattttctagagtagattccatgttgatgtacacatcggagctaacacctctaaactatgcaagacacaattattgtgtctttagtactttcatcgtatccatttggcttttgctgctatctatgggctgcataggacaattgaatattgcgcattgaaacatatcaggtttgaggtttcgttgttaatcctaagccattgctgtactgaaagataacatcatttttttctatatttggtcaaataacggaagtgcatcataaatttgagatgatgagtgagaattcgattatgatctcttccaatccaatcagggaaggtaaggtgttccttatcaaacaagctagagttgttgtttggttggcattcagtttcctaatatgttggatttgatctgaatagataagcatgttccatgtgtcaatctgccaataatcagatgttgaaaaagtttcaagagtggagtatatgccctgtctggtcatgctcatgcccaacgatttgatacgatccgctcacctttttcttagtgggatgaagacgtattggcaactttattagttcatctttttcagtagtttctctagggttagaggtgtacttaccggcaacttatttgtagttatgtgagctttttgcaaaagtgtcttacttttataaatttgacaactacccactactttgagttaactttttatatgtatagtaattttaacttttgatcagaagtactggttgtttagtgctaaattagggagagtagttaattgaggtgccaaattggttctcgtaactcaaaagtgttgattttatttgactagagattttctagacattactgtagcaaaaacccgtttggaatctgcatttttcacttcagaacattatgaaaataaaacttatataagatttttaaatcccatgtaaaattaaattttaaaagatgactataaaagtgcactacaataaataaataaataaataaaatttatctcattctcttgaagaaaagcaattcattaattgcactttctagtgtagtacaatacacaataatattgttttctgaccatgtgctcatgatctgtaagtatatattttctctacatatgcaagcatgtttgtttcaaaaactttttaaactgcacgaagtataaaatatttagaatttagtgaaagcaagcatttcgaatcaaaattaaacttgtcaattcagaataaagtagtctggctagcttgacaatatatagataaattaattaattcgctttgtgctggcatgcatatttctggtatttcagatatatcagaaatttcgttttgtactttctgctatttcagaaacttgaagaatttccccccccccaatatgaaattaatttggctgaaaaaaaattcttgtttttaagtaagcaaattttaactaaactttaaccaaaatttgttgaaatttcaaccttttcggcctgagatttccgaaatttcggttctatcgaaatttgttcaaattttgtactgtatacaatatgtgtgcagttgtcggaggtgctggggaagggtgcgatgaagacggtgtaccgagggttcgacgagctgcggggggtggaggtggcgtggaaccaggccaccatctccgacgtcctccgcaccccggacgccctccaccgcatgtacgcggaggtgagcctcctcgccgacctccgccacgacgccatcatcgccttccacgcctcctgggtccacccctcccgccgcaccttcaacttcatcaccgagctcttctcctccggcaccctccgctcctaccgcctccgctacccgcgcgtcagccgacgcgccgtcgccgcctgggcgcgcgccatcctccgcggcctcgcctacctccacgcccgcggcgtcatccaccgcgacctcaagtgcgacaacatcttcgtcaacggccacctcggccaggtcaagatcggcgacctcggcctcgccgccgtcctccgcggctgcgcctccgcccgcagcgtcatcggcacgccggagttcatggcccccgagatgtacgacgagtgctacggcgtcggcgtcgacgtctactccttcggcatgtgcatgctcgagatgctcaccaacgagtatccctacagcgagtgcgacaacccggcgcagatctacaagaaggtcaccgccggcaagctccccgacgccttctaccgcctcaccgacgccgacgcgcgccgcttcatcggccggtgcctcgtcgacgccgcccaccgcccctccccgaggagctcctgctcgaccccttcctctccccgtctcagaaccacgacgatcacaatatcattgctcatgcccctgcgccgccaccgccattgccattggcgtgcagtaattccagtgaggagcaagaggaggcggcgccggcgccggcagcaaagacgacggacatggcgatcaccgggaagctgaacaaggagcacgacaccatcttcctcaaggtgcagatcggcggcggccgcaacgtgcggaacatctacttcccgttcgacgtggcgaacgacacggcgatggaggtggcgacggagatggtgaaggagctggacatcgccgaccgggagcccacggagatcgccgccatgatcgagcaggagatcgtgaggttggtgccagggtacaagcagcacgagtactcgtacgcggatgacaacgacgatgatgacgtcagcggacaccctaatcccttctactacctctcctcttcgccgacctcctctcagggatctctctgcggagtggggtccacatcgtcagaggggtttcctggcccacatggaaaagttgactggtcaagaggtactataacaaagtgttttcatcttgattactttcctatatatcaacaacgtgctattctaatctgaatatggttctagctatatagaagataaaaggttgggttttctatacaaatctcttgagtaggtagaagaaacttgcataattaaacatttttacatacagttttgaaatgggcacatgacgtagtagcatgcatgcagtgatgcagatgataatagtgcggcaccaacttccaaatgcatgtatgtatacctgaagttagcttttgttcatttgctcaactgcttttgttcctatgcaagaaattaaatttcctagtcaccatatatatgaacagagaaattggaagtcagacgtgcaaactactagaggtagctagctagcaaggtggttgatatatgcttgtccatttgtcgttgctattcgtgccaatcctgtgacacgaatacatgcgtcagcgttatatcgtttctgttcctatatagtactagtagctagcagcttacagacagccatgcattaggttcgtgatgcataattgtggctttcactgtcacaattgatctctgcagagacatcttagacggataaaaattgtgctcagttagtcgtgttacaatcatcatcctggccggccagcagcataaatgtcaaatggaatagttgtcatgtaacatacacatcaatcattatatctactacaagtactaccaccagctggttagtgcagttaataatgtgcgcatgaaataatggacatgaataatgaataaagattaggcactatatatacacatggtacatatatagctccccatttcattgtcatcgaccgcatctttattcatatccatttatttcatgcgcacattattaactgcactaatcagctggtggtagtacttgtagtagatgatgttttgaattgactaatccgtttgatttgatgcatggtgtagattactgttactaccctccaagcagcgtcagcgtgagcgacgacgatgacagcagcacgagctcactctctgctgcagtcagtgcaagcagcctgcatcagcagcagcagcattgctcggcctcttccagcagattggggccagcatctgcatctgcatctgaagacggaggaggaggacacgccggacggccacggcagcgagagggggaggaggagcggcggcggcggaggatgagtcggaacaggtccatggtggacatgcggagccagctgctgcaccggacgttggtggaggagctcaacaagcgcctcttcttcaacaccgtcggcgccgtccacgacatcggcttccgcgaccctactgctgctgcttcttcttcctctagctcttcccaccaccgccggagaagcagcaacaagatcgaccacaagcaccactacatgttctgaataaacttttcagagcaacttaatttgctactccattatgtacagagaatcagatgcagagtattagcctctgataatggattagggccgttcactttgatgccactttgaaccttactaaattttggtaaaactaccaaaaaaaagtggctacatttagtttgttgtcaaattttagtaactatatataagaaatcctgctaaaattttaacaagttgccaaaatttgataaggttttttttttgacatcaaagtgaacatgcccttaatgtgcgcagtgcagagtatgcattgcgtgcgcggccacaaaattgtgtatatttggaacgagtgcatatatatatatgcgtgttatcaatgagagtttcgccatgagacatgtaagtgaatatgggagtgatatgtacatatagttgttgttaccagtggagtacaaaatactactccagcatgcatgcgctgctgaccagagtttttactgatgaacagctctcctaatcaacgcgctgtttttttttcaagtttcaattttgctaataaaaatggctctctctttttgttgaaagtgttttcagctttggtgagtttgctggtcgttctccgacatcttttccaatccaaatttttttccccgaaattgattgtggaaatcaaccaaaattttctaccccgagatcatcttgggctctggacacactgatgtgatgaccctaccttcctgggccacgtccatcgatctctgggctgcagtaatgggccttcgcccatcaccgcgcgtgtgcaattactgcaaggaataagttcactttaggtccctctatttgtcggtcagtccgattttcgtcccttgaccacaaaaccggatacgacccatttctcaacttatcaaaacctaacaaacaagatccctcggcagtatggagtgtggttttagccaacgtggcgcctacgtggctcctctaactaggtcttcattccacgtggcattgacgtggcaactcgatctgaaaaaaaattaaaccccataggacccacatgtaaattaaaccccataggacccacatgtcagtttcacgcataaagtaataaaaatggtggggccccacatatcactcccacccctacctcttcttcttcccctctcccccatctcccctctccggccacggtcacgccgccgcctgggacgacgacctcaagaagacttcgcccgggcgtccgcccacgtcgctgccccagtccgtcccgtcgggcttcacgccgccgtccgctcgcccgccccccgcttcgccccgccccgacggcttcgcgccgctgcgtgccggaagacgacgacgacgaggctggcgccctctgcttggctccgccgcccgccgagtcgcagccgtatgcggacgggagctcgacgcggcccgccgcggaggaggaggagaccacggcgctcaagactctgcaagttccatctagctttgcaaggcccatcaaccgcagcatcatcagttcttcttcttcgtcgtcgtcgtctcagaattctctgcggccaaagcctggtattggcagggctcgccgcaagtgtcgccggagagaggcggcgccggagcacggtggaatcttactataaatgcctgtatggtgatgttggatgctcattcagattacctgctccaataatagtcaagactcaagagtcgattaatttctaagttccaataatatttggtgtttatatatattggactcgcaagcaagaactactacaccaggttaggtgaatggtccagcttgcccaaaagttgcagatgaaatattcagacctgtggatcggacaaagtgttcccgtttgaatcattgatcatagctggagaaaaaacctaggagctggggataactaatatgatatatatggaagacgtgatcatctcaactaacaatctatggcgttgctggttgtagttgctactacacgtttgatgggaaacatgcaggggcggcaacaacctgcacggctgcgtggacgagggcgccgcggcaggagcaggcggcggagatccccatcgtgctgttcctgtcgatggtctttcccggcacgacggtgcagctccaggtgttcgagttcaggtaccggatcatggtgcacatgctgctccagtgctccaggaggaggtcaccaggttcggcgtcgtgtactcctgcatgggagtgggggtcggtgtggcgccccgccaggtggggtgcgtcggcgacgaccggtttcgcgtcgtcggcgctgtccagacgaagccgcacgcggtcccgaggatccgccgccccgccatccgcccgccgccgccccccactccgcgcccgctctaccacccacgcgaagcttcttcgtcggcggcaatggctgataggggaagatagggagaggagaaagaaattgctacagcctaccgactgacatgtggggtcccatatgggccccatcacatttattttgttgtgtagttgacatgtgggtccacgcgggccccaccatttctaaattattatttttttgtgtagttgacatgtgggcccgtggtttttattattttttcgagatataattgccacgtaagtgccacgtcattgccacgtggaacggagacctagccaaaccagccacgtaggcgccacgtcagccaaaaccgctatccaaaccgccttaggaccttatgtgcactggttttgtaagtttggggatgcgttatatccggttttgcggttcagactgggcgacaagagggacctaaagtgaacttattccttactgcaacgcgtaaacagcctgcaacttgctgtatctgtatgcgtgtcgccagcttcggaggagggcacggcaacgatccagagtcaacggtcaaatgttccctatcccatttacatctctctcttgatccaatgcattgtaccaccaacttcttctccaagcactgaccctaaattgcctaattgtttcctcttttttttttatgaaatagaaatcatgtatttgtctcatcttctcaaggtgttcaatgtgtctcagatatcgcgcgttgtcaaggaccaaattatgctgcatatcttgctaacctctttatattttgtatctagctgatcatctcgtaattaaaaggtagtaaatttgatctgtaattctaacatcaatgtaattctaaatttgatttgtcccatggaagcataaccgatattacataaattagactcatcagctgcacccccctccacccgctttctttttcctttcttattataatctcctagcccctgggctattgtacagtttttccccctactttacaaatacaccccgcggggtttaaaaaaaaacatcaatatgcatcacagcagtcagaactcagaaatattcagaaaatgcaggggaaaccaaagaaaaacgttccattagttgttgcgaactagctagcaaatcgatctcatgtatatatatatgtacatagtttctgtatatccaacaaatcaacagataaaaagaaacaagaaaaagaagtagcctgtgtcatacactcatacatacacaactaagatcgagagcctacagaggaggaagaggaagatggcaagtacgagcagctagctaagctagtttgtgcgcttgctggggctggatggttgtggccttcctctgggcttcatacttctcaaccaagacagctgctgctgctgcaccacttgttcttcagtcctcgtcgtcgtatctgctgatgctgtctccgattcgtgcttcagctgcggctgcatcggcgtcgtcggcgacgggagaagcagaggcctgctgcagctgccgtggtgcgcgaagaagacgagcaggaggagcagcacaagcagcagcaacgacgacgacgagctgcagggcttcttgttgcttgacaatagcaatgtggccattgttgtgatctccttgtgttggaagctaatatggatggatttgcagaggaattgaagcacaggtagctatccgggatataaatacaagagataggtagccgcagagcgaagaaaagggggcgtttcaattaaagtcaatggagaggagacgatcgatggaattattaactcaagctaagacgtgtttcctcttccaaaagattagctctcaagacgtgtggaatggaaatatggaatcaattaagccagttttgcaagctggaaggaagaagcagaagaagatgtagataaagaagacttggtgtgaggggaggcgtgcggatcaagttgaagctagctagcaacgatcgatggagggacgacgcgttttgagtagcaagctccacctggcgagaccgtgtagccgtctacacattgatgccactagtatactgtacattctgcttcactcataggctgacaggccacgtaccgactttctatcagcacacctcatctatcagtaattccatttaatttgtagcgaaaatgtttagctatcgtgcaaaacgctaggccccatgcgatcgaggccatgtcttaccgataatgggagtatttggagttggtaagcgatagaccacaa

SEQ ID NO: 59715 - DNA, 3007 bp, Oryza sativa
ccagacggcgacaatgaagcagacgaggaacaataatgccttcccgtccgtgcctgcatgatgccaatggtgcatgcgttgccagctatgagctattcgtacgtgcactcgatcgatcagtatcttgatgatcttgatcaacaatataatataataattaatcaaaagctgctgatgctagccgcagtacgtctctttaattaagctgcctggctgcttaatcgattgtgtaacatgccagtattttttgccaatcgacttgggcttatatatctcaatcgactctggatcggagtaattcccccgtcacaatacataagaatatataatatgatgaaacacattttaatactataaatctagatagactctacaaccaaatctataatcgaattcgtagtacttagatatattctatttaattaatactagttacatagtcgtgttacacgtgacttttgattctgtttaagtactttgctatatgcaacctcgttattccgtttatgcttatgcttgtatttcttaaattcttttcatgactctgtagtgtgagaccatgaacaaattactccctcgttttagaacatagcaatttttaagcatgaatctagattgggattgagggactcaagagaaacacgtaggggtcttttggctagctccacaatgtggtgggctagacgatctcggttcaaaacctcaccccttctaattacttgatattagatcattccctaatatttgtgtcttttttttctactaaaaaaatagttgcccttctatctcaatattaatcttctacgtaagtacaagatactagataatcagccaattaatcaatacagaattactacatacagtgacatattgcagaatactacaatatacaacatgttcagtgacatattgcagaatactacagtatacaacatgttatgttcgacattcttttttcagtacaactgcatggccaaaattaaagcgaactctagtacagcacaatccatctgctatctgaatttgggatcagtttcatcagaaatagtgtcttgttgttcgtgacagaggaacactctgcacgccaccatggtctcacccaccttcatccccggcgtcacggtgaacgcaactccatctcctccgccacgaccagcatcggcggcggcggcggccacgacgctgtccatgtactccgccgcgtacctgctccctctcctcgcgtacaacatcctcacacttccacggccacaacatcgccggtgcgccgtcaccgccacctgcagcgcccacgccgacctcgccatcgtcgcgaacgccctgtagaaccacgtcctcaggtgcccgcctcgcgacacgaacgccctcacgtccagattgtttctgaacatcgctgcctccatctctgacggcacggccgctaaatactttgttcgacagaatctcgcgaagctggagtttggatgcgccatcaacgcgtcaagagggtcacagcacctcatgatccgatcgaagcgagcaagatcgagttcgtcatcatcttcagcaccatcatgtactgcaagcattgttcgtgacaggtaagcttccagcgagtacctcttgtatggtgaatgttcgtctgcattgttggtgcaatgatgatcagatgaggaaatcaagctaaagatcagctctgcgaaatcatgcaccgatgtcgatgcaaccttgaacagctccaagactgcactgggtgtcgtcaactttttcaggacaacggagtaatccttatgatggttaactgatggtttgctgctactgatctgtttattcagtctcgaattggcactcttcagaccatccagctctcttctcaacagcataatgtctgaatccttcttcctcgtctcagcttccagttcctgcaccagcgaccatcgatcgttgatcagtgacccgacgctgccattccaactgcataagctctgaagagcagtgaccgagtcgagctcggaggtgatgatctcgtcggcgaaggctatctttggaggattataagggatatgggctttctgcagcttgatgtaggctgacttgagagctccgatttcctcaaacagtcttgtgataattagcctctgatcatatccgccacaataatctccaaattctgtcttcgtgtcagcaaattcaggcgcggcacaaatctttgtgattttgcagagcttggagaagcctaatacgagtccaggaacattacaggtgctccttgcaactgaacttcttggtgttcttgactccattggggctgattcagtgaaaaccaagaaacaaaagaagaatctttgagacgacatgggagagtatggtaaaattatctacgagaaaatcaatgtaatcaatggtttgaacttgctttacttctctaattcgacagaaagactaacaaacctctgtttatgaccacagaccaaatgcagcaatatctttcattttgtgagatgtaaacccaacagtaaaccacagactacataggctccatctccactgttttgagcacttgcacaacaaaattcagatactacaatgtactactagtagatttgagcaataagctggagccttgcatttgcatggttgtaatggatagaattggataaagcagtacacaacagatagagctatgcaggatcaagaaaatatgttgcagacaaacagatttatttgttgaaaatgaagggtagaaccgtagaagagcaagcatgaagtacctgggactctgggagagggaggctgggactgacaagtgaaatgctgaattgaattggtgtagagtgaccaagtctgaagctgctgctgctgctgcctgctatgcagagaggaaagcgaaagagcaagcaggagcagtagtacaatgaaggacaagaaatggacatggcagtggcattgggaacaacaaaagcaaaaagcttgcagagacaaggtttttgcgatgcattgtggccactggaatggatagtgtgtgctg

SEQ ID NO: 59716 - DNA, 3312 bp, Oryza sativa
ggtgccaattttcctttgatatgaaaacgacgaactcctcgaagaggcgtgacacgaagatacacataatctccttcttcaaaactcaaatctctgcggcgattgtcggcataactcttatgacgagactgagccactcgcaatctttcttgaatgattttcaccttttcttctgcttctcttaggatatccgtcccgaaaacctgacgttctcccgtttgatcccacaaaagtggagtgcggcacttccgaccatacagtgcttcgtaaggagccatctgaagactagcttgataactgttgttgtacgaaaattctgcataaggtagactcttatcccaacttccaccgaagtctaaagcacaagctctcaacatgtcttccaaaatttgattcaccctttcggtttgtccgtctgtctgcggatgataagcagtactaaagttcagcttagaacccatctcttcctgaagtttcttccaaaaatttgaagtaaactgactgcctcgatcagacactattttcttagggacgccatgcaaacacacgatccttgccatgtacaattccgccaaccgacttccagaataggttgtctttaccggaatgaaatgagctactttggtaagtctgtcgactatcacccaaatagagtcatgacccgatgacgttctgggtaaaccagtgataaaatccataccgatttcttcccacttccattcaggaatctttaaaggctgcagcaaactggcaggtttctgatgttctgccttgactcgctgacaaacatcacatactgctacatattctgctatttcacgtttcatacttgcccaccaaaatctttccttgagatcctggtacatcttagtactaccagggtgaatagagtataaagtatcatgagcttctttcagaattacatcttttaaatctttgttgtcagggacacagattctctcgcccaaccaaacagttccttgctcatcctccaagaaaccgatagcttttcctcttctcatattcttcttgatctctgaatatcaggatcattaatttgggcttctctaacttgatcaattagagtgggcttcgcttctaaagctgcaacgaaacctctactgacaattcccaaatttaatctttcaaattcctggcataactccaatggcaactgtcgtccttcggtagcattgcaatagcctttcctgctaagagcgtcggctacaacatttgcctttcctgggtgataatgaattcccatgtcataatccttaattaattccaaccatctccgttgtctcatgttcagatccggctgagtaaagatatactttaaactcttgtgatcggtatatacctctgtacgagtaccgaaaagataatgacgccaaattttcaacgcatgaactactgcagctaactcaagatcatgagtagggtagttcttctcatgcggacgtaactgacgagatgcataggcaaccaccttcccatcttgcatcagaacacaacctaacccaagtttggatgcatcgcaatagacttggaaacccttctttggatcgggtaaaatcaaaataggagctgatatcaagcgattcttcaactcttgaaaactctgctcacattcttctgaccacttgtacttcacatctttctgtagcagtcgtgtcatgggcttagcaatcttggaaaaattctctataaacctccggtaatatcctgcgaggcctagaaaactgcgaatctctgaaactgtctttggttgtttccagttggttacggattccacattactgggatcgacggcaactcctcctgctgagatgacgtgaccaaggaacttcacttcagacaaccaaaattcacacttgctaaacttagcatacagttgatgttctcgtagcttctccaatgcaaggcgaagatgttcttcatgctcttctttggttcgggagtagataagaatgtcatcaataaagaccaccacaaacttgtctaggtattccataaacaccttattcatcaagttcatgaagaaagcaggggcattggtaagtccaaaagacataacagtacattcgaacaacccatacctagtggtaaaagctgtcttaggtatatcttcctctttgattctcaactggtgatatcctgatcgaagatctatcttggagaatacagtagcacctttaagctgatcaaacaaatcatcaattctgggcagcggatacttattcttgatagtcacatcgtttaatgcacgatagtccacacacatccgctgagtatggtctttcttttccacaaaaataaccggagcaccccatggagatgaactcggtctgatgtaccctttctgaagcaaatcgtctacttgccttttgacttctgccaactcattggctgccattctataaggtctcttatggatcggagttgttcctggtaccaaatctattctgaactctatatcccttttgggcggcataccaggtaaatcatctgggaacacatcgggatactcccggactataggaatctcttccaaagttatctggttcagtcttgaccttaaagactcagatgacaatgcatgaacagttacaactcgaccatcattgctgatgagagttacttttctgttagcacagtctatcacacctttatgtctggctaaccagtccatccctaggatgacatcaaggtctttggattctaacaagataagattggccagaaatggtactcctttaatttctattctgacagaggggctacgttgcaaagagagtgcttgattacttggggtactaaccatcaaaggatgtctaagatcttctacttccatcccatgatttcccgcaaaactcatagataagaatgaatgtgtagcaccagaatcgaaaagcactgtggcaggaactaagttaacaaggaacgtacccaaaatcacatctggagcatcttgagcttctgcagcagcgacatgattgacacgggcctttgatgctggtgcggtagagttgctctgagtagggacaaccttcacgcgtcggggcttcggacacttgtcagcgtaatgtcctgggtctccacagttgaaacacaccacgggtttgctgccttgctccctcttggcaggttgttgctgtgttggagctgcaacaggacgtggaacttgattacggatgttgttgccagcattgttgttgaagaactgacgctgcggacgaacaatagacgaagaacctccctgtggcacggactaaagtcctaaagtaagacacaacctctgattattcccct

SEQ ID NO: 59717 - DNA, 3510 bp, Oryza sativa
ttcctgcagcccgaatgaatgtgtagcaccagaatcgaaaagcactgttgcaggaactgagttaacagaaaacgtacccaaaatcacatctggagcatcttgggcttctgcagcagcaacatgattgacacgggcctttgatgctggtgcggtagagttgctctgggcagggacaaccttcaccgtcggggcttcggacacttgcagcataatgtcctgggtctccacagttgaaacacaccacgggcttgctgcctggctccctcttggcaggttgttgctgtgttggagctgcaacaggacgtggagcttgattgcggatgttgttgccagcattgttgttgaaaaactgacgttgcggacgaacaacagacgaagaacctccctgtggcatagactggggtcctaaagtaagacgcggcttctgattactcccctgttgtgctttgaagtgagcaatccggcgtttcttctgctccatgcggttgtacttgtcttcctgacgaatagccttatccattaatttctggaaatcagaataatctccagtcatgagtgggtaagaaagctcatcattaagtccttccaagaacttctcctggcgctcttcatcattgcgcacatcttccggagcataacgagcaagacgattgaactcgtgcagatactccgtaacagagcgagatccctgggtgagcgacctgaactccttcttcttgagagacaccactcccgatggtatatgcgtcttccggaaagcagcggtgaattcaagccaagtaataggttcagcagtagtcctattcaggcggaagtgatcccaccattcagaggcagggccatgcaactgatgtgatgcaaatgagaccttctcctgatcagtgcactgaagcaaatccaacttcttctctatggcatgcagccaatcaccagcttcaacaggattagtggtactagagaaaacaggcggcctcacacgaagaaattctgctaacttattctgaggaggtgcatggttatttccttggttctgctgattctggagttgctgcatcatcatgttcatgagttgtgtctgttgagcaagaacttgggcaagtgtgggattctctccactttattgttgttattggggttgttgttggggccattcccattgctgcgagtgttcaccatctggcatggacagggcacaagaagagaaaccgggcaaaactacttaggacagggaattactttaacttttattgatcttaactgagtttcattattacaaactgaagactctcacaccactaaactcaccaacttcctaacactcaaaagcaaacaaacgcatgcacttacatcccaccactgatgtaaatcacatgcgagacacacacaagcaaacttaaagcaagcaaactaacacaacgatctaagacaacgacttaacaagtcactctagttcttccgagcatcggaggtcgattgaaggctcattcggctcgtcttcatcatcttgagttactacccactcaatcttggaatgggtgtgcttggattcttcttcttcatcatcacttatgatgatgaccggaggatctgctagggttggggcaacttcattctccaccacacgaacctttggcgccaattgatagcgagggacaaatagagctctcttcattgcagtgagacgaatcctggccttctgcggcggtgcttctcccttcaatgcggctaattccttctccaaacgatccaccttgtcttctagcttgcaaatcttaccacgattccggtcttcacgatcttgagccgctaatacagtctccgcacgactttcatccatagcccacagcatctcaaccaaatgccttgtggtagcatcattctcaattccttcagtctcaaggtaattgccacggtcacttccctgtggttgacgaggatggtagcgatactccgtatcggccaactgatcactgtagcgatcgcgaagctctcctatggcgatccttgccacctcctgacacgcatggatgtagtttcttcctccagcttcgaacatcactgagggaatatcttcactattactgttcaaggtgactttgactcggcacttctcttcatgacgatcatgaggaatctgggcataaaaaggggcagtcccaaatccaatgacaaaggacatcgtacgcaactcctggacaaaaccctcaacaccaaacaagtactcaggcttgtagcgcggcatctaaagacaagtgaaaggagggagttaagacatctatccaattaacagcacaagtttttggattaatttgaataaagtttagaaatcaaaataaaccaaacctgcaggataagttgaaacagttggaaacaaggttacaagctttgtgcttttgagtaacaggttttaaaagaaataaaagaaagttataaaatcaacttgctaaatctattttattgcagcaagattaaataaaacaacattgtaaaacttttgctggtaaatgagccattggtacagtaataaatgtacggtactaataacactggaataaattttgaatgagaaccattaaaagagattatgaagtgcatgtgccattagtttggtttaattaaaagagaaagggaggagaacagttctacttttccaatatttttagaaggcttctatgggtaaccatttggcataacctagggtcaagggggctctgataccaacttgtcacgcccggaatttctatccaaaattccaaacgcttacatgtgtgtgaaccctcgtccaggaatcagccgaggcacacaataacaaattgataatagagtacaattattactctaattaataagcgtataaagtgtcattacagaggtagatagttcctctcaaacaataaatatctaagcagcggaaaaagaaataaacggcgcagacggctccactccacataccgaggtgcgagcttcccttttgtctgaaacctgtgcacacctcgcaatggcgtgacccgaaggtatacaaaatcacccactgcgaattccaggtcacggcgacggttatctgcataacttttctgccgagactgtgccacctttagattatcccgaatgattctgactttagcttcagcttctctcaggatatcagtcccgaacacttggctttctccaacttggtcccacaagagcggtgtccggcatttgcgcccgtacaacgcttcataaggtgccatttgtatgctggcttgataactgttattgtaggagaattcggcataggggagactcttatcccaggtcttcccgaaatctagtacacatgcgcggagcatatcttctaggatctgatttagatgctcggtctgtccatctgtctgcgggtgatacgcggtgctgaaatttaatcgggttcccaactcttcttggagtttcttccaaaaatgagaggtgaattggcttcccctatcagatacaattttcttgggaacgccatggagactcacgatccta

SEQ ID NO: 59718 - DNA, 4062 bp, Oryza sativa
ttgtacgcaactcctggacaaaaccctcacaccaaacaagtactcaggcttgtagcgcggcatctaaagacaagtgaaaggagggagttaagacatttatccaattaatagcacaagtttttggattaatgtgaataaagttggaaaatcaaagtaaaaaggtaagtaaataaagtaaaccaagcttgcaagataagttgaaatagttgaaaacgaggttacaaatttttgtacttttgatcatcaggttttaacagaaataaaagaaagttataaaatcgacatgctaaatttattttattgcagcaggattaaataaaacaatattgtaaaacttttgctggtaaatgagtcattagtacagtaatagatgtacagtactaataacactgaaataaattttgaatgagaaccattaaaagagattatgaagtgcatgtgccattagtttggtttaaaagagaaagggaggagaacagttctacttttccaatatttttagagggcttctatgggtaaccatttggcataacctaaggtcaaggaggctctgataccaacttgtcacgcccggaatttctatccaaaattccaaacgcttacatgtgtgggaaccctcgtctaggaatcagccgaggcacacaataacaaattgataatagagtacaaatattactctaactaataagcgaataaaatgtcattacagaggtagatagttcctctcaatcaataaagatctaagcagcggaaaataagataaacggcgcggacggctccactccacaagcagcttgaccaaggctacacctaatcctccacaccatcagcatcattgtagaactcttcctctgatgaatgattgcaaggtgagtatatgacatactcagcaagccacgcagcaaatatgcaagtgcacaggataacaaaggatggcataatagggtttcttttgcaaaagcagcatttagcaaacatttgagaatttaataaaacagttaagtaataattaaacaatattaatccaacgctatacaacataccctgttgtataggcccaaccattctgaacaaccatcccggctgcacagttctatctccaaaccaggaatataccattccaaaccaggagctaatcaaattattaccagttatagcatcatttactatggtgagaagggtgagactaatcacgaaagacattgttagacccgcccataaccgcgggcacggctattcgaatagttttactctgatcagaggtgtaccactgtacccacaagacacaaccccacatcatgtcaccatgtgcctcaataccaccacggtacctcggaaaggagttgtgacaataccccttgcataacacaatccactgcagcgcaccttcctggatcataatcacccccttataaacaaggcatggactccccagcgacccccgtgggcttatctccgccacttctcagtctggtgccccgcaatgaaccatgttatacaaaagataaagccgttgcccacgctggcttgtggttggcacggttaatgtttcacaaccgaaactcgtgaaccggtccttaattgtcatgagcacgaccatcaaaaccatgtgctcacaacccaccattaccaggttttagttggcacattaattaattaaccaatcacaattgaccatcgtgagctatcattaaataatagtgaatcataagttatcccaaaagtgtgctaatgtttctaagcatggctaagcaattatatctaatatctagttgaaccaatataaataaagctcaactagtcaaattataataacccaaggtatcaaggaataaagtaatcaagaacaaaagggctatagcaaacaataggttaattccacccaatgacattcgaaaataaatgcaatagttgaatagaaacaatagctttaaacgggatcaacatgctcaaagggttgtttgggatctgtgtgacttgccttgctggccttggaactcttcaaactcttctcctgcgaaaacggactctccggaaacgacggaatctaagcagaaaagagcaaaatcaccaaaacagcacataaacaagcatgaacagtacatgtggatatttttattgtgtagatctcaattttagaaaaatttagagacttgaaccaactaaatcggagctaagatgaattagttatgaatttttgaagattaaatcggattaaaacacttatattgattttaattgaattatgacgcaataatgaattatttttgaaaaggaaaagggatttattgcgtcagcgggctagggtttcggtggaccgggcgcacggcggcggttcacgcgaacggacggccgagatcgacttgatccaaaacggacggccgagatcgatcggtccacgaccggctcatggaagagggcgacgatgacgtcggcgatgacgtcaccaccggcggcggcggctcggcggctcggacggctcggacggcgcacgcttgccagcgaacggcggcacttcggcaagaacggaggacaccaacgggtagcggacggcacggcgaactcaccggcgacccaagcgacggcggaagaccaacggacggcgacggcgacgaggaagaagcgacggcggagatcgggtcgacaacggcgacgatgctccggcggtctccgacggtggcgaaggggcggacgaggacggcgacgacttggcgatcccgacggtggccttcctgagcgatgacgatgaccggaacggcggcggcgcagggctggagcgacggcggcgatggcggctcgaggtctcacgacgctagggcgctaccggtgacgagaggcgaaggcgagggtggcggcgggtagagaagagctcgggggtccttttaaaggggctcggaggcagcggcgaaggcccacgacggccggcgacgagaaggaaagttcgggaaaatcgaatccgaaacaaactcgaatccacgaatttccaaacgattttagccggtgtttccaaaggagaaaaggtagaggaaatcccgaagatcatttcccctcttttgattcggccggagaaggaaaggatcggccgatttggaaagcggcggcggcggcgcggcgctaaggtttcggccggaggaagacgacgactccgacaggcgggccccacctgtcagcgagcgaggacgcgcgcgcgggcggctgcggctgcggactgggccgacttgggccgaggagagagagaagggttttgggccgactttcggcccaaagccaaaagaagacttttcaaaacctttttcaatttaaattattttttaaatgcaattccatttattaaaaatacttccttagctcaaataaatcccagaaaaatctaggaattatagaattaagcaaagtatttaatgaaattttatctggccccattttatattggaatttattaattaaaattagatcttctcttctaggcttttaaaataaattctaaaaattccatttaaacaacaatttatatattttgaattttcagggtgtgacaaacctacccccttaaacagaatctcgtcctcgagattcggaagaactggcgaacagatgcggatgagttgacttcaattcatcttctcgttcccaagttgattcttcttccgagtgattactccattgaactttgcaaaaacggataactcgattcctggttcttctctcatctatttccaagatacggattggtttcttgtcgcgaccgggaaaattgccttttcccgaacgccagtgtattaatccccgtcccaggaaaagccggggtacaccatacaaacatgatataaaagacacatctttattatatcgataatatttacattattacaaaggcgcttcaggcctgacaaacaaaaataaacagcagcggactagcgggcctacggctccatcttcacaggcgctcaactggggtataagccaggactccacctaagacatcttctctgaagcttctcttactgaaggggggagaaagatagagcaagaatgagtacaaccacagtactcagcaagtca

SEQ ID NO: 59719 - DNA, 3618 bp, Oryza sativa
gggatctgtgtgacttgccttgctggccttggaactcttcaaactcttctcctgcgaaaacggactctccggaaacgacggaatctaagcagaaaagagcaaaatcaccaaaacagcacataaacaagcatgaacagtacatgtggatatttttattgtgtagatctcaattttagaaaaatttagagacttgaaccaactaaatcggagctaagatgaattagttatgaatttttgaagattaaatcggattaaaacacttatattgattttaattgaattatgacgcaataatgaattatttttgaaaaggaaaagggatttattgcgtcagcgggctagggtttcggtggaccgggcgcacggcggcagttcacgcgaacggacggccgagatcgacttgatccaaaacggacgaccgagatcgatcggtccacgaccggctcacggaagagggcgacgatgaccaaaacggacgaccgagatcgatcggtccacgaccggctcacggaagagggcgacgatgacgtcggcgatgacgtcaccaccggcggcggcggctcggcggctcggacggctcggacggcgcacgcttgccagtgaacggcggcacttcggcaagaacggtggacaccaacgggtagcggacggcacggcgaactcaccggcgacccaagcgacggcggaagaccaacggacggcgacggcgacgaggaagaagcgacggcggagatcgggtcgacgacggcgacgatgctccggcggtctccgacggtggcgaaggggcggacgaggacgacgacgacttggcgatcccgacggcggccttcccgagcgatgacgatgaccggaacggcggcggcgcacggctggagcgacggcggcgacggcggcactagggcacacggtgctagagctcttccggcgacgagaggcgaaggcgagggtggcgacgggtagaggaggcaccgggggtccttttaaatgggctcggaggcggcggcaaaggcccacggcgacggcaacggcgaaggaaagctcgggtagaacgaatccgagacgaactcgaatccaactctttccaagacgatttggccaaagattccaaaggagaaaaggtagaggagatcccgaggatcatttcccctctatcaattcggccggagaaggaaaggagcggccggattggaaagcggcggcggcggcgcgaaactagggtttcggcccgaggaagacgacgactccgacaggcgggacccacctgtcagcgacagcgagggcgcgcgcgcgagcggctgcggctgcggactgggccggctgggccgaggagagagagaggaggttttgggcgactttcggcccaaagccaaaagaagactttttaaaacctttttccatttaaattatttcttaaatgcaattccatttattaaaaatactttcttagctcaaataaatcccagaaaaatctaggaattatagaattaagcaaagtatttaatgaaattttatctggccccattttatattggaatttattaattaaaattagatcttctcttctaggcttttaaaataaattctaaaaatttcatttaaacaacaatttatatattttgaattttcagggtgtgacaacaatcttctcggagaggtcaccgggcaacttctccacaagccgtctaggaggcggcatcctccaagagtaacaagcaatgacccggcgtgagatgatcaagtgccacactagctctacaatggaagcaaatgcacttgactcttggctaatcaaccctataacactagatggatgaacacaaagctcaagtgagtgtgagagaggtgcaaggggtgtatgcaattgaattgggtgccaagagagtccccttgctgctggtgggagagtatttatactcccacccaccaaaactagccgttgggggcgaaatcccccaactttgtgctctgccggtctgaccggaggtatgtggccggtcatactgtgctactctgcaacggctagaaaactagcagttgtagcgctgtcagagggccccatcggcccggccggtcagaccggagttgattgggcggtcagaccggagtcggctcggtcagaccgccatcggctcggtctgaccgactacggctccgtcggctctgtatcggcagtcccgaggagcaccatttcggcctccagggggccggtctgaccgggcatgtgccgccggtcagaccgacattatgggccggtcagaccgccaacttgtggccggtcagacctgccctggtcaggccgaacccagtgaatgtgtgtgtgtgtgtgatgaaaaagtgagcacaagtgataatgcaatgacctaatgtggcaattaaaatcatctctttgctaggtcattacccctcttaatagtacggcgaaactagaaataaactagcaaatttgatcgccctacaccccgatcaattctaaattaaagcactagttttaccgtcttctttctctttgccttgcgccgtcaattttaatccatcgatcgtcatccatgtgcacacatgacgtggacctaacttaaaatattatttcaaagacaacggttagtccacaattagcgcttgtcattaattaccaaaattaacaccgggggcctagatgcttcaatctccccctttttggtaattgatgacaaactccacaaatagatatataatcaaacatagagcacatggacatttattgcattgaaaagcaaaggctccccctaaacatatgcataaaaatcacaaatagcaaatatggagccaatgcacattacaatatcacatttcaacatagcacaacacatatgcaaattatatgtgaacttcacatatgaatcaaccgaatgcataagatggtcacaagtatatcaatgtagcaccaaccatccatcatagcacaagttcacatcaagaccacataaagggttcacaaataaatgcataggctattacaagaccacgaagggtccaaatgacataaagagtttaacaaaacgacaaataacacacaagatagagtaatagcccatacccatacaaaatatagctcaatcctccttaacctattaaatacgagggcactatcctcactactactagtcccaacccaacaaaaaacacacttttctcccccttttggcatcaagcaccaaaaaggtcttcactcttgtggagaaaaaggaggacgcgccgaagtggaaggatgagaagcatcacgatgacgatgatacacgaatgcttgggagctctccaacatttggactcgagagtccaatgtacccactcgagtgtgcaatctccccacggaagcattcaagtctccaacgtccgtgcgcaagccacgaacatcctcatgcaaagcgtcatgcccggtagacaagcgttgaatgctttcacttagggtattaatagccccaagtaccgggttgaagtactcgttgggttgcatcccaaaataggcatactgaggatgaaagaaagcatttggatcatacccatgaagaggcggaggtgcagagcatgagctagctctaggatgagaggagggcgccgtcctatgagcacggggagctccaa

SEQ ID NO: 59720 - DNA, 3096 bp, Oryza sativa
attcagtttgagcctttgccttctcacttcttcctctccaccgatcttcaatctcagatttcgtgtgtgtgcgtgagtggttgatttgagtttgtttgagtgcttggtgttgacttcgtgaagatttgttgagcactcgattcatcgccaagaaatctctgtgcatttgttactcttggtggttgaggacacctagatggttaggagtaaacctcgagataccgatttgtttgtggtgtgccgagggagtatgtgaaggtcggatcttacctccgaaagggaagagcgaggatagagttggaaaagacccggcccattatgggctcctcaacaaagtgtagaatccccccaaggatttgatctttggtaacacatcaacttgcaagaatcctgatgatatctttttcttactcctctagctttgctatttggtgccgctagtagtttagtcgttgtttgtgcaaacccattaactacctgttacaccatccctttttgtttgcctttctagcttgctaaaaaatctgagatttttggaatatcccaaaatatttcagaatatcggaaatattccaaaatatccgaaaatattccaaatatccaaaaagtttatcttcttcattgacttacgagttttaaacgcctcttcaacctcccccccccccctccgcaggtgatatcaagatcctttcacttgtgataccacgttctgatacctatggttctcagatgattcctatggggcatcatgtaatacttgtgaggtattgcaacacttgtgatattaggttctaacacctacgttgaagcatcgaggcccccggtgttaattttggtaattaatgacaagcgctaattgtggactaaccgttgtctttgagataatattttaagttaggtccacgtcatgtgtgcacatggatgacgatcgatggattaaaattgacggcgcaaggcaaagagaaagaagacggtaaaactagtgctttaatttagaattgatcagggtgtagggcgatcaaatttgctagtttatttctagtttcgccgtactattaagaggggtaatgacctagcaaagagatgattttaattgccacattaggtcattgcattatcacttgtgctcactttttcatcacacacaaacacattcactgggttcggcctgaccaggggcggtcagaccggccacatagtggcggtctcaccggcgtgccctgcccggtgacctctccgagaagattgtggaggaggcccggtgccggtttgtgagtggtttggagttcaccaccttcggagtgaagaaagaactaacctagtgatcgaggcttgggtagtcctctccatgggccggctcccgccatgcccaccccttgacgaagggggcgtgcggaggctacgtggttgagcggtggagttgggctcgcctcagcggggagtaagaaaccgacgagtttccgaacctcggtgaaaaatctcttgtctccttgtctcatttgattgtcgcatttacttttgtgcaatttacttttctagagacaaacttgagatcatatcaccctaggattgctaaacattgacataggagtgtgagttactttcctagagatataattgagcctctatcaccctaggtttgcaaaacctaacttagttgcatagttagagttgaccctcaccaagcctagcaacttaggttagttttgattaggtgtcatttagttttaaatcgcctattcacccccctctagtcgacatctcgatcttacaagtggtatcagagcttggtctctcctgattgggcttcaccgcctagagagaagatgtcgaacgaggtgaaacacgaagggaaggctcccatgtttaatggcacaaactattccacttggaaaattaaaatgtctactcacctcaaagctatgagcttccatatttggagtattgtggatgtaggctttgcaatcaccggcacgcccttgatggagattgatcaccgcaacctccaactcaatgcccaagccatgaatgctttgttcaactctttgagccaagaggagtttgatagagtgagcaaccttgagaccgcatatgagatttggaacaagttggcggagatccatgagggcacaagtgagtacaaggatgccaagcttcacttcctcaagatccaatatgagacattctctatgttgcctcatgagagtgtgaatgacatgtatgggaggctcaatgtcattgtgaatgatctcaaggggcttggggcaaactacaccgatcttgaggttgcccaaaagatgcttagggctctaccagagaagtatgagacccttgtcaccatgctcatcaactccgacatgtcaaggatgacaccggcaagcctcttggggaagatcaacaccaatgacatgtataagttgaagaaaaaggaaatggaggaagcctcaccttccaagaagtgcattactctctaagccgaagttgaagacaagggcaagggcaaggtgaatgaagtcaatgagaacttggaagaagagaatgcccttcttgctagaaggttcaatgatttcttgggaaggagaaaggagagaggaaagggctccaactcaaataggagaagaaatagaagacccaacaagactctctccaacttgaggtgctttgagtgtggtgagaagggacactttgcttccaagtgcccttccaaggatgatgatggagacaagtcatccaagaagaagagtggaggctacaagctcatgaagaagctcaagaaggaaggcaagaagattgaggccttcatcgaggaatgggactcaaatgaggagagctcgcctcatccgggtccgaggaagaagatggtgatgatgcaagctccaggaagaagaagatggccgttgttgccatcaaggaggctccatcactcttcgctccactttgtctcatggcaaaaggctcctctaaggtaacatctcttagtgatagtgagagtgatgatgattgtgatgatgtttcctatgatgagcttgtgagtatgtttgaggagctccatgcttatagtgagaaggagattgtcaagttcaaggccctaaagaa

SEQ ID NO: 59721 - DNA, 21068 bp, Oryza sativa
  unsure (1)..(21068): unsure at all n locations
ctttcggttgctcaaatttgtgatcttagcttgtcatgtgctttcttcccgcaagaagttattgtttctagccttcttgacaagtcttgtgtgttcaaaggttttagatatggaaatctttatttggttgatttcaattctagtgaagcaaatttgaaaacttgtttagttgcaaaaacttctttgggttggctttggcatagaaggctagcccatgttggcatgaatcaattgagcaaattttcaaaacgtgatctagttatgggcttgaaagatgtgaagtttgagaaagataagctttgtagtgcttgtcaagccggcaagcaagttgcatgttctcatcctactaagagtatcatgtccacatctaaaccattggagctcttgcatatggatttgtttgacccaacaacctataagagcattggtggtaatagtcattgtcttgtgattgttgatgattattctcgctatacttgggtgttctttttgcatgataagtctattgtcgccgaccttttcaaaaagtttgcaaaaagggcccaaaatgaatttagttgcactcttgtgaaaattagaagtaacattggttccgagtttaagaataccaatatcgaggactattgtgatgatcttggtattaaacatgaacttttcgctacctactcacctcaacaaaatggtgtagtggagaggaaaattcgtacattgattgagatggcaaggactatgcttgatgaatatggtgtttccgattccttttgggcggaagccataaacaccgcttgccatgcaaccaataggctttatntgcatcgtgtcttganaaagacttcctatgaggtaattgttgggaggaagcctaatattgcctattttcgagtttttggttgtaaatgttatattcatcgaaagggtgttagactaaccaaatttgaaagtcggtgtgatgaagggtttcttctaggttatgcctcaaaaagcaaggcataccgggtctacaacaagaacaaaggtattgtggaagaaaccgccgatgttcaatttgatgagactaatggctcccaagaggggcacgagaatttggatgatgtaggtgatgaaggcttgatgagagttatgaagaacatgtcaattggagatgtcaagcctattgaagtggaagacaagccatccacctccactcaagatgagcatctacttccgctatgccaagtcaagctcaagttgaagtggaggaggagaaggcacaagaaccacctatgccaccaaggatacacaccgctctttccaaggatcacccaattgaccaagtgttgggtgacattagtaagggtgttcaaactcgatctcgtgtcacttcgatttgtgaacattactcgtttgtttcttgtcttgagcgaaaacatgtagatgaagctctttgtgatccggattggatgaatgctatgcatgaagagctcaaaaactttgcaagaaacaaggtgtggactttggttgaaagacctagagaccacaatgtcatagggacaaagtgggtctttaggaacaaacaagatgagaacgggttggtggtgagaaacaaggcaagattggtggcacaaggtttcacacaagttgaaggtttggactttggtgaaacttttgcccccgtggcaagacttgaggctatttgcatccttcttgcatttgcatcatgctttgatataaaactatttcaaatggatgtgaaaagtgcttttctaaatggtgaaattgccgaacttgtctttgttgaataacctcccggttttgaagatactaaatatcctaaccatgtttacaaactctcaaaagctctttatggtttaagacaagctcctagggcttggtatgaaagattgagagattttcttttgtcaaaggatttcaaaattggaaaagttgacatcactcttttcacaaaaatcattggtgatgatttctttgtgtatcaaatttatgttgatgacatcatattcggttctactaatgaggtattttgcaaggaatttggtgatatgatgtctagggaatttgaaatgtccatgattggagagttgagcttcttccttggacttcaaatcaagcaactcaagaatgggacgttcgtgagccaaaccaagtacatcaaggatctactcaagaggtttggcttggaggatgcgaagcccattaagacacctatggcaaccaacgggcatctcgaccttgatgagggaggtaaaccggtagatttaaagctttatcgttctatgattggtagcttgctttaccttaccgtatctaggccggatatcatgtttagtgtttgcatgtgtgcacggtttcaagccgctcctaaggagtgtcacttagtggccgtgaaaaggattctaagatatttaaagcattcctctactattggcttgtggtacccaaaaggtgctaaatttaagcttgttggctattccgatccggattatgccggttgcaaagtggatagaaagagcacatccagtagttgccaaatgcttggtagatcccttgtgtcatggtcatccaagaaacaaaactccgtagccctctctactgccgagacagaatatgtttcggcgggtagttgttgtgcccaattgctttggatgaaacaaacattgttggactatggcatatccttcaccaaaaccccactcctatgtgacaatgatggtgccataaagatagccaataacccggtccaacattctagaaccaagcatattgacatacgccatcacttcctaagagaccatgttgccaagtgtgacatagtcattagccacataagaaccgaggatcaactagccgacatctttaccaagcctcttgatgaaacccgcttttgcaagttgaggaatgagttaaatatcatagacttctctaatgtggcttgagatggtgcaccatggttgcttcttttccatattgtttatttgctccttttttgctcttatgctttagatttattgccatttggttcttcattgcgaaaatggagcatgtcacattaagggggaggtttgcactcttgcatgtgctccacttccttttatatgtgagcaaatcaactaaaagtgctagtagtgttttcaaaatgcccaagtcaacataagtcaaaatttttgcaaaattaatgtaatttgaaaactatctcttggaaaatgtttcaaaaggttccctatatgttttccaaccttcactttgcaagaaaaatgtttttttaatgaaaatgccattttggccctcttttgaagaaactagaatcttgtttttggccaaaatgaaattcaaccccaaaatgagattgagaaggaatttgagaaaagtttcaaaacaaagttggtagagaagaagatttgaaatgtttttggtattcaaatcatattcaaaatccaaatattttaaaagttgtttgaaaatcaaattcgcccaaaaacccctatagaccataaatggtcacctcctagcactcaagtgagttttgttgcaaatcttcataaatttcaaatattatgaatggttggcaatatttcaactcacacatttcaaaattgctccaaaattcaaatttttattgaattttattgtgtgggggtagccgaactatgcaagggcagtgcacagtcggctgggggccaggcggtctgaccagcgctatatgcgcggtctgaccggcctggtggcggcggtctgaccggcctctagggcccggtctgaccggctgcaccctggcggtctgactggccagggatggagggcccaggactttgtcctttcttcctcctcctccttctacccgacccgtcctcatcccatctcatctcttcacttctccaactcgaaatttcttctgctctctcctctcccaaaccctagccacctccctccaccaaatccgtccggttcaaccgtcaaaatcactccggttactccgtaagtgaatcccctcctcttcctctctctattccatggattgatttgagtttttattgagtttgtgatccatggcatggaaccctaggtgaaggaagaggtgttcatcgatttgcaccaatagagggtagtttcttggtgtgattcaactccttcaaccggtaaatccctctccctcttgtgcattgctctcaaatcggtctatttcaatctttagggttaagggtagtttccccattgcttcaatcttgatgaaatagacctacacaatgtcacgtcccaaaacgactctaaaatacatcctctaaattatgccgagaataattaaaattcgtgtgaaagcctccaacaattaaaatgtgcaaatataaaagtcaaataaggcttggaggatttttgtatatttcctaaaagcctaaaatgcgtaaataaattttagtggaattttcagagcacaaataataattgagaagaaataaacaaagttaaaaaggttttataaaaagaaaaaccctaaaagaagtccttttccccccccttcccctcttgggccggcccggcccaattccctccctctctctcctctcccccgcggcccatcggcctcctccccgcgcgcgcgccgctgacgggcgggcccgcccgccaccctcgctgacgggtggggcccacctgtcatcccctacctcgcgcctcgcccgccgccgcccgtgccctagcgccgccgccgccgcggattccgccgcatcccgccgtccccgcgtgcaataaagtgggggaaatcactccccgtgatcccctctccctttccccccatttttccctccctctctcccttggattcgtttggaaacccctccccaaatcccgccggcgccattgatggagcccgagaacgccacgccggtttccttccttctccggccgccctctctcgccccggccctatttaaactctccccgcgcctcccccgcccgtttccgccccttgccgcaccgtctctccgccggaatcgagctcgcgccgtcgccctctctctcctccgtcgccgacgaccaccggccggccttctcgctcgccgggaccgtctcccgccccggcgtcgcctcctccggcttcgccgcaccgccatcgaccccgtccaccccctcgccgggtccgccgaccgccggaacgccgtcgaccccgtcgacccgagccgcgccgccgccttcctccgctctggctgcctttttcgtcgttgccgtcgacctagggtgagccgtggaccgccgcctcttttcccccttcccttcccctctctcggccgccgctccgccgtgcctatggccgtcgccggcgaccataggggcgcgggcgccgcctcccgccggccgcgccgagtggccgccgtcgggcgcgccgagtggctgccgcgtggggtccagccgtcagccgcccgcgccctcgggtgtggctgacacgtggggcccacggcgccggccggtgcgagcccgggtgcgcccggtccaccgtggaccatgaggctgccgcgtgggccctactcccgtggacccggtccgcgcgcccctccccctcggctgacgcaataaaccctttttaaattaaaatttaaatgaagaaattcgcaaatattcatttaaagagcatataaacttcaaatggccataacttggccatttgaactcggaattggaccgttcaagtctctaatttttccttaagaagtcaagaacccatttttgtgctttgttcctgcttgttatatggagtttattagagtaaaagccttttcttttctgttggtcgtgtagacgctgcagcttcggaagatccgctcttggtggaggttgaagccgacgtttgggaaagcgagcaaggcaagttacatcatccttgaacatattgaaacccagtttataaaattattttcatttaaattattgcattatcgctttacttaaattcccgcgttatcactgttttatctagccatgcctatgtacctttgttatgaccttattattattgttattgatattattaccttgttcaccctagattaaacagaaccccaactagtggacactctactcatggtaccactagtatgattttaggtaaatgcttcgctggttaattaggcaacattaggtggttttacaactctagactttgggaatattctcatcacctggacattacggaatggatggattattttggaattggattcacacctccccctctattcaaaaccctcaaaatggtttttggctgggctcggggtgcatggttttgatagtagcacctcggccatataaggaccggtcttcgggcctctgttgcaaaacactaccgtacttccacatgtctagtgggtaaggcttagattgtggctcagtctggttataaacaaaagtacacggatggagatggacgaagtcgggggtcgatggacatctctagggcaaatgaatgctacacgagctgcggcccagtagtcgagatgtcatggcacaggaccggtgtcctgctgttaggggctcagtcctgcctacctgtcccgggggttccgggcgtaggtggggttgggtcggtactcttttctatggctaggatgggttggaaactatgtcacgtcttccgtccgtataccgtggtggtatgtggcacgtggttacacgtgaggaagatgtgtcttgtgggtaaagatgtacacctctgatcagagtataacctatcgaatagccgcgccctcggttatgggcaagccgagcaatgtacccaagttagtgtttttaattcttaaaacctgcttaacaactaaaatgtggaatggttggcctgggttggcttgggacgagctgggacccagggtcgggttgccagttcggtccgaatcatcgtaggccttgggttaaggcaggttcgtgagggttcacggccttgtttaataatactgtgtagctctaggatcgtctttataaaatggctttgggcaactaagtgacttttaaatgctgctttactgcaaaacttaacccctatgttatttaccccttgtacccccttgcattaatcgtgcatctaccggtgtgacttgctgagtactgtggttgtactcattcttgctctatctttctccccccttcagtaagagaagcttcagagaagatgtcttaggtggagtcctggcttataccccagttgagcgcctgtgaagatggagccgtaggcccgctagtccgctgctgtttatttttgtttgtcaggcctgaagcgcctttgtaataatgtaaatattatcgatataataaagatgtgtcttttatatcatgtttgtatggtgtaccccggcttttcctgggacggggattaatacactggcgttcgggaaaaggcaattttcccggtcgcgacaagatggtatcagagccatctcgactgtaggataagccaagtggataaaacctaaggacatattttataaataaaactatttgcgaaagttcctttttttctcctttcccctatgctatttgcaaaagggtttactcccttcttccttcttcggatttcaactagtactagatggtcaggtcagtgaagaagaagacatcgtcagttgtttgccgaagctccggaagactgcaggatccgctagcgaagtggaggaagcagtgaagccagctgtaaagcaggagtgaagatcttggagaacccgtcgcagaacctaagccaccctctagtgtttcgtttgtcgtgtgtttccttgcttgtgtgtgtagcgcgtggtttgcatcagtggattgtgatgtaaccatgctaggttgtttgcttaatcaacttgcagaataagtgaaacaaagaacacatcaacaagaagagttagttcctttaaggtcctatctctagttctggtctattctttcctggcttgtttcctctctcacctcaatccctgtaacagatgtttaacagagaaaaaggaaagaatgtcagcgggtatgactcaagtaactcaagttttcaactcaatctgccactggcctcaagagagttaaccagggcacacccttggtccattccaagcatgctgcttagttcacagctaccattggttggaagtcaagaccaaaatcagtatgtgtttgatcgagcctttgccacccaggtcaatgagcttccaatgccagaagagcaggttcccttttgtcatgattgtagagagcaaggacactatgccctgaattgtccatgggtatatgtcaaagaagccccttcccttggtttagcagggcggacatcgctaaaccagcctcctcacaccaagtcaagcttgcagcctagtgtgcaaagtagagagctcaacggagagaatccattgaatcccgggaaatgctttcctcctagcctctcgtaccacgtggggtcacatactaagcaagccaaaggcaagaagagtaagaatcagaagagaaaagcaccgatgcgaactgaagaagaagtacgtaagatgactattaccagcaccgaatggcctccagcagggataactattcctagacgtcaaagaggaaataccttccgaggtgcacgacagttgacccagcacctcctaagccgtggtggcagagtatctgatagtgaagggtcagatcaagtctcctcggatgaagaagatgagtctccccgacatctcggcgaggaagagatggaatccaaagcatgcccccgttgtggagaaattggacacgttgctagcatgtgtctcacactctgccctcattgtgaggaagaccatccaccaggtgaatgtcccacccgcaaggtcacatgttttctgtgcgaaggtacaaaccatgtgcccaaggattgccaactcagtgtgttgttgaccaagaccgcagaaatccaacgaacaaccctacgattgtctcatcagctagtcagctccaacagcaacatcgacgatatcatccacagcaccaatgctcctcccgctgcacctgactctgcaataaatcatagcgataataccttcagcaccaaccattctctgcaccgacagcctcaacaaagaattgtcatcgatggaagaagttgtgtctctccccgacctactccaggccgagccaagggcaatcaacctccggagggcgataccaagcagaagaccgttattcgcctcaaccagcaaccagaaggaaacttctcctgtgaatgatagcaatatgcagtcctatcacatcatcacagaaccaatcaaggatgcagtcactagaacaatgccagctatgtatccatgtttgtgattttcagttcgctacttatcactgtaatcgggagtttgcagcaatcatgtaataaataaacatattcatgattataaacaatgagtttgttatgtttatggatgattcatgttgaggatacaatgtaccgatgataagcaccttccctttttgtttaaggcagtgccttgtattcgtgtaataagggagaaatgtgtaatacagacaagttctgagaggattcttttggaagatgcggatatgtgatcatgtgtataattgtttactgacaaaggagacctagggtctcgtgtcagaggaactatattctaacctcgagttaataaccaacctgtggatggaaaagaaaaccaattaaactgtgttgggttaaaaagccaatgagacagtagttggggataggagtttggatacgcctcttacagatcaagataaggattgttggatgaaacccataagggacccgccatgcctctacattgataagttcggatattcctgcaaacagttaagaagatccaggagacatcaatatttgagaacataatagtcgatggttggtaattagtctatcaggtatcagaaaagggtcaaaggtgatatggcagaagaacaatatggatgctccccatctcgaggaagcactaaagatgatcatcggcaattaaaccctagtggcatagatacagatagcaagcaatgtatttccctgaaggtggtcagtgcagcttcttgacaaaccacatcaaggtttcactgaaaggcagcaagccaaaggacctcatcgtccccagaagcgtccgcaatccacattaaagaataccacatgttaaagataagccgaaagatgattgataaaagagattggcaaagatgttctccagcatgaaagaagtaggccggaaggtgattgataaacagaaacatgctctgcatcgctcaaggaagacccctgatagtaattgccccgcaacagtcaccttgtcattaagtaagcaagatgacctaggtaaaagtgtttctatgaaggcaaggagtgaaatcttcaactcggtatcagatgctacacggagtgaaaagtgcaagcaccggttaccaggtaatgccatgtcttgggagatgatccaatgggaaggaacacatcaaggttaaaaggtgtaaaggaatacgttgaatgctaaccgaggacaacctgaagataatagtggaaagtaaactgaacataaagaaagtgaatccgagttgcttgttcgtgagagctattcccagttatgaatcaagtgatatgttcaaagataatctacagaggtcagattaaaatcacatctaacaacgaagcctcagatttggcaggataatgattagacagtaacaaatccagcaataaagccatttgggaagacgtcaaagtatgtcaagtgggataagttggttctcttgggaagcataattcaaaggcaaagttagcgacccttgcatcaaatagcagaagtacctagcaccggagaccaggaaagctaatatgagacagttcatgttgtcaatcatggtatccttagtaagcgggatatcatagtctaaagcatatggtggtaagctggaaggaaacgccaagcatggtattctcatgatgacaagcatggtatcctagtaatgacaagcaggttacgagacatgacatgaagttgataacttgtgaggttgacgccgaagatatgaatcgtgagaagttctggatctgaagccccatcttcaagtgccgcaacctagtctgagtcagctaaaaggtgcaccctggttcaagtcaggtgaagagaagattccatccgcagcaggaggtcaagccaagcagttccgagtggtgaagttttgctgaaagtttgtgaggacggagcggaagaagtcaaacaagaagagaagaccgcccaacctatcttcttgctagcctcctcgaatctcggggacgagattcttgtaaggggggtggatttgtcacgtcctgataaattcatcccgaaataaaaatcattttctaaaaggaataatagaattaattaaaattcgaaaagaaattggcaaacactaaaatgcgtataagaaaaattcaaatgtggcccggagaatttttgttaaattctccttggtctaaaaggcgccctcaaattttagtggaattttcagagcacaaataataattgagaagaaataaacaaagttagaatggttttataaaaagaaaaatcctaaaaaaagtcttctttccccccccttcccttactgggccagctcggcccagctccctccctctctctcctcctccccgcggcccactcggcctctccccgcgcgtgcgccgctgacgggcgggcccgcccgccaccctcgctgacgggtggggcccacctgtcatccctatcctcgcgccgcgcccgccgcccgcccgtgccctagcgccgccgccgccgcggattccgccgcatcccgccgtccccgcgcgccataaagagggggaaatcactccccgtgattccctccctcttttccccctctttcccctctctctctccctcggattcgtccggattcactcccgcaaagttcgccggcgcatcaatggcggccgagatttccgcggccgattccttcccctccggccgctctctccctctcccggcgctatataatcgtcccccgtgcttcgctcttccgtttccgccactcgccgcctctcctccccgtcggaatcgagcccgcgccgtcgcaccttctctccgccgtcgccgccgaactccggttcaccgccgtcgtcgccccggacctcctcccgcttcggcatcgcccccttcggcttcgccgcgtcctcgccgaccccgtccgctcctccgtttcgcccgccgaccgccggaacgccgccgtcctcgtcgacccgagccgcgccgccgccttcctccgctccggtcgtcgtttccgccgtcctcgtcgtcccggggtgagccgtggaccgctcctttcgcttcccccttccctcctctctctcgggtgccgctccgccgcgtcggtggtcgccggcggtgaccatcggggcgcgggcgcgccgcctcccgtcggccgtgccggcgaggccgccttcgggcgcgccccgcggctgccaggtggggcccggccgtcagccgcccgcgcccgcaggtgcggctgacgcgtgggacccacggcgccggccggcgtctgccgcgtgcgcccggtccaccgtggaccgagaggctgacgcgtgggccccactcccatggacccggtccgcgcgcccctcccctcggctgacgcaataaatccgatttttaattaaaatttaaatgaagaaattcgcaaatatccatttaaagagcatataaacttcaaatggccataacttggccatttgaactcggaattggaccgttcaagtctctaatttttccttaagaagtcaagaacccatttttgtgctttgtttctgctgttatgtggagtttattagagtaaaagccttttcttttccgttggtcgtgtagacgctgcagcttcggaagatccgctcttcgtggaagttgaagccggtgtttgggaaagcgagcaaggcaagtcacatcatccttgagcatattgaatcccagtttataaaattattttgatttaaattaatgcattaccgctttatttcaattcccgcgttatcactgttttatttagccatgcctatttacctttgttaagacattattattgctattgttattattaccttgttcaccctagaataaacaaaaccccaactagtgggtactctattcctggttccactagtatgaatttaggtagatgcttcgctgattaattaggcaatattaggtggttttataactttagactttgggaattctcatatcatttggacactatggaattgttggtttatggtggaattggacatacacctctcttcctctttcaaaacccctaaaacctgttttcggtggggtctgggtgcatgccagttgtgggaagtagcaccccggccactataaggattaagctcgggcctctgttgcaaagcactaccgtacttccacatgtctagtgggtaaggcttagtttgtggctcagtctggtcataaacaaaagtacacggatggagatggatgaagtcgggggtcgatggacattctctaggacaaatgaaggctacacgagctgcggcccggtagtcgagatgtcatggcacagggttggtgccctgctgctaggggctcagtcctgcctgcctgtcccgggggttccggccgtaggtgggattgggtcggtactcttgtctatggctaggatgggttggaaactatgtcacagcttccgtctgtataccgtggtggtatgtggcacgtggttgcacgtgaggaagatgtgtcttgtgggtaaagatgtacacctctgatcagagtataatctattcgaatagccgcgccctcggttatgggcaagccgagcaatgtacccaagttagcgtttcaattcctaagacctgcttaacaactaaaatgtggaatggttggcctgggttggcttggaacgagctggtacccagggtcgggttgccagttcggtctgaatcatcataggccttgggttaaggcaggttctgtgtgggttcacggccttgataattaatattgtatagttctaggatcgcgtttacaaaatagctttgagcaactaaacgtctttaaatgctgtttactgcaaccctaacccctttatagtataattcctttgtactcccttgcatttattctgcatttgtgggtgtgtcttgttgagtacggtggttgtactcagtcttgctcaatttttcccaagcccagaagaggagctccttgaagatgaaggctttggtgtctagctcgtgcctgccgtcaagcgcctgtggtcgtcgccctagtcttccgctgtttctcgtttgtctctgtgtgtgctgggccttcgctgcccatgtaataagttaactatttacgcttccgcttgttaaactctgaattgtatcaacttttggtgtaccttgcctcctgggacaaggattaatgcacgcacgtcaggaacgcccgttgggttatttccggtcgtgacaagttggtatcagagccaccgttgaccctaggacgagccgtagatcccaagccttagcaatattttcaaaaataaaaatcttttgttatttgtgaaaactgtctagtctctctctgtcttgctgcttcatttatcgccaaaatctgacctttaaaatgttgtttttctttttgtttttgtttgtagatggccagcagcgtcacccgtcgtggtttggacatgactggcttcgtcttggagctgcggggcatgtgcgtggtcttggggtatccacatggagtggactaccaggccaggccgcttccggagcaggagggtgacgatgcagagccccacgctggttgggaggtcactgcagtgatcctgtctggctctcccgagcggacttcgctggcagtcaccgcgggtggagattccttccccgccgcttgccagaacgccgctctcctcgctatcggcactcttcaccagcgctacccggacgagttgcagcactcgccctaccgctaccaccctcgtcgcggaggagcccgcgactacgccaccttccgggatgctagctcggaggatgacgctaccatcgtgcacctggcgcgcatggtggaggcgtacgacgcggctcgtatcgacttccaccagatggtacgccgtgggatggtcgagaacaacatgaagatcctggagctgcgtcaggagaacctgcagctcaagaaggacctagacgcggtggaggcgcagctgcatcagctcaagatcgcccagggagaggtctgccgccccaagcgtcgccgcgtctggtggagccgttccaaccaactgatgagttgcgaagccaacccgctcctggtcggtgcactgaatcaaccctagcttcttctcgattgtgcgcaaccaatcactggcttccataggatcgacggcaatggcaaaggttggaggctcagttttgagaaattctgataacttgcactgttgccggactgtaggcacttgaacgttggttgtccctgctgggctgctccaattctgtaatagttgaaaggctgttgccaacatgttggtttggttaaccacaacttggattagctctggtgaggtttcgttggtgcttctctcattcccattggcttgggttcttgcgtcatcggatccatcattcccatagcctttgttaccagtattatccatctgtcacaaggtaggggttgagaggggaagcatacaaggaaagaatagaccagaactagggacaagaccttaaaggaactaactctttttgttgatgtgttgtttgtttcacttattctgcaagttgattaagcaaacaacctagcatggttacatcaccacccaccgatgcaaaccacgcgctacacacacaagcaaggaacacacgactaacaacactaccctatagggtggcttaggttctgcgacgggttcccaagatcttcactccttcacagctggcttcattgcttccttcgcttcgctagcggatcctgcagtcttccggagcttcggcaaacaactgacgacatcttcttcctcgcaaagctgaccatctagtactagttgaaaatccgaagaaggaagaacggagtaaaccttttgcaaatagcattaggggaaggagaaaaaggaactttcgcaaataatttttatttataaaatatgtccttgggttttatccacttggcttatcctacagtcgagatggctctgataccagcttgtcgcgaccgggaaaattgccttttcccgaacgccagtgtattaatccccgtcccaggaaaagccggggtacaccacacaaacatgatatagaagacacatctttattatatcgataatatttacattattacaaaggcacttcaggcctgacaagcaaaaataaacagcagcggactagcggcctacggctccatcttcacaggcgctcaactggggtataagccaggactccacctaagacatcttctccaaagcttctcttactgaagggggggaaagattgagcaagaatgagtacaaccacagtactcagcaagccacaccggcagatgcataattaatgcaagggaggtacaagggaataataatatagggattaaggtttgcagtaaacagcatttaaaagtcacttagttgcccaaagccattttgtaaagacgatcatagaactacacagtattattaaacaaggccgtgaaccctcacgaacctgccttaacccaaggcctacgatgattcagaccgaactggcaacccgaccctgggtcccagctcgtcccaagccaacccaggccaaccattccatattttagttgttgagcaaattttaagaattaaaacactgacttgggtacattgctaggcttgcccatatccgagggctcggctattcgaatagatttactctgatcagaggtgtacatctttacccacaagacacatctttactccgcattccatggccttggaacccgtcgtaaagatgtgacatagtttccaacccatcctagccttagacaagagtaccgacccaatcctacctacggccgggatacccgggacaggcaggcagaactgagcccctagcattgggcaccaaccctccgccgtatgacatctcgactaccgggccgcagctcgtgtagccttcatttgccctggagaatgtccatcgacgcccgacttcatccatctccaatccgtgtacttttgtttatgactagactgagccacaaactaagccttacccattagacatgtggaagtacggtagtgctttgcaacagaggcccgagctttagtccttatagtggccggggtgctacttcccacaactggcatgcacccaaaccccaccgaaaacaggttttaggggttttgaaagaggaagagaggtgtgtgtccaattccaccataattcaacaattccatagtgtccaaatgatatgagaactcccaaagtctaaagttataaaaccacctaatgttgcctaattattcagcgaagcatctacctaaatttatactagtggaaccatgaatagagtacccactagttgaggttttgtttaatctagggtgaacaaggtaataataataacaatagcaataataatgtcataacaaaggtaaataggcttggctaaataaaacagtgataacgcgggaatttaaataaagcgataatgcattaatttaaatcaaaataattttataaactgggattcaatatgctcaaggatgatgtgacttgccttgctcagagagaacggccttccgaaccttcggcgacgaccacgaaccacgcttcgggaacctccggaacgacgaaagctacgcgaagcacacaagcaaagctacaagcctataaagaagcaataacaatacataaaaagaaagcacagggttctttaggttataacaaacattaggagacttgaacgggtcgattcagagttcgtatgaccgagatatgatcatccgaagtttaatgctgttatatggagatttgcggattattataatcaagttttgcaactataaaacaggtgtaagcgctagcctggaaaagacaggaaggctgcgccgttgacatgcggaccccacatgtcaacctaaaggaccgcggcagaccgagtacacagagacggtccacgggtcgacggaagcggaccccgtgtgtcaaccgaagcgagtggccgacaaacggactccactagacaccacacggtcaccacccgcacacgcgaacgactgccgacgccgatacacgggtaccggggccgacaaccgcacaacgggcatgggcgacaccgaaaggacgaggacagggcagcgagggagagggaaccttaccaccacgcgacgaggcgcgggaacgacaacgacgaacgggcgcggcggagacagacgggcacaacggaggcgaacggcgaggggacggcttcggcggcgatccttggacgaaggcgagacgcggccggcgcgaggcttgacgacgcggaggcgaggacgaagacgatgacgggggctgcagcgaccttgacgaagcgaggacgacgaacgagaacggcttgacggagggacgaacgccccgacgatcgggaacgacgagaggacgaggacgacgacgaccggggccggcgaggaggctacgagggcagccagcagcggctgcacggcggtgaggatggcgtggaacacgccgctacgatgacgatgacggaggcggcgccgcgagacgacgagccgggcgaccgacgggacgtcgacggcgagaacgatcggagacgacgatgatggcaggcagcagcggctgagaggaggaggggacagcgtggaacacgccgctgcgacgttggtgaaggtggtggtgagcggggcgacgagccgacgaggaggaaggagaggccggcgcggagacgacggcgttccggcgaagttcgggcgaggaggaggtgatgccggggatgagagcggcgtcgtggagccgaggaaggtggtggcgacgtcggccggcgctccggggacgtggcagaggcggccagaggcggagaagtggtggcgacgccactggacgccggcgagggcgcgtctccggtgatttccccgcgaaacggagggctgaccgagggagagggggcagctgcgaggccgagggagaagacggcgcggccgggcggcgctcgggcgaggagaggaaggcggctggaggtggccggcgcgagggaaaggggagggcgacggcgggaacgcgcctccggcggtcaccgcgcgaaacggagggtaggccgtgggagaggaggcggctgcgatgctggaggaggcgacggcgcggccggaagacgctccggcgaggcgggagaggcggctggaggccggccggcaacgtgggagagagggggcgacggtggggaggtggctagagaccacgggagagctcgggaagaggctaaaacggtagaacggggatgaggatcccattttataggatgggggagagagccggccacgggaggagcgggaacggcgacgggaatggcggccggcggcaaaggaaggcggccggacttggcgcgtccgttcccggcgattgggggcgccgttcaagggggaattaagggggaattgaagaggattcaatggggtttaatttcccctattcaatttggaaagaagggcattgattcgcgtggatttgagggaggaagggattagggttccacgggaagagagagagaggtggccgggcggaggaggaagaaggcgacggcggcctgacgcgtgggccccacgcggtcgggcgcgcggccgacacgcggcaacggcgcgcacgcacgcgcacgtgcgcggcacgggtgggagcgcggctcggcttgggccgggcgaagccgaggcggcccaggaggaggggagggagagaagatgggccgggaaggagaggagggaggggcggcccagaaggaggaggagaggagggagtgggctgcccgggaggggaagagaggcccgggagagagagggagagaaggggagggagagaaagagagggaggagagaaggacttttgggctgggcttggcccaaaggaggaaggagggttatttttagattttctttttaataaactttgttaattgttgttgttgtttaataattatttccggcgctctgaaaattcaagtaaaatttgagggctcgttttagaccaaggagaatttaacaaaaattctccgggccacattcgaatttttcttgtacgtattttagtgtttgccaatttcttttcgaattttaattaattctattattccttttagcgaatgaattttatttcgggatgaatttatcaggacgtgacaaatccaccccccttacaagaatctcgtccccgagattcgaggaggctagcaagaagataggttgggcggtcttctcttcttgtctgacttcttccgctccgtcttctataacaaacttgcctaacaacacttcttcactctggactgcttggctcgatctcctgttgcagatggaatcttctcttcacctgacttgtccctggttgaacctttagctgacttcgactgggttgcggcacttgaagatggggcttcagttccagaactttgcatagttcatatctttggagtcaacctcatacaagttacccacttcatgtcatgcgtcgagatcagctcgtctttactaagataccatgcttgtcataacttgtcatcatttagcattcaacgtattcctttacacctttgcccttgatgtgttctttcccgatttctcttattaatcacctttcgacctacttctttgcctggtaataaacatctttttcgatatcttctatcagtcatcttttgaccttggtcactaagtactcttcactccgagagttgtggatgcttctggtggcgaggaggtcctttggtctgctacctttcagtgaaaccttgaagtgtttcgccaaaagctacactgactgtcattgcctttgatccggaaaagacacatctgaaactcttagtccaaacaaatgtctctttggataatcacctgattttcttttccatcctcaggctggttattag

SEQ ID NO: 59722 - DNA, 728 bp, Oryza sativa
catagacttgctcatacacactcttctggaaagcagtatgaaaacggggatccggggtgtcccgaggcctcaaaaactgatcgtggtgcctcaagatggtatattgggatggattcctcatgtttacaacaaactggatggagggatcaatattcatctcatcacttccttcatcctcatcctctccacttccactgtcatcatctccactttccccctcgctagccccctcaacattggcctcaacctcttcatcactttgagcatactcatctccgcttgactcctcactcacgggatcaggagtgggcgcacgacgaccatgacgggtgcggggaggcatagctgaaaaacaaggagcaaaggatggataagcaacaattttagaaaccacatagtgaagtgggaggaagggcgagtgctgcctatcaggggcggtcagactgagagccacggccggtcagaccgccggccctcggccgatcagaccgcgtgccctcggccggtcagaccgacggccaatggctggttagaccgcctttggtcagaccaccactgacaagagcacacccaaatccttccacaatccacataaatgattctaaaaattgctaggacagtgttgcacacgattggaactagaacatcaaggtgtgtgtcacgaccggaaataacccaacgggcgttccttacgtgcgtgcattattccttgtcccaggaggcaaggt

SEQ ID NO: 59723 - DNA, 2003 bp, Oryza sativa
tatgtactggtttttatcatgaaccgttacttataggcatcatatatgtgttggttcttaataaaaactatacttataggcatcatatatgtgttgattcttaataaaaactagtacttatgagctcatagatgttggttacaactaaaatcggcaccaataatgacacaatattttctatctaacattttcatataaagttggatgaagataaactttatatcaaatttgtagttgacgagacatataactttgtaggtgatgaattttttatttaatgtttttctgatgtccgaaaatgtgttataatgtttcagatctatttacataagtgaatatttaaaatttctaaatgatctcggatggagacaaaacatatatgaacgttgtaggtatagatgacgtctacaattttgtagtcgctaaaattttcagttgagcattataaatttggataacaataatcacaaaacaatagcatggtaagaatctttagaagcatgtctatgaatatgggttgcaaaaatcatgtgatatgtgggaagcgaagtgtgacgttatagggaagtaataaaaataccaaatattttttcatgtttttttagcacctataaaaataaaaaagggtgcacctctatgggtttttctgcagtagtgagtatagactaagtttagatctatttgtttagtaatttacatcttcatgatctatcttatcaatttaatatttctttttttttgtcagtacaagtctaacgcacacacaacacaatcgtgcaaacgctcacatatctaccaggaggactcgttttgtgaaaattttaaaaattttatatagctatctagattgcatgtatgcaactaggtgtgtgtatatgcactttggtgaaaagaatacattctgcaagcaccaaatcctatagacacagctagcatatgaatcatacgattcaacagagctgatcgacaaaaaattgaagaacggggaacgccgtcctgacgcaaaggatgccgtggcagcatcagatttccacggcaagtttttcccttcccgcggcaggcagtcaaaacaacggcgggtggacaagtcaatgtttttgacacgactaacaccataaaactttaaaacatactagttgagagttttttttaacattatgattgagagttgacgaaagaaaaaaaaattaaaacatactcacaaaataagataattaatattaattattttaaacttaaaaattaaaaatacaactttttgtaatttcttttgtaaaaaaatattgtatagtattttggtaagcgtatgcttttgaaagagaaggtaatttttctctctgtgtattgtcgctgaacgtaacctaagatagcattaaacaagtactcatatgggacaaaactttaacgaagtaaaactgaataaaaggacgcaaagtgcaaaaactaaaaagaatttttcaagctgttttcttgaatttagatatatatgaaaaataactaatctttaattaagaactcaccgggcatacactagttggtcatcctcatgctcttgttaatgtcatctttaatttgaccaaaacacttgcttgctaaaagaggattcctagcatcccaaaataaatttagtgagattcctagcatcccaaaacaaatttagtgaggagtaaaaatgacaaaaataaccctcatcaatagtagtaaaggtagtaatggtgataagtaggtaaatgatatttaagagataaaacttctcattttatatgctagaggaggtaggtaaagtggtagaagttgattttttttttggataaatttaaactctataagttgagttttttgggacggatagagtaatccatatcgttatcaaccatgacggataagattaaccaaagcacgagggtcgttgttgaagctgagtacacatttgaccaaattttttaatgtttagtggcacgtacatatatacctacagatatacatctctttggcatgcacac

SEQ ID NO: 59724 - DNA, 1829 bp, Oryza sativa
atttttgggtctaaaatggatggagtccatggatttcaattggattcatccccaaatagcagatgatgtcgtctcagacacagaggcactccatcaccaccgccctcggccgcctcgacctcgccgcgcagccgcgtttggatgtccggccgccgcactaggttcgccgtcggagagcttccgccgccgccgcccgccgccttctggaaggtggagaagacgcgggcgcgggggaggaagcggagggaactcctgctgcacggcgcgcatggcgccgacgagctcgccgtccacgccgtcgccgaaccacgtggccaagttgagcgcgaacagtgcggcgtacaggcagcacgacgagcagagcggcgccaagaaggcggcgtgggtggtgtcgcccaacggccaagtgaagcgagaaaaggcggtggaagcggcgcgcggcgagggagctgcagccggagccggagaagaagaagaaaagcggatcgacttggccgtgctccgttgccctatctgcctccttcctagctgttcatccaatccatctgacattcttcttcttgttgttgttctttcattcgattcgtgagggctcggctagtggcaatttcttggcgtgcagtccgcggcggggcacttggcgtgcagcagctgccatggcgacgtcccggcaagcagtgccacgcgtgcggcggcgccgccaagatcctgtgccccaacgacctgttcggctgctggagctacgtcgcctattacgacgtcgccggccaccagcgcgcctgcccgcacgcgccctgctcctgctcggagtcgcgctgcgacttcctcggctcgccgccgatgctcctcgcccacctcgtcgccgacatgtggttggtgtcgatttggaatggggtgaaatggactggaaaagtgaactgaatccatatagatgaaatgggttgggttgatttgggttgaaatatgatatgggttggattggtttggattctaagagaagacaaatgaattagagtggtttggacttgtgtagcttactgctttggtttgggctggttgtggattggatttcaaaccattggcaggcttccacgcatgcatgtctctcttgtttggtttccctccatgtactttgatcgcaggagtactaatttgtggttgataataactttgatagtgtgtccgctcttgccgcgttgaaaccaaagagttagagaaatcctatatatttatataaagttcatttctacagtggttattaatgctatttatatcttttcttattaagccacatcatctaaattgtttctttatccctatgtagttgagataggtatattgttcaaattatctctcacgttttcttttgttattaagccgtatcacctttgttttatatttaagatgatgtacttagccacatcactattgttgtgattttaaatggccaatctagtttaaattattataaataacatcctaattgtatatagttttttttctgcagtcgataaagatgaaattatataatgttatgcctactgattatatgttatttctattattactgtataaaacttacgcagcaacccgtgagtttcatgaagtctgatttcactattgcgtagctttcatccgcatgattactaatggtgagttaataaattaaccatgcagcggctgctctgaacacgatactagggagatggggcaagaaggcatcaccggagtggaacatcagcggtgagctctgcagcggtttcgcagctgataaaaccgattgggataactaccgcgacatcaacccgttcatcaagtgcgattgcaca

SEQ ID NO: 59725 - DNA, 2127 bp, Oryza sativa
aatagctctcacgaacaagcaactcggattcactttccactattctcttcatgtcgttattatttagcattcaaagtattcctttacacattcaaccctgacgtattctttttagatttctcttatcaatcacctttcgaacgttgtcaaccaagtactcttccgaaataatcctcatagaacttgtttttattacacatgtctcccttattacatgaatacaaggcactgtcttaaacaaaaagggaaggtgcttaacatcggtacattgtttccactatgggttagaattaacatgaggcctcacaggtacggcgtttgctccagtgaccacaaggcgagtgacctgtcttcttcttgcataatggccggagtgatggcgcaggttacgcttcggctgtggacaatctctagagaaatgacctggttctttgcagttgtaacaaatcaacgtcttctttgctgagttgtccgtctgggaacgatcgttctgactaggagttggaattggtggttggaaatccttgctaacattggcatcagtggtaccgtagttgctatcacaattggagtctttctcagtgtcaaaattgcacgcttgattcgagtggtcactaatggggcaagaaccatggttgttggtggtatcatcaccattagtattgctagggttgttgtctgtattgcgtccgtcttcttggggcaggaactcttgatgcacaacagaagatccggtgatctgaagtggctcagtgcgctgtctttggttaccacatggaattactgggatgttgacaatccttctcttgcagttcgtcatccgattatgctcactttcgagttgcatggctttgtccacaagtttctcaaaatcttcataatcctctaggagtagttgcactgcaagctcatcttttaacccctggagaaacttctcttgtttgtcttcatccgtttccacatcttctggtgcatagtgagccaaacgatagaactcgtgcaggtactctgtgacggtcaaatctccttgcttcaggtagcgaaactctcgttttcttagtgtgatcattcctgcgggaacatgtgatctcttgaatacagatgaaaactcgttccaggtgatggtatgtccttctggccgtgatgcttcgtagctatcccaccactctgaagccggtccaaccaactgatgagttgcgaagccaacccgctcctggtcggtgcactgaatcaaccctagcttcttctcgattgtgcgcaaccaatcactggcttccataggatcgacggcaatggcaaaggttggaagccccgttttgagaaattctgataacttgcactggtgcttgactgtaagggcttgaacgtttgtttcccctgctgggctgttcccattctgtgatttttgaaaggctgttgccaacatgtcggtttggttaaccacaactttggattagctctggtgaggtttcggtgatgcttttctcattcccattggcttgggttcttgagtcatcggatccatcattcccgtagcctttgttaccaatgttatccatctgtcacaaggtagaggttgagaggggaagcatacaaggaaagaatagaccagaactagggacaagaccttaaaggaactaactctttttgttgatgtgttgtttgtttcgcttattctgcaggttgattaagcaaacaacctagcatggttacatcacctcccaccgatgcaaaccacgcgctacacacacaagcaagaaacacacgactaacaacactaccctatagggcggcttaggttctgcgactggttctccaagatcttagcttcagcttcacggctggcttcactgcttcctacactttgctagcggatcctgcagtcttccggagcttcggcaaacaactgacgacatcttcttcttcgcaaaactgaccatctagtactagttgaaatccgaagaaggaagaagggagtaaaccttttgcaaatagcattagggggaggaaaaaaaggaactttcgcaaatagttttatttataacatatgtccttaagttttatccacttggcttatcctacagtcgagatggcttttataccaacttgtcgcgaccgggaaaattg

SEQ ID NO: 59726 - DNA, 2743 bp, Oryza sativa
aatgacattcgaaattaaatgcacatttaaaataaaagaagaatttaaatattttatcaacatgctcaaagggattgtttgggacatgtgtgacatgccttacaataatcaattaaacaatatataaaaaggatggaaactacaagctaacatgcaaaacgagaaaaaagactaataaaaaccaaataaacaatacataaaaagtaaacaaacatttagagctttattttagatgaattatgaactgcctcatttcgacttcatatgaattagtaatgaattttacaagatttaattcaactaaagcctatttaaaaggattaaatagatttattacataatttataattattttaaagaagaaaaagataaattatgatgtcatcagcaatcagtccaccgtagagtaggtccacagagattgaccacatgttcactgagatggacaaccgagattgatcttgaccaagagttaaccaagagttaaccaagatctgacggctcaaaccgattcaatctagggtttagatggaaccacgtggcaacatgttgacgtgaaatttgtcgcacacgaaggcctgagagatccacatagctcgtcgtatcaatcgggtgtagggcgtggcggttagtttgatcgtacaattaagaagatagatagatggattgtataagatcaaagagccgatcagccaataggctgatgtgatgtagcaaggctagccgatgtatataaggttttcatcaatcgtcaataaaccattcctaatcaaagataatcttgatagatcagacctaattaatcgagacggtatgatattgaagttgataaagagatatttaactattgattatacaagtttgagtataagacgatacaacacttagaagtagtaacaagataactaattggctagaactctaataaaatgttgcataaaaacttatcggcttagtagaatataattacatattagcacaatctaataaatcaaacctaaacgagacagtataagattgaagatgataaaaaatgggataattgcttatttgaccctgttttgaagcctaacttctaatctgactatgtttttcttagtttgcttatttgacttttttaaattgaacactccgtctgaccctctttccactacatcattagggtttcttctagaaaaagaaaaaaaatctatttactatttaaactgaccaaaataccatcaaggcacttcaaccctatccatcccaccttgtctctctcatctcttacaagcggcacatggagaaatggatctgcggtggcggcggtgcgtcgagggagtggctagcagcaccgccgatgcgtggaggtagggagcagcagcgtcggcagcgcatggggaagcggcggctgccgcacggatagggaggtcggcgcaaacgccattgcgcgacggagcggccgcggcatcacgcgatgcgtgtaggtatctcggaattcccgtgtcgcatcagcggccgaccgcggcagaagtggaggaggatggagcgtttcgttgacgacctactcaggtctctcaagaagaacgccacggtgggtgcgccgacgaccatggtgaacgtgttcggattattatcgagatattgatctggctactacttggataaccttgatgagatattgattatcagagcacttgattaatttgctgcgcctagacgtttctctacaagtgaagggggcatgcaagagtataagaattccctcgcgagttcattcgatgggccgtttaattcgcttgtggaggcatcggtttgtccgcagcggcgctgtcgcggggagcagtggcgtgcaaagggtggtcggcggcggcacccagcatcaacctccagctactgtgtattaaatttgtcaaattgattctgatttgttaaaagatccatttgtatgaatgtttggatacaagagggccaaataagcaagggcaaaagggactatttgcctcttatttaacagtgttaacccgccttaacggaacagggtcagacggttcatttgattttgatgaacagggtcaaataagcaaactgaaaattgtagggtcaaattagtagttatgcttttaaacatggtcaaataagcaattgcccctaaaaaacctatttatccgataaatctacacagacgtgatggatataacaaatctatctaaaacaatagtataattagagaaatatcaactaaatcagaatatcggacctaaccaagaaagtcctaactaagtcgatgcaactctaaacggcaatgcagttaaagatagaatcaatatatcggatatgtaatgcttgcgtcaacccaaaaagaatacctgacttaatcgagaaagttcttgccacggcgatacatgaaaagttgatagaaattacttcctcattggagatcaaaaccaatgcagcccaactcaaagtaagaacttgctagaacaaaaggttgcaatgcgccgaaagtaattgtattaatatgtggagaaagtttacaaagaccctgtggtacatatttatctcctcaggttgatgcaagtcctaatcagacaagacataggtttgctaaacataaaaggaaaaaatacaagtcttaatcagacattagataaaacttcctaaagattaaaggaaagttactaaatcaacagatagaattaatatgccatgccatggtcttcaccatcctttttgaattcggtatcttctggatagacttcca

SEQ ID NO: 59727 - DNA, 1453 bp, Oryza sativa
ctgcgctgagcgcggagagagagacatgggctcaattcgacccagaactttggaggggtttctaatttattttatatttaaataaccattgaattgatgtttgtattgttaaaattagtaattgagctctgaaaaatccgaaaaaattctagagagtgtaaactaatcatggagaatataataaaaattaaatccagcaatgttttatttaggaaactttatttcccactttaattcattttcttaattaatgtacactttaatataaattctagaagtattttattaaataatttataaattcctgaaacaaaatcagggtgtggcactactaaagagtcttgtactaataatttatagatcaagggtttgcacaaaatataaattcaatcccatggttctttctgtgaacaccaacaaatgcttgtcaggtattcatcattatttttgtgttggctaattgttctagtttatttttgtgatcttttcaggaacttattccgtaattacttgactggtcccattccgtcgttcatcggaaaatttacttcaatgcaatacttgtatgagttacatgtttgttctagatcatgttccatctattggtcgttgtttttttttaattattgctaatcatctcaaggtcattatctttcaatccactatctggactacttccaaaggaactaggaaacctcaccaatcttctttcattgtaagaaatcttttctcacatgtggattaatcttccactgctccctctgctacaaaccactcatcctttcagctttaactgtcaattcctagcagttttcacgcgcgtgcgcgcacatatatatagagagagagttgaacttatgactacgaatctgagcatagcttatgtgtaaattgttagctagaagttgtatttttttttacggagggagtacgaactataaattatgaaattatttctcatgttgaatctaaatgttaaactatataaatatgtaaaaatggatggttagaaatataatgtttgacttacaacaaaagtagaatgacagataatatgaaatgagtggagtatatatttggactgcacgaactaatataataatacatgaaatagcaatcgcataagttctacttcccccgtcccataataagtgcagttgtgggttttagtgctcaacatttgaccgtccgttttatttgaaatatttttataaatagtattctaattgttattagatgataaaatatgaatagtagtttatgcatgacttatttttttaaaaacaatcataattttttcaaataagacgaacggtcaaacgtttgatacagaaacacttatggttgcacttataatgggacggagggagtgataaaaaagatcaaaactactactaaataggatgtaataggcatgtcagtgtaactcctgctcatgtggtgcttcatatga

SEQ ID NO: 59728 - DNA, 1470 bp, Oryza sativa
ttcctcaatccatcttgaatttgggaaatctcaattctttgtaagaaattctttctttacatcaatttgttcatacgagcctgtattaagcagatgagtatattttataatcttgaactgtgcccaattcaggtttcttgggaacaatagccttacaggaaagttgccggatggtataagctcttcattaaaagtgatgtatgtcaaatacaattgacatggcagtatagcacaaactacattcataatagtacgcactaattttgtataacataattctggaatgttgacagagatttttcgtacaaccaactcactgggagcattccttcttgggctagacaaaacaatttacagttgtaagtgtaaaagtgtgatatttgtgtcgctgagaaaaaatataaatactaatattctgttttttgaaaggaatttggtggcaaacaacttcttactcgataccaccagtgaaaggtacttgtgacatttagttctaatttggcgagtgaactatatgaaaatcttgctggtaactttaaattttcaattcaaattgtgcacagtacgctaccttggggaataaactgcctccaacaagacaccccttgtttccgtggatctccagaatgtatatttctcattcttcataaaactaaacagtaacatgaacttacgaatttgaatgatggctacaatttttttaatcttaattgcagattattccttcgcagttgactgtggcagtaatgcatccataagaggctcagatgacactatttatgaagcagatcctacaaatcttggagctgcaacatattatgttaccggtcaaacaagatggggtgtcagtagtgtagggaacgccatagatgcaaagaatattatatatagctcccaaccttttcaaaatgtagttgattcagagttgtttgaaactgcaaggatgtcatcatcatctctgaggtactatggacttggacttgagaatggaaattacactgttttgctccaattcgcagaattagcttttccagactcacagacttggctaagcttagggagaagagtttttgacatatatatccaggtagaaattttgtgcattttatataatgtttttctactgaatcttaccaatatttatctaaaagtattactgatatttacatagggtgctctaaaacaaaaggatttcgatataaggaaaacagcaggtggaaaatcttttaccgtagttaataggagtttcatggtaactgtgtctaaaaacttccttgagatccatctattctgggctggcaagggcactgttgacatacctactaaagataattactatgggccaatgatctcagcattgagcgtcactccaagtaagcaccacactaaaacaacagcaggaagtgttatattcgctgccgataaataatatttttcctttgcagattttactcctaccgttcgaaacgg

SEQ ID NO: 59729 - DNA, 2234 bp, Oryza sativa
tgaatgggtatgctggtctatgttcttcccatactagaaaacttcaattcattgtaaattgccttttgcttactcaaactatgtttatcaaaaggcatggggcctgtatgaaatggatcaagcacttggaattgttgacccaagtctcaaggaatttgacaaggatgaagcttttagagtcatatatgttgcacttgtctgcactcagggctctccgcaccagcgaccgccaatgtcgaaggtcgtgacaatgttgactggagatgtcgatgtggctaaggtggtcaccaagccaagctacatcactgagtggcagcttaggggtggtgggtacagcagcaacaccactagcagctacgcatggtctagcaaccctgagttgagtaggcaaaaagagatcactgaagtttctctccaggtgaggtgaatttaatgtagaaaatctatgggccatctatattggtttgaaatgacgatattgtaactccttttttttacataattttgtaattttgtgtcgatgtgagttattgcaaacaatggaattacttatcctgaatctttcctggtaacaaaagtttgctcctaataatttgtaaatggtgaataactgtggtgtattcactactcaaaaaaaaaagttaatagataaccttttatctgtaatggtcagtgcaatgcagaggtaaaattttgtccaattgtttataaacactgacatggtatggttacagtgcggtaggtgtgttgtccactttccaacggattcgactttgtattaatatttagatcgaggtgtcagcaatttaacaaacaagatgccacgtgaccttaatggttgtttggtcttgcaacttcatctgtgaccatggccaaagtgagaccatgttctgatggaggatgttcctaggtagcagggacgtcttggatatcatcccacctcttccaatagctatgtattacttcagggtgtcttgggtttttaaatcattattattgctaatttaatgtatgaagctgtgaacagttagatagttgttttcccatctttggaacctaacttatcgtatgtgttttttcgtatttctaattcagattgtttttatgttgttcttatttacttatttactcatcgattgatcataggaacatttttttttttgcatcggcaagatcagtgacccttgaagtagtttttttttataatgaaattcattccggcttttgcttaaagaaaaactacaaccagttattacggaggttgcaggacaaatgagtgcaaattacaaaattacagctcgattaaaaataagaaaactacatagtataccactttaaagacaaatatttccatctatggttggcaagagtatgtatagtcattgttctaccaacggtttacaagttaaatgtagtccttatcttcctcaaataagaaaagaaaaaacctttgaaatcagcggctgatccttgtcgatcaaatttcgctccaggcactaccagtgctaacctcaaaccaaagcatgacataacatcagagagtaactaagctataatcaatcattcgtctagtccatgccaccaccattgcaatcgaacccaactggtaggaacaccgccacaaggacgccccactaatagggaacctccgatgtgacgccttcatgaaagtggcaactaggatattactgtaacaccctgaaaattttgattttaaaatatggaaactaaaatttattgaaagtaaggatccccggcctatccaaggatgtcgcgaggaggagcgagagctgagcagtggcaaggaggcggcccaccactgatgacctgtaatgcgggccatggaggacgacctgctcagcgaggaggacgtggctgccggcaacgaccttcagcgtggggcgtggatggtggaggacctgctcaatatggaggacgtggtcgccaccaccgacctctagcgtgggccgtggacggtcgaggacctgctcctcattaacgacattgccacccaaagggagggccgctataacgcactcacttgctgtgtcggtatgcttttgatttctctctttctatttctctttcttctccgatggatatattgatccatcaatcgcttattagatcaagttagtgcagggcttaagaggcccaggaagagctatagactattgtggctgaactactggtcctggagcatgacggagcaggagcagctactggtcctggag

SEQ ID NO: 59730 - DNA, 1257 bp, Oryza sativa
ttgccacgcatggactaagtcctgagaaggcaattgtatctattaattaggatattttatgtaatttccttagagatatgtttgggcaaaagtctgccgcaaagacttatggtatcttagtttgttagagataaaagtcgtgtccgacacgggcatattttgtaaatcttgggtataaatagaccccgagccccatgtaatatgataacacacgttcaatacaatctcagcgcaccgccacccttttactttcattttgtttcgacgagttcttgctttcgggttgagctgcatcggtttcgatcttcaactagaggtaaaacttgttatggtggcttgcgttctcggaattagggcttccatctttatgatactctaatcttgttcatgtaattcgttgagttatcatatatcctatataatctccggcaatatcgttatctaacccccaattggctaatgtctgttactaaaaggcagccgattaggttaaataccaacgttgactaggattatataggatatccaccactctatgaaacatccaatggcttgattgtctagatattttccttcttttcatacttatagctgcatcagttgagtttgaccttgtaagtcatgattagaatctcaatctctagcctgcttttggttgccgattagtgtagcatcggggtttcagtcgatcttacctaatttaactacatttatcttatatgcttgattgacatgttaaattgccctttttgttaagatcttgttgcatttaagtatattaggctttcgtttgatatattttacttgctttgatatctcaatatagagtggtattggagtattagccgatacatgctagatctatctgatcggctatgctatgaacgtatatagtcttgttgttaatatatatttcgatctaagtgatttatactgtctcggcatggcgaccgatctgtcccaatcacttgatttaagtatatatcgacacaaggattatatattgttaatatctatagccgatcgagtagatttaattttttcttacttgttcatgattgccgatcgatctatatatgacatcggctcaaagatgaatgatatgtcatcggcaattagccgatcggctatcgtttatggatttaaccgcggtttctttgtctttatttcttgttgattgcaggatcaaatcaactggcatgctcattaacctaaaggcaagatttttggacctacactgaagttaagcagatcttc

SEQ ID NO: 59731 - DNA, 2430 bp, Oryza sativa
aagccgaggcggcccaggaggaggggagggagagaagatgggccgggaaggagaggagggagggcgggcccagaaggaggaggagaggagggagtgggctgcccgggaggggaagagaggcccgggagagagagggagagaaggggagggagagaaagagagggaggagagaaggacttttgggctgggcttggcccaaaggaggaaggagggttatttttagattttctttttaataaactttgttaattgttgttgttgtttaataattatttccggcgctctgaaaattcaagtaaaatttgagggctcgttttagaccaaggagaatttaacaaaaattctccgggccacattcgaatttttcttgtacgtattttagtgtttgccaatttcttttcgaattttaattaattctattattccttttagcgaatgaattttatttcgggatgaatttatcaggacgtgacacaacccaggccaactattccacattttagttgataagcaggttttaagaattaaaacactaacttgggtacattgctcggcttgcccataaccgagggcgcggctattcgaatagattatactctgatcagaggtgtacatctttacccacaagacacatcttcctcacgtgcaaccacgtgccacataccaccacggtatacagacggaagacgtgacatagtttccaacccatcctagccatagacaagagtaccgacccaatcccacctacggccggaacccccgggacaggcaggcaggactgagcccctagcagcaggacaccggccctgtgccatgacatctcgactaccgggccgcagctcgtgtagccttcatttgccctggagaatgtccatcgacccccgacttcatccatctccaatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttggggattttgaatagaaggagcggtgtgaagccaattccacaataaccaaaccattccatagtgtccaggtgataagaatatttcccaaagtctatagttgaaaaaccacctaatgttacctaattaaattgcgaagcatctacctaaaactaaactagtggtgccatgagtagagtgtccactagttgaggttttgtttattctagggtgaacaaggtaataataataataacaataataataaggtcataacaaaggtaaataggcatggctaaataaaacagtgataacgcgggaatttaaataaagcgataatgcaataatttaaatcaacataattttacaaacggggattcaatatgttcaaagatgatgtgacttgccttgctcgctttcccaaacgtcggcttcaacttccacgaagagcggatcttccgaagctgcagcgtctacacgaccaacggaaaagaaaaggcttttactctaataaactccatataacagcagaaacaaagcataaaaatgggttcttggcttcataaggaaaaattagagacttgaacggtccaattccgagttcaaatggccaagttatggccatttgaagtttatatgctctttaaatggatatttgcgaatttcttcatttaaattttaattaaaaatcggatttattgcgtcagccgagggagagggcgcgcggaccgggtccacgggagtggggcccacgcgtcagcctctcggtccatggtggaccgggcgcacgcggctgacgccggccggcgtcgtgggtcccacgcgtcagccgcacccgcgggcgcgggcggctgacggccgggccccacctggcagccgcgggacgcgcccgaaggcggccttgccggcacggccgacgggaggcggcgcgcccgcgccccgatggtcgccggcggcgacctccggcgcgacggagcggcggccgagagaggggagggaagggggaagtgaaacggcggtccttggctcaccccgggtcgacggcggtgacggaaacggcgaccgaagcggcgagaggcggcggcgcggctcgggttgacgaggacggcggtgctccgacggtcggcgggcgaaacggaggagtggacgaggtcgacgaggacgcggcgaagccgaaggaggtgacgccgagacgggaggaggtccggggcgacgacggcggcgaaccggagctcggcggcgacggcggagagagaggacgacagcgcgggcttgattccgacggggagagaaagcggcgagcggcggaaacggagcagagaggctcggggagcgattatataccgtcgggagggggagagagcggccggaggggaaggaatcgg

SEQ ID NO: 59732 - DNA, 1707 bp, Oryza sativa
ttcgaatgtggcccggagaatttttgttaaattctccttggtctaaaaggagccctcaaattttacttgaattttcagagcgccggaaatatttattaagcaacaaaaacaattatcaaagtttaataaaacgaaaacctaaaaataaccctctccttccctttgggccaagtctggcccaaggttcctctcttctcttggcccgcggccaaagtctccctctcctccctctctttccctcctctcccgggcctctcctcctcctcccggcccactcttcccctccccctctcggcccactccctcctccaccctctccctcccgggctgcctctccctcctatcctcctgggccgcctcggcttcgcccggcccaagccgagccgcgcctccctcccgtgccgcgcacgtgcgcgtgcgtgcgcgccgttgccgcgcgttgaccgcgcgcctcccgcgtgggtcccgcctgtcaggcgcgtccccggcctccagccgccggcctccttcctctctctcccgtgaaccctagcgccgttcctcctccaaatccgctccattcaagccggctctttccaaattgattggggggaattaatccccattgattcctctttgatttcccccgtttttccccttgaatggcgcccccaatcgcccggaacggccgcgccattcccggccgccttccatggctgccggccgtgtttcccgtcgccgttccgccctctcccatgcccggctcgcttccctccgctataaaacggaatcccctcgctccgttctatcgttttagcccactcccgcgatctcccgtggtccctagccctcaccgccgtcacgcgcgccgcctcttcctcggtctcgtcggcacccactccggcagcccctttcgccgtgccagtgcgccggccgacgtcgccgtctccacctccggcatcgcagcgtcaaggacgccctcggcctcgcctccccttcgaccgaaccccgccggtgttcgtcgtcgtcgtcaccgttcatcctcgccggctcgtcatctcgcggcgccgcctccgtcgtcgacatcgcagcggcgtgttccacgccatcctcgcctccgtgcagccgctgccggctgccctcgtcgtctcctcgccggccccggtcgtcgtcgtcgtcgtcctcccgtcgttcccggtcgtcgtggcgttcgtccctctgtcgagccgttctcgtccgtcctcggtgtttcgtcaaggtcgctgtagccgtcgtcgtctttgtcctcggctccgcgtcgtcaagcctcatgccggccgcgtctcgccttcgtccaaggatcgccgccgaagtcgttccctcgccgtccgccgcgcccgttcgtcgttgttgttcccacgcctcgtcgcgtggtggtaaggatccgtcctctcgctgccccgtcctcgtcctttcagtgtcaccccgtacccgttgtgcggttgtcgaccccggtacccgtgtaccggtgtcggtagtcgttcacgcgtgcgggtggtgaccgtgtagtgtctgtgttagtgtgcccgctcggtagccgcgtggtttccacgtgtgcaggccgtgtggtgtctagtggagtccgtttgtcggccactcgcctcggttgacacacgggatccgcttccgtcgacccgtggaccgtctctgtgtacgcggtctaccgcggtcctttttgttgacatgtga

SEQ ID NO: 59733 - DNA, 1493 bp, Oryza sativa
  unsure (1)..(1493): unsure at all n locations
acagcattaaactttggatgatcatatcttggtcatacgagctctgaatcgacccgttcaagtctcctaatgtttgttataacctaaagaaccgtatgctttctttttatgtattgttattgtttctttataggcttgtagctttgcttgtgtgcttcgcgtagcttctgtcgttccggaggttccagaagcgtggttcgcggtcgtcgccaaaggttcggaaggccgttctctctgagcaaggcaagtcacatcatccttgagcatattgaatcccagtttataaaattattttgatttaaattaatgcattatcgctttatataaattcccgcgttatcactgttttatttagccatgcctatttacctttgttaagacattattattgctattgttattattaccttgttcaccctagaataaacaaaaccccaactagtggacactctattcatggttccactagtatgaatttaggtagatgcttcgctgtttaattaggcaacattaggtggttttataactttagactttgggaaatctcatatcatttggacattatggaattgttggattatggtggaattggacatacccctctcttcctctttcaaaacccctaaaacctgttttccggtggggtttgggtgcatgccagttgtgggaagtagcaccccggccaatataaggattaagctcgggcctctgttgcaaagcactaccgtacttccacatgtctagtgggtaaggcttagtttgtggctcagtctggttataaacaaaagtacacggatggagatggatgaagtcgggggtcgatggacatctctaggacaaatgaaggctacacgagctgcggcccggtagtcgagatgtcatggcacagggctagtgtcctgctgctaggggctcaatcctgcctacctgtcccggaggttccggccgtaggttgggattgggtcggtactcttgtctatggctaggatgggttggaaactatgtcacgtcttccgtctgtataccgtggtggtatgtggcacgtggttgcacgtgaggaagatgtgtcttgtgggtaaagatgtacacctctgatcagagtataacctattcgaatagccgcgccctcggttatgggcaagcctagcaatgtacccaagttagtgttttaaattcttaaaacctgcttaacaactaaaatgtggaatggttggcctgggttggcttgggacgagctgggaccctgtcgcgtcctaaaacgactctaaaatacatcctcgaaattgtgccgagaataattaaaattcgtgtgaaagcctccaacaattaaaatgtgcaaatataaaagtcaaataaggcttggaggatttttgtgtatttcctaaaagcctaaaatgcgtaaataaattntagtgaaattttcagagcacaaataataattgagaagaaataaacaaagttaaaaggggtttataaaaagaaaaatccctaaa

SEQ ID NO: 59734 - DNA, 1911 bp, Oryza sativa
agcggggaggcgcttgaccttgctgacgccttggcttcgggcatttatccgcaaagtgcccgggctggaagcagttgaagcacagacgctgctgaccttgagcgtccctgcggccttgaccgggctgcacagtcggcgtaggaggacggggcgcacgagtcccttgctgattctgctgctgctgcggctgtgggacgcgcaccacgaattgaggtcgaggcgcggagcgaggttgctgctgctgttgttgctgctgcgaggaggatccccctggatagggattggtgtagcggaccctttggttagcaccctgctgattgcggaaattcgccaagcggcgcttgtgcgactccagttccttgtgcttggcctccaagcggatgctcttgtccaccaatcgttgaaaatccggatagtccccagagactagacggacggacagctcggggtccattcctgccaagaacttctcttgcttctcctcatcttcccgcacatcctccggggcgtaacgggccagattgttgaactcatgcaaatactccatcacggagcggttgccttgcttcaactctcggaattcccttttcttaagagccacgactccagcgggcacatgggtcctccggaaagcggcggtgaagcgggcccaagtaataggttgcccctctggctgcgtagcttggaaatggtcccaccatagagatgcgggcccctgcagctagtgggcggcgaagatgactttctcctcatcgctgcactgcaccgtgtctagctttttccccacggcatgcaaccaatccaacgcatccacggggttgttggagctagagaaggtgggtggacggatgcggaggaactcggcgagtttagagtgttgtgggggtggtggtggagcattctgttgtggtggattttggaggtggtggaggaaagcagtcatcatgttggcctgctgggcgaggatttgggtgagaatggcattggtatctggtggtggtggtggaggcggaggaggaggtggaggtgggttgcccgggtggttgtggttgctgccttcaggttggttgccatcaccggtggcagcatttctcctggtcgtcaccatctgaaaaccccacacagaaccagcaaacagagaaagagctaacaattaaaactaaccacccacgactaccataattcttgaatttattactgctattaaatgggttcattaaagttcaagttgcttaggcaaataaaataagacaggctccgacacagttatgccacacaccggcatgaccatgccccacacgactcaaacaaaagacaaacaagaaagaacacacgcgcaagcctactaactgctcgtctaccgctgcgacgggccaggacggaaggtgagcaacagcgcatcctccgtgctaccaacgccggaggcttccccctcctggggaaccacgggcgcgggctcggcacgaggggtctcgacgaagcaagtccacgccagggactgacgaacaagctcgggcctggaggtgctcttgcgggcggtgatcttctggctgcggcagacacggcgacgcttggggcggcagacctctccctgggcgatcttgagctgatgcagctgcacctccaccgcgtctaggtccttcttgagctgcaggttctcctgacgcagctccaggatcttcaagttgttctcgaccatcccacggtgtaccatctggtggaagtcgatacgagccgcgtcgtacgcctccaccatgcgcgccaggtgcacgatggtagcgtcatcctccgagctagcatcccggaaggtggcgtagtcgcgggctcctccgcgacgagggtggtagcggtagggcgagtgctgcaactcgtccgggtagcgctggtgaagagtgccgatgacgaggagag

SEQ ID NO: 59735 - DNA, 9638 bp, Oryza sativa
ttgtgtcttgtgggtacagtggtacacctctgatcagagtaaaactattcgaatagctgtgcccgcggttatgggcgagtctaacaatgtctttcgtgattagtcccacacttctcatcttagtaaatgatgctttaactggtaataatttgattagctcctggtttggaatggtatattcctggtttggagatagaactgtgcagccgaggtggttgtttagaatggttgggcctatacaacagggtatgttgtatagcgttggattaatattgtttaattattacttaacggtttgattaaattctcaaatgtttgctaaatgctgcttttgcaaatgaaaccctattatgccatcctttgttatcctgtgcacttgcatatttgctgcgtggcttgctgagtatgtcatatactcaccttgcaatcattcatcagaggaagagttctacagtgaagctgatggagtggaggattaggtgtagccttggtcaagctgcctgtggagtggagccgtctgcgccgtttatttctttttccgctgcttagatatttattgtttgagaggaactatctacctctgtaatgacactttatacgcttattaattagagtaataattgtactctattatcaatttgttattgtgtgcctcggctgattcctggacgagggttcacacacatgtaagcgtttggaattttggatagaaattccgggcgtgacaaaagatcatactcagagaatgtgcgtggattatcgagcgttgaatgaggtgattatcaagaataagtatcctctacccagaattgatgacctgtttgatcaactggaaggtgctacagttttctctaagatagatctccgttctggatatcatcaacttcgaatccgtgaggaagatataccaaagaccgctttcacaactcggtatggtatgttcgaatgtaccgttatgtcatttggactcactaatgccccagcctttttcatgaatctgatgaacaaggtgtttatggaatatctggataagtttgtcgtggtgtttattgatgacattcttatttactccaagacgaaggaagaacatgaagagcatcttcgtctagctttagagaaactacgtgagcatcagctttatgccaagttcagtaaatgtgaattttggttgtccgaagtgaagtttcttggtcatgtcatctcgtccggaggagtggcagtagatccaagcaatgtggagtcagtgttaagttggaagcaacccaagacggtttcagaaattcgtagtttccttggacttgctgggtattaccgcaggtttattgagaacttttcaaagatcgccagaccaatgactcgtctgcttcagaaggaagtaaagtacaagtggacagaggattgtgaacaaagtttccaagaattgaagaaaaggctagtgactgcgcctgtgttaattttgcctgattcgaggaaaggtttccaagtgtattgtgatgcatcccgactcggtttgggttgtgtgatgatgcaagaaggaaaggtggttgcctatgcatctaggcaattacgtcctcatgagaataactacccaacgcatgacctagagttggcagctgtggtgcatgcattgaagatttggcgtcattatcttttcggtaaccgtacagagatgtatacggatcataaaagtttgaagtacattttcactcaacctgatttgaacatgcgtcagcgaagatggttagagttgattaaagattatgatatggaaatccactatcacccggggaaagcaaatgttgtagccgatgctcttagccggaaaagctactgtaatatgtcagaaggtcgacatttaccttgggagttatgccaagaatttgaaaagttaaacttggatatagtcagcaaaggttttgtggctactttggaagctcaacctactctgtttgatcaagttagagaagctcaagtgaatgatcctgatatcccagaaataaaaaagaacatgagaagaggaaaagccatcggttatgtagaagatgagcaaggaactgtgtggttaggagaaagaatttgcgtcccagataataaggagttgaaggatactatcatgaaagaagctcatgaaactttgtattccattcaccctggaagcactaagatgtaccaagacctaaagcaacaattctggtgggccagtatgcgacgtgagatagcagaatatgtggctctatgtgatgtatgtcagcgggtcaaggcagaacatcagaagccagccggtctgttacaaccgttgaagattccagagtggaagtgggaagaaataggaatggattttataaccggtctacccagaacgtcggcaggacatgattctatttgggtagtggttgataggttgataaaagtcgctcacttcataccggtcaaaacaacctacacggggaataagcttgcagaattatacatggccagagtggtatgtttgcatggcgttcctaagaagatagtgtcagatagaggtagccagtttacttggaagttttggcagaaattacaagtagagatgggtacccgtttgaatttcagtaccgcttatcaccctcaaacagatggtcagacggaaagagtaaaccaaattttagaagatatgttgagagcctgtgttctagattttggtggaagttgggataagaatttgtcgtacgcggaattctcatataacaatagttatcaagctagtttgcaaatggctccgtatgaagcattatatggccgaaagtgccgtacgccgctcctttgggatcaaaccggtgaacgtcaagtttttgggacagacatattgcgagaggcagaagaaaaagtgaagattatccaagaaaggttgcgcgttgctcagtcacgtcagaagagctatgccgacaatcgtcgcagagatttggctttcgaagaaggagattatgtataccttcgggttacgccgttacgaggtgttcatcgtttccagaccaaagggaaattggcaccgtgtttcgtgggaccttttaagattgtgagtcgaagaggtgaggtagcttatcagttggaattgcctccgtcaatggcgggaatacatgacgtgttccatgtgtcgcagttgaagaaatgtttacgtgtacctacggaggaagcagatcctgatcgtatagagcttcaagaagatttaacttatgttgagaagccagtcagaatcttggaagtaagcgagaggaataccaggaatcgcattatacggttctgcaaggttcagtggagcaatcattcagaagaagaagccacttgggagcgagaagatgaattgaagtcagctcatcctcatctcttcgccagttcttctgaatcacgaggacgagattccgtttaaggagggtaggtttgtcacgccctaaaaatcgtctaatgtaaaaatacattgtttaaatcatttttagaaattattttaaaagcctacaagttaaaccctaattatctaggaaaattttcagcataaaaatgagctagataaaattttattaaatactttacttgttcctctattttctagatttttctaggaattgtttgagcaagggaagtatttttaataattgaaacaacaattcacaaattatttttattcaaaaaagttcaaaaacccctccctaagccgttgggccgaattcggcccaacattcctctctcttccgcgcggccgaaccggcccaagccggcccagccgacgccgcccgcccctcctcctcgggtcaccgacatgtagggcccacatgtcggacccatcttcctcctccagccggccgattgccaggccgagccgtccgagccgccgtttgcaccatcgataccgccgccctcggtcgcaatcgagtccgattgttaggggggtttttatccccacatcttcctctatctttcccctcaagaatcggagcaaatggttgtgtatcttgtccgaatcaaactcgttttgattttatctctgcaaactaacccgaagattttccggtttcgattcctctcgtttggagtctgatctcttcaatccaaggctataaataggaccccccagttccctgtcacgaccggaaataacccaacgggcgttcctgacgtgcgtgcattaatccttgtcccaggaggcaaggtacaccaaaagttgatacaattcagagtttaacaagcggaagcgtaaatagataacttattacatgggcagcgaaggcccagcacacacagagacaaacgagaaacagcggaagactagggcgacgaccacaggcgcttgacggcaggcacgagctagacaccaaagccttcatctttaaggagctcctcttctgggcttgggaaaaaattgagcaagactgagtacaaccaccgtactcaacaagacacacccacaaatgcagaataaatgcaagggagtacaaaggaattatactataaaggggttagggttgcagaaaacagcatttaaagacatttagttgctcaaagctattttgtaaacgcgatcctagaactatacaatgttattaatcaaggccgtgaacccacacgaacctgccttaacccaaggcctatgatgattcagaccgaactggcaacccgaccctgggtcccagctcgtcccaagccaacccaggccaaccattccacattttagttgttaagcaggttttaagaattgaaacactaacttgggtacattgctcggcttgcccataaccgagggcgcggctattcgaatagattatactctgatcagaggtgtacatctttacccacaagacacatcttcctcacgtgcaaccacgtgccacataccaccacggtatacagacggaagctgtgacatagtttccaacccatcctagccatagacaagagtaccgacccaatcccacctacggccggaacccccgggacaggcaggcaggactgagcccctagcagcaggacaccggccctgtgccatgacatctcgactaccgggccgcagctcgtgtagccttcatttgccctggagaatgtccatcgacccccgacttcatccatctccaatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgaacccagcctaaaaccattttggggattttgaatagaaggagcggtgtgaagccaattccacaataaccaaaccattccatagtatccagatgatatgaatatttcccaaagtctatagttgaaaaaccacctaatgttacctaattaaattgcgaagcatctacctaaaactaaactagtggtgccatgagtagagtgtccactagttgaggttttgtttattctagggtgaacaaggtaataataacaataacaataataataaggtcataacaaaggtaaataggcatggctaaataaaacagtgataacgcgggaatttaaataaagcgataatgcaataatttaaatcaacataattttataaactgggattcaatatgctcaaagatgatgtgacttgccttgctcgctttcccaaacgtcggcttcaacttccacgaagagcggatcttccgaagctgcagcgtctacacgaccaacggaaaagaaaaggcttttactctaataaactccatataacagcagaaacaaagcacaaaaatgggttcttgacttcttaaggaaaaattagagacttgaacggtccaattccgagttcaaatggccaagttatggccatttgaagtttatatgctctttaaatggatatttgcgaatttcttcatttaaattttaattaaaaatcggatttattgcgtcagccgagggagagggcgcgcggaccgggtccacgggagtggggcccacgcgtcagcctctcggtccacggtggaccgggcgcacgcggctgacgccggccggcgccgtgggtcccacgcgtcagccgcacccgcgggcgcgggcggctgacggccgggccccacctggcagctgcggggcgcgcccgaaggcggccttgccggcacggccgacgggaggcggcgcgcccgcgccccgatggtcgccgccggcgaccaacggcgcggcggagcggcggccgagagaggggagggaagagggaaagcgaacggcggtcctcggctcaccccgggacgacgagggcggcggagacgacgaccggagcggaggaaggcggcggcgcggttcggatcgacgaggacggcggcgctccgacggtcggcgggcgaaacgaaggggtggacgaggttgacggggacgcggcgaagccgaaggaggtgacgccgagacgggaggaggtccggagcgacgacggcggcgaaccggagctcggcggcgacggcggagagagagtacaacggcgcgagcacgaatccgacggaaagagcgagcggcgagtggcggaaacggaggagtgaggcacggggaacaattatatagggacgggagcgagagagggcggccggggaggaaggaaaccggcgcggcgatctcgggctccattgatgcgccggcgaactttgcgggattgaatccgagcgaatccgagggagagagagaggggaaagtggggggaaagagggagggaatcacggggagtgatttccccctctttatggcgcgcggggacggcgggatgcggcggaatcggtggcggcggcggcgctagggcacgggcggcggcgggcgcggcgcgaggtaggcgatgacaggtgggccccacccgtcagcgagggtggcgggcgggcccgcccgtcagcggcgcgcgcgcggggaggaggccgatgggccgcgggggagaggagagagagggagggagttgggccgagccggcccaagagaggaaggggggggggggaaaaggacttttagggatttttctttttataaaacccttttaactttgtttatttcttctcaattattatttgtgctctgaaaatttcactaaaatttatttacgcattttaggcttttaggaaatatacaaaaatcctccaagccttatttgacttttatatttgcacattttaattgttggaggctttcacacgaattttaattattctcggcacaatttcgaggatgtattttagagtcgttttaggacgcggcaaacctaccccccttaaacggaatctcgaccccgagattcggaagaactggcgaagagatcgggatgggctgccttcagctcgtcttcacgctcccaagtagcttcttcttcggcatggttgctccactggaccttgcaaaaacggattacccggttcctggtcctgcgctccatggtgtccaggattttcactggcctctccacataggtcaagtcttcgcgaacttcaatctgctctgagtcggcctgctcggatggcactcgaaggcatttcttgagttgcgacacatggaacacatcatgcacgttgcccaaggaggcgggcagctccagctggtaagcgacttctccgcgtcgagcaatgatacggaaaggacccacataccgaggtgcgagcttcccttttgtctgaaacctgtgtacacctcgcaatggcgtgacccgaagatacacaaagtcatccactgcgaattccagatcacggcgtcggttatccgcataacttttctgccgggactgtgccacctttagattatcccgaatgattctgactttagcttcagcttctctcaggatatcagtcccgaacacttggctttctccaacttggtcccacaagagcggtgtccggcatttgcgcccgtacaacgcttcataaggtgccatttgtatgctggcttgataactgttattgtaggagaactcagcataggggagactcttatcccaggtcttcccgaaatctagtacacatgcgtggagcatatcttctaggatctgatttagacgctcggtctgtccatctgtctgcggatgatacgcggtgctgaaatttaatcgggttcccaattcttcttggagtttcttccagaaatgagaggtgaattggcttcccctatcagatacgattttcttgggaacgccatggagactcacgatcctagcgaagtagagctctgctagtttgttccctccataggtggtcttcacaggaataaatcgagctaccttggttaatcgatccacaactacccatatagaatcatatccaccttgggtttttggaagtccggtgatgaaatccatcccaatttcatcccatttccattctggtacttggagaggttggagaagtccggccggtcgttggtgctctgccttgacacgctggcacacatcacaaagggccacgaactctgcaatttcccgcttcatactaacccaccagtatttttccttcaagtctaagtacatctttgtactgcccgggtgaatggaataaggactctcgtgagcttcctgaagtatcagctgtttaagttctctgttatctggaacgcatacccgatttccgttccatagggttctgtgttcatcctctgtgaaaccagcggctttaccctgtttcatattcttgaggagtccatgcatgtccggatcattcttctgagcctcgcggatttgatcgagcaaggtgggcttggcttctagcgcggccaagaatccgcgaccaactatgcttaggttcagggcttccatctgttgattaagttcgggtggaatgccacggacgttaagagtgttgcaatggccctttcgacttagagcgtcggcaaccacgttggccttaccaggataatagtgaattcccacatcatagtccttgatgagttctaaccatctcctttgccgaagattcagatccgactgggtgaagatgtattttaaactcttatgatcagtatatatttcacagcgattcccaataagatagtgccgccagatttttagagcatgaaccaccgcggctaactccaaatcatgtgtagggtagttgccttcatgaggtcgtagctgacgtgaggcataggctaccacgtgaccgtcctgcatgagcacgcaccccaatccttggcgcgaagcgtcacaatacaccaggaagtccttgcgagtatccggtaagattaacaccggcgaggaaaccagcttttccttgagagtttggaacgccttctcgcattgcaggctccacacaaatttctcttctttcttcaacaactgtgtcatgggtcgagcgattttggagaagttctcgatgaatctccggtagtatcctgccaaacctaagaaacagcggacttgagtaactgtcttgggttgcttccaatcggtgacggcggtcactgtttcggggtccacagcaactcctttagcagatatcacgtgccctaagaatttgacttcggacaaccagaactcacacttgctaagcttggcatacaattgatgttcccgcaactttcccaacaccagacggagatggtgctgatggtcttcttctgattgtgagtatatcagaatgtcatcaatg

SEQ ID NO: 59736 - DNA, 2374 bp, Oryza sativa
ggattcggcgccgcggcgggcgttagggcacggcggcggcgggcgcggcgcgaggtagacgataacaggtgggccccacccgtcagcgagggtggcgggcgggcccgcccgtcagcggcgcgcgcgcggggaggaggccgatgggccgcgggggagaggagagagagggagggagttgggccgggccggcccaagagaggaaggggggggaaagagacttcttttagggtttttctttttataaaacctttttaactttgtttatttcttctcaattattatttgtgctctgaaaattccactaaaatttatttacgcattttaggcttttaggaaatatacaaaaatcctccaagccttatttgacttttatatttgcacattttaattgttggaggctttcacatgaattttaattattctcggcacaatttcgaggatgtattttagagtcgttttgggacgcgacaaagcacaaggaactggagtcgcacaagcgccgcttggcgaatttccgcaatcaacagggtgctaaccaaagggtccgctacaccaacccctatccagggggatcctcctcgcaacagcaacaacagcagcagcaacctcgctccgcgccgcgacctcaattcgtggtgcgcgtcccacagccgcagcagcagcagaatcagcaagggactcgtgcgccccgtcctcctacgccaaccgtgcagtctggtcaaggccgcagggacgctcaaggtcagcagcgtctgtgcttcaactgcttcgagcccgggcactttgcggataaatgcccgaagccaaggcgtcagcaaggccaagcgcctccccactccaacaacggtgggaaggatgtcattcggggtcgtgtgaatcacgtgacggccgaggacgtgctgacaactccagacgtcatcgttggtacgttcctcgttcattccatccctgctaccattttgttcgactctggagcttcccactggtttatatctgtgccattcgtggggagaaatcagttgggggtagaaaggcttaggaaccctctgctcatcaccacccctggaggggttatgacagcaaagtattatagccctgccgtccctatagaaattcaggggattccttttccctcggatctgattctgctagacaccaagaacttggatgtgatccttgggatgaattggttggctcaattccaaggagtagtggattgcgcgaggcgcactgtcactctgtaccgagggccggaacaaccggttgttttctttgcacccccaacctctgtcagtagttcagaactgcatcagataggactgtcagaaatccccatcgtcagggagttcggagatgtgtttccggaagaactacccggtatgccgcccaagcgagagattgagttccggatagatcttgctccaggaaccactcctctgcacaagcgaccctaccgtatggcagcaaatgaactggccgaagtaaagaaacagttggaagagttgaaagaaaaggggtatatacgtccgagtacttccccctggggtgctcctgtgatttttgtggagaagaaagacaagactaagaggatgtgcgttgactacagagctctcaatgaagtcaccatcaaaaacaagtaccctcttccccggatcgatgatctgttcgatcagcttaaaggtgccactgtattctccaagattgatcttcgttccggatatcaccaattacgtattcgtgaagaagatattccgaagaccgcattcaccacgcgatacgggctgtatgaattcacggtgatgtcattcggcctaaccaatgcacctgccttcttcatgaacttaatgaacaaagtgttcatggaatacttggataagtttgttgtggttttcattgatgacattctggtatactcacaatcagaggaagaccatcagcaccatctccgtctggtgttgggaaagctgcgggaacatcaattgtatgccaaacttagcaagtgtgagttctggctgtccgaagtcaaattcttaggacacgtgatatctgctaaaggagtttctgtggaccccgaaacagtgaccaccgtcaccgattggaagcaacccaagacagttactcaagtccgcagtttcttaggtttggcaggatactaccggagattcatcgagaacttctccaaaatcgctcgacccatgacacagttgttgaagaaagaagagaaatttgtgtggagcccgcaatgcgagaaggcgttccaaactctcaagaaaagctggtttcctcgccggtgttaatcttgccggatactcgcaaggacttcctggtgtattgtgacgcttcgcgccaaggattggggtgcgtgctcatgcag

SEQ ID NO: 59737 - DNA, 855 bp, Oryza sativa
ctgcattatgttgttgaagttggtaaattgagcatcggcagattgttgccattcttgcgtttgtgctatgtgttccgtgaggttgtactggatctcccccgtctgcacatcaaaggtatccattctcgtagtgatttcacccaagtcccaacaagaggaacacgagcacaattcacttagagatggaggcacaccacttgatctgggaggttggtcgtccccccattgtatgtcatgaggcgcacgccatcggtcctcactggcacttgcccagcttgagactccgatgctgtagcgtggagcttgggtccatccgggtgcatccccagttggttcccaacctgtctcacgggtgttgaggatgatgagctttcccgttcatttcttgccatgttgcgcatctccctgtatgctccacctgcacgagattcttctatggtttgcaggggaatggttagttcacggcagttgtacaaatgataccccgcatttggcaacgggatttcatttgtacaaccggagaaaaagtatatcaaagatccatctactccatgtttcagaatatgaccttgcactagataagtctcatcaatacacggacgagaagctaagataaaagcaatttggtcgctaatgatccctagcccttttgctatccgagtaatcagagaagtgcagtcaacaagagcagagaactttatattctctaaccattgtcttatcatacatttcataggagcaatgttgttttttctaaccatggcaaacatgataatcaattcatcccccctaatggatctatgatcacctctagaaaacaaggtcatagcaatccatttatgcatgagcctaagt

SEQ ID NO: 59738 - DNA, 13884 bp, Oryza sativa
ggttatacttgtcttcctgacgaatcgccttgtccaccaactgctagaaatcccggaaatccgtagacatcaaagcataagacaactcatcattcagtccctccaagaacctctcctgacgctcttcatcggtgcgaacatcttccggagcataacgagctaaacggttgaaatcatggaggtactcggtgaccgaacgagatcctggttgagtgctctaaattctctcttctttagagttacaacacccgttggtatgtgtgtcttcttgaaagcggccgtgaattcctgccacgtaataggctctccttcagccctgccttggcgaaaatgatcccaccattcagcagcaggaccatgcaattgatgcgaagcaaaagaaactttctcctgctcagtacactggatcaaatccaacttcttctccaccgcatgcagccaatctcctgcttctactggattggtggtgcttgaaaaggtagggggtctcacacgtaagaaatctgccagcttgttttggggaggtgggggtggattctggttctgattgtttgcctgctgattctgtgcctgctgcactaacagattgatcagttgtgtttgttgggccagaatttgagctagcgtgggatctcctccattgttagcagctccacttccacttccacttccacttccggtgcgcgtgttcaccatctgacgataagcagagacaacaggaaagaacgacagagagacacccttagaacagagttatttaattaatttaaattctatattgctcttaactgtgtatgttttcatttaaattgcattaacactatctcaccaactatcttacactctgacaagcaaaagaactagactcatgctgttacatcccaccaatgatgtaagcaacaactaaaacccacacactcacaagcaaacttaaacaagcaatctaacacagcgaactacggcaacgatctaactaagcgactaatcccgccttgcgtcggaacgaagcgatggatcttcttcctctggagtagctggctctctttcttcagggtcttcctcttcttcctcatcacttatgatgtcgatgacaggttcagcacgatcgggcacagcttcacccatcacgcgaatcttcgaagctaactggagacgaggtggcggacaggttctttttcttgcgatgaggcgaagcttgggtgttggcggcggcgtttctcctttaagttcagctaattccttctgtagacggtacaccttgctctccaacttgcaaatcttgcctcgattccagttttccctgtcatgagctgctttgtctcgctccacacttactgcatccatagcactaagcatatgcaccgcatgcatcagagtggcactctcttcaccatcaggacaggtataggttccatagtcttgaccatgaggcttgtgaggatgatactggaaagctgatgaatccaactcttcttcaaagtgttgacgcaactctccaatggccaccaaagctgcttcttgacaagcatggctatacgatcttcctccagcttcgaacttaatggacggaaggtcttcacgatcactagccaatgtcacacgaacacgacacttctcctcgttggggtcatgggaaatccggcgatcctcaggagcaacttcatagcctacctcaaaagccatcaacctcagctccctgacgaatcctaacaccttgatcaaatttctcggtgaatggggcggcatctaaagaaacatagaagagaggaattaatgcatatttttttttaagttagctgcaccatctagacttaactgatttgaccaaagaggaagaaaaaataaaagaaaagacacatactaagctattatatatatatatatttagaatttaactttttggacagagacaaataatttttttttttgacaaataactaaaataaaactaaaatacttatgatctattataagcacggtacagtgtcaccataagaaggatgagtagtactagtgctatcatgattgtatcgataccataatagatgtacagtgctgactaatcaatgaagtttactaaggcggaataagaaacattttgagaagaaaatttttttttcttttaaaagaaaagaaaatgaattaaattaattttgtgcataaccttgcatgtgcggccaacttaattaatttgtaagagaatagagaagagcagttctaatttttttcaaaatattttgaaggctacttaaggtttaccatttggcttatcctaaggtcaaggtggctctgataccaacttgtcacgcccggaatttctatccaaaattccaaacgcttacatgtgtgttaaaccctcgtccaggaatcaaccgaggcacacaataacaaattgataatagagtacaagtaaataactatttaatactcgcaaacaataaaatattacagaggtagatagttcctctcaaagaataaccttctacgcagcggaaaaataagactataacaaactacggaagagctatggcgactccactccacaggcaacttaaccagaacaagcctaatcctccagatcatcaccttcactgagatactcctcttctgatgattgaatattgcaagaatgagcatatgacatactcaacaagtcacacagcaaatatgcaagtgcacaagataacaaaggatggcataatatagctcatttgtagaaacagcatttaataaatatttaagagaatggtaaaaacagttgaataattaatcagtattaaataacaccatacaacacacccatgttgcatagggccaacctcatatgaacaaccaaccccggttgtacaaatctaacctccataccaggaatataccattccaaaccaggagtcaaattgattatcacaattaccattaatgaataacatgggactaatcacgaaaaacattgctcaactcacccataaccgcgggtacgcctattcgaatagattaaactctgatcagaggtgtaccactgtacccacaagacacattcccacaacatgttaccatgcgccttagtaccaccacgatacctcggaaaggaactgtgacaataccccttgcataacacaactcaccacagtgcaccgtacctggatcataatcaccctctacaaccagaggcatggactccccagcgacccccacggacttctcgccgcttctcagtctggcactccataatgaatcatgctatacaaaaggtaaagccgttgcccacgctggcttgtggttggcacggtaaaagtttcacaacagtagctcgcgaaccggtccttaattgtcatgagcacaaccatcaaaaccatatgctcacaacccaccttaaccaggttttaattatcaattaattaacatcacacgatcacccatcgtgagctaccatttaatgtaaccataattaaaataataatgtaacatagtctataattaatccctttagttagctaatgtttctaagcacggctaagcaaacttacatatagcatttagctgaaccaatccaacatataaggttcatgttaatcaaattataacccataggaaaataagatcatcttcggccgttaattaattgggaaggttcaccacccgatgacattcgaaaacaatgcatagttgaaataaaataatagctttaaacgggtttaacatgctcaaagagttgtttgggatctgtgtgacttgccttgggcttccgcaaacgcttcggaaccttcctcaacggaaatgctctcctccggaacgtcgaaaactaaagcaattaaacaaaaatcaacaaaacagtacaaaaacaagcataaacagtacatgtggatatttttaacatgtagatcttgattttagaaaaatttagcaacttgaaccacctgaaacggatctacgattatttagttatgattttccgaagatttaatctattagaaaaaaaaagaaaaagggaaagatgatgatgtcatgatgacgtcatcaatggcggccttggctcgggcggcacgaccaccggcgctacggaccttggtcgggcgaaaagagggcacctacgcgtagagggcaacaagacgaacgcaacggtactcaccaatgcgcccaacgacgaccgatggtggccggcgacgagaggaggcggcgcggcggttcggtcgacggcggcgacgggtctccggcgaccggcgacagcggggagagggcggccgaggttcctcacctccgtgcgcacctaacggcggcgagaggaagcggcggcgacggcgaaatcgatggcgcggcgcggctggagatcgccggcggcgacggcgagacaaggcggcgtcggcggcgagctacggggcacgggagaggacgggaataggggcaaacgaaagaggagaactagggggtcctatttatagccttggattgaagagatcagactccaaacgagaggaatcgaaaccggaaaatcttcgggttagtttgcagagataaaatcaaaacgagtttgattcggacaagatacacaaccatttgctccgattcttgaggggaaagatagaggaagatgtggggataaaaacccccctaacaatcggactcgattgcgacagagggcggcggtatcgatggtgcaaacggcggctcggacggctcggcctggcaatcggccggctggaggaggaagatgggtccgacatgtgggccccacatgtcggtgacccgaggaggaggggcgggcggcgtcggctgggccggcttgggccggttcggccgcgcggaagagagaggaatgttgggccgaattcggcccaacggcttagggaggggtttttgaacttttttgaataaaaataatttgtgaattgttgtttcaattattaaaaatacttcccttgctcaaacaattcccagaaaaatctagaaaatagaggaacaagtaaagtatttaataaaattttatctagctcatttttatgttgaaaattttcctagataattagggtttaacttgtaggcttttaaaataatttctaaaaatgatttaaacaatgtatttttacattagacgatttttagggcgtgaacaagctcaaggctagatatgtgccatcctctaatagctaatcattcactcgaacctatgatagattatataatttgtgatagactccttgtcacgcccggaatttctatccaaaattccaaacgcttacatgtgtattaaaccctcgtccaggaatcaaccgaggcacacaatgacaatttgataatagagtacaaataaataactatttaatactcgcaaaaataaaagattacagaggtagatagttcctctcaaagaataacattctacgcagcggaaaaataaaacgataacaaactacggaacagctatggcgactccactccacaggcatcttaaccaagaacaagctcaatcctccagatcatcaccttcactgaaaaactcctcttctgatgaatgaatattgcaagaatgagcatatgacatactcaacaagccacacagcaaatatgcaagtgcacaggataacaaaggatggcataatatagctcatttgcagaaacagcatttaataaatatttaagagaatagtaaaaacagttgaatatttaatcaatattaaataaacaccatacaacacacccatgttgcacaggcccaaccacatttgaacaaccaaccccagttgaacaaattaaacctccaaaccaggaattatccattccaaaccaggagtcaaattaattatcacattattaacattgatgagtagtgtgagactaatcacgaaaaacattgctcaactcacccataaccgcgggtacggctattcgaatagtttaagctctgatcagaggtgtaccactgtacccacaagacacaaccccacatgatgtcaccatgtgcctcaataccaccacggtacctcggaaaggagttgtgacaataccccttgcacaacataacccattacagcgcacctttcctggatcataatcacccccttataaacaaggcctggactccccagcgacccccgtggacttctcgccacttctcagtctggcgcactataatgaatcacgctatacaaaagataaagccgttgcccacgctggcttgtggctggcacgataaatgtttcacaacagtagctcgcgaaccggtccttaattgtcatgagcacaaccatcaaaaccatatgctcacaacccaccttaaccaggttttaattatcaattaattaacctcacacgattaaccatcgtgagctaccatttaatataaccatcattaataaaaatataacatagtttataattaatccctttagttagctaatgtttctaagcatggctaagcaaacatatatatagcatttagctggaccaatctaatatataaggttcatgctaatcaaattataacccataggaaaataaagtcatcttcggccaacaattaactgggaaaggttcaccacccaatgacattcgaaaataatgcataagttgaaataaaataatagctttaaatgggttcaacatgctcaaagggttgtttgggatctgtgtgacttgccttgggcttccgcaaatgcttcggaaccttcctcaatggaaacgctctcctccggaacgacggaaactaaagcaattaaacaaaaatcaacaaaacagtacaaaaacaagcataaacagtacatgtggatatttttaacatgtagattttgattttagaaaaatttagcaacttgaaccacctaaaacggatctacggttatttagttatgattttccgaagttttaatctattagaaaattggaaaaaagaaaagaaaaggagatgatgacgtcatgctgacgtcaccccacggcagccggctagggtttgcgacctcgccggagctagggcgatcggccgggcaattggagggcacctacgcgtagaggacgacgaggcgaacccaacggtactcaccacaacgacaaacgacgaacgatgacggccggcgacgagaggaaggcggcggcggctcgggttggacggcgacggcgagctacggcggtcggcggcgaaggggaaggggcggccaaggttcctctcaccacggcgcacctaacggcggcggcggcagacggcggcgacggcggaggcggcagcgcgacgcgaccgaagacggccggcggcggcggcgaacttaatgcgcgcggcggcggctctacgatgcacgagagaggacggaagagggggcaaacgaaagggggcgatgagatggtcctatatataaccttggattgaagagatcgaacttgtcacgcccggaaattcactagtaatttccgaactaatttgtgtataaaatcctcgtccaggaatcagccgaggtacacaaactgacaatttaatatacaaatccatcataataacgttacatacttacaaagaaaagaaaacagcagcggaattaacggtctagcgatggcttcagctccactcccacaggcagctcaactggggtataagccaaacgtcttctccttccggatcctttatcttcaactgaggtttgatgattattgcaagaatgagcatatgacatactcaacaagccacacagcaaatatgcaagtgcacaaggattccaaaggatggcataatataggctcatttgcaaaagcagcatttagcaaagatttaagataagtaaaacagtagagtaattaatcaccaattttaatcaacactgaacagcacacccatgctgctcaggcccaaccaaacctgaacaaccaaccccggtcatacagatcaaacctccaaaccaggaattatccattccaaaccaggagtcaaattaattatcacattattaatattgatgagtagtgtgagactaatcacgaaaaacattgctcaactcgcccataaccgcgggcacggctattcgaatagttttactctggccagaggtgtaccactgtacccacaagacacgattccacacatgttgccatgccccgaaataccaccacggcattgcaaagggggaaatcgtgacaataccctttgcacaacacaactcaaaacagtgcaccgtacctggatcataatcacccccttataaacaaggcatggactccccagcgatccccatggatgtcacgtcctgataaattcatcccgaaaataaaaatcattctctaaaaggaataatagaattaattaaaattcgaaaagaaattggcaaacactaaaatacgtgcaagaaaaattcaaatgtggcccggagaatttttgttaaattctccttggtctaaaaataagccctcaaattttacttgaattttcagagcaccggaaatatttattaaacaacaacatttatcaaagttcaataaaaagaaaacctaaaaatccctcctcttcctcctttgggccaagcccagcccgaagtccttccctcctccctctctttctctccctctccttctctccctcctcttgggcctcctcccctctcggcccagctccctttcccccctctctctcccgggctgcctctttccccccccctccttcccggcctgcctcggcccagccgcccggcccaagccgcctcccccttccccccccctcctgggccggccgcccggcccaacccgagcggcgccctcccgcccgagcgcgcacgtgcgcgcgctgaccgcgcgccccgcgtggggcccacgcgtcaggccgccgtcgccttcttcctccagccgccgcccggcttccctctccccgtgcgaaccctagctcactccctcctccaaatccgcttgattcgcttggttaattccaaaattaaataggggaaattaatccccattgactcctcttcatttccccctaatttcccctttgaatgccgcccccaatcgccgggaacggccgcgccaagtccggccgccttccattgccgccggccggcttttccgccgccgttccgacctcccccgtggccggctccctcttctctcatataaaatagaaccccctctttacgttctaccgttttagcctcttcccgagctctcccgtggtctctagccacctccccaccgtcgccctctctctcccacgttgccggccggcctccagccgcctctcccgcctcgccggagcgtcgtccggccgcgccgtcgcctcctccagcgtcgccgccacctcctccaccccggcttgccctccgtttcgcgaggtgacccccggagctgcctccccgccgtcgcccttctcgtttctccgcgccggccgcctccagtcgcctctcccgcctcgcccgtgcgccgtccggtcacgccgtcttctccctcggcctcgcagccacctcctctccctcggtcagccctctgtttcgcggggaaaacaccggagacgcgtcctcgccggcgtccagtggcgtcgccaccacttctccgcctccggccgcctctgccgcgtccccggtgcgccggccgacgtcgccaccacctctcccggcaccggagtgccgtcctctctcccggccaggccacggcgtcgcccgaatttcgccggaacgccgtcatctccgcgccggcctctccttcctcctcgtcggctcgtcgccccgctgcaccaccaccttcaccaacatcgcagcggcgtgttccacgccatcccctcctccgctcagccgctgctgcctgccatcatcgtcatcgtcgtctccgttcgtcctcgccgatcgacgtcccatcggttgcccggctcgtcgtctcgcggcgccgcctccgtcatcgtcatcgtagcggcgtgttccacgtcgtcctcgtccccgtgcagctgctgctggctgcccctcgtcgccccctcgccggtcccggtcgtcgtcgtcgtcgtcgtcctctcgtcgttcccggtcgtcgtggcgttcgtccctccgtctagccgttctcgtccgtcgtccgcgttcgtcaagcgagccgctgcagccccgtcctcgtctccgtgctcggctccgcgtcgtcaagcctcgtgccggccgcgtctcgcctttgtccaaggatcgccgccgaagtcgttccctcgccgttcgcctccgtcgtccccgagctgtcctcgccggtcccgttcgtcgttgtcgttcccacgcctcgtcgcgtggtggtaaggatccgtcctctcgcttccccgccctcgtccttccggtgtcgccccgtacccgttgtgcggtcgtcgaccccggtacccgtgtaccggtgtcggtagtcgttcacgtgtgcgggtggcgaccgtgtagtgtccgtgttagtgtgcccgctcggtagccgcgtggtttccacgtgtgcaacccgtgtggtgtctagtggagtccgtttgtcggccactcgcctcggttgacacacggggtccgcttccgtcgacccgtggaccgtctctgtgtacccggtctaccgtggtcctttaggttgacatgtggggtccgcatgtcaacggcgcagccttcctgtcttttccaggctagcgcttacacatgttttataattgcaaagcttaattataataattcgcaaatctccatataacagcattaaacttcggatgatcatatcctggtcatacgagctccgaatcgacccgttcaagtctcttaatgtttgttataacctaaagaaccctgtgctttgtttttatgtattgttattgcttctttataggcttgtagctttgtttgtgtgcttcgcgtagcttctgtcgttccggaggttcccgaagcgtggttcgtggtcgtcgccgaaggttcggaaggccgttctctctgagcaaggcaagtcacatcatccttgaacatattgaatcccagtttgtaaaattatgttgatttaaattattgcattaccgctttatttaaattcccgcgttatcactgttttatctagccatgcctatttacctttgttatgaccttattattgctattgttattattaccttgttcaccctagagtaaacaaaacctcaactagtggacactctactcgtggtatccctagtttaaatttaggtagatgcttcgcaatttaataggacaacattagttagattttataactttagactttgggaatttctcatatcatttggacactatggaattgttggattatggtggaattggacatacacctctcttcctctttcaaaacccctaaagcctgttttcggtggggtttgggtgcatgccagttatgggaagtagcaccccggccactataaggattaagctcgggcctctgttgcaaagcactaccgtactaaccacatgtctaatgggtaaggcttaactcggtgctcagtctagtcctgaacaaaaggacacggattggagatggatgaagtcgggtgtcgatggacattctccagggcaaatgaaggctacacgagctgcggcccggtagtcgagatgtcgtatggcagagggttggtgccctgctgctaggggctcagttctgcctgcctgtcccgggtatcccggccgtaggtgggattgggtcggtacttttgttcacggctaggatgggtgaagggttatgtcacatctttacgacgggttccaaggccatggaatgcggagtaaagatgtgtcttgtgggtaaagatgtacacctctgatcagagtaaatctattcgaatagccgagccctcggatatgggcaagcctagcaatgtacccaagtcagtgttttaattcttaaaatttgctcaacaactaaaatatggaatggttggcctgggttggcttgggacgagctgggacccagggtcgggttgccagttcggtccgaatcatcgtaggccttgggttaaggcaggttcgtgagggttcacggccttgattaataatactgtgtagctctaggatcgtctttacaaaatggctttgggcaactaagtggcttttaaatgctgtttactgcaaaacttaacctctatattattatccccttgtactcctttgcattaattgtgcatccccggtgtggcttgctgagtactgtggttgtactcattcttgctcaatctttcccctcttcagtaagagaagctttggagaagaagtcttaggtggagtcctggcttataccccagttgagcgcctgtgaagatggagccgtaggcccgctagtccgctgctgtttatttttgattgtcaggccttaagtgcctttgtaataatgtaaatattatcgatataataaagatgtgtcttttatatcatgtttgtgtggtgtaccccggcttttcctgggacggggattaatacactagcgttcgggaaaaggcaattttcccggtcgcgacaatggacttctcgccacttctcagtctggcgcactataatgaatcatgctatacaaaggataaagccgttgcccacgctggcttgtggttggcacgataaatgtttcacaacagtagctcgcgaaccggtccttaattgccatgagcacgaccttcaaaaccatgtgctcacaacccaccattaatcatattttaattaccaattaattatcataacacgattaaccatcgtgagctaccattaaatataaccataataataatgtagtatatatgattcatcccattagtgagctaatgtttctaaacatggctaagcaattatatatatataacatttagctgaaccaaaccaatacataaggttcaagctaatcaatttattacccaaggtatcaaggaatagagcattcaatgcaaattggccataacaaaggaaaaggttcacaccacccggtgacattcaaaaataaatgcacagttgaaataaatagagaatttaaatataggatcaacatgctcaaaggattgtgtttaggatctgtgtgacttgccttgcaataatcgatcttcaattaatcttcttgatcacttccgacgcactcacgaaccttcgcaacgacggaaacgacaagctaacacgcaaaacgaagaaaaagactaataaaaaaccaaataaacagtacataaaaagtaaacaaacatgtagatcataattttagatgaattatgagacttgaacggcctcattctgacttcaaatgaatttattatgaattttacaagattaaatctaattaaagcccatttaaaaagaattaataaatttaattcaatttatggacaattttaatatgtagatctttattttagaaaaatttagcaacttgaactacattaaactgagttacgatgatttagttatgattttccgaagatttaatctattaaaagaaaaggaaaaagatgagatgatgacgtcagcatgacgtcatccatggccggcggctcggattggcgacctcgccggagctagatggtcggccggggatttggagggcacctacgcatagaggacgacgagatgaacccaacggtactcaccacgacgacaaacgacgaacgacgacggccggcgacgagaagggcgacggcggcggctcggttgaacggcgacggcgagctccggtggccggcggcaaagaaggacgggcggccgagcttctccaccccttggcgcacctcttggcgatggcggcaagcggcggcgacgacggaggcggcggcgcgacgacgccgaagatggccggcggcggcggcgagctagacgcgcgtggcgcggcggctaggaggcacgggagaccacgggagagagagcaaatgaaagaggggacgaggggatgctatatatagccttggattgaagagatcgaactccaaacgagaggaatcgactcgggaaa

SEQ ID NO: 59739 - DNA, 1496 bp, Oryza sativa
  unsure (1)..(1496): unsure at all n locations
ggagaagagaagagttgggtcgaattcggcccaacggcttaaaggaggggtttttgaactttttcaataaaaacaatttgtgaaatgttgtttcatttattaaaaatacttcccttgctcaaataattcccagaaaaatctagaaaatagaggagcaagcatagtatttaataaaattttatctagctcatttttatattgaaaattttcctagaaaattagggtttagcttgtaggtttttaaaataatttctaaaaaattccaattaaacaacaatttatatatttaggattttaaacaagaaaaactcttaacaattatagttagatcatttaatgatcaaataattactaaactgttctttgtatcatttaggaattgagctccgaaaaatccgagaaaattccagagagtataattaaccatggagaatttaataaaaattaaatccatccatgctttatatttaggaaattttatttcccacatttaacttcacttgtaaattaatgaacatttaatataaattctattaataatttactaaattctttataaatcttgaaacgaaaatcaggctgtgacagaactccaaacgagaggaatcgactcgggaaaaatccaaactcggttttagggataaaatcgaaacgaactcgattcggaaaaaatcctcaacgatttgcttcgaaacttgggaaaagatagaggagaacgtgaggaacaaaacccctcaaaaacccgaaagaatcggggtcggattggagcagaaacggaggcggaaaagggcggctcgggcttgctagggcggccggccggaggtaggggatggatccgacaggtgggccccacctgtcggtctcctgagaggagggcacgggcggctcggctgggccggcttgggccgcgcgggagagagagaatgttgggccgaattcggcccaacggctaaggaaggggatttttgaacttttttgaataaaaacaatttgtgaaatgttgtttcatttattaaaaatacttcccttgctcaaataattcccagaaaaatctagaaaatagaggagcaagcatagtatttaataaaattttatctagctcatttttatgttgaaaattttcctagaaaattagagtttagcttgtaggcttttaaaataatttctaaaaattccaattaaacaacagtttatacatttaggatttttagggcgtgacaaacctaccccccttaaacggaatctcgtcctcgagattcagaagaactggcgaacagatgaggatgagctgacttcaattcatcttctcgctcccaagtggcttcttctttgaatgattgctccatnnncccnngcagaacgtataacgcgattcctggtattcctctcgcttacttccaaaattctgacgggcttctcaacataagttaaatcttcttgaagctctatacgatcaggatctgcttctccgtaggtacacgtaaacatttcttcaa

SEQ ID NO: 59740 - DNA, 19725 bp, Oryza sativa
aactgaaacctgaaagtatacccttctttagtaatgaaaaaaacacagttaaaccatatctaatatccaaagaaaaccacgcaatagaaaacagaaaaaaaaaaagggcacactatcttaacagattttttgtttaatctacattggttaaggaccaagtaaaaatcttttcaaaataatgttgttgattcagaagtgcttacgataattgatgatctgtgtgaaatctatgttccagtgtacttgaacaggtagaggaagtaggctgttacctgtaataagtatgttagatatgatagcatatactgttgctaatactttgtcataaaatttatctgggtcatgattgtctagagttgttgagtgtaggggctgcaaccataggggttcacggatgttatgggtattgtaggttcataaaccccactgcctgtgatggatttagttggttcttttaccaatatttatcagttatggatcatcatcacttaagtagaaataggcattttattatttgcaaaagttaagtgtcatcataactttctcatgctgtgatcttccaacagattgatccttcagaaaagcttgatcctgaagttgaagatgttcttattgacattgcagaagattttgttgaatctgtaagccccttccctccaccatcattgctgttctccaatagtttctttttgcaagtatgcttattacggggatgtgttctctggttcttcttgtgtgaggaaatagtaaacactgcctaatggttgctagaggcctagaagctctgggtcgaagttatgctgtctttagatatagaagaaagttgtcaccctttaatcatcagcaacatgtgaatttgtcatcctggtgtatctaggatgtcttctgtaccttttttttaattagctgttttgagcaggttgcaacatttgcttgttctttagcaaaacatagaaagtcaagcattttagaagcaaaagatgtactcctccatgcaggtaacttgaatatttttgttcttctagaatctttgtggtgatgctatcaagtcatagcatttcaaattttcaattgcatttttcatatgatttaattgtcatccattgcagagagaagctggaatattaccttgccaggcttcagtggagatgaaataaaactgtacaagaagccggtaattcatacatttgcatacttatttcttcgcttttgattgcttgctatgaattctcacaattgtttgtaactgtaataatcttttcctttacaatttgcagcatgtcaatgatattcacagggagaggcttactctggtaactgttcttcccatcttatatcttggaaacatattgttttgattccctctattcaaagtagtacaaactgtgaattgacaaatatcctaatctattctcaatgctgtttcaaaattaacctattgatggtcatttctcatcaccaaatacagcgttctgccgatacgtccatttgattgttgtctttgcttgcggtgtgatatgttattgttttgtctgaacctgtccagatcaagaagtcaatggccagcgaaagtaacgcaaagggctctgctgcgcaagctgcagctaaccagaaaaatcagacacccaagccacctgccacaggctctccatgaaagaaattcaataggattaccctccaaatcctgagccatcaatgcattgtcatcatattcggtgtttggacgatatgtgctgtagtacatcttcaactaattggcattggcttgttgtattataggactgtacaactgttgggaccgttagtaggactgcaagattacatgtacaaatgctttttctgaagagtagatctattgaaatgctaattcagttattttgggttcagctgcaagttgcaaccgttcagccgtggtaatactcaaaacttgcaatggcatggtgctccaattcaggatttctgcttgagaaattgggaatcacatcgggccccagacgaacagtcattctatagctgatgcctggctatggggcagcggccaacagctgctcaccagtcactcccttggagtggagcgttacttctgtctgaccctatcttgtgtcaactgatctgtcattggctactcattgccgtgaaaccaataatatgtactctgttctgtctaagcccagagaagaaatgccgtttggacttttgcctaaatttgattctctacaaataaccaatattaggattctagccatttgagtcacgtcatcagaaataaatatcttccttgatccgtcctcctcactgcagaacacccatcctgcacgtcgcttttgctctacaaatgctgcaaggtgacccgcatcctcccttgattccatccacgaacgtcgcttaatcaggtgtccatctgtacgactgtaccctcgccgcagtcaagtcatcttcggcgtcaccgcctcaacggtaccgcgtcgcgaggccgtgacgttttcactgatgatgctgcctcgctctcgaccggtcggccacgatggcgatcgctttgttccaaagagacagtacgagggtgcggcccctcgcgaaccaccacccatcgttccccgccaattgtgacttgtgtgaggccgcctcggcgcgcgcggaaaccaccagacctcgtcgtcttccctggctggctacatcgaccgcgggatcaaccctgtccttacctttccctggagagttggagacattatctcgtgcagtcacgtgtcgcgcccgcccccgcgcgcgcgctcacgaatcggtcggaggctggccgtggcgggggcggcattgcgatttgcgagcgaacggctgtcctctcaggctctcaccaaacgaaggccacacagaccgccacgctgattcaggcgtacgatccgcacagggcgaggcaggcagcccgggcccggggccggccggttccggtgcgaggcgcctctcgcggcggtgacaaaggacgggacggagcccgcgcgcgccaaccgtcgcgccccgcgctcgccacgacgagacggcgatgcgcgcggtgaggccgtgatccaaagaaaaccttccggccggccgcccggctgtcggctagtgagacgttgctgttgccactcgcctctgctccgcgcgccacacgtgggtagtagtaatgcgcgcgtttttctcgctgccgctgcgtccatcgtctctctccgctgctgatggcgcgagacgttgtcgtacggcggaacgaggacgaaaggatgatggctcataaactcggcggtggttgttgtggccatctcgtgtcggaggtcggcatccgtccgtcgtagtagcagcgtagcacacgttcggtcgtccgccccagcacaaggaacagtgtagcttgtacggcagcatcacatgaagcccacctctttacacgaggatgaatgagcctcgaaagagtcgaatccatctcgagtttggggcctttgggccagtggtcactcacggcagggggacatcgataccacaccaacattttgttatgtatttgccactataattaatcacgtgttaatgtactgttccatttttcatgtataggagatgggttcccaatactcacccccgaaaacagcctaaagtgtctctctttatggaccacggttagatgtgctcactccgccattgatacctatcaagaaaagcatgcatacaatggacagcagtttaaatccacttgtcaactgggtcgggtcctacactgaactttgaacataaagacagatgcttccagagattatcgcccagccaaccggcaaggccccattgtttattgcctttggacctgagttcattcagacatcgattgtgttacttgaagcaaattgtacgttgattactactttcttcgttccataaaaatttaaagtagttctggatatgatatatcataatactatgaatttagacacatctctatctagattcgttgtactaaaatgtgtcacatctagctttatattcggtttttttattggacggagggagtactaagaggctttcatagtctctagtctcatcttagaatgtgctgttgcgatgctaacattatttttattctttatgatacagctcgttagtttacgccgatttcaactttccatagcttttcatatgccgtgcaatggaagaagtatgatggaaaaaatgttaagttaaactttttaaaagcttaaccattttataaaaaaatatatagcaacactatagcataaaattagtttcattacgtctaatgttgaacaattttttatattttttattgtgcattgaaaatattgttatattttctataaattaaattaaacataaaaaattaatttaaaaaagttaaaatgacttatagtatgaaataggggcagtatttgtcaacctcccagtttggtgcttatacgtaaatatgttatactactagaaaaaccgcgtggctttgccacgcatggtacccctttatttgaaaggaaaatataggatttttttattctgtataggaacaatatttttttctatagaaattttttctatatgattttttgaaccaaaggattattgaaaactattaaatcctatcaaatttctaaggaatgcccaaattcatattagattttgagatttttaccatgaggtctgacggagcgtggggctcctcaccgggagaccgcgcaggcccccctttgccggttcggccgggggccctgggtgaggttctaagctcctagtctgtggaaagttcgcgagattggaaaaagcacaagacacgggcgatgtatacaggttcgggccgctgagaagcgtaataccctactcctgtgttttggtggatctatgtatgaagaagctacaaaagagctggagaaccagagagctcttaccctctccctctctgatcgttctggatcccaaaaaaaaatcatcccctttctaagtgggcaaggtcctccttttatacctcaaggggataccacatgcaccatctctctcttttttgtggggacttatcctatcttttcataaacagacggagacttgtatggttgccgtccgaatgaccttctgatgggacggcccatacctacctccacttccgccggaagcaggcgcgacgtgggaacatggctgtctgctgacgacatgaccagtgtcagaccggtcacaaatcggtcattcttgtccaccacgtgtcagttcatcaatctgcatgtttgcccctcttcatacaatgtcttgcttgtaatggttaggatgaagcctggtatatatctgaccgggaccaacgtgccatctccaggagctaacacgccggctccggctagggacgagtgcttggaggctctcatcctgacgggatggggcgaggcgtgcgtcaaaccgcctgtcgccacctaacccacgatctgatcggtctgtgactggtcactgaccggataaacgagcgcgctgcactgcgttacatgcggcgtgacgcgctcgtccaaaccgcaataaatgtggttaggtgagccccgctatgctcacctaccccatatacgcgcgcaaaacccacaaggggtcggggtgcctcggccctcggggccgagacgggagcggtccgacccctcggggagacaaagggaagggcggccgtatcaccctcgggcccgaccccccccccccccgagggggttaggccacgtgggtgatcgtgtctgcctcaagtctctaagtcatgatactcccggtcccatgtcaccgacaaggtctaatatcataaaaagtctctcatgagtttatctctctcatcctatgtaatcaacttcatgtaatctgaatgccccatccatctcaagtgctctatctctctctttctttttttcttccaacatacaagtcctatactcctatgcaatccgaatgcccttaactttcttatttctttatttatcattcctatttcgatacattttctatctatgtttttcctatccaataatccgaacaagccctgaaaatggttgggatgaatagccccttttttttcttatgcttaagcttatgtcaaattttgtattttaaaacttaattttaaagttgattttgtgctttgtttttcatcgaagtttatattgtagcatttgcttttgtattttttttaattagtgataagcggttgagcatatacgtagatgaaaagatagtgccagaagtgatgtcaggctgttcgtaatggtctcagcgcattctctcccacaacttttttttagggggggcatttgcaaatttgccattgtttttttcaatttggtaaggatgccactcgaatgacagttctagtggtatttttgtaattttctagtggcagtcttacaataacgatttaaaatagtgataaatttgccattgcctcttttttttttctagttcatgcatcgatcaacatgcatcgggtatttgcatgcatacataatatctcgtttcacctagtgtgttcttgtcatcttgtgccatcacatagcccgctgagccatgacctatgtacctaaatcatctactaattgcttgattgatactccagaaaattttggacgcccgttgcacgcacgcacacgagcatttccggattgctgcacgcgcgctagcaagatcgagcctgttccacgaaataggtgttgccatgtggcataattttccttgcgatttcttgcatggaattcgtattataagattatgccattagctgaaccagtcattaccattctggtagtacacgttccgagtctgactacctaaatgcccctgactgttgcagcgtgatgaagcaaagcatataattgcattcagatttcagagcgaagagaagtaaacatcgattgaatgcggatggtccgtgacccagccttgattgcacataagttggtacttatgtagacagaactaacacaattagaccatccaatgagtgaaactaatcatcttgtgggagcacaaatccctgccggggaggccccaatgtccctgttccatgtccaatatggcctttattgtcatgctgtctggtaagatcgatcttaatcgagctaaacattagtcgaggaattaacaatcacatgcacccttctttgatttgcgtatagataggatgatttagcttataaagccaagatgcgccatttcacgtgtggaatagcactccgattcggaccgaaaaagaccgaaggaattcgacggtaaacatgttagaagatagtaaaatgcaggtatctacgtcaagaaaatgttcctaaaacagtttatgacggatctagaaccaatcttccacagtgtagtttatggctggtttttgcctctagtttatgagcacagtggtttcatggtatcatcagtcatcacgtcccacccaatggaactgttcaaccacgtccaatgatgcagtggacagttctttccacacctaacttataacttgtttattttttacatgtgacctataagccacgttaaatgttaaattttgatttttagaacttaatttaaaattaattcagcgtgttttttttctttttttcatcacacgcttttatacaattgtttttttattggtcatgtatcttcggcttataagccgtagcctaatacttaataaatgattttttttttgcgataggacttaataaatgacttctaagcaggccccagacgtccatgtgtgagttcatgtgcaggaatagccccctaggcgagagtacaagacttcttttcataagatggctcagttcttgctgccatttctttatcagattatcatgcctgacgtggtatagaatacctaaacggctgggcaccttttaaggccgtgtttagttctaaaatttttcttcaaactttcaacttttctatcacatcaaaactttcctacacacacaaacttctaacttttccatcacatcgttttaatttcaaccgaacttccaattttagtgtgaactaaactaagcctaagttgtgaaactgagaggcacgggcagcagtagcactcaactggagatctgtctcactgttctcgtagtactcatagttcctaccatgtgagatcagatacaactatggctgtgtttagttccacgttaaaattgaaagtttgactaaaattgaaagtttaaagaaaaaagttaaaaatttatgtgtgtaggaaagttttgatgtgatggaaaagttgaaagtttgaagaaaaagttgggaattaaacaagcactatacaatgtgtttttgccaatgctacatgatgtatgcccacctttactctctctctctctcagcctcggttatctcgatatatttgcatgaatcttgaatcaaaacccttattgtatatatatacatcttagaccaaatataaatatgtcatagtacaatactatgtttacgtaaaaacaccaatcaaatatactaagaccgaaggagcaaggatatcaaagataaaaaaatggtggtccagggcttgaggctgcatggttgcatgggcttaaatttatttaaaggaaccacacaagacaatacaatgtttaaatagtgcatgtaaaaattacaagactactactctgaaaagaaaaaaaaacacaatactgtcaccatgcaccgacagcacctacacacaaccaagaaaaaggtctagcacaggatcggccaccgctagactaacaaaggagcaacaattgtgccacgcgcctagcaccactccctaaaaatcgagcacctagcctcttgaacatcaccaagacgaaaggttgtagaaggagagggtaagaaatatccctctccctcgcacagacctgcgacctgccaccatctaagggcttcgcaccaactgtttgaaaagcatatgaggcagtaaaggggcctcctagacgacacctccaatgacagacgcaacatagggagtgtcattgtcgtccgtccagatcttcaagctagaggatcatgacaaaggtttttactatgaagtccaatcaggtagggagggaggcgtctcgacaatgcccttaagagggaacacgtcgccaagagacatcatccttgtcggctcaacgaccaggcaatgctttcacctgccgtattgggtttagattaagcacacaactgtggaaaatctcacctgccgtatctcacgagttatatctaatcaaatttgaataattgagtaaattttacaaaaccatacgttctgggacattcgtaacaaaaaccccagattttgcaacttgtttcaaagaacctaagttttagtgcaaaatgcttcataaaaccccatattaatgcatatatcttttgtttggcaattatacttatggataatacatgtatataaaaataatgtcatatttttaagtagatacatatattagttactttctcaataaacgtcaattaccaattacatattgttgggtctatgtactccattcacgtgatgctgatacagtaaattgggggagttaggaagtaaaaagaataaatggtatagaaatatgtattctcggcctatatgcttgaaaatattggatattataatgaaattggagtattttgtacaagtatgaggtttgtggaacactttgccctaaaatttgtggtttcttgaaataaattttacacacggagctttgtgatatagatgtttaaaaccaattggttttataaatacacctaataactagatctatctagaacagcaagggaaccatcaagcggcattatttcgcattagttctgtatgagcttttatgtcaaacatcttttatgtaaacacatcttaaaatgttacggaaaatgaaaaaaatgttctcgataatatcttttgtgctctccaaaacatcacatagtgggtcatactccctccgtccctaaatatttgacgctattgacttttttaaacatgtttgaccattcgtcttattcaaaaacttttgtaaaatatatgaaactataagtatacataaaagtataattagcaatgaatcaaatggtaggaaaagaattaataatcatttaaattttttggataagatgaacgatcaaatatgtttaaaaaaatcaacggtgtcaaatatttagggatggagggagtatcaagaaaaccatgccaagtaggagtaccaaacaaagccatgtgtcaccatttggtgatgagaatttcaagccctgaccgatcgccatcacgagggggagagcaggttttcaccctctttcgttttgtctgatgtgcctatcacggttcaaatcattcgttttcttgttataattatcgtgcttacagcaacgcttgtcctcttgtgtcatgcttgcaggcggatgattaaagtatgacgtggcttggttattcttatgctaattataggtgtgatattaaaaaaaacacttattcttcagggcagtgtaggtgttgtactgcagtgcaatattgtaagagaaaacaattaaggtatagccattgtccagtccaaagtttctgcctgccaggaatactaaaatctagaatcatcaaccgtctgaatctttcatatattctactgaaaaggaactggagagaaaaacaaaataacgtcatcttgcagtactacatccctctgttatatatattttagaactctgtttgtttagcttgttttgattgtttagctggtgcatatctacctaaatgacacgtgctagcaatcatggttctatgattgtttgtgctatatatggctaataattaagttgtggaaaatgactagagcaacaaaaataatttataagtattttttatatatttttgttattagtgatttacatgtcaataacaaaagaataggctacaatggaagaaaaatatcaaaatactctaaaagttcaaaaaaaaattatggatgataaaccaacaagcagacgatgaaaggtgactgcttgagttgcggcttatagagcttaattttagaaaaaaaaattggtattttctatttgattacctttattttttaattgcccaaagtataagtatacaaaaatattttctgttgctcccgttattattttgaacttatccgtaacctaaaaatgccatccaagctgttccaaaattttgatagcaaacaaaataatcagagagaaaagaagtggtccactgatctatcatccctggagacttttctaaatgacattttatttgtgaaatttgataccatggaggcccctcttaaccatgctttactttagttagctacattgagctttacaccaagactaccaagttcgaatagaaaggcacaccttgatcacctaccagagggccgaaggcagacctagctacaccataagatggcccctgctttggccgttcttcttcaagcaacgtgtacacgacacaaaggaaaagaaatagattttgagtgcggcatttaattatcactaaattgatccggcttgctggccatgccgagatctggtgcacatctttcaactctcccatctcacaaatagcaaacagtaagaccggttgttggtgcagtgcccatggtgtagtacgtcctccccagtcaccacgaaaagaccccgaaatcatttggtttacggaaagatatcggtgtaaaaaaacgcaacaggacaagaaaggtcaccattaatcgaatgcttctggacgttagaaaagaaaaatatatagcgtttggaggataagcgagcgagggagagaaagtgagcacgagcgacaaaagagcgtagatcctagatggcgtataaacacaatcatagtgtttatttttgtaggtcctgcaagtgggcgatcgacgacgtgtgatctccgcccgtggtgttgacaaatccgaattgcactcgtgccacacctccgtgatggtgccatctgtgctaccgtcttctcttctctttgtctcgatatgtactgtcgtcgtttctatggatacatatacgccggtcgtgttctgcgtcaagtcattgcaagctagctaccacgatcgggagctgtaattgtgtaattgtgtacgtgttttgatgcgcataccgctgcgcgcgaccgatccgtgcgtggattaattggccgaggcgagcgcggcggttgcgctcgttttcctgaagtgtgtcaactgtcacgtgccggcgaacccgtgccttctagacgtgccggccgcgcgtcggctgcacgtccctgtcaggcacacacacacacacaatcagagcagcggcgcgcgcgcggtatccatccctgtcgccttgccgagccgcgccatctgggaggatcggatcggttgccatgcggcgtacgtccctcgctgctcgcttcgatcgattaccggcgccgcggggcattgccttgccgccggtccgcgcgcgtctcgttgcgttgtgtgggcactgcacaggttgactccgagcggtcgcgaatggccgtaaacctcgcgcgcgaggcgatcaactcaaccggagcggagccccgcgcgcggcagggccatgcgtgcgcgcgtgcagcggttggcgcgtttgtccgtatcgtttaacggttggtggccggaggtggggggaccccgggcgcggtcgaaaggaagcggatggatgggcgggccacggggggaattggcagcgcaaccgcagcgtgccggaatcgtggcgatgtcagggtcaaggcgcccccggtgcccgaaacggggaaaagagacgagtcgtcgactgtcgtgtcggcaaacacctgcatgccgccggtctagggctaacagacaggtgatccggattcgtcctcggcttcatccttccaggttaggcatatcgatatagacggctttttagttctactaaaatttggtaacagcctaatggttacaagagtctcagtagcacatgtggtccttgattcgactccccacaaaagtggattttttagaatttaacggcgttgtgctttcagtggtaagcgacgtaaccgtcgacaacaaggcgcctgtggtgacttcgtcaatctctcaaggatttgccggcctagtcttcgaagatactcataggggtaagttttacgtgcgtgtgtttatagggggtgagtgcgcgtgcgttgtgagtgtctgcgttgtactgtgtaattcttgaaaatgctttagtctggccgaccaatgcgaaggggaaaatcagacggcttgctgaaaatatcaatatcagccaacccactaaatacccaatgctctatctatatggtttctttctcctctctgctgcatactcggtctgcacacagccaaccacttatgtgtagcaatttttttattttttttcttatgatccgattatacattatattacttacaattaaatctttttatcaagatctcacatgattatattctgataaatatatacatatgttgcataaaatatggtctttgtgttatggtcagtttttcaccagtgttacatttgatcgaaacatttttatcaagcagtgaaatattttttatcaagtgataaaacacccaaaacattttttttattgagcgatgaaacatctgattttttttatatgttttgaagcaccattcaatatttcgcaaatatgagatatctgggccgtagtatcctcaggtaattctaataaactaaacatagccattgccactgtactaaaatttgataattccaaaattccaaaccaagcacgtccatcggtaccaaaatttgataacaccaatatttattatatataaaattttgataaggatgattttaacaataaaaaagttaacaattccatagttgtaggtcccaagtctaaatagatgacgtttagcctcctgaaatcatgatattggattaaatattcaaatacgtacactgttcatacaaaatttcaagaatataacaaaattttaagaatatacctttaaagaaatagaaaatatacccatgtcatcactagctgcgatgacatttgcatgacaagctagttgggctttgtagggtcgttagacttatcgccatatggcggcaatgagggtatcaccacttgctgtgacgagacaggtatatttttagaattttctttaaaatatgtattcatgaagatttatgagagaaaaatattttgaaaaaaaaatatgacattgcgctagctacaatatccaacaagaatagacaatcggcgtgcttacaggagtactcagaaaactcaacctcgtactacagcatgacacatcctaatacaacgaatctagatatactttatgttcaaatttgttgtattaaaatgtgtatattctagtattaggttgtatttttttgggacggagggattattagcaaatgacatgagagtctgattggctacaaatcctctcagtcggatcatgtacggagtaacgcctgcggtatgaatattcagagtttcagacaactttaacaccttctagtaaaagtgcaacagttcagatagaaataacctttggaaaagtgcgcccaaagcaacaaatttgcacaaaatcagtacagataatcgggacataaaacgacaaaatgaagggcctatcattgaacagcggtaagaaaaggatatcttccctccttttatctccagtgaccagtaggatagacatccggtccatccggacattggtcgagcacaccaggcctactgctgccaatgttattactatcaggtccctctgcgacaactatttcaaagatgacgggtataacaatctttgtcttaagcggttgacactgacagcgacgtaatatgtacatgtgatctatatagtacatcttcaaggcacagctagaaataatcattgaatggcaacaaggacaagaactatatagaatacaaacggtgggtcctttcgtaattcaatcagatacgtccacagaaggcagaaccacttttgcctgaagaaaaacagaacttaattaattaagattattagaaccactattattcaggaatctaataatacactcaccatgcattgcatgtagtacgcatctcgcaatatagtgtgggatatcggtgccagggcaacacgtgtctacattaactcatctctcttcgccgcaacatatattggcttggctctggtccagcatgatgacagaaatatataagcacagctcaccaaccctgagtagatatcttttagattgataaggtaaccagataaataagtagactaaaaatattcacgaacacgtatatcaccttgcatcattgcgctgtcatgacggcgtcttctagctatcttcggtcatcatgataaaaatttcacataactacgtatgttttttttatcaaactgacagcagactatatttaagcaattatattacaaaacaacagatttagagtttaaatcctactccctccggttttattttaattgatgttttggataatgacacggtctacaagatatatgtttgaccttatttttctattataatatgtataataaacaaatacatgtttacttttattatagtgctttaaaagataaatctatatatattgttctagttcctttaatctaaatatttttaaagttattgatggtcaaagttataaaagtttgaactcaaccttgtccaaaacgtcaattaatatagaaccggagggagtagtattattttgtgaaaattttgttagtaatccttacttttatgacatatcattttaaatctataatttcatgatgtagtttgtaatagtttggtcaaaatatatgtagttttgtgaaatttactttaatatttataaatgtagtgttagtaatcgattttcccaatcctttggtcttggttatgtttaactagactaaaaattataaaatcagatatgctacttcacattcgatacaaaacatgaggtaaaatcttacggactcgtcctgttcttttgtccaacaagagttggatgaatattaagatttttatggtatgctttttaaactgctaaacggtgtgtttcgtgcgaaaactttatatatgaaagttgctctaaaatatcatattaatctatttttcaagtttgtaataattcaaactcaatggagaaaagaacaccacctagtgcgccagtaccttagactacatctctaacgtgttctccatgatctccaacaagcctatatggttaggtttctgtgggttaggtcatggtttgagtggggtgggggagaggggagagggaatgaagaggggaatagttctctggtacttcctccgttcttaaatattttgacgccgttgatttttttaaacatgtttgaccatttgtcttattaaaaaattaagtaattattaattattttttatcatttgattcattattaaatatatatacatatagttttacatatttcataaatttttacatatttcataattttttttaaataagatgaatggtcaaacatgtttaaaaaagtaacagcgttaaatatttaaaaaccgagctagtaatttagagggaagcttagagtggcgaaggtctggcgatgggcaacggagtcggaacgtaatatagttaaattatccatagaagacatatattggacaatattttagtaccaactgaccaacacaagctcacatggcttgctccaactgtacatacgtgtctacaccaccatgcacgttttgggaatcttgttgcgcaggataggataaaatactgaagtgatgaaactattaattagcatgcgacatacctgattagatttaagtatctgatcaagtcaagatatcatatttgtgcactagattcggtgggtcgtcggttgatgacagtgatgttatatatatgaaacttcccatgcatatttagaacgatataactgtttaatttcactgcatctgtctcaaaatatagctaacttttttaatttcaattcaaaattacatctccaaaataatactataattaatgtccccaaattatactattatcgtggggtagctaaataatcgtccgctgcagacatatagcttatgaaattacatttccaactatattgctaacatcctcccgttgttaaatcgtggaccagctaaattcgggttgttttggtggctaaactttgttatacttttgacaaccaaatctgatcaagtgagataaatgtttagggtcttattgattgcccaaaagcttattaattataatcctaacggtttattagtgataaaaaatattttttctgtaaaacttttatatatgtgtttttaacaacttaaaagtcaatgataaaaaagaaactagattaaaaatatcttaaaataaacttcaaagctacttcatccatttcatattacaagccgttttgattttcttctagtcaaacttctttaagtttgatcaaatttgtagaaaaaattagcaacatctacaacatcatattatcactactaaaaaatcgatttttcatggtgtcaacctattttttttctctaacagccatacatgatcaccgtcaatgaaaatactccgagggatgaggggctatggaccgccagtgaaaatggatcttcgctggtagccgcagcgaatatgtacaacttttcgctggcaacccacttaaacagccgtcaacaaaaattcgattttcgttggtggccactagagagcattgctagtgaaaatatcgccacattaaaaaaaatccaccgccacccaacacctcctcctcagctccttttcccaactccccctcttcctctagacccacccagccctcctccctcaccggcgacagctccctctcctcctccctccccaccgtcggtagctcgcgcaagcggtggtggcgaagagaagcacggggggcggggatctggcgcagggaggggtggcggcggcggagataagtgcgggcggcgaagattcgacgccgggagggggcggcgactgaggagagaagtgtgcatgcttattcctcctcctcaagggcgcgtacatgacgacgagcaaggcgtcatcgtcctcttcgcgctcctcgacaagaccggcatcctccctatcgaccatggcatcatctacgcgctgctgcttggcgggctggtgctcgatgtggatgccatcctcatgctcctctcctccaaccagatgatcttcttcttcgacagaaagccaaagctggcgtggcttgtagggtggccaaggccgtgctgctgcggccaaggcgatggttggagtggatggatttttttttcatatttttttgtgatctgtgaatggatatgtgtttaatttgtgatttgtgaatggactagggtgggagaggattttggatttggagtggggtattttggatttgtgtgggggatttttgctggcggttctctttacggacccaccagcaatattttcgtaagtggttaattccagcctatgaaaatactctattttcactaaccttttcttgccagcgattgggctggccgctagctaaaatataaattgtccgccaacaaaaaaagctttttttagtagtgttagttttattagatgcaacgttgaatatattttgatgttatgtttattttgtattgaaaatgttaccatttttatctaaacttgatcaaatataaaaatatctgactagaaaaaaaatcaaaatgacttataatatgaaacaagtgaagttttttaaattttaaattttgctttggcctattctctttaggacaaccaataggccattagcttacagcataactatgtcatgtcacacctttttagccaataaatccatacgtagacatatctttgcagcataaatattactcccccgtcccataatataagcgattttgagtttttgtttgtactgtttgaccactcgtcatattaaaaaagtttgtggcaaaatataaagcccgtaaaaatgtgttgcgtccaagtttttctgaaggttctgtggcaaaatatgatgctgtccaaagagttcctcggagtcggagactacggttaaaatatactgatgtgcaaacaactgtacggtcaactctttagtcatgatatatatccgacgtggacacgagtaaattcctgcagtgcgccctgccgtcgataagctctctcgaccggccagtcggtagttagctcgtgtaggtgcactgtaccacacgtgctgatccgatccttttggttcatttgaactggtactacctcgaccagagagcgaggctatttatctcccctggaatcgtagatcgtcacatagggacgaggacactgaaggctacgtgcactggccactggccaaagcaggaaggtactccctccgtcccataagtgattttgataatttgcttccactgtttaaccacttatcttattaaaaaaattatataaatataaaaaacaagaagttattcttaaaatactttagataataaagtaagtcacaaataaaataaatatgagtaaatttcatcatgggctatattttttttaccagtgtttcatattgggctagggctaagtcaagattttcactttacaccatgtttctttgccaattgccaagagttgcactttggggtagggtatgtttacaacctgggcatgtgtgactgacctcgccgtagatattatgattggattgtgatggcactcaattcaaacaactttttgatgcgcggtgtggcacggtttaggtagagatggctaagcccactcatgacatgacg

SEQ ID NO: 59741 - DNA, 16058 bp, Oryza sativa
tactgacatgtgagagcatctagtccaaagtgaaagcttttggtaaaagaaactagcccaaagtgaaaactttgtctttaggatggtccatgttgaaacttaggtaaaaatacctagaccaatgtgcaatttactcaataaataataattctaattttttaataagacgagtggttaaacagtacaagtaaaatgtaaaaatcccttatattagaaaacggagggagtacgtggtttcaattctctctcttccgttcagttgtgttctctgccgagtgatgctttggagctctctactatcactaaaaataatataaatcgtttgctattaaaggtaaatcggtaatttactaatccatggattagggataactttgttatttataatttttttctagatcgatatatggccattcattctgttgtctctataaaaaaggcaaaaaggaataaaaatattgtcacaattaaataattattatatctatctagacctattttttacaataataccctctacgtttgtagtacggctaactagaataatagtataaatagatctatactcttcgatccaatgagattaatggtttatattgtcttatattgtcttttagagtaaatttcaaagtacatatactttgatcaaattatcacataactacagattaacttgatgtatcacaaaactacacatttaagatgaagtgtcacaaaactacttgtttagtaacacaactacaagtttagaaccaatttagtcacacaacaataatgtttatagctccagcataattttgtgataacttcaatattaaatatatagttttgtgatatttaaccttaaatatgtaattttgtgataaatatggtgttaaatccgtacttttatgatacacattttaaatttgtatttttgtgataatttaatcaaaataccaatagttttatgaaatttacttatttttttattaccaaaagagaacatcctaatggggctcgggggtaaaaacccaccggcgcaggggcgatgcatgtgtccactgcagcgacggaatcatgcagatgaaattatcaagcacatgctccgcctcgccaactgaaacacccccacacgggatggcgggaatcaaacatgggaggaggggaataacaacgtgctgaatgggggcctaccggaacaattgagcggtcaaaacgtccttgcgcgcgcacacggacgtgacacgcgacctctcaatctctcactcatatatacccaacccaccccttatcacgggcgacgagacgtcccgctggtataaaacggccccctcccgggacgccacgatcgtcacaagcaaacgcacgcgcccccgcctatgaaagcccgcgcgcaccacgcacacacgcacgcacgcagtcgcaggcgccgcagctcgtctccatgggtgtcgtcgaggcagaggcgttgcatggggcggtggaggccctggctgggtcgctgcagccgcacgtggccaccgccttcttcgtgttctcggcgtgcacggtggccctcgccgcgctccttgccgtggtgcgcctgcgcccgccgtggtggtgcgactgcaccgtgtgcgaggccttcctgacggcgtcgtgggcgggagagttcgacaacctctgcgactggtacgcccacctgctgcgcacctcgccggcgcagaccgtgcacgtgcacgtcctccgcaacgtgctcaccgccaacccggtcaccgtcgaccacgtgctccgcgcccgcttcgacaactatcccaagggcgctcccttctccgccatcctcgccgacttcctcggccgcgggatatttaacgtcgacggtgacgcgtggctcttccagcgcaagctcgccgctgccgagctcgcctctccggcgctccgcgccttcgcggcgcgtgtcgtggcctccgagctgaggtgccgcctcatccctctgctccactctgcttcacgtgagggcaacggcaaggtgctcgacctgcaagacatgttccgccgcttcgccttcgacagcatatgcaagatctcgtttggcctcgaccctggctgcctcgagctgtcgatgcctgtatcgacgctcgtggaagcgttcgacacggcgtcgacactctccgcgcggcgggcgacggtgcccatgcagataatctggaggctgaagcggttcttgaacgtcggggacgaaaggaagctccgggacgcggtccgtttggtcgacgcgctcgcggcggaggtcatccgacaacggcggaagcttggcggcgctgccaccggcagcgacctcctttcacgcttcatgggctccatcgacgacgacaagtacctccgcgacatcgtcgtcagcttcatgctcgccggccgcgacaccatcgcctcggcgctcaccgccttctttctgctcctctccgatcacccagaggtcgccaccgccatccgagacgaggtcgcccgcgtcacgggcgacggcaaccgaaccatggccgccacattcgacaagctcaaggacatgcactatgtgcacgccgcgatgtacgagagcatgcgcctgttcccgccagtgcagttcgattccaagtttgccgccggcgacgatacgctgccggacggcacggtcgtcgcgaagggcacccgggtgacctaccacgcctacgccatgggccggatggagtccgtatggggccccgactgcgccgagttccggccggagcgatggctccgggacggccggttcgtcccggagagcccgtaccgttacccggtgttccaggcgggcgttcgcgtctgcatcggcaaggagctagccctcatggagatgaaagccgtcatcgtcgccgtcgtccggagcttcgacatcgaggcgatcgcgcggagctcgcggcggcccaagttcgcgccgggcctgaccgccacgttcgcaggcggcttgccggtgagagtgcgccggcggcgagcacgtgcgagcgggcacaacccgccaatttaataggtagagcaaacaaactggttcgtgtcatcacgatttgttcttctgtgcttcttttcgaactggaatattaattaggttacatgcatcatgtcgattatgatcgatgactccgtgaccactcgtgagtggctgagtgcgttggcacttggcagcaccaaacttgatgctggacgactagtcagttgcctccaccactcgagatggagcggtagattctgggaatcgatcgattgcgaacctatcagaccaaatcgcgcgtagcccgactcgtctgcgatcaaatcaatccccggcgccgttcgatcggttcattcaaagaagaacatatacgggacaaaaatggaactggagaagaggaatcagcgaacggcaacactgtcgtagacagtagagtagactcgaagtcgtttgctagctatagctaagcgcgcggcgcaaatctaatatgatttcctctgcgtggaaagagatcaatttagcgattattatagtggtaaattgaaatgcgaggcgtggccgtggcacagaatctaggcgtggtagctagtgagtatagtatgcgacgagcaggcttttggagcagaggcgcagagcgttgcacgcatatgttcgagtacggcgacataaacagatgctaattcttggtggtcggggtgggtctcggggggagaagaaccaacgcggcgcacatgtgctcgtggggcggccgctggctgctcgtgttagatcctcctcgtggtcctgccgtccgtcccaacttcgtctgggcctctcgccaaccaagtgccattaaactagtacgcagtaccagcagctgcaagaagcccgggtgcacgttttcttttgcatccagagcagccaaggacgcaatggcagtaaaagataggtaaggtggggactctctccctttacttattatccttcttgatctacaggaactaagctaggcaaattccatggcgcttccgaagaaggcagacctgagatttccacatgccaaaaggttaggatgccaagtgccaataagactccaactccacgcttgattccgttcatcggctgtatggtcagctcgactgtcgatcgatcccgtcaaaattgttacctccctctcaagttacatataagtaaaaagttgttatgttttaagacaaatgtgataagtaaaagtttgagaagagaatctcgaaggaaaaagtatgaattacccccctgaattattgtggttgaccgaattatcccctgaacccgaaaaccagacatttttcaccctgaactttcaataccggacgatttacccccttcgacccaaaccagagcggttttgtcctacgtggcgcatgcgtggcaatccagtcagtattttctctttttttttaaatggtggggcccacctgtcatatataccctctcatctccttctccacaacccctcttttactctctctctctctctgcaagcaggggcagctcgcgacggcgggtggtcagcgcgcgcggaggcgggcagtcggcggcgcgcggcagcggagcccgacctggatagctacagcccaccacctgggatgctgaggcgtcggcagcgtgggacagagccagcggcaaggtggcggagctagtgatctgccccatctacgccaacctccccgccgagctgcaggccaagatcttcgagccagcgccggcgggcgcgcgcaaggtggtgctcgccaccaacatcgccgacgccgagacgccgtacaacccgcgcacagcgatggagtcgtttctcgtcgcgccggtgtccagggcgtcggcggagcagcgcgcctgccggtcgggtatccaggtccgagtagcagctgccgtagctaggtggctgggagggtgaaccggtccacgccgccgccgccgcctccgcatccagtgccgccgccgccgcctccgcaactgctgtgattgacgaaacgttgggtgtgctttatcgatcaaatcgtgtgttaatccccatttgcttcggctggaattgcaacttgaccaccaaggaaaatgagcatgaacgtttacttgttctggtccatatgaacacattctccaagccatgcggtgttcgtctcgatctgtaacttcaaccagaattcccaatgccttccaaggacaagtgtgtgcgtgcgcgcatgttcaacaccatcatatcactatctaaaatgtgattcctccgcatcacatcgccgtcgccgatgcggacggcgcaggcggtgccggccttgaggcctcctgctctgcttccaggtcgaccgggacagcgacaccatcggggcgtacgtgtgcaacccaacgacaaggcggtgggcctccttgacgcagccggcgaccccgtggccccgcagacacgacggcgcgttcatcgccttcgacccggccgtctcgcagacacgacggctggcttgtggcgtggttggacgtacgccgacgctggatttgctcataccggagtcgtcgtccggagaagacgagctagcgccgtcgccggaggagaggacgttgcttctgcgcgtgttctctgtgtcccacgctgccgccgcctccgcatcccaggtcgtgggctgtagctgccaggtccggctccgccgccgcgcgctgaccacccgtcgccgtgagctgccctgctcgccgagagagggagagagagagagagtgaaagaggggaagaggagaaggagatgagagggtatatatatgataggtgggccccaccattaaaaaacgagaaaatactgactggattgtcacgcatgcatcgggtaattcgtactctttccaatctcgaaacccatgcaccacgaatctagagagatggagtgcgccatcacaccttgcattggttttacacgagtttgttggatggttgcgtttgaccctgtcctcccgcatcaaagctcataagatggaccaggtcaatcttcagtgtgtccagcagaaacaatttcttgtcagacatttccactgtaaactggtagcagtaaatggtttttgccggcatccatttcgtttggtcccgtctgtagatttttcatcggctgaaaatgacaatgcgtgtgccaggattcaggattcaggttaaagctgcagtttcctcataattaaaagttttttcaaacaatctagtttttcatccagattttagaaagatgtagtgatagaatttagaaaatgaactaaaagttttatcaccagctgaatttttacccactgctccttaaaatctatagcagtagttttcaggtgtgccgaggacagccaagagccaacaatctaggataagaatggttgaataatgctgctctgccgtatactgtttgaatattttgaccgtgtcgagtggcgatggcgacttgtgtgatgacgacgtcgttccattttcacctttgaggttttgatcgagcggcagtgagctgtgtaaaagaactgaattcatgacaaattggctcgttgctctcgtgtgtatgtgaactatgaagacccggaaatactgctcctgtgttgggtttcctgtccaagctctgcactgaaactccgacagactcacagacagtcacatcccgtgcgtgttgctcgttaacgatcggtgtcgcgtccgtactacactataccgtaccagtgtaccacacactagcgcgacaactcgtcgttgggtttcaccgttattgcttcgacaactcatgcttattatgcctctcctgccgtatcattcgcttcccgtgcaaaggcaatcatagagcccaaccatctccatctgaccgaagccggcagcttttctttttcctgcacgaggggctagtgcgtaccggagcatcggtcccgatcggatcaccgggcactaggcgcggcgtagattctggccgatctagtccagcagtccagcccaccggaacaaaggcttcaggtgtgtgcgtcaagcggaaagtgtattcaactaaacgttggaactcagctattgctctctctcgaagctccctctcctcaaggtggtcgctgtcgccgtcaccggcgctggctactctcgtcctgttgtcttggtccttgtcgtcggtgagctgaggcacctgggttcttcccctagccgtcgtgggtgtcatcggttttgcacaaaagaaggttacaccggcctacaatttcatctctgccaagcactatccaagccaagcagcctcttccccaaattccgacaagagttcataaagagatggttgatggaatccacaagtttgccgagaggccctcaacctcccattcaaggaggcccatttggatatgtatcttggctcccactgtgcttttattgttatctttgctggtgttttggatatagctgtttttcgttgtgcctattgttatgttgatttctttcaagaactcaagtggaaatcttctgtggagatgccaagtttttctcttttcggtccgacgcttcaaccttcatctttgggaggcccctccaaggtttgtgtgtgggatctacatcatgcagctcacctttctacaagcaccaccgaagctgagctccaagctaccgtcgttggcggttggcgtcgacagcagatcgacgagaaggacctgttgttttttctacttatgcgtaggtctttttctacaaaatgttgtacatatttgtaatttggtcattctagagggccctttctgcaaaactggttgtaccccagtaaaccgtgctatatccgccattccgccctgctactcgtgtaagtgtgtaacttgaccctagttctcttagataaatactccctccgaagacgttaactttttaaacatgttttatcgttcatcttatttaaattttttttaaaaaatatgtaaaattatatgtatatataaaattaaatttaacaatgaatcaaatgatatgaaaagaattaatagttaattatttttttaaaaaaaatgaatgatcaaatatattttaaaaagtcaacggtgtaagaatatttatgtatggagggagtacatgagtttaaaaaaagaaaaaactaatcgttggaacctaatttcgggaggaggagatttgaccaccccgctgtctcgcggaccacatcctccagcaaaccggcttcgctatttgccagaggaattctgcgtgcatgcagtgatgcagtgacggaaaagcgggagcacattggtactgcaatggtaaagtaagatgttatctataaaacatgtacatctcagcaatagactaaattaatagtaaaccacctcaatagtatgtctacatgggtatctataactctctaatccattgcctcgtttttctctatagactatctctaggttagtagataactttgctctctctctccatttaatctcttccaagtaggaaaatatgctgacatggatctcttgtagagagcatatagataaccattgtgggtgcccttagtgtctgtctttttctttacactatcgctaatggcgactttggatgctgacgaaagggcacccggagtactatatggtggctaagattccgtcgaaatgatgatacagcgctgataataataaagaagataagagcaaatataatagagggctataagaaggctgaatgctgatgtggatgagagaggagaggagagagatgagaagcggactgtaagtttacagccggcttaggcacaagaaccaagaaaatctgtgagacagacaggtagaccatatatttatagtgaagagttaaccattatatgaatgagctgatagataggctacaagtaagcagctggctgtattattatccttgctctaaaggaagtttactagccgattgattgttcattgtcttgcagaaagtcagaagctatatgggcctaatgtattattacgctttcagcccataacttcaggcccgtatagatctcaataggaaaccgacagaatatccgaggatggcgggccaccgactcgattgaacaaccccatctgcgaggtccagggatacggatgccggttggctcctcttccgcgactccggcgacggaatccctcccccgaaggagccgttcggttaatcctgagacagagattaaaggaaatttattggaattattctctcttaatccccttcaatcatctttaatccacttcaaaccgaacaaagcctcagggaagaattgaaacggatttattccacatctattgtggtgtggaattattcccgctcaatccttctcaataccgaacaagaccgaagcgagctatttctccgtttctttcctaaactctagctacggtggtgtttgaatctcctgaagataaagatgaagattaagtattttacgcaaaatgaggtgataataacatgtgactaattgggttttagttattacaaacttgaaaaatggattaatctgatattttaaaacaactttcatataaaagttttcgtacgaaacgcaccgtttagcagtttgaaaagcatgccatgagtatctaaggccccatttggccatctctagctcccactccaacttacgtggaaccaaaactgtgccaaacaatctggattctctatttttagagcagagttggcatagctacttcacaaaattgtactacgggggtggagctgggtttttctgctccacagctccactccaccccaaaagacccactactatttaattttttagtgtactagaaaaaatacccgtgcgttgcaacgggtaaactaaaattataccaaatataaaatattatattattatgttgagttttacattatatgggcctttaagaaaatatatttctagagaaataatgaaggttaaaaaaaagaaagaaaaggcctctttagagtatagacccgccggtctgctagtgcattcgcgcgagtggcccaacagcccagcagtgttgcggcccgggaagagaggccggcccgacacgggatcaacctgagccgttcattttcatcgatggctcggatgattctgaatccatcaaaaccgctaaccctaaccctcattcgctgacccctttccttccccactgcgacccacctccctccctctctctcagcgcgccgcctctccccctccctagcggcgtcgctccccctccacccaccagcggcgccgctccccctctctcttcctctgaccgtccttcccctcatcctctctctcgcctctcgtgcgatgggtccggcgacggcgaccgcgggtggatccggccgcggtggtggcggccgaggacggatctggcggcggcggctccgtccgacccctctcgcctccctcccacggtggatctgacggcactgacggtgtcggccccatccccggtgtggcgacgcggctaggagcggcggtgggctcgggagccggtagcggccgaaagcagcgatgcggacaacggcaacgacggtggcggcgaatgacgacgaggagagcgggtgtgggaggcggctagttttttttttaatttgggatgttgattttgtggggattcttgattttgatttgggattgcaactgagtgattttgtggttttgggcaaaggggttgggagcaatcggttgatctactcgtggattttttttatggtgtatttgagttcttgtggatctctcttctgactttatttggttggattagagtccgattcttttatcttttttagaaaaatcgcaaaaaaccgcacggggagggaatcagactgcgcatcgcattatactcggacgacttacaaaaatccctggcaaaaacatcttaaacttatataatataggtaaaaataaagataaagatagagtttttataatataatagagaagagatatagattaaaaccaaaacataaaattaaaactgacttaaatacggatgataaaccgcgaaaacatcttcaatttttataatcgaatcaaacacggatgacggaccgtagaaacatctttaatttttataatagtagagatagagatagagatagagattgagattttcaccacaatgccactgaactatcccttcataccacatctcctccagttctctctcctcctccgtcttcctcggtagcccggcggcggcgtcgttggcgtcggcagcggcggacgggtggcgcggcggcgagggccacgggcggcaggcgcgcgggcggaggcgcggggtggcggcggcggctgcgcgcgggcggtggcgcggggtcggcggcgcgcggcacgttacagaagaaacaaagcggacacgtatctcgccgtcgtctcccgctccgcacgcaagcagcgggcggctgctgctccgcgcctccgtcgtgtggggctcgcgagagcctggaccacggcggaggcctccaccggcgttgctcgccaccggatttggcgtgctctgcttaattgggccgatctcaagcccttggcggaacttgcacttctcgacccaaaaacccaaacaaggcataattgggccgattccctcctatattctcgtttcccgcggctcaaccgctcatcaagccctagatagtgctctctctctctctctctttgctcgattcgccggcgatggcggcgccgccggaggcgacgggggcgccgccccagactgaaggagaggaggttaaggatggcgtcgaggtctgcgtatttgacgagtcaccggaggtcttctccagagcggtgcacgccatctcggagctcacaaccggggagcacgagccgaacttccctgacgccgaagtcgagcggctcgcctcctcaataactttcctcaggtgagaaactccctccttgctctgtctaatccggtacctaatcaccgcggcaaaattggtaactttctgttgttggcctatttagctgggtggagtggacgaatttgtgtttaatagtagcgtttatcagcaaagcattaatttgttagtcattgatgcaatttcacggagctttcaatgggaaaatttatgtggcatgtaagctctctgtagtttattcattgccttatgtgccacacacggtggcaaattttattggaatttgttaatttagatcctaagacatcgctgccacacaaacagaaaaaaagcagttgtcacaggaatgctttggtgccgtttcattattcctgttgtggctattagaattcatttggcttttgccactgcaattggccatattcttacttccagtgtccttaggtaacaatattagctcaatgcacaattctgtttttctattgattagaacgatacaaggattttttttttcatgtcatgaacaaaatgcagttgcactgttacttgttttattactaattcactaagtttaagtcacttttgttctggtagatatatttccttaatctgtactcatttgttgtttgatgactctgatcgatgatcatttatgcacattgtgactttctagcttaccatttgatgttatggtttaaggcacagaggagtagcgaaacttgatcccctttatctataagtcactaagtcagtgagccccacctttatttgtgcagactacttgttagctgttactttgtattcaggattggcagtttcagtaacagctttagttattagcaacctatagtagcatgctataactagttagtactctttgatttaatcaccaattaaagtagaagaaaaaatttatgtgcccagtgttcaccagaaagatttttttttttaaaaagcaccactcactgtgttttagcacccaccaatataaggatgttaaactcaactgagactgatcagctggtacagccatacaaaggctgctcagaaccttagctttctagtatcatccatctcactgtaagctgatttgcatcaattggaactgcatagtttcaacgtgctgcattgttggttctcctccatgcccattttaaattttactgactaaaatttctacattgtcacatatacttgctccctaagtgcaatgcattggtttttatccaaatgtgtcaagtgtcaactattagcagttcacattagataaattatctgcatttattataaccattagccttttgtccaaacagactatctgcaatgattgaatttgtccactgatagtgttagaccactttccttggcatagtatagtctatagttgggtcagattttaggttcgccgtgttcagctcgcttatgcacatgaggacgactcctttcagcaccaagagtaacagattgtggaaagttctaacagtcattctgagcatcaattaaatggaattcacaagctgctttttcatttgtctaatctgattgccttctttttttttaaaaaaaaaatcaatattatttagtacctaatctgctagttatttcatatctttgcagagaatggaggcacttctcttatgagccaaaaaatgttagtttcacttgtgacgccagatcagctccatccagagttgacacacacaagataaacttaccacagttctcgtctgcatctgtcccccaggttattactcagttgctgttggtgccttgcgctaagttcttgaggctatttttttgttgtgttcagctgaatgagatttcttatatcatcttttgttccttttggaccatattctcataattaagttcggatcacactgcagatcacacacctagacaatgggaaggctaaaacagacaggtattgtttatggagttctttctgtactactttagaatcttgtcaatctagttatcttgttgtctgttttttccccatatttgtcaataaaggtcatactgttagtggagataggctatgttaagtttctcagttgatattaggaataacccaagatgtctgcttatgtattattttagctcctttggcaattcactagttgataatttgctgtaacatgaccaataagcagactaattgtcaacatatattgtattcctgctattggttagtagttttcaggtttcagggaatacctcctttgatctctttgagtaggtcttctatgaaacacgagatgcgggacttgaatcttattttgaaagccctccaaacttgtttaaagatttcagtacagtctccaaaactactaagagtatgctagttattaaggtttcttaaattgactgcacacacttcaaaactactaaccacatcaacttgggagtagtgggtcattcttttggtccagaagaacaatcgtacattgggtttggcaaacgtgccaaaccttcttccttttctttttttggggttgggggttgtggggggttgctttttttttttgtgattgatgaaaatagatctgatctaatactatttttgtgcctttgcacttctcattttatttagtacctgcctcacagtgtgataaacactgttaatacttttttacctgccatgtatatattctttcacttctccttgcttttcatacccatttgactctatgaagccatcttgattaaattatgtttaataattttttagcttttgcagctcagatttcgttatatttgccggaggcaatgtttgggcgttggactggtgccctaggttgtgtgacaggcctcattctcccataaactgtgaggttataactatgataatactgaaagttttctcttgttgtggcttcaaaattgtttatgcatcagcatattttttgttccaatatccactacttgctgtgactatgagtatgatgagtgctctttagttcatatgtcaatgggaaaattaacatgtttcactgagtgacatactttatggtgacatgaatttaaagacatctcttgcagtactccccacgtttacttttattaggcatatttggttttctgtatttgtttttcccattttagatgctcacaggaatcaaagtaaaatttctcatcttttccaactcttgttaaagcagtgaatctggttcaacatttccagttctatgtgctgtgcattgcaggacgataaaatggcagtttacttcttttttacttaataaaaccttgcgctgagataaagcatgtataagaaaatgaccgaagggagttcttcccaaggacatctttgcatgcagactaattgcatgattgcattgaatgtgcggtgtctatgaaattagtattatgttctttttatggtttatatcttcaagtatttgctggtttttgaaaaaaagtatatgactaagagtacaagttattgagagctgataaccttatttgcacgtctcctatacattgcagtatcttgctgttgctgctcaccctcctggttcttcttaccataaaattggcatgccgttaatcgggagaggtataattcaagtttggtgtctcctagcaccatctgaagagggtcatcctcatcagtcattggttgcatgcaataaatataatccatccaatcaaccaaaacaaaggggtagaccaagaaagaccatcacaacttctgatgatcacttggaaccaagtgtcaaaagaccaaggggcagaccaagaaaatatccactgcccattgccaaagtggaagattcatcccaaaacgacagaagtcaagagtttgctcttatttatcctcttgtcagtccagcagttgtttcatgtgacattgcaatagcttatcccatgccaactgttaatcctgtggaatcaactccaagaaaaggtagagggcgacctaggaaaaaacctgttgaaataaaaggtttgtctggcattaaactaacagaagacttgtctacagctctatctccaatagctttaacctgcatggagcccaagaaaaaaagggggaggccccgaaagtatcctgctccaagcaacagcaagcatcttccaggcactgatactgaattaggaaatgattctgtctgtcagcctggttcaattgattttggtttgggtcccactgaaaatactgggtctggtgctaatataactcatgctgcagttgatgcagcctccccagttccattgtcaggtcagaggggtagagaacagccagaaaaggaagtaattcatattgagaattccatgcaatctggacagtct

SEQ ID NO: 59742 - DNA, 7609 bp, Oryza sativa
  unsure (1)..(7609): unsure at all n locations
ttgagtgttggaacatctcatgctgcaacaccagcacagggcatatgtcttgcaaaatgcaaggaagaatcaagtgccaagaagggtagaggcagacctagaaagcagccaatttcaacggaatgcggttgttctaaagcatgcaggggtgaagaacaaaaaactcagacaattcccaagtcaagcgacaatgcgtccttggttgaaaattgcaagaaagaatcatgtcccggaaagggcagagtgcaagataaaaagaaatctgtttcaaatgaaagaagttcagtagtgcttagtgttgaagcacagaacatggacggatcttctgcatcaactgcatatacttcatgttgtactcctgcttgtaactttgaaaacgcagagacaaatcaggctgtatctgttccttccgaaaacagtgctcaggttattgatgaactaaaagatacagaagtggctcgattcaaagaatcaactaaagatgataatatgatttgttctgcagaaaagaccctttctcgtgtcccaaaagacatttctctaccaagggttgtcttatgtttagctcataatggaaaagttgcttgggacgtaaaatggaaacctccttcagcaaatcagtcagaacataaatcatgtttgggttttcttgcagtactcttggggaatggctcgcttgaagtgtgagtgtatgctcttgtagatccttatttatctcatttaaatatctatcaccccctcttatcatcttgtaattcatttttgtgcacagatgggaagttccatctccaagcatgattcagaaaatatattcctcttcttcaaaggagggtactgaccctcgatttttaaagctgaagcctgtgtttagctctgccaaagtaaagtgcgggaacagacaaaggtattggacctgtagacttttttttttgctagtagtagctcaaactaggtggaagatttggatatatttctaaattcctcagcatgaactttaattttgaagccattgcctctttataatggtaaacagcattcccttgacagttgattggtcaccctctcatgatatgatattggcgggatgtcacgatggaacggtaccttttccttacccagcaaaattattttcttaacataaatcctgtgacctttgagtctttcaagttgctgttctgaaagttctgtgattgacttttttttatattccaggttgctttatggaagttctctgcaaacctgtcatttcaaggtatttagatagttttgccaacgacgtcactcttatcagttatcatttacactttgcctgacaacatgtctgactgtagaactgctttattggtttaaaagcaagttactggagttcccaaatcttcgcatttcttattctgttctgtttgcaaacaaaactaaatcatgcgttctgttgataaacaggttcaaaaccttttatgtgtgtaactgctgaatctgctcccatcagaaccgtgtcgtgggcaccatctgtgaggtagccagttgtactgttacttctggtctattccaaaagataatttttgagttttgactcttgtcattctgtcagtaaggaaaacgtgaatacctttgtcactgctggagaggatggtctgaaattctgggatttaaggtaggtgttggccttgttgtgaactgaagcaatgtttaaagcatctttcaaactactctcctatcctgcatgaatttctaatattatgtatgggtcctcagaggtcttaacattgagggtagtctctcccccttcctctctgaattcgtggcacccaccaatttctgaaccattcatatttgtttctgtttgtttcctaatggtaaaaattccgagttaacaaacaaaagataggcacgatatgcagaatatgttattatcacatggaccaatgatgtcagtaggagtttctttatgaatccagtgcgatatacggtttttttctttaatttttcaatgggcgctaagaaacttgttctagaagctgcagtatgtttgtctaatagatagtattgattgatatggttaaatcactacttgtcacagccgctttggattagctggtgtcttctcctgtgtatgctgtgcagacccccgaatgctagtgcgtctcatgagcatttgtttgggcagagagccatatgtgtcatctatgggagttaaatagtgctcagagcgccgtaatgagtattcaatgggtgaaggatgcaaggtaatatttgttaaccactaaatgtacttgtttttcttcattacacaagatttttcttcactaacatggtgtttacgctgttttccttgtctttgaaacactgcactaattttaaatggagatgtatgttttcattaatgttggaacacatactagaaaccatatttgctattgacaattgttttagtcatgtaatttatgttcttagcccgtggttcataggacctgtacttctctgttattgtgtgctaaggtggatattgtctttgtttatataatttgttccattaaatcatcagaatttttttaagcaattctacttgcacttttttttttgcaaacactctatttgcacttgtttacataattattaatataaatgtttgtatttgcccacgtaccttctaaatatgcaagcttccttcgctggacatggtcttgatgtataactggatcaaagtagacgtgattacatagaccacattgtttcattcatggtgatattgtgtgtatataggccagacatacccttttgtttactagaatggtaatgttaactgttatatttttatctttgtgttcagaggtgttgtcatatcattggaagatggcacattaaagttcgttagcttgtcaagaatcgcaaatgatgttccttttactggaaggccatttgttggaacgaaaactcagggtgtttctacctatcaattgtctgaatatttgatctggagtgtccatgcctcagaaattacaggtgcatttcacctcatgtccaaccatagtagatgtcaagtatcggaatattggttatagcctatatcaatatttagttccccacatgtgagcagagtaaaaatgtcaaatattcatgataattcatgaatttgtaattttgttttgctgatatccaggctatgcggcttattgtgtggctgatggaactgctgtttgctttgaggtaaactaaacagcacatatactattgatttatgcatgctattgtgattctctataacattgctaaagaaatattcaacttactgtagcttactccgagattctgggaaaaggaacctgggaggaaccgtgtaccatattttctttgtggttcattatcagaggagggaacaaccattaaaattggtatcgcattaccaaactctcctttgtcaaatgttcctctggggaccaaacgggctactaaaacttgcaaagatgtagctcaattgcatgttatagaagaagggaaacttcttaccaactcaggtaatctctgtcacctgcaacttgtatcattttgcttgtacctgacatgcctgcttaaccaccatacagaatacaatggtgctataaatccgagcatcagagatggtcaacaagatgaacctgatgaaggacaagaaaccggtgccatagttttagctgctccttcaatgcaagagaattttgacacaagcaccagcaggggtagtgaatcccctgaaaattttgaggtctttcctcctaaagctgtagcattgcatcggttgagatggaacatgaataaaggtagcgagaaatggttgtgctatggaggtgctgcaggcattatccggtgtcagaggatctaagaaacaagagcacacttgaggaatctccttgcatatcaggaaaatctgcatgtgtccatctacacaataaactgttgcatgctgtggtatgtttcatccgtttctttcctctactgttattctgatcaccgtgtccattttgggttgtatgtattgacttcttgcaatgtgcttgcaatataactgattatctttggaactcccgacagagctgtatagccttatggactgaagctttacctgagctgcgaggttctctgcgttttgggaccagcaattcattgcaggttggtttgaaaatagaaaatactgtcactccatgcgattcttcctcgacattagtctgaaataagtgcaataagtgcctttggcgatccagattcgctaaatctgttgtaattgtaattgtaattgtaattataattgatagctattcttattcatttccttaaacatattattgatgcagctgaaaaactgcacgatattaggtggaatttcatgcatcgctgtttaagttttggaagtcatacagccttgttgcttcatctctttttaaggattgttgagttgttaggctgtcgaagcttttttaaannnnnnnnnnnnnnnnnnnnnaggcatttcttcgctgctgtgctcaagttctcgtagggagcacgaccctacgacataggagcatttctgtccttgctccttaccagataaagagatctgatgtatctttgttaacatgatatcataacagttgggtaaacacataggagcattttcattatcggagagagaatctggcatatttacatttcacttagctgtctttatcaaagtgatatttcgggtgaaactgcaggatgaagtactgtacagtagtaataaacgtggctccccttaaaaaaagaaaaaaagaaaaaaaaacgtggcctgttaacatccctaatgtcaatgttcagtgtataatacaactatacatgcataattcttagtcgctcaatgttcagtgtataatacaactatacatgcataattcttagtcgctcaagttatcctcatcgactacaaaatccgtttgcctcatgaataattctcagtcgctccagttatcgtcatcgactacaaaatccgtttgcctcttgccatcatcttcttgcagaggcttagaagtgctaacaatcaaatgcctaaaaaagcttatgcgataatatcctaatatgcccgactactcctaagaaatttgaatttgataggatataggaaaattctacagaaagatatatgataacaagaaatagaaaatataccatttcagtaaacgctggagttgatggagaccacacaagaatttgcatgtcattgctgccagtataaagctcctggattccaaaagactcagcagtggtattgatgcgggaacattcagggttaacagaggataggagtacagggaagacttacttgttcttgtgcactacagtagcagcaattaacaggttcatagtgcccccggaatgtttgaaatgtcataccagaccataaattgtacgcctacatgaatatggcaacacaaggtgaagtctaaaattcagcgtccaaactgagaagctaaaaaatgacaacacaccttaatgcttgccatgcatgggatgaatacaagtgatggatcctcagtgacagctaattgtagcggtttgctagtctgtaatcgcatagcttcaaaattgaccaaagtattgcagcctgaatcaatatcccaaagtcttaagcgagaatcagaacctgaagagagaggataacaatcattaatgcatactgcatacaggcataacaagaagatagccatagacaataattcctttcaagcaatagcaatcgaatgctcatagaaatagcaattaaattcaatcaacctgagctaagaaggtacatcccatctgtagttgttcttaatcctgtaacagcaccataatgtgccgttgcacaattttgactagaagacaaaccagggtgcaatctctgttggatatgtccatgtccagggatttgacttttgtgcaatttgtgtgactgtttcttactcttgcctgtcctctgctgtgcagagtaaatctttgaagaagatgaaggttgtaaagagttcaaaggatcctggtcaaaattaaaaatgaatacattgatcatttgcacaactagagtggaaggctgagtttgcgcgtcatttctaggacacaacaatcaacaagaaacaatgtatgcagaccttatattgtaagaattggagcactaaacataccatagcacctatatactgacactaatatgtgagacaaacctataaattaatagccgcagaaatcagcttttacttgaaggctgactgtattgatctagcattacagccataatattttacttgaagctgtaacatttttgaagcttttgcagaaaataatagtggaagtccagctttagcattgcaaccaaatattctgaaaacaaatgtaagtgatggataatggtgaccatatcttatctgaggtgccctcaagaaaaggaggccgccttcctagttgagaccgtgactgatcaagaacaagaaagcatccagctcgtcttatgtcccaaaatcgtattgctccatcacaaccaccgctcatcaaaatccactcacttgaagtagaccactccaaagacatgataccatctgacatgtcagataccaaggataaggtggtaaccatacaaacaaagcaagcatattttcatcactgcactagaagtaagaaactaaccacgatgaccggacaacgtgtgggtaaaggctccagaagcaatgtcacataaatggacctgaacatccgcacttccagtagcgatcagcatatgtgttgttgcaattggggacattgctgcgctatacacttttccaggcatcttaaaatccattacgacctaggaaaagaaagccaaggcaaaaatcagaacatcaggatcacaccgttgccaccaccaaaggaggcaagagaaaagaaaaataagcaatccacaaagcagatgaatgcatacttgagtcgaattagtatcccacactttgacatactgatcaaaagaagctgtcacgaacagcccagtgtccacaggataccatacggccatcgataccacgaacttgtggccattttcatgctgcttgtccacaagcagaatgctcctgtgcttggcaatgaacccggcttcgtattcggttgcattctgcacatcgaatatagcggctgatccatccgatgcgccagcgagtaggtaccgccgctctgtcaaatcaacctgaccatattgtgaaattacaaaacaccagcgggagcgactcacacattgcacatcaaatacgccaagattccatctacgggggtgtacaaatcaaattgatctaagcctctaaggtgagagaaggaaaaggggagtgagggggaagaagggggtggacctggagggagttgatggcgccgttgtgcggggtggtgaactccttgcggttggagagcgcgagcgaggcggtgcggcgcgcccgggcggcggtctcgaagcgccgtgcgcccagctccccgtgttccctccacctcaccgcctcacaccacatccactcggccgcgcacggcagctgcgtccctcttctcggcggcgacgacggcgactccggcgggcggtggacggtgcggcgcaccggtgagggaagagccgcgagagcaaacctggggg

SEQ ID NO: 59743 - DNA, 19846 bp, Oryza sativa
aaaaatttgaatcgggtatgtaaacttttgacttataaactttggtctataaattgtaggtgtataaactttagatgtatagaaatactatatatagaaaatatttgaattcaaattcaaaattgaatcagatataattcaaattcaaatttgaaacgggtatataaacttttgacttataaactttaggtgtataaactttaggtgtataaactttagatgtatagaaatactatatatataaaaaaagtttataaactttaggtctataaaatttgaattcaaatttaaattgaatttaaattcaaatttgaatcgggtatgtaaacttttgacttataaactttggatctataaactttaggtgtataaactttagatgtatagaaatactatatatagaaactatttgaattcaaattaaaatttgaattggatataattcaaattcaaatttgaaacgggtatataaacttttgacttataaactttaggtctataaactttaggtctataaactttagatgtataaaaatactatatataaaaaaaaatatttgaattcaaattcaaatttgaattggatacataaatttttgacttataaactttgggtctctaaactttagatgtgtaaacttaaggtgtataaactttagatgcataaatttactaaaatagaaaagtaatgcggtgaaaaaaatggaaaccaggtgaagggagagaggggggagggggcgcggggcgattgctacccgatgggatgggcgatcgatcgcccattagagtttccgctcatgggggcacctggtggatgtttgtctctgaatgtgttgtggtgtgaacattgagatactaggtgaaaccccgcgcattgctgcggaaatttagtatgataacaataaaaaaataacgtgcaagatagttagataacatcaaattaagtaaattaatatggtttatgataatttaaatttaaatagtatgtagaatgttgattcaaacgtaaaaagtaaggtggcatgactttatggaaaaagaaaagcagaaagatagtttggaccgtagattaatcatctaaaggctaaaaacaattgatgtgatatgacttaattagaggaaaaaaggagaaagataatttggaccatagattaatcatttaagcactaactaattaaggatgaactatataagtatataggatatcataaaacataataaagatatacattgaaacattatgtgaattatattggatgataatttaacatatttgtatttgaaaagctcttaaattataaaaactataaagatatagcatgtttgcatgatgtttaaatgtgatgattgttagtggatgatgatgtagcattttgttaattagtggatgatgatgtggcatctttgcatgttaagcttaaggagttagtgggggataactttatactaagataggatttacaatctctgctattataaaaattgaaaaaaaatttaccggtcggtattttggtacgtcacccgtatttaagtaggtttttaaattcattcgcttttggaaatatagatctgtgtttgagtcggattttaagttcgtttgcttttggaaatacaaaagaagtcgtataagaaatttctttaaaacaacttgcatgctaacttgagatgaaagccagactcctaactgtagctcatgattttctaaaaaaaatccaagtgaattcccatagtgaatttcatcctagctaaaccatataacaataataagattaaaatagcttttacccgttgcaatgcacgagcatttttagtataaaaaaatacacatgcgttgcaacgggtgaatactattttaaccttattattgttatacggtttagaaaggataaaattcacggtaggaatttgcttggatttttcttttagaaaatcacgagctacaattaggagtccgatttttatcttaagttagtatgcgggtattttctaaaagagatttcttgtacgacttcttttgtattttcaaaagcaaatgagcttaaattctaactcaaacacatatatgtatttctaaaagcgaaggaagttaaaaaatgactcaaacatggatgatataccaaaataccggttaaaacatctttaatttttataatagcagagatagagaagtgtttcgttataatatcattgtttgaatgggcttgatagaatatcataagttaaacaaagagtgttcgcttagttccttttattattgaaataaaactaactaaatttataccaccataatcttcgtatatatgacgctggctagttcaaactagccaatgtcattaaaagacctagagggagtaatatagttaaattttatttactttattgttaaaataaactttatcaaactttatcatggttaagaataaggtgttgttgatttcttttttaacaaaactgactaggcatttgcttgttttgttatcaaaattgcatttggctttcaaccatgccaatcgttttatattctatatagtttaacattgcataaatattgacttagcaaagttgagctacaaacagggtttacgattccgacgaaatccgatcggatttcgtcggaatttcgatgtttcgacgagactcgaaagtagaaaccgtctgagatattttgaggagtttcatccaaattcaaatttgaattgataaaaaataaaaaatcttataaatactattttctccgtttcacgatgtaagccactctagtatttcccacattcatattgatgttaatgaatctagacatatatatctgtcggtgaaatgggcccaggggtacgcacagtaaagggaaatatctttcccatctggtcgcgtggccacacggcctcgtttccccccgcccctcgggtagagaggtggccagggagcctcggggtgccacgccgcacccctcgggctttcggggcgtgctaccccggggccctcacctggccaccacgtggcggggagaggaggcggggcgaaagacgatgctccgcgcctttaatgcgcggtaccccaaccgtcccacgccgtattcaatgcggcgttgggggacgtgcggcgccgctcgattgacccatgtcaatcgagcatgaccggcctgtgaccggtcacaggcgacgggacggagggcagtgcccccacgttccaccctgtgtcaggcggagtgggggcaggtgtgccctgtcccgtcggcacgctgctaggggcgccccacgcgcgtgatgggccgccgaagccttcatacaattaatagagaatgatagggatgtcccccgtgtcaagcggaggacggcgttgggccccacctgaagccaggcgaccatgttgcttccggttgaagcaaaggatagcgatatgattaggaccatgtgggtaccccttttcgtggggggtaggtgcaaacggtgcatgtggtatccccttgaactataaaaggaggaccattaccaccgggaaaaagggaggactcgaggagaactcaagctcgaaggaagaacagctaggtccccgtcggagcttgaaatcccttgtaaaaactcaccataatcccacacacaggagtagggtattacgctcggtagcggcccgaacctgtataatcctcgatctcccatacagtcccgacaacgatcaagcagctagactgcgagcggaagtaaactcctgtcatcgcgccatttcccccagccgaactcacaaaagggggtctcacgaccacctactagagaggatcgctcctcgacaatatctatctagattcattaacatcaatatgaatgtgggaaatgctaaaatgacttacattgtgaaacggagggagtatgatattcatagaacctattgggatataaatgttcgaaaaatgatgtattatgtatatttactgaaacttacatcaagaaagaaaagaataaagaatttaaaaaagaaaacaaattactgatcgaaattttgatgatttcgatcggaatttcgccaaaaccgaccggttttcgagaacttgccggcaaactcaaggatttgtattcaaattttggtttatgaaatttgttcggaatttaccggttttccaccggatttcaaaaatttcgaattccaccggtgtccgaaacgaaagagcatgtcggaatcgtataccctggctacaaaccaaaccaaccttgtttgccgaattggatttcagcacagttggtgtcccgttttgattcttgaggcccatgatgtagcaaatactactgctaccagaggagaaaaccgtcaaaccggcatagctcctctcaaaaaaaaaaaaggaggggaaaaagaatcacgacatatagctggtagctccggtccaaactccaaacccgcccgtctcctcttcggccgtctttgctcgaccggagcggagcgcagcgcaggccaacggcgtggacgacgcgcgccccctctggatcgccgctcccccgcgcgccacagcttccatccggcgactgcaaggccgcccaagccaagaggttattattcgtcttccgctccatgattccctttttttttccctgaagatgattcgctggatgctttagtagtttctacctcgctgtttattggatccgttcaattcgtctcctccttgggacgaaattctcgcgtatgtggttattgggacgaaattcttccgagtattccctcaaaaaaaaaacttccgagtagcctagggtttggggaaccttttccacgatttttatcatcgtgtcgattagttctttaggtattagaccgtccattcaccgattcgaggtgcacatattttgtacttgcaaaatagggttaaatcatggttcgacaagactgttagcctgaagatgcaaaatacctgtttaagttgtgctatttgtgttcaacacagttcctttatagtaaggaatatatagcatatctgatgtaaggcttcaatgtggggctaaattctatgtaatagtgtgtattatgttcttataatctcttgagttcgatggaagagcttgaccgtgcaaatgtattgcattgtgaatcttacacctactctatgtcctcagggtttctttgcaagctttagccgctcgacgttcattgacagaacatgcctaaaataaagacaagccgtgtcaaatatcctggaggatgggagcttattgaaccaactatccgtgagttggatgccaaaatgagggaaggtatgacatatgctcccctttcagatgtttattgatacttctgctcttatatggatactaatatcatctactcatgtagctgaaaatgacacacatgatgggaagagaaagtgcgaagccctctggccaattttccgtatttcccatcaaagaagtcgctacatatatgatctttattacagaaggaaggagatatcaaaagagttgtatgagttttgcctggaccagggttatgcagaccgtaatctgattgcaaagtggaaaaaggttagtattcgacccatgatttgctctgtaagatgcccatcattccttatactctgtgctagtttagtaagatgccttatccaccttgtataatctttaagactttaattaacttgtgtacaaagataattcagatgaagccatagacccctggatacaccgctaagtttctcacattttttccccatgcttagaatgtaacttaactgcttgaagccttgaaccatactttttgtacttgtactatgaaaaataaaacactaaactaaccgcatcctaccatttcttgcagtaaatcaattatattgggttaagctatcacatactgatctagtttgacatgacacatcataaatcttgttttagaatctaatctatatgtatgaacctgcgattaatagctgtatgtcaaagttgagtagtgccttattggatttcttgcaatgaaccgtaggaaatagtgaaataatgcagcatgagtgacgtggggatttatggactagatattctcttatatgggtgcaccatgaaaaataagattttgggagcaaaaagaaaaggcagttgactaaaagatgtttatatattttccgctatgtatttttattggcatactagcagctgatgtaaccagaaatcaaatcatggatagacttctaacacccaatgatattttttttcctggacatctgataaaagttggcagatttgggagggatgcaatacttgtgttccatattactactttatatacttgtctgaacattgataacgaggggcctaaattgccctaagaatattgtgagacgtacgtgacgaattcaactgtcaaagttttcagtcactttttagatgcaaatccagaagatgcttttttgtcacaagagtttgtcaggcattcttatatcaaatgtatcattgcttctttttgtgtgttttcagccgggttatgagcgcctttgctgtcttcgatgcatacagacacgagaccacaactttgcaactacatgcgtctgccgggtccccaagcatctcagagaggagaaggttatagaatgtgttcactgtggatgcagaggctgtgccagcggtgattgagatatcgtcattatcttgtttgaatctgtcaaactaagcagacataatgtttcttgagcgaaatttcggctaaaaacgtttacgaaaacgttttgtaaacccgcctaccgggtatgacgttatttaagtacctgagattgtggttacggtctgcattaatctgccgcatggtcattgcttgatcatcggcctcaacaccctgcatatgtgtattctaaagttttttaatggaaacatctgttactcgatgctataattgccgctatggtctttgaagacgtattgttctatgcacgatgagctgactttgctttgaatgaccttatcgaaaccgttgcaagactcaaatgtttccgtgcggtagaagttcgtgatccaagcagaaagattccaagcaaggacagcctgagatctcggccatttttggagcagcaccagtagcagtaggcagtagcacaagagaagacgagtagttttgctggcttcgtcgcgttgctcgaacatggcaaagctgtaccacgttcactactcttgtcctcgacgaatttacccccataaacaagtgctactggagttcatgtacacagtacaccataaatccaaactctcatgattttgtaagatgccaaattgacaatatgccactggaccccggacagggcaggaggcagatcagtcgatacaggtaggtgaggcatcgccattctcccttgaaaatggacggcgcagcctagctaactacaccgttgcggtggtctcgtcagcccgtggccctcgtgctgcagcggggcgcttgtgtcgcgcgtaggtagcgtactccctgtcctgggctgtcggtgcgccgtgcgcccgcggccgcgagtacgacgcgcgctgcgtgtgcgccgtgcgcggctcacgggaaaccaagccgtttttaatacgcggcgccggtcaagccacaccgccggcatgtgacagtgcgcggagcggcatacgtacgcagcaacgtcactcgcggctcggctcggggagcgcgtgagcgtgcgcgcggtggcatgcatggcggactccacggccatgaccgtcgacttcctccgcgcgcggctgctctccgagcggtccgtctcccgcgccgccaaggagcgcgccgaccagctcgccaagagggtcagccagccaccgcgcgcaggggcagcctactctcgctgtcgttcgcgccattgattacgtgtgttgggtcacttggttgtaggttgcggagctggaggagcaggtccaggcggtgacggcgcagaggcggcaggcggagcgggcggcgacggaggtgctgggtattctggagtcacatggcttcggcggcaacctatccgacgtgctcgactcgggctccgaccgcgacggcgaggaggatgacgacccacgcgacgcgaggagcgacggcgacacggccggctcccgcggggaggagcagccgccggcgcagtgcgaagcggcggaggacgcgctgtccgggacggccgagcccggcggcgggctgtcgtggaaaggccgcagcgtgagcccgcgcaaggcgaggcagctcaagcagaagcaccggaggagctacttctacctcctctcctccgacccgtcgcccaagtaccggatggggcagtcctgccgcaagaacaagcgcaaggagctcaggtgagctccgtcccgccatagacgctggcacaccgcacacgccattgtttgtcgaattctaacatcccacggctctgctcatcagcaatggcaagtcgacggcgccggaagagcagcgcggcgacgtcgaggagatcgcctggagtcagaaggggcagcaagatggatcggattgcaccgacgacggccaggcggacatggacggcgaggttgctggtggtcagtatgtgatcaggtacgagaaggacggcgagatggaaagggtgctcgagaggcaggccgagctgatcggccagtatgaggcggaggaagaagctcagaggcagtgggagaagcagttcaacgagaatcggagctcagccaaggtaagcaaccaaacacagttacacagaaacactgctcagagttgtgataccaaattcttccacttccagagaaaatgtttcacatgaagcaacttctgcagtagtacatgtgtacaacaaaaatataatctcataactttgtaccatgaactacgccacagagagagtcaacttccccttgacttccacatgctaccaaatttagtgcacatgcagtacaaaaatgtgtaccaccaacttgataagtataaataatttgctctctcaaaatgcttttttttaataacaaaatgcactgcagagtgctacccacaggttagttagtatcatgagtgaaacctggttgttttggttcaaaatttgacattttactcatacttttgtctttggagctccaggttcatgttgaggcagagaataaggcgtgccagatagaaaatggttgggagcagagcaaggagcattctaggctcgcggatcaagcggttcattgcaacgaagaggcaaaaccaggcgttaaaaatcaccccagcgccagcaacaaccgctctgctggacttctgttgaatggttcccttcctgaatcaccccaagacacatcaggacaagaagcagcagccgaccaacgtgactcgcacgaggagcttcacggccactgtcatgcacagtctcaaggaaactctaatgtcgccggcacaatgacagggaagaatcaagaacaaggaaacgagaatccggatggatgttcaagctactgtgacatcaaagcgccatcagatgggagcccgtcaatgagtgatgccaccctgaacagcaaggtctctgattggagctcatcacgcttccatgaccatggcgacaaccaggtcgatgcagggccagatcaacagccaacgagcaacatggacatagagtgtgttcttcaggcacttcagcttgccaggatttccctgagtcagaagctgagcaagccagttccacccagccaggtgacgctggcgcttcctgcaccaggggaccatgaacattcagaagacgacggctactcccccgtcgacgacgagttcaattctgcaagagatgagctctgcagctcaagccaatctcctgatcaggagatactggctctccctgcaccagaggattaccatgacagggagaatttgcctgccaatgacgacgctaccatttcactgacagaggaacagaccagttcaagcccacaccggcaggagatcctggctctcccggctccggtagatgattaccacagagagatagtggatgacatcaagatacctatctgcattgccggcttgtttcggttgccaacagactcatttccaaaggacgagatggtctcaacttgcaacaaatatggaggttcagagctcaatctgagaccaactgcagctgctcctcagaacgccttcgtgagcaacactgctgatcgtgtcacggtagctccgtcagagataagagatgatcatggcttttcaacgaggccatgttacgatccacacagttctgggctgctgtctgtgcctacttctggtaggtgtagcactccaagttcagattttacaataaggggagcttctttcctctccggaattcccggacttgctgaagatttcaggaagggaaggccccttgcagatgcagacctgttcatgcagcgtggctgcgattacactatttctaataagtggatgctgtagcttgtaacatgcatgaatttgttctctttgctttttttactagcggaaggcagcactgataattgacaagtagtatttctcatggctgcatatccttgtgaagaaggcgttcgattactaggggagataatttgaccaagacatgggaagtgcgccactttttgacaattggtactccctccgtcccataatataagggattttgagtttttgcttgcactgtttgaccactcatctttttaaaaaaaattggaattatttttttttacttactttattatccaaagtattttaagcacaacttttcgtttttttatatttgcataattttttttaaataagatgagtagtcaaacaatataaacaaaaactcaaaatcccttatattatgggacgaagggagtatgttgaagtgcatttgcaaacttgcagccttgcaggtcacaaagaagcaatagccttgcgccactggatggcctgcggctagcaatttatactggcatgccccagttcttgtcctttgtttatgtggcatgcccagcagtcatgatagcggagtgttgcttgacttcggaatcaagcttgctacacatttttatcccagtgaattcatcataatgttttgcatattgtgctgcatccggtgacaaccggcatcattgccgtacctcatgtagtacgtgctaactgctgtacacgcgacattcgagccgtgcacgcagctagccgtagacaagcaacagcattggaatttggaaggagcgtgctgagaagccacccgtgccgccgtgcccggcacggccgttccatgtgaaggtccttgtcagcctcgtcatcggtacaggccggtggcgaggtccattggctttgacccctcagaaaagagggtctagtgtccacgacaaggccctctagagtgcctgagtggtctcagaactgggctatatacgtggttacggggataaccaacaagtcagccagccatgataaccaacaagtcagcaaagatccaatgtgtacaggctgggttatgccaaagttgggaggtggcaactggaaaaatagccccgtaacattacagactctttgattccttgcccatgtacttcagacaggcagctttacatgcttaacagttgacatggatgccagcctttagcactgcgaggatgagataattcagcaggaaaacctggcacggtgaaactcgctatcactagtagctaagttgaaagtaaaatatccacacacaggaaatgttgaaagtaagataactagatcaattaagcacagctcaggtttggttcagatcatttaccgcctgtacaaatagatatccctaacaccaattaaatagtaccaggagaagagcaaaatctgtaagtgatgacaaaaggtagtccaaaaaaatgtgggaagcccctgatgcatctagcatctgcatcaggacaagacaactaacctagagagcaattcagtatgtacactcgatagtcgataccttggttgaaaaacattgggaaacagtcggtcatgattcgtgactaaccatttctttcgcctgagattttgcacagtaaccatttttcattcttggaagctgcagaatattttttgtgcagttggccaaggctacaaaccacaccaaaactgtgctataggccaacgcatttcacccacctgaatgcgtgtccaatcttgaaaggaagttcatagtctttcatgacagctgattctctccttgccgcctccgcctctgaccatacatacaaaccccgctcttggcgaccaccagggacagtattgtcaagtatgagggcaaccaaaaacgcaatgaccatgttgagtgacagtaacgtgttgagaatatagtttacctgagagcaaggaaataaaggaattgcaaatcaaatagttaacataaacatatagcaaaaatattgccatattttgagacttatatgaatgaatttgtcaggcttcacaaataaaatgagaacagttcttatatactgcaaatgtgcctacgcagtaaattagaaagcaatatatcattcatgtgaatgggattgaaaatatcatggcacggtatataagagtgaaataattgtgttctttgttaagaaggaaactatgctggaaccatatgtaagttatggaactcaacctaagcacttctactcgataaagtttattaccactaggaatttatagcttgactaatttcagttgaagcatagtatatacatgaaaaatgaaagttccagggttcatatcaaaacagaggagtaaaaaggactatatttaatgagaattttctaattccgactattttcccaggatttgtttattcctttctttatgtttctttctactgctttctccagttgtacaatatagttatgtaaatgttcaggatacttccataagacactccacaacaatattgttactgaaagaaaccagatatttgttattgtaccaggcaagcggcatgaagagttacagttggcaaactatctatattcataaataatgtgagcactataatatggactctgcatgtgtatcaccagtcttttgtttatgtatttccattgaaactctagtatgcaaacagcatagtgttagaaaagaacggatgaatacataccccactagatccagtgtgtataggtccatgagatgcaacaatgtatggctggaagtaggttggaactgatgagtttgaattaggctgtaatctgtactgttgaaagtacgatggaactgacagggacaaaaacaaagctagcccaactacaatactgttcctggagcttcccttggcgctataccgaagattggataagccaagggcacatagcatggcccacatgaaacaaagaagagcagcaactagaacatcaggaatagaagcaatgaaggcaccaacttttcctacaatggggacacaagaattgttatagcaagaacctgaatgctgtcacagttaaatgatgtctactcttccaacacaggggaaaaagtgcaaatagttgcttaccaacaaaagagagtagtataagtacaatagcaccaaatccaaccgcccttcgattgcccattttagtaaccgcaattgtgtgtacattctctgttattgttgcagatccaactcctgtaccccacaagccagctaagactgtggagacaccttcaacaccaatgcccctactaacaaccccagctgttggtggtcttgtggccacaaacaaagaagatgcatggtaggaaccaaccttaagtccaaaatgcataaatgaattgtcaggaaacaaaaataaattggatagtgaagagcaatgaatggttgattctagaatcctacttactgagtgatccaatttcaggcatttaacaatattgtcagagaagaaagcttatgttaagttgatgcttagcagggggagcaacaatatgctttgtagatcatttcccagtaagtactagattgtttatccaaatttatgaaaagtaaacaaaccaaaagaaagaaaaacaagcatcatctaagttcaaagcaattataaacttactgaatcgactgatgcaataacagatgcaacacacatcacaagacccattttccaactgaaaattggagtgccccattgcaacggatatggaaatctcaaccaaggtgaagatcgcaaggcatgtgaagtgtctacgcgacaagatttcatcctcagtacatgcttccggcaataggctgatacattgtttgaggcaggaatatttgcatcacaacctctgtagctataaactccagttgctgttagaacaaaagcgatagcccatgtgatccctagagcaagaggaacctaagaaggcagcaccaaaagttcagcaattagaattgcataatcacactaatgactagcatagatggaggtattagctcaaataactattagcccaaatcttaccgcataaattaaaaacacccggtagccaaataactttacttttcggaggtactgtcacagaaatagacagatcatcagcttaagacattatttgcacaaaatattacaatgcatttaacaagttggtttactgcatactcactagtgcaaacataacaacaatcaataattgtaataggcccatctctatacatgaccctactttagtgaacccataactgaaaaacgaaagtccaacagctgcgacggttggtgagatgacaactggatttatcaacctgaaacagaggtagttaatgacaaaatgctcagtgaagatggagatacatatgtattactatttgtcacaaaaatatacagttgatggtacagtcagaagaaatagaggcaggcttactaatgtttcattgatctggattcatcagtttataagacatgcaaaagtatgtttattgtccgagaaacaacggtttatgcaaagaaattaattcataacagggatgctcagaagcaggaaatatgtataataactagtaatatccaacaaagtttcctttattatttgaatacctctatggtggtcttctactaacatcaccagtagaagcgatatcaaccattgatttatgatatctactaccagtagaaaaaaaatattctacaagtagttgaggtggtagtataaatagatcaatccattagattagagagtatgaacagactggattgattctataaaataccaatagagaccatagtaaaacacctgtatcataatcggtgtttattaacatatcgtgaccattgttaacaaacaccacatagataagagaaagttgttcacagtcatcacgagatgtatctctgtagtacagtagaaattttggatcatttgttttcttaagaatgtgttagtactcagtatgcaccattccaaataaaaatctgatcgacttactaccaaacccaatcatgtggccatggtaaatagagaaatatactgccatgtcaacaagccacatgatagcagacaactaggagaaaaagatgaatgtatttgtatctaataaacagcaacagctgcacaccttagaaatagtgacattaggcctgtatatcctaacagcacttggaatgcacctcctattatgatagctccctgcaggtgcttcatgatgtgcttaaagttctgcaatgaaatacaacgtgttaggttcaacaacaaacgctctaaagcaatgatgaggcaatccctacatgacaacatgtggcattgcatcacgccaacacaaataaaatttatacatataaacatacattgtgattgagcccaaagaattcaggggagtagattattgcaagcgcaggggcaagatatacaaaggatggtccctgcacaagaggcagccttgtcccacagaatgtgtgcagcaatgtggtcatccctgagacaagcaacaccgtggacaccaccgctgccatatcatcctaagcatccaacagcgtatattaagtactaaacctacaaaaccaaacatgctgtgagaactactactaaattgaagccacactcacaggtgaaccgcccattgcaggaaccatcaaaagtgggatcaggatgattgagccgagcatggagatgtaatgctgaaatccatataccgctattggaactgcaacacatcgtaaaacctcgtaaatcagcgcgctcgcacatgacagtgtgggatatttaattcctcttttgagcacttacatactccggggctgtcacggagctcgtacttgggccgctccggcgcaccgtcgtcctcctcctccagcagctgaggaagcggcgctgcggccgcctgcccattcggccttccgccatccgaatccctcctccgcgtcctcgcaggaggcggcggcggcggcggttgcggctttgcctccgcattggccgcggcggcggcgggagggggcgggagggcggagttgggcctggccggtgggccggactccagatcggaaggtgcctcggcggggcgaggcagcgatacctgccccgagctggaggcggagacgatggcgacggactccccggagacgcgggactggaagccagtgcgcttggcccaggagaggggctgcgcctgcggctgtggcgtcggtgcggggggccatggcccggggcgcgcccggcgagccgcgccggaggaggatgacatggcgcaggcgggggaggagggggggaggtcaccgccggtgagcggtggtggtgattaggaggggagggggaagcggtgcggggtggcggaagcaagcagtgagtgagctggacgcgtactaatccatgcgtggggaaggggaggcggagattttgcagtgtggggcccgcggcgccagtggacgttatggcgttgtcacgattgtgcggcgtgtgttttgaaatttttggtgagataggatgacggctgaggggctgatgtttttcagttagctcgggtgctactgctgtatgctaagagaagtttaacagtatagccaattactaactctaaattatctatagtcatataatagctaatttatacaatatttggttactatatactagtaatacctgatactacatatcatacatacattatgtcttggagtccgtattgcagctagctcttctctctattcttttatctctttaaaatatgtttatagctagcttatagcctgctattgtatctattctaagagcaaggctaataatacaaccgatctgttggctataaggttctttgtagcattctctcagtctacccatataatagttagctctttacaattaatatagggtccacttgtctctctcacagagtttcttagatcttgtttccaagccgactgtaagtttacagcccacttcttctctcttctcttctccaccttaacttttagccagcttatagcctactattatacttgccctaagactggctaagagagcctgatgcttgcttggctacgcggtgaaatcagaataggtttctttttcgtgagggcctgttacgcctatattaagttatttttatgtttatttatcaaaatattagatttatatctataaccgcgtagataatccactacagtattttggtcaatattccattttaaaccagccctaaaccatttcagataaaatagattaaaatatgtaaaaaaaaaccaacgtttcgaatggacttaccctatgcaaattctcgggaacatagatagagatttagcattagagtttgttattataattatttcatcaaaacaatattggcttttaatgtgtttagactttccagtttcagcttctgtaaggtttgcttaatgctgaacttaggtaaaaataagatacggctgagagctgtcaaactaaagattggaatttataatttcattgaataaaaaaatgacttagtaagaaatttcaacatttcaaacgggcctcttgcagaaagcgaaagcccgccttttctgaactaaaggcccacatttttccttgtcacaactatgtcatgggcccagttggagatgataacaagggatatgggccaaatggcaggcccggataggccctttttttcagaactaaaggcccacatatatatttgtccacactactattctagttgaaaatgttgaatccaagcttttaagatgtggatgacctatgcaatctctatgccaagctatgtctggtcgatttcaggacacacaaagtcacgtggtaattgaaaggtagatctcgtgtattacaatatgaaccatcaagggttaatttatctttcgccctttcgcggtttcgccgtaatgtctcatagtgaacagggacagacctgattgagaacatggagatcatgtacctcttgtctcctgaacatgcttgcatactgcatttcacggcataccgacacacacggacacaccccatgtcattgatggactggactaggaaaaaaagaccgttcctcgctagcacagtagcagtatgcctactcctactctatatgaagaaattcgcattccatgtgaagaaaattgcagccagcacgcagaagtttaatgaagagagtcgccgaaactgagattaatttctcgcttccgtactccgacacatctatccacatgattatcctttgaaatgttcactgctggatgcagtagccaagtagtcaaggggatcaatgcagtgttttaccagtccccactaatggtggtggacgcactttctgctgcaaatccaaagccttccagaacttttcttatctctggatcaccaactttagacaaacagcaatatctctttcctcttttacaataaaaataacgcgagctttgcccatttatgcggaagaacagaaatggcgtcacattctttcgcctactccctcttggacttgtcaaggactcgaggtcgtttgattcatatttcagagtaagttactgtgaaagacgtcatagaaagacgatgctgcaaaatatgtgttgttgctataccattttatttctcttctgaccaaatagagtactcgattagtggcgagcagcgtgaagtttcaggcaccagagaggcgtgttcctgttaggattacattactcatgtactccatattagtactaattaattatctatagctagaagcccgtgatcgattagttggtgttagtttagaattagaaccgatggcgttcatgcatacacgacaagtgttcgatcgacctacgcaaaaaagtctttgctgccacaaagtacgtggatctagctagcctggagcctggaacggatcaaaaagtttactaatttatttagcagccatctagtttgctgaagtgtggaaaccataggagcatgcaagcttacgaagtcagcaactacagcgctatcaacttatcatatgaaacttgtgctgttttttcttctgctatatttaagggagaatagctaatatggttcctaaaatttcgctcctgggacattttagtctttaatctttcatactgtctaaacaaatcctttaattttgtcacgtgggttgacatagtccttgatcttaccaaaatcgccacatagatatgccatgtcacatttccatgcaaaatctatatgatttgtccaatttacccttacatatatcatagaaaaataaaaaacaaaaagtaaaatgtaagagcaaaaatatacctcaaaagggtgaaaaaaaggataagtattttttcccatggttatgtctaattcacccttatatttatttttctatgatatacataaaggtaaattggacaattcatcatagattttgcatcaatgatgacatggcatatttatataatgattttggtggacccaaggactattctagaccttatgacaaagtttaaggatttctttggaccatttaaaaggttaaggactaaactgatcctacagagaaactttagggactaaattagctattctccctatatttaatgaaaaggcacaatctatt

SEQ ID NO: 59744 - DNA, 21780 bp, Oryza sativa
caagtagagtattatcaaaccggatagagtagcttaattagctacatccaaaatttaaatttcgaaacctaaaagttgatttctatttttctatttgtatatttttaagtattggcatcaaactattaatgagacatatatataaagtttaaccatatattgttttgtgccgcttcgtttttttttttttacaacctatggccttctgattccgacgtattaattgcatccatatacatggccgtagctgtgcaccgtacatatatgttgttgtactctcttcgtcccataaaaaataaatattagaactgaatacaacacattctaatactaatattatagtactacgtgcatactccctccatcccacctagtacaataaatctggacgggatcacatcttcttctaggttgggttttttcttggacggagagagtacagtatctccccaatagagcctatttagttggcaaaaaaaatttgcccctgcatgttgcatcggatatacgaacacacatttgaaatattaaacatagtttagtaacaaaacaaattacagattccgccatgaaactgtgagacgaatttattaagcataattaatccatcattagcaaatgattactgtagcaccacattgtcaaatcatggtgcaattaggcttaaaagattcatctcgtaattttcttttttttaagaagggaacaactcaggacgcacactaacacacactgcactcacaccacgacacacatgcgtgcgcgtccctaacacacgctaggaatgagattggaggctcgtaattttctggcgaattatgtaattggtttttttttctacatttaatactctatatatgtgtccaaacattcgatgtgacagcgtaaaaaactttgtttgagaactaaggcctagtttagttccaggggtgaaaagttttggcgtgtcacatcggatacacagacacacactgaagtattaaacgtaatctaataacaaaataaattacagattccgcatgtaaaccgcgagatgaatttattgagccaaattaattcatcattagcaaatgtttactgcagcactacattgtcaaatcatggcgcaaataggcttaaaagattcgtctcgcaatttacacataatctgtgtaattagttttttctttgtctatatttaatactccatgcatgtgtccaaacattcgatgtgaaagtgaaaagtttttgcatggaaactaaggcctggtttagttccccaaaatttttttcccaaaaacatcacatcgaatctttggacacatgcttggagcattatatatagattaaaaaacaaattgcacagttgggaggaaatcacgaggcaaatattttgagcctaattagtccatgattagtcataagtgctacagtaacttacacgtgctaatgacagattaactaggctcaaacgattcgtatcgcggtttccaggcgagttatgaaattagttttttcattcgtgtccgaaaaccccttccaacatccggtcaaacatctgatgtgacacttaaaaattttcttttcacgaactaaacagaccctaaacagagcctaaggccgtgtttagttcctaaattttttttcccaaaaacgtcaatttgaatctttgtacacatgtgtcgacgcttgatgtcgcgattccggtatttgcatagtatggggatcgttggtactaggatatatgcgagacttaggtaaaagagacggatgtgaggatttttatacaggttcgggcccctgaattgtcaggtaataaccctacatcctattggccgaaaccggtgttgctctttattcatctggataacacaaatacaacatgtgggataacatatctggctgtcgtcgacttgacggctagataactaactcgtagtcgatgacagggtagtcttcttcctcgagcacgaactcgtcgagatcagagatagtgcttgacccctcttgccggcccccgcaggtaccagatagggtttgtctaagctaatttttgatgttgatatttggaggcgtgttggcttgtatgttgatcttgtgtcttgatctattgtttcgtgtcccctgtccttctagggggccttgtatttatacccataggtgtccccttgtccaaatagaactaagaaaaccaatatggatacaatccgagtagtacatgtcgtttacatgtagaattctattcatccttccttatacgaaactccttctatatccggaggttgtttccgtataagacatgatatttggtgggtcctgccgagatttagtcgactactattaggtatgcggtatccataaccctgacaacatgcatgtagtattaaatatagataaaataaaaaactaattacataatttgcgtgaaaatcgcgagacgaatcttttgagcctaattagtccatgattagccataagcgctacagtaacccatatatactaatgccagattaattaagcttaataaattcgtctcgcggtttccagatgagttatgaaattagtttttttattcgtgtcaaaaaccccttccgacatccggtcgaacgtccgatgtgatacctaaattttttttttcgcgaactaaacaaggcctaagcaggctctgtgtgtcatatttcatactattagattattttttatgggatggaggaagtactctgttgctcctctgaaaacgaacagtactgacccccgggaatgacgtcccgtcaggatcacgatcgatatgaaggcgcccgccctccgacgaccgacgtgcacggtcacagcactagtagagatgagaacgagacaccaatcggcggattagttaggtgcatcagtcggtaaggaaaacgagtactctgagctctacgagcacttctgtgctatatatggtggccaagttggcgagcatataagccactcgtacgtcaaggcctcatgggccacggactcgtgcaagcctctcggccgcgctacatgcgcgcaccatttaatccgtgtccatctcgcggtctcgccgctcgatccgtcgacttcgacaccttgcaaaccacacgataatccgaaggaatttttttaaccgttttgtatgttatcctttgattagttgagtttcggctaagtcgtaaacgaataaatgaactaaaaatgttattttttaaaaaaaaataacggtatttttagcagtttaaataaacttacgaaagaaaaaagatcaactctaaaattaaacttcggaactcaaatttggttgcgattgaaacaaaccaacaaacagacgatgagatgagaggctaggaacagttcgatctggcttattggatgagcatctttgcagagatagagatatggcaaaattcagcaactaatttttgttgatttattttcaaagggatatagttgtgtcgtattataaataaatctatttactttttctaagttaattatgtatattgtcttctaaatgtatgcagactattaatcaaaatactatgatcgttatacatggaaccgatagttcaaagtaaataatcgtgtagaaagtatatttggagtttgtaatcgaaacaaagaaaactggagtatattttaatgccatcttttactgtgagaatctgttgcaattcaaaacgttgaaattattttgaaaattataaactgaaagcaatatgaaatataaagtactgttcacagtgtaaacaaaaaataatgtaatcaaaatcaaaagtttaattaactgaatttattttttgtattttattttaaattttgtaacattaaatagggaaacaacgtcattttcatgattagaaaacgataattgacatcaaccgcctttcgatgataataagtgactcctagcagccacgaggatttttttttaacgatcccgcacaagacaacgtgaaatttcttatgatatggcatagaaaaattacaaagttacatgacgaaaaaattgtgaccaatgaaaaaaaaacaaaacacaaccaccacgtgctaacagctccctacacaactaaggagaagacactaggaacaaaccgaccgccgctaagtttgaccgatcgctgctagacctgcaagatcctactcagacaaatcatcgatgagttcctaatcatcctcatgtagagtggttgaggaagagggcgagagagaagaagatccgctcgtccctcacattaaccagatgacgtcaaccaaaaatttgccaagaaaaagctaagaaaagacggtaaagcgaggaaaaaaacttcccaaacaacaccaccaaagagatcatgacatcttagacgccaccaccgcccatccattcggactgggttttgacatgaagaatgatgttaatgagtggaaaggtgtcgatgatggcttaacaatgctctaagagaggataataatgtccgtaggcatcggcgttgatggctcagagaaacctcaggctaggttttcgcctacaacaccctcttcgcacttatcgtcaccaccgcaatgctccaccaattgaacagcctcttatagctcgcagctctgctgcacctatgctatatacagctaaccggcctaaactgccggtcttcaacatggctaggaaagacaaatattactccctccgtttcaggttataagatgttttgactttggtcaaagtcaaactgcttcaaatttaaacaagtttatagaaaaaatagtaatattttcgacccaaaataaatttattataaaaatatatttaattattaatttaataaaactaatttagtattataaatattactatatttgtctataaatttagtcaaatttgaagtagtttgattttgatcaaagtcaaaacatattataacctgaaacggagggagtagcatttatgctaatgcaaaatgagatttacaatggctttgtttataccataaaaaaatccaaggttttttagcactacaacttacacatacacaataggatctactagtacatgcattatgcatacctaaatatgtagtacttcctctgtcccacaatatagcaacctatgataaaactcatgtccatatttgtagttctagaataggtcttagaggttcctacactgtgggacggagccacggagtatgtacttatcccctccctgacatgttttctatttttcggtggccacgtgacattggcaaggagagggtagtggccagtgggcgaagccaaggctaccaaagaatgtagcaggcacaaattagtgtgtgtagcactagctcttctctgttgccgtaatgcagaggatccatgcctgtcaaaaaggttgtacacgaataaaattgtgaagttttgagtccgttgacaattttttatgtttacgatactggacggcctttggcttaaaatcctagtagtactagatggactttctcatacttgcattacaatgtacaataaaaattttcctcgtttgggttctcgacggattttctttttatttttggtttccaaagtatgacttttttcgtgatcttaacgtattagcgattctctgccgactgcccggcctggtcgcgggagcgagcgcgcgggagattctcccgccgtggcacgcgcgacgtgccgcgtgcgcacaggccgcactgtccctttcgcccgcgcgtcatacggtgtccacccggtccgcgagcgcgcttgcttcttcttctctatatatggagtacgcagttcagcttcagcagtagaagcgcaaaaggcaaaaccagagcccgctcacctgctgagaaacaccgcgcagaggcagagacaaacaacgtacggccgtgtagaactgtagatcgtatcgtccgagtcccccaagagtttcaggccatcaacccgtagtttggcgctcccttggttttacctgcaagacaaaagagctagcgaccgaatcgttcgacggcagaggcgtcatgggggcgccgagcagggaggatgaggaggcgaagaagatggaggccggcggcgacaccgtcggccagaagctcgacgccggggctctcttcgtccttcagtccaaaggtgcgttcgtgtctgacatgagctctcttgtttctcgcttactcgcttctgatcacccactattctttctttctttcgttatttctttcttgattcctctttggcgcatgtcaggcagcaagcatgtttggctagctgcacatataagcgtaacctgtttgtgttctgggagcatcggaggccgtatattctagactgttgatggattgtccccagctattaataagcaaaagagctggctaactaatcagtagcaactagccaactaacatgtacgagttaatagattgttctggctgctatatcaagatggtttgatgaagtgttgttgtgcaggatttggctatgccatcccgattgatatgatccgtatgtaaatgatttggctcatgttaataatcgtacccaaaaactgtacaaactaccaagataacgggaaaaaaatgatggtttacaaattgtttcggttaattttcctcagcgcatgtacccggcagccattgtgaggggtactgcgttactgttctacttgaatgactgggtgcgtctcctgaactctgattaaaagttcttggacagatgtagatgtttgaatggtccctgcccatctatccttttgcactactttttcacagttttaccctatgaagattggatgtagtaacaaaaactctcttctttctttgctcgcttttttccgttcccctacatccgttgcctgcacgcctacatctattctttttcaacattcagagaagagacaagagaaaatgtacttcagggatgatgggctccctggctatcaagcctattatcaatagcaatgcatgtaaagttgtaaacatgggcaattcatattattgttctgctaggctgctagctcagccgatcccccatatcacgatacagtactcgtattagtcaacctttcgggctccatgaaatggttacacgtctatttggtcttgttgaagcagacagaaaatatattaatatatggacctaagtgaactataaaagtataataacgatgtattgttatttttattccaaaaaaataaattaggcatgaatcgttcagtctttagcgtgatgtctgtatcgtataggagaactggtacaggtcaccatctcgttgattatcatgcgcactagcgcagatactcttgactcgaggaaattataaatggcatcgggaggttggttagctagaactctctccgtttcaaaataagcgcagttataagtttttttttaattttaatcgtctgtcttattaaaaaaatttaattagtatttttattgctattagcttataaaatatgaatagtactttgtgcgtgacttatattttttttatttttttttaaaaaaataaataagacggacaattaaaattgtacacggaaactcatcgtagtgattattttggaatggagtgaggaatatggtaggagtaatgtactaatcaaatcatatttggtctattttggaaaaaggaaaatcgaattaggtgtgagactgcaggcttaacaaaatcaaattgctcactgcccccaatgcctcatagttccctgttgatttgctgacccctgaaacatactagtatcaacaactttattttaggataattttaccatccttaaaaatgtatctagaagtaccaaaaattttaatgtaaaatttaggtatctcgatgtacttttttttaatgactgcaaaatttcttttatttttatctttcgattgtcaaagcaagtttagtgactgaggagtactacatgtgtaagacatacagctttggaaagtaggtatgggcattgtgcaggattgatcaatgtttgatggagggatggggtttcttccgatggcaacgtgttttttttttttgaaacgactgatagaaacgtgtttactcgccatattccaacttccaagcgtttagctaacctgtgaactttcttttgccaatccttcatctcctacaacttttgaccgagtggagctgcggaagcctctcccaatcagcttatcatcatccagcgactaatacaaacagaaaaaataccagtaggattaacagattagctaactactagcaggagtaatgttattctttttctatatctatgatatactactttgaatgatattagtgagggtgtctgagttttccccatcaccataagttaacatattagaccataagatcctcaaatgtgagtatttttgcacttgatatgacataatatgcctaattaactaactacgttagtaggtttgtaatttttatttttatatttatctcttatgatattcgccgcaatgcacagtacctttagctagtttaacagaaaaaaactgatcatgctgctgctgtataaatgcgcagggtcatggctgcactgcgggtaccacctgacgacgtccatcgtggcgccaccgctgctgagcctgccgttcgcgttcgcgtcgctggggtgggcggcggggctcatctgcctcgtcatcggcgccgccgtgaccttctactcgtacaacctcatctccctcgtcctcgagcaccacgcgcagcaaggacgccgccagctccgcttcagggacatggccaccgatattttaggtcagtaatcactcgtatacctatctatccgtaattacagttaaacaatgagattgatcgacagggattgttgcttcagccacaattaagactgtgtttagattcaaagtttgaatccaaacttcagtccttctccatcacatcaacctgtcatacacacacaacttttcagccacatcattttcaatttcaaccaaaatctaaactttacactgaactaaacacagcctaaacgctgctgtaaactacagccatttttagtactgctacagccgtaaccgctatagcaagaataggtactgaacacaccctattactatttactagttaggttcccattaaaatggaaataatgtagtaggttgatgctaatatactcattaaactcgagtacataagtgattaaaaggaaggcacgtagcaactccaagctaattggtagatggaggagaatctgcatataaaattgcattggctgacaactgtctcgcaaactcatactacgtgcaataccaaaagcattacaatacaatagtaagggcgttcacaatggacggacgtggcattcagccttcacccaaaaaaacgaatacagtacaactgtacaagtcagtagtgggtactagtatccatcacgaggcaggtaagattctctcgcccatgtcttcacttagccctggctcctaaaggcccgaattgagaatttggagaaaacaacctctgattataacacgggatttatttttctgtaatggaccatttctttcgaagcatttacatagtttgtgatattcttgcgttcaaacgagacatgaggatgagtcaatacatcaacacctatgtcgtcaccttgaatataggggcagaaacgccaagtgcagtgttctttcagaaaagaaaggaagggaggaaggaacaccaacttgtagacgtgacaggtttagcgactgatcattgatgtcctgttttattcacaagaaagtcagctgcccgcccccttttcttgtgcggaacaagtcagctgtattatttggccaaatcaagtcccatttcgcatttgcgagtttgcgacatgtacgtgtctgcagcattcatgagcaatgggtatggccatactatatcggaccggtaaactcttcaaccggagtgagtgcagcgtctgaagccgacatgttgcttgatttcagtaactgactaagcagcattcaataaaatcgtaacacggtacagtacaggttagaaaagtccagctgctagggctcgtattttgtcactgtcaagagtcgacgagggaaagaatccccactggttagataatactaattaaaactccagttagcgcttggcggatatatagagaaaaacttgattggtcgaaagggatagtattcccacattagtactacagatcatgcaattggtcgagtttgacgaatttgtcggcaagtatttgctgtggaatttaatattccagctttccacttgattgcctgtctaaatcgattgatactgcttgcgaaggaaaaaaaccagcaccgcgcgccgtttcttgtcaatatgtcaatcttaaatactccctccgtcccaatatgtaacaacctagaactggaccctccgtcccaatatgtaacaacctagaactggattggacatttcctagtactacgaatctggacaggacagtagtagaaaatgtcccatcggttctagattcttatatattgggacggagggagtagcactgtaccaggtgtagtagaatcagtcatatactagcatcctagctgatacgacattggacagataagcacaggtttaacgtacgtgttgggaaaaaggaatcgtccttagtgccatctggcagcagattcatacagtttaattacacacgcatctgacaaaaaatgtttcgaaagggatattcatcttcatcaccgcgacaaaatcactgtcactgagatgagattcatggttaatttttccacggtgatgcatgcagggcctggatggggacgcttctacatcgggccgatccagttcctggtctgcttcggggcagtcgtcgcgtgcactctcctagccggtcagagcatgaaggtatcttcatcagaacttagtccacgaactgatttcgtgtcggatcggatcggatcgcgttcatcaattgcacatggtatgaatccacatttcttactcgatcgcgttgcaggctatctacctgattgccaacccgggcggcacgatcaagctgtacgtgttcgtggcaatcttcggcgtcttcatgatgatcctggcgcagatgccgtcgttccactctctccgccacgttaacctcatctccctcgtgctgtgcctcgcctacagcttctgcgccgtcgccgcctgcatctaccttggtaggtttcccggcgacccggcccattatttagattagctattgggctttaatttggcctgtcgacgcgacggattaaaattggactgacgaattttgtgcaggaagctcaaagggagcgcccgagaaggactactcgatcgccggcgccaacacccgtgaccgcgtgttcggcgtgttcaacgccatcgccgtcatcgccacgacgtacggcaatggaatcatccccgagatacaggcgacggtggcggcgccggtgacggggaagatgttcaaggggctgtgcctgtgctacgccgtggtggtgacgacgttcttcagcgtggccatctcggggtactgggcgttcggcaaccagtcgcagggcacgctcctgagcaacttcatggtgggcggcagggccgtcatcccggagtggctgctgctcatcatcgagctcttcacgctgctgcagctgtcggcggtggccgtggtgtacctgcagccgaccaacgaggtcctggagggcctcctgtccgaccccaaggccgggcagtacgccgcgaggaacgtcgcgccgcgggtgctctcccgcaccgccgccgtcgcgctgggcaccaccatcgcggccatggtgcccttcttcggcgacatgaacgcgctcatcggcgcattcggcttcctcccgctcgacttcgctgtgccggcggtgttctacaacgtgacgttcaagccgtccaagaagggcgccgtgttctggctcaacaccaccatcgccgtcgtgttctccgcgctcgctgtcgtcgcgtcagtcgccgcggtccggcagatcattctggacgccaatagctataaactgttcgcgaacgtgtgatgttattatgctttaactcttgacaaaggaacatcaatgcaggaagaagattttttttccttttatttttcttttttttaaaagaagtcatcttcccacttatgtttatattatatttattaatcatttattagcaactaaaaataatttatagcatgtctttagtgatttaaaaaaaaatactgtaaaataaactacaacgagaaaataacaaaatcaacgccaaaattgagttttaaactttaatttttatcttatatgcataagcataaatcaatcgaggcagaaatatagcctgagtttcgctcagaaatgtgtgttctgtctatgaatacggagagactcaacaccggagacgctttcttatatcgaaggcgtataaacgagaggtaagttgggctcggtactgaaagcacgcgacctcacgcgccgctaacaaaagcccaaagcgacccaggccgtgagtcgttggacgggccaggctcgatgcggacggcccgcacgccggcgtcggcggcgcgcggcggccgggcgctgtacgagctgtacagggcggcgagccgcgcggcggcgccggcggcgcttctatggcggcggctacgaggactggagcacccgtcgcgttggcccgagcggctgggcaggccgtcggtggcgcggcctcgtccgggctcgccgctcgtgtggttccacgccgtatccctcggcgaggggatggccgcgctcccggtcgtacgccactgcgcccgcctccaccctggtctccccatcctcctcaccactactaccctctcatccttgtaagcttcccccattaccgcaaatacgagttgcctggctctctcatttccgtgtaatgtggccatattctatttcggttgttttgatttcaatgcagcgaagtgatgaaagacttgctcccggatggtgtcatatatcaggtgagctcggaaattgctcttgtactttcagatccctgtcgtgacggccggtttagttttctgagaaatggcgtatgcacaacaaatttttactgatggactgttcttgaaaaaaaaggacattttaggttcgaactgtgtcaaggcagatagatattgtctgttcattatatgtatcccttaaactaaggtcatattatactcgttgaactatgatagtaaggtttcgtaatattaaacctttaaggtggtaatattcgatagtacagacacagatcaagcaaagttttgggaacagatggaacttgtttagatgaagggaatcacgaataggctaacagaaggatagtttaaatgtttgatatgccctatatacatctacggtagcttattgttgttttacataactgaaatacatatgtgtgtagtttgcaccccttgactgtcctgatgcaatagaaagtttcattggatactggaaaccaaatttgatacttcttatggaaagtgaactctggccaaacctcattttgtctgcagcagagaaaggggtaagttttttttttctcataatgactattttctactaagtggttaggcttccctttgttacccttgttttttccatgtgcaatggcagattagctatattttcggtccatagtacattctttcactatttaattatctgctgtgaatgaccttcctatttttcagattgcagtggttcttttaaatgcgcgcatgtcattgaagtctttcaaccgttggtccttgcctctagggttgcagttagtctctttgatgctctccaaactatcacttgttatcccattggtatggagtggtggggttctaaaccttattttgatgtaaaattattgccattgtattcatttctatctgttccagagtactattcaagctgttcgttttcaattacttcatgcaccaccacagatcatccattttgctggcgatttaaaatacggtatgcgccatgccaatttttctctggcttcctatgttcatgagagtatgtttgaaataaacatatgagtgatgcatttctcaaggattatcttgggagcttgaaagataaccaggttcacaaactcaataatttatagagattcatgtgatttacctagctgttggtgacattgctgctggggagaaagaggtagctgcaatagaagatcttcagcagcagttcagcaataggcccatctggatggcagcttctatccacaaaggggaagatgaaagtaagcacctcagacacccaccttttctttttattggatcagtattatctgctcttccaaggaactgtgtgcaggactaaaactgtatatatgtagctgttttgcctatggtgatgatcaccattgatatccctaaagtcattgctgacttctttatgctttcctgaataattgaatccttgccttactatgcttatgttctcaacataaaaacaatgttgacaagcttcctctctttttcagtcattctccgtgttcatgatgagttaaccagggcgtatcctactctacttttaattctcgtcccaaggcatcctgaggacagcaagaatgtttctcaagtatgtcaattgtcttccttacccttttatatctggtcctgtttagttgatgaagtagttggtgggttgtactgcttatcttttagttttttttaatacattatcatattgggtaatctataggtgtagcattgttgtaatgaaaaaaagggaactaacttagttcactgtatgaagcttgaaattaattgcttataactgtttgtatacgattacttgaaatttcttatggttctagagcatgtagcatatgattctcacttcaatgctgatagtataatatgtatgggccacatctttagttctttactcatcttcttttagaccctgaagaaacagaaagtgaattttgtgctgaggtcaacaagagaagtggtgtcttcaaacaccagtatatatgtggttgatacgttaggtttgtgctatctcttatgccttaagtttgcacattttttcagtatggagtatggactgtgtatattcttttgaatgttagttaatgaatgaaataccatggaaaataggtgaattaagaatgctctacagggttactccaatagctgttattgggggttcttttttgcccggcttagctggacataatatttctgaggctgctgcagttggttgcgctgttatgactggtacgcaagagtgcaagacacatctgactattttgaatgactttttctacaaaatcggaatgtctagagtttcattaattgtctttcaggtcctagtgttgggcacttctatcatatgctggtcgaaatgtggcaaataaatcctttagctgtcaagcaggtgataatctgtcttgtactttgttatttatctaactgacacaaaaaatgccgcatcatttgtgcactatgttcgattaagagtgggattactactatttcgtggccttcttaggggaggtattttgttaattattgacttggccttgtccctacttctggaaattagtttggacggtaacaggatgaattgccttctacttgctctttcaataaattatgcttgcaatgtgggtatgctgctttactgcatgggtgattctttttttttttacacctaaacatcgcaaggagctacagcccctttcattctatgaggattaatgcaaatgtttttcaggtcaaaggagaatatgaacttttggaagcactaaaacaactgcttggtgattctagagctctggaagcatgtcaaagagccgcaaaagatgcgttttcctttatgtcagatggagttgtcaatcgtgtatggaatttagtccacccgttcactattggttcccaaacagacacatgcgacagcttctcgagtagttagtatggaaggcttgcacatggaagtatggaaaatcagggtagtcacatttaaaacattgacatcttctagtaacttgcagggacaggttgacaatgtatgagtcctctttattaggaagataaggtctcacgaatttctctgtacagtctgatgcacataacaaacttgtactcctagcatgccggtgacagatgacacaaatatcaaattaaaggccattagctcctcttagcaatctaacatttctgacgaattctactggagcccctctcattttgtattttcttgtgatgtgggtcagctgttgtagacttgcagttcttcgtctcctatcagtatggctgataattgattgtttgactttgtttatttcttgtattggttgatcccctgtaatcaggtttgcaaaagtttgaaaagcatgtcctaacaacttcatgatttatcaggcgtgccatgcgtgacttttactttgactaaatacagtttcagcggggttttcttttgtccggtggcccgtggggagggcagaatattcgatcagctataggtattcacagtattctcccgtttctggtttctcagtaagcaaccacatgcgcagtttgcgtttcattatgcgtgcgaccatatgtgcaggtttgcacattggcatgagacagactgctcttcagccgttctgcatctgtctagcgatacacacacagtacgtgctttaactgcgagaaacctaattcgcgcgcgccggcagcgcgcactcccggctgttttctctttttttttccatacggcccactcggcgtgcgcccgcgaaatctaaccaccgctgttttctcttttttttttccacttttttttcttccctgatttttttcgctttcctttttttttctttttttcctgattactttttaatcttctagcagcaagtgtttttattttttaaaaagtttttaaatcttgacttaaaaatttttaaatcttaatttaaaaaatttcaaatctcgagttgaaagttttcaaattcgagttgaaagttttcaaatacgagttgaaagttttcaaattttgagctgaaagttttcaaatctcgagttgaaagtttttaaatttgagttaaaagttttcaaatctcgagttgaaagttttaaaaaattttcttgcaaattgaaaactttcaaagttcgagttgaaagttttcaaaatttgagtttaaagtttaaatcttaagtcaaaagttttcaaatgtaacttaaaatttttcaatctattaggaaaaagaatctcctaataaaataaaaaatctattgttaattaccatcattatccttaactaacagagttagttaggctaccgcgtcggcgtacgcacatactaggaacgcccctttaactgcccgtccgtattctcagaaatggagcaaaaagccaaggcaacgttcagagcaagaatgcaggatatacactattcagcgttttatatacgtcaatggttttcaattgagtaaattgcatcgccggtacacgaacttgtcagatgggtgcaatctagtgcacgaacttgtaaaatgctcattttggtgcatgaatttgtctaggtgcgtgcggagaaaaccgaaaagtacactacatggttaatcttattaatttaggggttgattaggatactatgtaaacatatatctaagaaggttgccattagacatatctattcaataaaaatcagaaagattaaaaaacttagcactaatataagggttagaaacatatgagattcgttatttccattctgaaggataaagttaagacgaaatttataaatattacgtgtcttatgcatactcactatacgtatgcacgtcacatcctaatgaacatcataaattaacattgctaagttattttggtcctcgttcgcacgaactagacaagttcgtgtactgaaataagcattttacaagtttacgtactaaattgcacccacctaataagtttgtgtaccaccaatacaatttactcttttcaatttttattaaactacagagctttccttcttgaaaagaggaaaaaggcctacgtgtcaatggtttcagttttattgacaccttcacaaaggaatataaaggggttgttgtacgacgaaatcccgttcgaacgggatgaaaccggttgggtatcaggtataataccttatagttatcagatctcaagtattatctaataccttagggatatcaggaccttatacctaactagtatcatcccatttgttgtagtagggggtgaacgccatccctatgttcggcaaaaacacacacaataaggaaatcgtatttgagccatgcaatctgctcgaatgaagttttgacctgtaacaacccttgatcgatcatttgcatttgcccaagaaatgtttattccaaggaaagtgcgtttgagtagtttcacttgctcaaatcagtattccctccatctcagaatataagaagttttagagttagacacagttattaagaaagtagatagaattaagagaaaatcccttatgtatctatgaaagtttacctaatccattctatatccctgaattttgctcaatcccttacatacctctgaattttagtttggatcccttccatgccttttccgctagttgaccgttagttaaccgttaaattcttttgaaaaaaagtccattttgccctttgctacgaagaaacataataaattaatgaagtatattgttggaatgtaaaaatttattggatgagactattatatttatgagtctgtgatgcaccatattatttgtgacaaatttacttttacatatgatataaaaatttaatacttatttattagttattaaaagttcttttatgtagcatgtgttttcatagtaatacaacagatttgtttattactatcagaacacatatgctaaaaaaataaataagtattaattttttatgtcatatctaaaagtatatttatcgcaaataatatggtgcataactatctcataaacataatagtctcatataataaatttctatgctccaacaatatactctattaatttatatacttctttataccaaatggcaaaatggactttttcataagaatttaacggtcaactagcggaaagggcatggaagggatccatactaaaatttaggggtatgtaagggattgagcaaaattcagggtatagaagggattaggtgaactttcaggggtacacaggggttttctttagaattaaatagggaaaggttgtgattggttaagaagtggaggtagttaggaaaagtgaacgatggagggttgtgaattgttgggaagagaatgttggtgaaaaaaaatgttatattttggaacaaatactgagtgttaaaggttgttatatttttggactgatggggtatattactaacaacacaacgtgtttggacaattctcttcacttagcaggtgagaagccagaagatgggaaaaatgtattcaagccctcacgagagagacattactctacccggatgattgaagtcaagggaaagtatcattgagcaaaagaacatgtctcaagaaggtaacaggggatcactccaactacaaaagaacatgtctcaagaaggtaactggggatcactccaactacaaaagaacatgtctcaagaaggtaacagggatcactccaactactctcactggatgttacttgaagaccactaaaatatagtaaaatgctcttaggattgtaaactttataagggtagtatgataatatgtaggccctcaggggcaaacttgtaatctcaagtgtatggttgagagtcatttaagccgacctagatcctgtaagcagggacaagttcaatagagaaaaatacttttcactcactttgcttttgagctcactctcaggataggcgggaaactatacttccccgtctatccccaaatttgtccgtaccctaaggtcacgataccgttcgaacgagatatcgtcccgtagtattcttgtaaatcaatttcttgcaatttgtttagaattccccaggaaatcacaacatcataaaaaaaagaaaaaaacaattctaaaaggttaataaatgcagagcttttcatccttttgtcggagtttgggggcaatgcgccaagccgccaacaccatgctgccctcccactctccagctgctacccatcagctacccacctcccctcgccgcagcacgcgccccgcgccgccaccaccatgcccatgcccgcgcgccggcgcagccccggcggccgagtctctcctccctggatgccttcgggcggagtcgctgccccggcacgtggcggtggtgatggacgggaacgcgcggtgggcgcgggcgcgggggctcccgtcggcggccgggcacgaggccgggcggcgcgcgctggaggagacggtgcgtctctcccgcgcctggggcatccgcgcgctcactgccttcgccttctccaacgagaactggagccgccccaaggtacacacgcctcgccgccgattccttcgaaatctctgccttcgccgagcttgacgcgtcctcgccatgttggaattcgcaggtggaggtggacttcttgatgaggctgttcgagcgggtgatccacgatagcgtcgccgagtttctgaggtaaacatccgtacttgcaaattaaataattagttaatgcctcacgcgttcacaacacttggctttgtggaactggaagttcgccaatagatgctcaaagcccacagtgctccgggcgtaccagcaactcaattaccagcttgtaataggaatttcttgcaagattcataggaaaaagattcaattttcacaggagccagtataatttcctgccaaagtctaatgtgtacatgtcatgtggtgatgtggacaacaaaatgaggattttttttttccacagggaaggaattcggctacgtgtaatcggtgacagctcaaggctaccggtttctctacagaagattgcgagagaagccgaggagaccacgaggaacaattcacagcttgatctgacactggcaatcagctacagcgggaggagggacatcgtgcaggcgtgccggaagcttgcccagaaggtgcagagcaaggcgctcgcggcggaggacatcgacgaggcgctgttcgccgacgagctcgagacgagctgcgcggccgacgagttcccgtaccccgaccttctcatcaggaccagcggcgagctgaggctgagcaacttcttgctgtggcagtcagcgtactcggagctcttcttcaccaacacgctgtggcctgatttcggggaggctgattacctcgaagcgctttgctccttccagagcagagacaggcgatttggtgtaagaaaattgtagcacaaacatacaaaagttgaagcatgaaaggtatgtgtctgaaaatgctcagtgatagttggcaggtaaatatcagtcaatgcttatgacttggttctctgcaggaatgttgatcaagaagcataggacatcacatttttcatgttagttcaatacttcaattatccatgttaaaggcaagtctgaacatacagtacaagaagagccaaaaatatgtagaaaagcaattcagcaagtgaaaacaccatgacaactaggcatactgagtagaaaaatgttgctatgaaattgcaagatgaggagcacaaacacgaatgtcatgtatatggcatttgattcacagaaccacaaacaaacaggtttatacaaggaacatatgaagagtataatgtattcgatttattagaaccacaaactagatagcagtgaatcattcattgtgtactcgacggagtagtactagtattaacggccaagtaacatgagattggccaacttatttggtttcagttcctttttctcacatattcctgcatcttcttttt

SEQ ID NO: 59745 - DNA, 4754 bp, Oryza sativa
  unsure (1)..(4754): unsure at all n locations
acgccccgcgccccgccccaggcggccgtccccggaggaggggccggtgccaccgccggtggggtcaccatgcggatgttccacggcgacgtgttcctcggcgaggcggaggtgttcccgatgaagcagggggccgaggggagcctgccgttcccgagcaacgagatccgcatcagccacctctcgccgacgagcgagcggtgcccgccgctcgccatcctgcagaccatcgcgcccttctccgtgcgatgcaagctccaggccaagctgatgcctccccacccgagcctacaccgcctctacctcacttgcttcaacgagtacaaggtttgcccccacgcaatttctcaacaatcgctcatgtccatcgctttgtattagtatagctggtactcccattcgaaatcgaagcgaaataagttgtttacagcgactacttgggaaatggtattagcgccacttctaaattttggggcaatcaccagtaatcaaagcgttttacacattctattatggatcttcgatgggttgtgtgtttgatgtggtttgattcgttcggatgatgtttcccattgatgatatttccatcaggggcacgaaataataggatttataaaattttttgtctccttgggtttgtgtagagcgcagtggtagtagttggagatgaggagctacacctagtggcaatgccgagcaaggtggagaaggtgccatgcttttggtgctgttcagtacgctctgggatctatgcagcatctgttgggatgctgaacttgcggtgccttgctatcgtatttgatctcgatgaaacccttattgtcgctaacacaatgaagtcctttgaggaccggatcgagatgctttcccgtaggatggatattgaagacgaccccgtcaggatagcagggatgtctgcagaaatcaagcggtatattgaggacagggagctgctcaaggagttcattgacacagatacagttacagataatggcagaatcgttgggacccaaaaggaggaagttctgcctatctctggtgggcaggagcgtgttctccggcctgttatcaggctgccagaaaggaatgcgattctaactcgcataaatccagaggtacaattcagatagatcatgtataaatatatttcatttaaatgaaatgttgttatcgtttgcctgtgtgcatgtttttggcctggggttatctagaattacactttgaaatcagttggacctattcctgggttggaaaaatagaactgggctccaatttgctgcccacaaaaggcatgctgtatgtctatttggttattagcgatggtacaaaaataagttctataaatgacttgtaattgctgcagttttgatcctcggataagacatatttgttcaggctcattgtttctacctacaggtctgtatgatctgcatagttacataatttgctttgtacatgtgatgtttatgaataaaacagatgcagaaatgaacttgtagcctgatggtttgggaaatgatgaaataacaattaacacaaagtttgacaacctacacacaatgtgttattatcagctcatatgtttgctgccaatagaaaaaagagattctattttagtaattatttttgtaatgcttatctgagacgattaatcaagctgattaagtcattctggactgaaaatgggctcagtataattctcatatgtctagttattcaaaattttgagataactagagtttttaattattgtagaattctgtaattagttcccttttttgaggtgattaccttatcccctgtctgattttaatactctgctcaggttcgcgatactagtgtttttgtaaagctaaggcctgcttgggaggatttgagaagtcctgactgtaagggacgcaaacgatttgaggtctatgtatgtacaatggctgagagagattatgctcttgagatgtggaggcttcttgatccagaagccaacttgataagctctcataaccttgcagagcgtgtagtatgtgtaaagtcaggtaaattttcaagaaattggaggttcttttttttctgctatctttcattgctttcttgtctcaacatgttttgttatattgacatcgttactaaacacagagtagctactttaaaacactgaacacgaatattctgtgttatctatcttttcatgtacaatgaaattatgttgtgtttccaagttattgagaaggaatgggttcggtattgcagattagtgtcccagagagaaaacccatagtttttctagcatgtatcgttcattcccttagtattgtatttcattcttatccttacaacttcaaatatagtgcataagtagtactaaatattgtttaaatttgtataaaacttattcttagtttaaacaatataatatttgtgtagaatgcttaagtgaatgagaaattgcgctttgccattgcccattatatggataatacataacatagatcttcgctttactatctctattgtctcagctctggactatgttcctgccataatttcatggacataaccaccaatattattcattattctatttcatggcaggttcgaaaaagtgtctgcagaatgtttttaaagacaaaggatgccatccgaagatggccatggtaattgatgaccgactgcaggtttgggatgagaaggatcaacctcgagttcatgttgtcccagcatatactccatattatgccccacaagctgaggtatttatttgtattttattgcttacactttttttggtcaacaatatctcattctggaccctgtttgcatattttagatggcaaatgctgtgcctgtgctttgtgttgcaagaaatgttgcttgcaatgttcgtggtggtttcttcaggttggtaaaaaatataagataccgtatgtgcattctgatgatatcatgcttactgttgtaatgttattctttgcgttcatcaatgcattgcagagagttcgatgaaaatctattgagaaaagtgtttgaactaatgtatgaaaatgagttgctagatcttccatatgctcctgatgttggtgactacttagtctgtgaggtaacattattgaatcgttgttattttgtgtgtgtttattttctaaatggttatccaactgctaattttgttccaggacactaattttgcaccaaacaataaggatgttgcccctatacctgagggtatgagtggagctgaagtagggaagaggttgaatgggctggtgagtgctgatcttcgtttctgctttgctttgatttttagggacttgattttttttttcacctagatcaaatcagctaatgatgcctatttctatggtaagcgctgttatacagcataatataaatgctgtcatgtagcttgatttcaattatttataaccatctactttgtgttatttcattttagaagaaatgtaggtgtatcaaattgatccttctttggcttacaattggatttgtccttgtatcaaaattaagtccacagttctatcacttagctagcaaaatcatcactagtttctttatcagtttgtaatagactagtatataatgatcatgctagtgtgttccttatttcaggcatatcctagagaccagaaacaaataccatcatcaacccgtttgtcaggtacttacctcatgtccattatctttattggctttcttttggttcttcttcctgggctttcttgaacccttgcatttataaatcactttagtcattttttattattaccttgcggacattaaaagagggaatggttttctctgtaccattttttccctgtaaaggaaagagtactctactatgaaatgcagcagcatcaacattatgcttgaaaatcctaattgtacctcactattattaaagaagtacaattcatatattgttttggatctgtaatttgatgcttcgagtaacataaaccaatctttgtagatgacgacggagtggcactccgtggcattccaggtggtacaaatatccaatctaacgggggatcattggcaacaaccccctcattatttgtcacggtgttgcaagaaattggacggctgtgcgaatccagggtatttggatctttaagattatatttgttttctgccattgcccttatgagctgagagtaatctcctgttctttcttcattaggtggagttcaggtctactgtaagcagtggaaaaaacatgcaattttctgttgaggttggcattttgaatttttacatattatacttcgtttccatgtggtcttggcaacagcttgggctgaaattctaattgagaaaaatatatatttagaatgttgagacacatttcctttggcgtctcaactctcaacttcagcatcagtccagtgcttttgctctgaagctgtttgcttgcgggtgcattaccagatttgtatagcaatgctgtgatatctctacttaatcatgtgatcctcatgttacctatacatatgatgttccaggttctatttagtaatgaaaaaatcgggatcggcattggaaaaacaagagatgaagcccaagtactagctgctgaaaaagctctccagaatttggaaagtgagtataatcctttacatcttgattattgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 59746 - DNA, 7974 bp, Oryza sativa
  unsure (1)..(7974): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgagccttcggttagcaatcggattagagaggtagaagaagtgcattggcagggaaggacttgcacaagttattttccgaggtgaaatgagcagtcaaattggaatttggaaggtacacagatgacacaatgcaaagctaaagttgtatttgccatttgggaaacatggagagcaaagttgcagcaaggctgtatagaagatgtacaattgattcttcatgaaattacgaagaaagatcagtctaaattacagttacagtgccaaaagcggaagaaatcgtcctcgtatgctaatggagggatcctaatgcttagtacacacctccaatcccaccatcatatcaaaatttcgctactatttcaattcgtctatcaatctaatcacaaaaaataacccaccttacgaagcaacattttacactgagccactaatacaacacaatcctccaccggaaaaaagtggcataacgtcgagcaccttgcgcgcacgcgctctaatggtagaacacgacgggcgggacggcgataccggcgtcgttgaggaaggggactacctccggccggtcggcgaggtcgcggtagaaggcgtactccgccttgtagtcgtggaggtccagctccgccttctggttgctgtggtaatggtgcttcgcgtcggccgccttcccgaacccgaacacgctcaccctgtcgcacactcccacggcgaccatgatggcctgcatccccgacgagtagtggaacatggccgcgtcgcgcgtgctgctccactcctcggccgcgcgccccgtctcggcgacgaagcggcggagcgagtagtacttgacgatgcgcgcgcagaggacgtcgaggcgtggatcggtgacggagatggatgcggcgtggagggagcgggaggaggcgttgcatgaggcgacgtcgaggaagtgcgcggcctggcagatgtagagcaggatggggacgccgtcgccgtaggggtggcagaagcagttgggacggcgggcgcagagatggaggacgttgctgttgatgaaggagaggttggtcttggcgccgacgttggcggcgaagccggagatgcgggcgttgttgaggcggaagacggcggcgtgggagtcgatgagggcgccgtggctggcgccgaggaggatgccgctgttgcccacgacggcgcaggaggggatgcggccggggagggagaggagggaagggagattgcggaggacgccggggtcgtgccggcggaggcggtgccaggagcggagcgcgcggcggagggatgggtcgaggtggagctcctggcgcgggagcgggtggaggagggggtcgtggtcgtgatccgggtggtggccgcgccggtagacggggaactggtggtggcggaggtgaaggtggagcctgtcgccccggaggcgccacgcgcgggcgcgcgcggacgacgccgggaggcggccctcgaggaggtcgtccacgtcgcggcgcagcggcgcctccgatggatcggccgcggcaaggcggaggagcgtggcgttgaggcgcgcgggatcaagcggcggcagcggcgcgagcacgggagccgggcccaccgacctgcgcaacacggaggggaacgaggccgcggcgcacagcacgacgaagaggagcaccgcgaacgggcgccgcagcggccgcttcatcgccgccgccgccgccgcagcatccgccgccgcgggctaagtgggtcggggccgccgcatggggggcggcgcatcagggagagagacacagggagggttgtgttccgttccgtgccgtgcgagctgagctccgagtgccgcgcggtgtggggcgacgagttttttatcggacgcgatgcgttccggttcgcgaggtggtactaaaatagggagcgtgatatgtttgcagtttgcggttggttggaccttgggttcgggggaacgggggatccaatgtgctctggttgggttcgtgcattggagggagtatataatgattctctgcagggaacagggctgcgggcgtgggtcccacaacaagcctgtacgcatgacaggtggggccgtcggtatgagttgctaagcttggcgtggccacgtggtgtccagcgtagcgttcgatgtgtgtgattcatgcagaaacgcaatgaactctgtacctcgcgccacatgacgctttttatgattgttatacggcctcctcggagtattaacaacctgcatccagtgttttacgtgtgcaagctacacgttcaaaaaaactagtactactagtagtagcgtatgttttcggcgtgtaagctatgacaaaaacagagaaatttcgttgtgttttacgtgtctgtatagtagaatttaaactcgtcgcaatcgattcattgaattctttccaactcagccagcctaggccggtagacttggggtcaactttggccggaaccaatccgcctcggttaatccacgccctgatgttgccgcccccagccgtcctggtcttggtcttgtcttgtttatcaaacatcagaggttcagaagcgttcaaccctctcaggccgtacctttgttaatcttatattagcgataataaccaccgctgtaggttacagagatcggcgcaggtggatggatagatatgctcctattctattacaacaaactcaatctagccttatctaatcatatctatccatctaaccatgccgtgtgcatcacacaaatacatatcacatgtttaacaccctccctcaatcataactttcctaagttaagattgtacttaaaattctccaactgtcgaactgacaaagcctttgtaaaaccatctgcaacttgatctcctgtaggcacaaaatcaatttctaacaatttccttgaaactctttctcgaacaaaatgataatcaacctctatgtgtttagttctggcatgaaacacaggattagcagaaagatacttagctcctaaattatcacaccacaactttgccatagatggactctcaacttgcaattctgccaataaagtctgtacccacataatctctgctgtagcattagccaaagctttatattctgactctgtactagatctagaaacagtagcttgtttccgtgcactccatgacacaagattatctcctaagaatactgcaaaacctcctgtagatctcctgtcatctagggaaccagcccaatctgcatctgaacaagcacttactaacatagatctagacttgcttaacttaagtccaagtctagtacattgcttcaaatatcttaaaattctcttaacagctgcccaatggtgtgtagttggagcatgtaaaaattgacaaaccttatttacaggaaaagcaatatcaggcctagtcaatgttagatactgtaaagcaccaactacacttctataatgtgttgcatcatttggtcctaaaggatctccttcatttatagacaatttctcacttgtagacaggggtgtactaaccggtttgcagtcaaacatatttactcttctcaacaaatcattgacatatttatcttgagtaagaactataccaccagacactttagttacctcaataccaagaaagtaatgaagatctccaagatccttcagagcaaactccttttgtaaatcctgaagcaaggctggaacagcttcctgtctagaactggtgacaataatatcatcaacataaatgagtacaaatataatcaaatctcctttgttataaaagaacaaagaagtatcagccttggacccttggaatcccatatcatataacttcttgctaagcctagagtaccaagctctaggtgcctgctttaagccatataaagctttatcaagcttgcacacataccctggcaaagaactgtcctcataacctggtggttgtttcatatacacttcttcttcgagaactccatgaagaaaagcattctgaacatctaactgtctcatacaccatcctttagagacagcaatggaaagaataatcctgattgtagcagctttaacaacaggactaaaagtatcttcataatctatgccatatctttgcttaaacccttttgcaactaagcgagctttatatctgtctagactcccatcttgtttccttttaattttatacacccacttacagtctataacatttctacctttctgaggtggaactaaatgccaggtcttattattttgtaaagccataaactctgcatccatagcttttttccaattattatcttttaaagcgtcatctaaattttctggctctccagtaacagtgagaaaagtagtcctatatttaactgtaccatcagtataaactttttccttacgaataatgccactttgcaacctcgtagccggtctagatattacctggtgctgttgttgctgtgtatctacctcccctgcaacagaagcatcaagagacgtggatggctcctgtgagtcagaggaagcagtaggagacgtggcatctggagattgcatggccacgggtgagtgcgccggtgtgagctcgacatgcaaccgatcaggagagcaggaggactctacggtggcctccacacgacgctggaggacgctcgaagacgctgcgtcagaggtgtgaggggagtcagccgctggatctttcgtggcagctgtggctgcgtccgcaccatctggagctgcattatttgctgccaaattttcctgtagcgataattcatctccagaaatttgattagcaggattagtaggaacattagccacagtggtactcatttgttgcaccccaggaataataggaatatcaagatgggatggcaataataaaatttcagaacgcaattttgcaccggcattgggatgaagtgaggcaaagggaaaaacattctcataaaaaattacatcacgggatatgtaaacgcgaccggtggaaggatctagacatttgaaccccttatgaaggggactgtaacctagaaaggtacattgtttggaacggaattgtaatttgcgagcattatatggtcggagatgaggccaacatgcacacccaaatacacaaagaatattatagtcaggagtttgtttaaacagacgttccaaaggcgttgcatatttcaagagtctgctaggagtacgattaatgagataaacagcagaagtaaaagcctcatcccaaaactttaatggcatagatgagtaagcaagaagagcaagacccatttctacaatatgcctatgttttctttcagctgagccattttgctggtgtgtgtgaggacaagacacatgatgagtaatacctattttggtaaagaaggaattaagtttctcatattctcctccccagtcagattgcatcgctaggatttttctgttaaacaatcgttcaacaagagcctgaaactcatggaacttttggataacttcagatttaaacttaattaaataaatccaagtaaacttgctgaaatcatcaataaaactcacataatactgtttgcctccaacagaagtgggggcaggaccccaaacatcagaataaataagttccaaaggatgactagatatactagatgatatagaataaggcaattgatgactctttgccttttgacaagcatcacacacagactgtttattagactcaactaaacatgggagattatttttgctaatgaccttctctacaattggagaggagggatgaccgagacgactgtgccacctttcaaaagatggcttggagactccataaacttctttggttgagtgtgcatgtggcggtgtagatggaagagcatagagacgaccacggcagggccccctaagcagaagtttcttcgtggctagatccttaagattgaaatatttagaatatagttccataaaggcagaattatcagaaacaagacgttgagcagaaactaaatttttgttagccttaggaacatgtaaaatattgcgtaaatgaatatcacgactgggggttttaacaatagagtgaccaatatggctaatttccatacctgcaccgctagcggtatgcacttgatcatgtcctttgtagcgatcacgaacgatgagcttctccaactctcctgtcacgtgatcagttgccccagtatccacataccagttggtatcgataccataggaggtggctgcagaacctgcatacttctcatctggaacaaaatcctcatcataacgataccaacagttgattaccgtatgtcctcgcttgtaacatagctggcacttgggcctagtgtcgacgccacctccttgacgtcctccattgaagccgccattcccgcgaccacccttgccgcggtttgcgctgttgttgcctccattgccgccgcgtccacggttgttcccaccgcgtccgcgttggcctccgttgccgccggtggtgccgcgccctcgattcgccaggtttgctgacgactcgccgccgtgacggagattgttgcgctgctcaaagctgagcagttgagagaaagcctccccgaaggacatcggctcagatttgccgacgattgaggagatcaccggttcatacgtgtcgtcgaggccggcaatgatgtaggagatgagatcttcgtcgtcgacgaccttgccagccgccgtcatgtcatcaccaagtgctctcatcttggcgacatattctgtgatggagagatcgccctttttggtgttggagagagcgatccgagtgttgatgaagcgtgcccttgtcatggaggtatacatctcctccagcatgctccaggcggcagctgcagtgccgcaggtggccacctgcgccagaacatctttggacagggtgctcagtagaagccctaggatctgctgatccgtagccacccattcatcgtaggcgggattagccgccctggtggccttgtcgccttccttctcgcctggcacggagatggtgatggccggcgctgctgtggtgccagtgagatgcccttcaagacgagctcctctcaccgacgccaggacttgcgctttccatagcgcatagttgtttttggctaatttctctgagattgcggttcctccgaaaggattagtggctgccatcttggacgacgagctggccatagattggatcgggatttgtttagtggaaaggctctgataccatatcaaacatcagaggttcagaagcgttcaaccctctcgggccgcacctttgttaatcttatattagcgataataaccaccgctgtgggttacagagatcggcgcaggtggatggatagatatgctcctattctgttacaacaaactcaatctagccttatctaatcatatctatccatctaaccatgccgtgtgcatcacacaaatacatatcacatgtttaacattgttcactcgatcccctcagatggtcgaagccgtttggattaatccggtttacgtcgctctcctttgttccgccgtgcagctcgatttctcggattatcattggcacggcggcaacgtggagtcgtcgcgtttgccgctggattaatctgtctctgtccaccactacgacaactagaactccagtgattatttattctttgcagtgtgtttcccccgccataatcctcggcctcgcatcttctaatctagtcgggatccacaatggcaagcactaagaatcttttttcaagcactttgatcagctcaggattgatatggaaatcggaaccttcagttcagtgctcgctcgctctttagctggcgtaaagtgttgttgcgaatgcattgcacgccaagattagtttcagctgggtgatcatgagatcatta

SEQ ID NO: 59747 - DNA, 4424 bp, Oryza sativa
cgattttacgtgatgtctatgactaaaaccaaatttgacgaggcatgtctgtgacctgcgaagcttagcacacgaaaatgactggacgaacgaacacgatacaaaagccaattctgtcacaccatcatggaaaggaaacgatgaatggagacggctgtagacggtatccagtaaagctgaatatttcgtggcagagaaagctctatcttctggtagaaagatgcattccatgttgtcctggggagcaatgggcgcggttatatacaggcgtgtggaatggcgctactaccatgttggacacgccatgttggacactgcctgaacctgaaaaagttgtattcctccgttttataagagataacgctcttaactttagaacactccgttttctaatagataacactatgaacttttagacacacgtataattatttatattatttaaaactttaatgcagatgcataaggtaccgtaatgtttttttaactgttcggagtggcttgtcgtcggcttcagctctgcagagccagcaaagcactttgtgttggtatatctgaaaactcaaatggaaatgattgaattaggatgtttgcagctcgtagagaccttttttatatataaaagttactccctccgttttataatgcaagtcattctagcattgctcacattaacatctatataaatatgggcaatgctaaaatggcttacattatgaaacggaggaagtagtcgatatagcggaacgacgactaatcttctcgatcgcttcaatcaatgatcacccaagacacgtcagataacgacacaagaacacacaatatttgttaacgaggtttagccgaagcttatgtcctggggttttgattatgggcgctcctcaacccatataactcctagccgctacaagtccatggccacaccaccatcatctccatgcctctctatttaagagagttgctaggttatagagtccgactctacctctaccccctaccacctattacaactttaaatccaactgtaaccaaatagaattagtatattcgacatctattctaacaattttcttagatctcccccgttccttgcgagtaattgtcaatgggcatggatgatttgaaggatgctgttgatggcaggttcacagattctattgtggaggacatctgctgccagaagagatgttcacaatgcagagattattgcggagaggaaatgatctggtaactcggccagtttaatcaaacatttgacagcatatcttaggggactcagtggctcaggaagttaatcagcacagaacaccattggcatgcaaacctgaaaaggttatgctgcatgaaactgactggacatacaacccctgtatgactgcatcaagaaatagtgaatcaccatcttcagtagattgtctttggggtttgactgctctctatttgatcggtacagatatgatgatactacatgttagctagcatctcatctagaacaaacatcatagcccaagacatacaactttcctagtttcctggcatagagtggagcaattacacattctagtttcaacgagaagggaatccatgttaagcacttgtgcattagataaaaagatactactccggcaggcagcatcagagaaactgaccggatagcatcagaacggaaaactgcaaaggtttccaacatcttctctctaaaaaaagaaggtagcatgaatcatctagatatttgctactccaacaacatatgcattccaagcatctgcttgattgaaatgctgtaattcttcatatttcacatcacggttggcattatattctttagcatttccacttgattgggtatttggcatctccctgatccagacatggattgatttaaatccagcttcctccaagcagtctttgatttctggtatcgaccacctacaaaggagcaacatgaatttcgaatttgaaggtatccttcctctttgcacaggactaagatgtcctgatactccagtgcaactctaaaacaaagttaacatgcgaggaagtcatgcaggtagtgtagggtgtgttacacacagcacttgaaaaacaatcccgtacatcatactcttcattatgaagagtgcaaagatatagcacgtgaaaaatctcctcagagatatagtagatgtagaagtggttggtatcaatatatcacagaggtaataaagtggcattgcctttggttgttccctgtgttataatttgggaagaagatgtaaatgggtaatgaactctctgttatcttgagttaggcctaaagggaaaatatagattacaagattggcctagaaacgggaaatgactacaatacccttgactaatacacatgtattctaaacaccttgcacatgatattaataccaatctagtttcccccctgaacctgtagaccggaggaccggactaagcaaaatattttcaactttatattttaataagaatttctatagttctttttgacagttacaaccttgcaggttttccataacacggtgaagatccactaaggaaacaggagagcaataataattatgaaatataccattctcaatagtatgtgatcaacttacaggcgccaatggtacgtgaaagcatgccgtaacatttgcttctttccagcttggaagtggagactgatccttgtttggtgacttatgatatcgaactcttcttgctcccagaaatactgaatgcatagttgtatcttgtatgtaagaacagtaatataaatctatatataatctcattctcattctccaaatcgcacgccattgataattggacaactctatctgttgtttatttcaactagaataaactacacaagggaaaaacctatatgactgataagtgaaatggacatcgagtcataaaaaggaggcacaaaatctcaccataaagggtaacaacatagcatatatactttacaattatttcagaatagctagattgaagttgtataaaaatatagctaaccgctttagaatctataaaaaggaggcatggtcaatagaaaattgtatttcggactaaaacattcttttatgttgcatactactactactgcaacatctttatgttggaataagcagattctacaagcagatagtgtgaattttcataaaaaagaacgcagttttttcagggcattatatgcctaccacatttctatctggtgagcaagaagatagcatttagtggattcgtaactagtataagggctaataactaacacaacatcactcacagtgaagctggggaacctcctctgcagacgtagcttgcgttcagatgatgtgccaccatacacatccattacaaatataccacctcgttttgacagtgcattgaaagcatgcctaaaatacaaaaccaagtcctttctcctgtggagacaacagcaactgtagttgaatgcacaaataatgtctcttgccggcaaaaccaaatccgacatggttgaattggctgagcattttgggctagcaggatccaactgatcacagatgttacttgctaaagagtcattatcattgtttacgtgcagatcttgcatggcatcacagatcttttgcttgactaggcgagctacatttggctgtagaacatttccatggaaaagtagcattcttgaatacccatcagctccaatcttgctcaggttgttttcaagacaccactcaagtgactcaaggtccaaatctaagccaactgctgtacgccttgcatcagtacgaagccactcagcactgccaacaggaaatcaaacaatatatcatgaccaagaagccaaaaacacatgcatcacacagtcacacactaaagttaactgatctcttgattgttgagcatcattgatcaaagttctccaaagaataaccattcaagcatttggcacatttcttgctaatggaactgctgaagtcttcaaccacacatgcaatgtgtgaaaaatgacagacatggacttcatcgaaaagtttagtgcattgacttgaggagggctgtgccacagaaatcctcttggaagtgcagagggacgcgcccgccgacgtacataaggaagaacttatgcaggtagctaatgtccccttttggcgactaaacacagacgcatactgttagcatttcgtcgaacaggttcggtgcacggagacttaatttcaccgatctatcccactagtgaagctagcgagattacctggacggagagttggtacaggtggaacttggaaggcatggaacctacttcccgctgctcctggtcacctccatccacacccccttcgtgttcgtcctcggctgctgcttcgtcggtgtcgtcaccgtcggagtcctcgtggtgtggcggtggagcatcataggcagatgaagggctgcaggaa

SEQ ID NO: 59748 - DNA, 1389 bp, Oryza sativa
acaccacccttgccccggcccccaatcccaccccagcccccgtccaaaccctagaaaccccagctccaagccccgccagtgcgcggccgccggtgccccgcatgaggcctccgtacactcacctggcctcgcccatcacgatgtcctcctctccggccacgggcgcggcctcttcctcctctgcttccgctccggccgccacctctgcgtcctcatctgccatgccacggggaggtgtagcccttgggctaccagcgcacccgcgtgcgccgcagacgcccgtcggctacaccgggttcgtgccgccgccgacactcgccgcgcagttcggctcgatgcatcggggtcctgaccagcccccaccatcctctacacaggtctgtatctgatgcttagctccgcacttttatattctggtgtgattaagctctcggtagtatgaggttttcatttggtcaggaaataactgatctggatgacagcaagaattacattcttttatataataatgacacgatatctgatcccatgttagtaaatttcttgaggaaaccatgacttagtaggattatcttgcttgatgtcacatgcttgttatctgcagttttgtggaacccatttttcaattttagttatccttattcagcatgggggtctgaatgtgggatggagaccaacaagtcttcgcgaaatctgtaccttggtgatttggctgcttaaatcctaccccctgatgttttagctaatttctttcagccaacaatcccagaaattgtcaaatccagctgacatttgtgtgcgtagaagaaatgtagatgcatctgacagttcagctgcgtaaaacattaagtggagcttattgaactctaatattgttcttctgtgacttactaattactactgttctaaacgactatagttgttaatacttcttcatctttggtacttataatattttagttggtgctaatgaactaatgatgattggttggttacgggcatgttcagattgtagccaaaataaacctttggcaagatggcaatattgccaaaattttggcaggatttcttatgtatttaccaaatttggcaacaaactaaacgtagccaaaattttggcaactttgccaaaaaatggtatggttgaaaatggcatcaaagtgaacaggccctacatgctccatctcctctcgcataaaattttttacaccaacacattcatcctcttagagatcattaattcccagttcccacgcagccaactcaaatgtacatacaaaaaaaaacatatatagtccgaaaagttgttcaatataatccagtataaagagagccaatttccattgcaaagtacatgcacgctgttagttgaaacatattgcacctttt

SEQ ID NO: 59749 - DNA, 711 bp, Oryza sativa
aaaatctgagtaacttcttgggtaaaacttgggttttacaaaagacttggaaaacccgacacctgggtcggtgcttgtgaactaaatgaatttccaaaaccgcggaccggggaacgtaccgggtgtacggtttcccgctcttgcacttaaggaccgtttccttggaatttcatccgaacataggacaagtacgaccacatgggtggaatgggacacccctggctgagtaactagcttatcaggggagccttgatgccgagagacatgtggattcgccggggtggtgtcggggaggacccccgggcttcctggcacagtatggtctgggacctaacctgttgttggtctgggacccctctcgtcggcatatggtaaacctgtgtcggctttcgaaatgccttgtcatgaaagcttggaggtctcccgacgtggctgatccccataagctaggtgatccgggttagtaatgtcgtgtgggtaaagtgtaccacctctgcagaggttaacaaactgttcgaacagccgtgcccacggtcatgggcggatgtgaggtgattcctagcgtagttttgtttgactactgccttgtgaaatttgctgttgtggaaaggggatcgatgtttggaaaatctgcagctgatgggatcagctaggcccgggtggccgtttgaaggttgttggcccgggtggccgtttaaaagttgttggccc

SEQ ID NO: 59750 - DNA, 2213 bp, Oryza sativa
ccttcttgaattttgttcaaattgattcaaatccagtcaaacattgtttgcaatttaaatctctagctagatttcaccgagagcggcatccctgagaaaaggatccctgctcaaggtatccgccggctgacccatgctaattcatttggtttacagtttatcaatctgaaatgagaataagtagaaggcaagtgcatttataatctaatggcatggattatttttgtaccacaagtgggcaaacttatgcccctaacgaggtgtgattgctgtttgtgtcaaacttgatgatgacatacccgtcgatgacgagagctgcccctccgatgaggccaccggcggtgcatatgttgccacgggcatcttggctggtagcatcggcattggtccactggactggaggaccatcatagcagctctgattgatggccgctggcatcggtctggatgcgcacaccagagcccgacagcaatgacacgctccatctcaaccacatcatagtcattgttgagccgcttgtcagctgcgttgtgaatggctccctggccgtatagatcccagacccactcgactagtcggaagagaccattattttgatcatccagtagactcattggtctccttgcacataccacttctaataaaacaaccccaaaactgtagacatcagattcggcacttgctttaccagtgatcacacattcggggtcaatatagccgggcgtcccagaggggtgcgtcattgtctgtaccccatcagcatggtcaatgagccttgcgaggccgaagtcacctagcttcgtattgaaggattcatccagcatgacattgcttggcttgatgtcacggtgcacaacacattgctcccactcctcatggaggtagagcagggcggatccgagcccaataacaatgttgatcctgcaacatccaaacccaataactgatcagttcatggccatttgtcaattgcacattagcaaaaattctaatgaattagggaaatcaattacctcattggccatgtgaggaaggtaccattgccgtagagatggacgtcaaggctgcggttggggacgagctcgtagacgaggaggagctcgttgcggccatggaaccagccgatgagctgaaccagattgcggtggcgcagccggcttatgaccttgatctctgacttgtactccctcctcccttggttggaggaatctttgatgaacctctttatggcgacgtcgaggccctgctctcttagatagccccggtacactgcgccgaatccgccctggccaagcttctcctccgccgcgaagctcttggttgcgttgacgagcacatggtacgcgaaccgcctcggccccatcccgttctcgatctccatgatgggatcgccttccgtgtcatcgtcgtcgtcgttcgcctcctccgcctccctcatcttcttcctctgatgtcgtcgtcgtacgagtacgacgactgctaccatggccaagaggagcacgacgaacagtgctgcgccgacgatggctcccgctacaaccccgccacttcctgaaccggaggtaggcggtggtgacggtgacggcggcgccactggtggcggtgtggccttgggttccagcgacgagctgaagtaccatgaacgtagctgatgcagctcgacggatgtggacgtcgcggcggagaagccgacggcgacctgctccggcaacacgctcttgaggtcaaccttgtagctaaggttgtaatccggccggtgacgggggccactaagcccatagccgaggtgcagcctcatggccaggatgctggagacgttgtcgtactcgacgacggcggtcatgttcccgacgagggtgaagctgggcaaggtcaaggtcgtcttggacacgacggagttgacgtcgacgccgaggtggtcgtaggtggcgtcggggtcgtgcacgatggtgtcgttgaaggtgtcgaactccacggcgacgaaccggtcgtcgccggcggccacctagtcggcagtctggttggtgaggccgaggttgtaggcgtaggagccggcggacgggagcctcgacgggaagccggcgaggaagaaggccatgccggcgcccttgttgttgatgccgccgtcctcttttggcgggttgatgacgaaggagaagccggtggtgaagctggcaacctcgccggtggcggcgtcccagagaggtaccgg

SEQ ID NO: 59751 - DNA, 1738 bp, Oryza sativa
tgggcttgacagtccttgaagtgcgccgcaacacgggttgatggtccataactcctccctgctctgcatcttcagcttcagcttgcatcttctcatcatcgtcctgctctgcttccaagctcagttcttcttcagtatcttcctcagcactgtcagatgacgatctgacaatcccttccccttgagttttggcttgtccccaagccaaagcattaggaaatctggccttcaagtcatgcagatcctcccaggtagcttgtgctggaatagtgtcagaccaatgagttagaacctggtgaacagtatggttaccttttttggtaagacgatgatccagtaatgctataggatactggacagcagagtaagttggagataatggtgtatgcactgatggctggaacccctttgcttcctttaaaagtgatacatgaaagactggatgaatggaacttgtggctggcaactgaagtttgtaagcaacagtacccaacttctccaggatttgaaatggtccaaaatatttgaaagccagcttgtgattcgctctgggggccactgaactttgcacatagggctgtaacttgagatagacccactcacccacctggaactgtcgaaaacttcttttcttatcagcaaaaagtttcatttgttgctgtgcacgatgcagatgttgttgaactaactgttgcatcaattttctatcctgcatccaagttatcaactcactgttgtcacagtccctgatgctgatcccaaaatggcgaggtggatatccatacagggcttcaaatggagttctgtcaatagttgaatggtatgagttgttataccagtactcagctaaatgcaaccaagaaggccatttggaaggtgctgactggacaaagcatttcaaatatatttccaggcattgatttcctcgttctgtttgtccatctgattgagggtgataagcagaactgtaatgtaatttagtgccagatctcagaaataactgctcccacaattggcttgtaaaaattttatctctgtcagagatgataatttgtggaagtccatggagtttgtacacattactcatgaaggcctttgctacatcaattgcagtgaaaggatgtctcaagggtatgaagtgggagtatttagaaaatttgtccactactactaagatgcaattgtagtgactggacctgggaagcccttcaatgaaatccaatgatatagtctgccaagcacctttagggactggtaaaggctgcaatagtcttggataccttgatctatccggttttgcttgagcacaaatttgacaattggcaagtgtttccttaatttgggatttcattccattccaggcaaataattgtttgattcttctgtaagtcactggaaatccagagtgccctcctactggactggcatgcatctcattaatgattttaagttgcaagtcaggactgttgcctatccaaatatttcccttatatctcaagactccatgctgaagtgaaaaatgaggcttagaattagggttaagtgtcagggcagcaactaactgagtagcatgtggatcagtatcatagctctgcaaaacttccatcagccattgaggaacacactgagaaatagcattgaactcttcctcagattgctgtggttttctagaaagagcatctgcagcagcattagtactcccctttctgtaacaaatcttgtattgtaaacccagtaa

SEQ ID NO: 59752 - DNA, 735 bp, Oryza sativa
tggcgccggtggcgcgtggatgcacagctccaccaagaacgggcagtccgtgaccgacctcggcgtggtggtacggtggtgcaggatcaactactgcttctacgtgcgcggcgagatggggcagcagcggagcaccgggtggatgatggccgagtacgagatcaccgacccgcggtgctaccgccgcgccgacgacggcgaggaggacgacttctgggttctctgccatgtcaggaagagctcgaggccccaagccgccaagatctctccagccaagccagcacggcggcgcaagcccgccgccgccgccgccgcggatgtccgggctgcgtgatccggccgacggcggagatcacgaggtttgcctcgcgttgggattcgacttcggttatacttttgctttggaattgtgttcctttgctttattcctcctctagcatctgcccatacattccgtgtgatgaacactgcgaatcaaatgggacgtttaagatgttgttgttgtactgatagcgtgattgaattcatggcctctttctgccaagccgcatatggagttttttttggtgtttcagtttcaagtcgcggttggtgaatccgaaatcacgtgattaaaacagtaattatcgagcacggaaggaatggaatttttttaaaaaaaatgcagaacggagtaatttcttacagatcatcctgtttctgcttgatgcgatagctaatcgctgtcggtgctct

SEQ ID NO: 59753 - DNA, 1836 bp, Oryza sativa
tagtggtcgttaataccagtctcccgtcacaggtaagtcaccaccgtcgcatagaacccacctgaccgccgcagatgactcatctctgacgggttgtaacttacgacccgtcactgatgacaaagcaagaaatacaatttttgaattttaaacgcaacaaaaaacctcaaaaaaatattttgaattttactagccatcctatacatggttacacatcactacctacaaattcacaatttttcacgcaatataacttggatgctacaagtgagattcgaactcaagacctcaacctccatatagagctcccttaccaactcacctacttaacacatattgactactaacccaatgttattattttgtctatgcttgtctgaatcatttaacatatatttaacaccctaaatgacttcaaatgaaaatattatcaactaaatagttatagatctcatcgtgttttataacttttacatagaaaatatcttcatccgatgttgtttgaagaattcaaaatttcatttttcaaaatatatctcactttataacatgtaaattttgtgaaatgaaaatattttcaattataatgttgtagatctgattgagttctatgactttgatacggggcatgtatccatccatgtcatttgaaaaaaaactcaaaattttgtttttaaaagtagatctgatcacttgtaatgcatgttcggggatgtaaatgatctctaatagaaatgttgttagttataaagttgtggatatcattaagagctacaacttttatataggacatgtttcaatccgaggtttttttgcaaaatttaaaaatttgaattttcactcatcactgacgggtcataactaccacccgtcagagataacgttatctgtgacgtgtgttagttaaaagacccgtcagagatgagtggtctcttttgtgatggttcataatactacacccgtcacagatgacatgtcatgtgtgacgagccatggttgtgacccgtcacagacgatctgtgacgggttacaagtgcaagccgtcacagatgacttcacatctgtgacgggtcctccctggtagccatatattgaagaggatattttttcggcccgtcagagatgactcatctttgacgagttgcgttggcccgtcacagatgacccgtcactgaagcccggatctgtagtagtgtgaaccgcccgcggtgttcgtccagttgccggtgtggaacaccgcgccgaggtaggggatgtccggcgagatggggacctggcaacaacccgtcccggtgcacggcgcgccgtcggcgtgagctcggcgcagtaggtgaagcagcccgtggcgtacaggtcgtcggcggcggcgccgcgcgggagaagacgaacgtggccgttggtggacggggaggtggccgatgacgcgtagcaggcgtagctgaggccggcgtagagccgcgagctgccgtgctcgccgagagaaggggggagagagagagagagagaggggaagaggagaaggaggaggtgagatgacaggtgggccccaccatttttttaaaaaaaaaggaaatgctgactggattgccacgtgtacgtcacgtaggataaaaccgctttggattgtgccagtgggggtaattcgtccggtattgaaagttcgaggtgagtgatgtctggttttcagatttagggggtaattcggtcgaccgcgatagtttaggggggtaattcatactttttccttagatattctattataaaatttaaagttatgtttcctcaaaattgttgcgatttcattaaccaaaaagttatagactaaagtgcatattt

SEQ ID NO: 59754 - DNA, 2674 bp, Oryza sativa
acagcttattaattattatggctgagagcctgtcagcctgagactgatggagagtggccggtggtcgccttagtggcagctgtccatctcttccatcacgcatgcaggggtcagattattccacccgcatttctttgcaatgtcctcgatgcagattggcggaaccaccaatccaggatagtggaatgcaatcagagatgtccagattttgtcgtcactaaggtcgtcatcccggcctgttaacacaatacaaacagaattaattagcgcatgcatgcacaagtaattaattaggaatagaagcgctaacacaatacaaacatgcacaagtaattactactaattaggaagagagaatcaagctcagctagattgtgagaaaacatgagatggatggatggatttacctccccgggtttcggtagcggaagtaatagttggacagataacaagaactaaaataagaacacctgctatcttcgtcatcttggtcgatttcatccgatcctttgctcctcctccgtataaataggctccagcccatgtgacgtgagtataataattaatataatgtatgcgaattttgctcaatatcctcttcaacgtcttactatgtttttggaatttggacgtgactacacggtaattaagtgtgcacatgacccgttcgcggcagcctccgacaacaagattttctccttccactagtaacgtgtactcctactccggccactaatcatgcatgagcggcatgacagaaatgtcacattcagagcagtgtgattaaagcgaatgcatgtctttctgtccacctgcttgtgcaagcaactgttagctaatcccctcctccactttactgtctgtgtgctcatgcagattggtttaaccctatagctaatataattaattaactaggcatgaaagtaaaaccaattaggaaacagcagagaaaatgtgacctggtgtaaacgtacatctatatctatctatcatatactaaaagttcattaaattaacttcctacaaaaactcccaagccgccatgtggtctcctacaaacgctcgtaaaccgccacatggtgttctaataaattaggaaaaaaaaatcggtggacctactaattttacccattagatctccatctcaaagaaaaaaaatcaggtatacccaccacgatactcccctccacatgtggaatcgtatgtcctcactaatccccacgtatacgagttctacatacaaaccactatccaccgatcgctaataagtcatattgcttacaagacatttcatgcacaatgtacctaatataagaatcagctgatatccaatgagcatgcatgcatgtcatctagcaccaaagataaagaacgatactccgcgagtaacatcaacaactgataggtaggtagagtatgccaccaagctacaaccaacagtagttgactacaagtaaactgagactattagtagtagtgttccgacaaaatacacctaagttgtcacgtgactctaataaattactccctccgttccaaaatataaggcacaaccaacattaacccaaagataaagaaatagttattatcatcttgtagtttggatcatcctaataaatataatgcatgcatccaatagaattagagaatgtgagagtgaattgtttaaaaaattaataatttaatgaagaagatgtcataattaattgaatgcatgccttatattatggaacatataaagaaagtggttgtacattatattatagaaccgagggagtaattgttctataaatataataaataaaataaaacaactgatcattggtttccacttaaatcgatggaccaagatatggttcgatcatcggaggcgttttagtttatatggttagggaattcatgttcatatatacatgttttagtttatctgcagctgggtagtaaaaggctagtggtagctaagcagcctagcagaagtgcagagaacaaatgtaatttgatcagtttcactctcatccagctgagaaccgaacgtctccgataaattaagaagacagttcaagtcaaaaggagcgaggaaattagggcaaaagttgatgctagtgaatctgaaatctgtttacacccaaatttgacacctatagacgaaataggggaaaattgccaaagtttggaaagtgacgggtttccttcacagggccggtcagaccacaggtgtgtgggcggtctgaccggctagtagggccggtctgaccgcaggtatgtgggcggtcagaccggcagggtccgagtccgagtctgttttcgtcgggtctcgggtttccttgctcgggaaggcatgtttcgtgtttcctttggtttctatcccgagttggacatggagaagggcctgtagagggcaagaccaacccctatttaagcgacaaggccggttcattgtaaaaccccccaaatacaatctacttgaatcgttcttttactatgtttttctattttactctagtttagtctatctttgtcggtttgcgccgtaaaccgtccgccgccgctgcgagagtgcgacacctctttttaggtttgtcctgaaaaccttccattttgcccacgagacgggtagtatcctatatcgatctaaatcggcctagaggctgattttgatctctaaatcggctct

SEQ ID NO: 59755 - DNA, 1321 bp, Oryza sativa
gtgattgtgtcatcagtgaccactaatcactgaccaagaccaaacccgtcaaaggtgagggtttgggcccgtcagagatgacctggtccggcgtagtgtcaacccgtgcttctaagccatcggcatgctcgtgtactacaacgagaccttggatgccggccgtggcatccccgtggacgtcgacgtgtgcgctcaggtcgccggcggcgagctagaggtcgtacaccatacggaggaggtgccgaagctcgtagttgtcggcgcgggtgagcacgccgatgagaaggcggaagtcgggcttccgcgacgccgtgtacgcccccggtgtcgccgggccgcacgagctcatcatgagcgcctggacggtgggaaggaggatcctgccgccatctcgctccacgtcccgccgccctcgccctctctgccgccgctgccatcggagccgaccgagcgctaccccgacgtctagtacgccgcgtcctcggctcctcgcccgccgcccacagccgcctccgcccccgcccaccgccggcctcggctccttgcccgccgctcgcagccgccttctgttcactgagagagagaggggcaaaggaggaggagagagaggggcagagaaggagagaaacaacaagcgctgaaaggtgggccctaccgttgtttttgctgactgtattgctacgagtgtgccacgtaggctgaaaaccagttcgaatcgatttagggttataatttatccagttttgagagtttggggtgttaaatgtctggtattatagtttgggggtaaatcgtactaccgcaatagttcggggggtaattcgtactttccaatatggaaatatctaactatttgccaaactattggtcatcattaattacaatcttaatttggtttttctcataattctaaggaaacataaaattaaattccattaatatattactctgtatgtttcaaaatattactggtcattctcacatttgaaattattattttagatcgcggtattctatcttcacattttatcaatgccatgtataactgttaatcaaagttaatattgcttttgaaaactataatgtagttaataagcatagcagtgtaatttgcacatctcctagtttgatgtgaaattttgctacaatgacaaataatataaaatgagagataggcaaatttaatatatattttgcagatgaaccatattacaggctaaattaggcggcacgtcaacagggcgtgcagatcttctagtatctaataatctaaagctagcgcttcttgtgccaacgggacatttaactatttgtcactatt

SEQ ID NO: 59756 - DNA, 1586 bp, Oryza sativa
ttggtttctcaacataggtcagatcctcttggacttctatctgttcaagattaccttcttccgtacgtacccttaaacacttcttcaattgcaaaacatggaacacattatggactcctgccaaatattgaggtaacttcaactgataagcaacctctcctcttctactgacaatcttataaggtcccacaaaacgcggagccaattttcctttggtgtgaaaacgatgaactcctcgaaaaggcgtgacacgaatatacacatactctccttcttcaaaactcatatctctacggcgattgtcggtataactcttatgacgagactgacccactcgcaatctttcctgaatgattgtcaccttttcttctgcttcccttaggatatccgtctcgaaaacctgacgttctcccgtttgctcccacagaagcggagtgcgacacttccgaccatacagtgcttcgtaaggagccatctgaagactagcttgataactgttgttgtacgaaaaattctacatagggtagattcttatcccaacttccaccgaagtctaaagcacaagctctcaacatgtcttccaaaatctgattcaccctttcggtttgtccgtctgtctgcggatgataagcagtactaaaattcagcttagaacccatctcttcctgaagtttcttccaaaaatttgaagtaaactgactgcctcgatcagacactatcttcttagggacgccatgcaaacacacaatccttgccatatacaattccgccaatcgacttccagaataagttgtctttaccggaatgaaatgagccactttggtaagtctgtcgactattacccaaatagagtaatggcctgatgacgttctgggtaaaccagtgataaaatccataccgatttcttcccacttccattcaggaatcttcaaaggctgtagcaaaccggcaggtttctgatgttctgccttgactcgctgacaaacatcacatactgctacatattctgcgatttcacgcttcatacttgcccaccaaaatctttccttgagatcctggtacattttagtactaccagggtgaatggagtataaagtatcatgagcttctttcagaattgcatcttttaagtctttgttgtcgggaacacaaattctttcacccaaccatacagttccttgctcatcctccaagaaaccgatagcttttcctcttctcatattcttcttgatttcttgaatatccggatcattaatttgggcttctctgacttgatcaattagagtgggcttcgcttctaaagctgcaacgaaacctctactgacaattcccaaatttaatctttcaaattccttgcataattccaatggcaactgtcgtccttcggtagcattgcaatagcctttcctgctaagagcgtctgctacaacattagcctttcccgggtgataatgaattcccatgtcataatccttaattaattccaaccatctccgttgtctcatgttcagatccggctgagtaaaaatatactttaaactcttgtgatcggtgtacatctccgtacgagtaccgaaaagataatg

SEQ ID NO: 59757 - DNA, 1546 bp, Oryza sativa
tttttaataagataaatgatcaaatatcacgttaaaaattaacagcatcaaatatttaaaaaccgagagagtagtttggaacacatgtttaagttacagtcatttaaacttgaaatattggctattattattgaacctaggaacaagatagtagttccaaaatttaaggtgtgatatcatattttgtattatccattttacaatatattgttgatactatctttttatggaccgccacttcgaaaaagcaaataatacttatctcagtctccagaaagttaccaggaccaaataaataaattttcaaataagtaatcttatttttcagtaaagcaaagcaataatgaacttatgattttaaggcttgctattcactctataattatatattgccgataaaattcatcacaacaaaacaaaatagtgtcaggaggagtagatttgttgagagaaaaagaccgagaataacgtatttggcccaattaagtatatacatatgtaatgcgtaatatacctacatgtgttgattattttcggacaacttttgagtattcactccaatacccaagagcctccctgtgtcccaccctgaagcaaacaaaccaggaagaacaataacaacagcatgggtagatatgttggcatccctgtaaactctataactcaaacttgaaatcggcagctctaaattatttaattagtaactggactaaaatatatatttctcgaaaaacgaagtggacaaattagaacttccataaatttagttttctcattaaaataagattttgttcagatttaagcatgatattctgctggtaagttatatgatattatatggagcatgtgatgatttttttaaatattcttttaagtcatttactaatgcaaacatagttgggggttaacttggaccaggttgtcgaaaaactagtataaagccacacagccacaagctagaatatccatcaataaacacatcatactgccatctccctcaactagttgcaaaagcacacgttcttccaatattccatcagccatgcctggagcagctgctgccgctgttgttgacagccgcctgtgcacacagcacgcggaaggccctgctgcggtcctcgccatcggcactgcaaacccggcaaatatcgtctatcaagatgggtttgccgactactactttggtctaaccaagagcgagcatcttattgagctgaaggacaaaatgaagaggatatgtaagtagaacaatcctttcatttcgatcgttgcattgatcatcattatcgttagttgtttttcataaactctaatgagaataaattatgcaagcgcttaaatttttaggacactcctgccataattcattataaaccatacaaatatttatactatactacgtagaaagaagagtgaaatgatgttggagttcagccaaattttctttatttcgcgtgtgggatgcaatgtggatgcatggggtgtggttgcatcccaaaatttttgaaaaaaaatctactatatacagtatatacttggtacatat

SEQ ID NO: 59758 - DNA, 2112 bp, Oryza sativa
agtggcatagatttccacctctctatccaggtgccaacactgatcaaggacaacatccggcagtgcttgcttgacacattccgatcggttggaaacatggatcctaattggaatgacctcttctgggcagtgcaccctggtggccgtgcgatccttgacaacatagaaggcgagcttcagctgcaaccagcaaagcttgcggcaagccgccatgtgttgaacgagtatgggaatatgagcggcacgacgatcgcgtttgttcttgatgacttgcgtcgccgtcgggagaaggaaggagatcagcatcaacaacttgagtggggagtaatgctagcctttggaccaggtatcacaatagaggcaatggtgctgcgtaacccactctcatgaagtcttaaggaaaattaattgccactatcttatgcttgtctggtatcttattacggtatatgttaattaatcaatgcatgacactaaatcaattctgcatgcttaagtggaattatgacctaccggtgatgtattgatgttgtggagttcctatctaatgtttattgctgttttttctgtatttgtaacaaaatttgtaataccctgtgtataattgaaaaagcatattgcttatatgagttgcttcaatccgagtttggatcaattgagatgtatctttcaagaaaacacttgaataagatcaagtcagtattttgcaagtgaaaaaatgttccaaaacaagataaaaagatgcaatcaatttcaacttaatctttagtaattaagattgtttttcttctcaaatatacatgagatgttgtgtatcattgcattaatggaagaacggaggcgtaagatgcaaatacaaataatcagaaaagacaaaaagtgagaaaacaaaacacgagcaaaagaagaacaaagtgcctaaccgaggctctcccaacaacctgaatcatgggccttcttaaccgggatctataatcaacgaaattcccctaggctcaataggtgagcctcgtcactcgctagaactagtcgagaagatgattggagcagcctcgttgaaaacacaggcgtttcgatgcttccaaatagaacatgccctaagaatgatcatattatttatacccttccttatagcccgttttaccaaattcttgtgtcttagctagggagatcgatctgctttcagaaccggcggcgcgttcatcttctcgtcgttcgatctgatcagcgagaacaattctgacaccggtgtgttcttcgatagatccatctgatcggcggcagcatacgcgcttcatcccacggcgagttctttgatgaatctggttggtggcggcaggcgtgcgtcctcctgtcgtctcatcgagttaatcggctcgacgtgattgagttttcggcgcagcaatccgaagcggagttcttttttgctaccacgcatccaccgaaaaagcagcagcgcatagctgcacggctctggaggaggaagaaaaatcaattgaagatactgctcgcttcgtgtttatgtgaagttccaaattcctgttggatttttgtacgtccacaaagactttatatcagggaatttcttttcttttggaatctattatatatattttttgatctggaattgtttctccaacatgtcatgtatcaaatttgacattgagaagtttgatggcaagattagtttttgcatatggcaggttcaaatgaaagttgttcctacacaagttgatgttcggaagcgaatatgattgatcaaggggaagataggctgtgttatctgtgtgaatggtaccgtatacaggttcttaagaaggaatcacaaataccgttccaaagcagcatatttcgacaacactgaatagcttgatgatccaccaggaccatgcaagggtgatagagtgttccaaatgacgaaaaatctcaaagtttttttttgagaaggcaaaaaagaaggaaaccaagcggaagcgaaatgcggaaggaccaagcgttctattcaatagatatatagatacatcattttatcggtgtcatgcacctagagaaaaatgtgttctatagaaccattgggactttagtagccataccaagcaagacaaatgatgg

SEQ ID NO: 59759 - DNA, 4848 bp, Oryza sativa
tacctcatagaagaaaggtaataatagtgttatgtatctccactatgaacaccgagttttaactccaagtcaaccattagataataacaaactcaggaattaatacaagtgaaagcatagactgtgaagaagcaaggaatttgggaatagggagaagcactaatggtgttcatgcatgactccatccaccagggtttaaatcctaatgcccagaaatattacgcacatataactggactttcaaccagattatactgagatcagagatgtgctgctagttttcatctcttagggcacccacaatggttatctataagctctctacaagagatacatgtcggcatattttcctacttggaagagattaaatgaagagagagagcaaagctatctactaacctggagatagtctatagagaaaaacgaggcaatggattagagagctatagatacccatgtagacatactattgatgtgatttactattaatctagtctattgctgagatgtatatgttttatagagagcaccttactttaccattgcgggtgctcttagagcatgtgttaggagacgcattctttagggtgtgagtgtgatgttgtgtgtgtagtggtgtgtgcgcgtttgttgtgaaattaaaaaaagaggattttaggaattagggaatggataatagagtttagggtggagactggatagagcactgctacactggcccactggggaaggaagacgagaacccaattctgttgctgctgctgcctctttttcatagcttcgacgttgcttgtttgggccccagcccaaagaccgtgacaaagggcgtatgttatcagaatttatcgcaattaaatgaagatagtagctcagtcgcatattaatagttacttaattaaacttgatagggcaaaaggaggacgatgaacaactaaatctcatctctccaaacccctaaaatcatagtattcgaggaggaagaggatgagtatacgtactcgcgttccttggactcttctctacttcctccaaataaccacactctactctctctctaccacaaattaccatttcagaatagttgagtacttgagttcatttcagaccagtttgtagccggtgacccagatgttcgccggcgccggcgccggctgcacgtacacgaacctgaggctcctccccggccgcagcgccggcagccacctcggcggcacgtacccgtacctcgcctcctccagcccccacagccgcccccggagccccgacacgcccaggtgcagctccctcaccgtcttcccccgcgacctgttcgtcaccgtcaccgcgtaccggtagtacgtcctccgcctcctcgcccacgtccccgtcacgttctgctcgatcccgatcgccgtcgccgtcgccggcagcgacgacgacgacgacgtccggttcacgaccggagtcgccgtttcttgttcgtattcctcctccttgaggccgccgcaggaggcggcgaggcgggcgaggacgccgagcagcggcgcgttgttgtaggtggcggcctccgtctgctcgtagttgtcgcgctcgtcggcgaagtcgtcgtactcgtcgggcccgccgacgacggcgccgtcgagcagttcgggttgccggcttccctcccgtaccacgacgagtacccctcctggcagctcacgaacgacgggtccctcttgatggacacgatggacgcgccgcggtggtgcacctgccgcgggtagctcgcgccgtacccgaccatgtagctcgtccccctcggattatcacccaaaatataattcacctgaaatcaattcgacaaaatttgagtaattcgtcaaccacatttgacaatgttttttttttctcgtgaagtggaagcggtgagagtattgccgaatatattagaaggacagagttgaccctgtttataaggaaaaccggctcaaaaaccatacaattgcacggcctttgacaatgtttttgtttgttttttacctgagatttgacgaatttgaggatgtcgaatggttgggcggcgccggcggggcagtggacggcgccgcggccggagatggcggcgaagtcggcgtagacggtgaggaggaaggaggcgctggtgacgaactggaggttgttccacctctggtggtacatcatgccgccgggggtcctggcgacgttgacggcgcccttgccgacgcaggagcacacaaagaactccgcgttctgcctgtacctctgcagcgcggcggcgtggtcgccggcgcggccctggaggaggaacttggcggcgaggacctgcacgccggggtacttgacgtcccacccgaactggttgatggaccaccccgtcccgcccagcgcctcgccgttgccggcgaggtactccaggtaggacctgtcctccgtcgcctcgaacagccacgccgccgcccagagcagctcgtcctgcagcaagatcaggtcatgtcagcaaggtgttcgtccgaatcctacggcgccgccgccacgccacttaccccgtatccgctgaaggagccgtagtagtttcgcgccaccgtgatgctggcgtcgtacttgccccggtacttgtcggcgaactcgaacagctgaacgcgccacaaaattttcagaggaaatttcgtttgatttcgagctcatttgcgagagttcttggagtgtttggatgaccgacctgcttggagtgcacaaggaggaggttggcgtagccagggtacgtgccgcggaagacgatggacgcggcggccatggccggcggcggtctcggcggcgaggtctgacccggggtgctgggggtcgacgcggaacgcctggcggctcgtcgtcatgtcctccggccgctgccagcagctgtggtcggtgtcgccgtcgccgacctcgccgtagagcacgtcgggctccgggtgcgccttgatgaagtagtcggtgccccacttgacggcgtccatggcgttccggagctcgccggccgccgccatctgcttgccgtactctaatatgctccacgacatcatggtcaccgtgaacgccattggcaacccaaacttgacattgtcccctgcatcataataacctccaacaagatcaacctgaaagacaaacaaaaacacaaacatttgcattgcactccattagaacccaactcatcatatctcctgaacaaattgaacacaatgccattgatggcatcatggttttgatcaaagatttgaaggtagaatggtgcatactccattggcctttccatcaaagaggccagagctggctctccaggagaccctctggttaggagggagaacgccggaccgctgcgcctggaagtagaggatgctcttcctcaatgccatggcatagtcatggccacccccagcaacaaatcccagcttcaccattgatgcaagtgccaagagaccaaacaatgtggctgcaccgtgagcaccaccattcttggccattgcaaaattgcaatgtaccaagaaggtgagtgagtgagagtgaagcagagtgaaggagcaggggagcagaggactttggttggcttggcttggagggagctcaaaagagtgcttcttatataccactggagtggagggaagatcagataaagcaggagattcaaagcatgagaaatagtttactgaactccagggcccctttctcactttagcaagttgttgatggcaaatattattccaaatgcatgcaactgatgaactcctaggtaggttacatcctcctacaaaatggcaagttttgtccatctctttttagtaaactactgactaatatagccacttctatgattgattatattattcatcgatggtcaccatctgttgtgagatatacactgaaatgcgataagcaacattagacagtggccacataatcagggcatgtattttagaaagctttcatgaactccacaaaagtaaacatttggtgaaaaactgaaaatgaacataaatcggactaaagttgctagattgccgatataaaatcatgatatgatagttgtaattttacagttattgtcactgagaaaaattttgtgatgttatggatagttaataaatgggataaagataattcaattccattgaaaaataaataagaaagctacatattacagaagttaactttgcatgcatatgcttgagaaacaagcgattcctcgtgcaaaagaacaccataggaactaccaactttaaaaaggaaataatgcaggcaattgtcttgcaattttgggagtatctgtaaaagccaaagaaaaggaaaaggttaaagaacgtcgtttctctatagaatgatcgtaccagcgctatcactattgataatactcttgttcttgcaatatacatgttttttttattatcatttgttttctagcagtttactgaaactaatgctccatttgaaatccaagtataatatgcgaatttcattagaaacagtctcccacgtagcctagctagggagtagggactagaaaatttcccaacttcatattcttacaaaagtatatttccatcccttaattccatcggtatctttgatgatagctgacaaaattcgctctatttgaggaaattagatcccgatctttcgataggtattgataactctcgtggaaacttcacacacacgatccagcttctgatcaacatgatccaaactctggttatcagccgtgccctactcagttgacctcgccgagaagactaatccttgtatgcaaatcgaaaaacacaagcaagaacaagatagattgcaacacaattggatatgaatgactaagcactcgaatttggggttccacaa

SEQ ID NO: 59760 - DNA, 777 bp, Oryza sativa
agacaccaccggtaggagatcgccggagagcgccgccgcagagcgccatggccaccccaagagctctgtttcttcagaggaagattcgtgatggcagcgagaagaagcaattacctgcagcagcaggcgtcgtcagggtcaaggtcgtcctgacgaggaaacaagcggcgcggctcgtctccctcgccggcgaggggaggaggaggaggaccgccgcgcagcttgtccgcgagctgaggaggatggaggacggcgccggccgtgtcgatggctcgccggcgacggcgacggcgacggcgtggaggccagtgctcgagaccatctccgaggagtggtaataatgtcaaatgtattatgtataaataatgtgtgtttgtgcatgcttgtacagtgtgcatgcctgcatgttagttatgtagtaagattcttttttctttgtatggtttggtcgtcaatttaggttgggttcagaggtgaggtaaacagcacaatatctactatccctcccatatgtatgtacccagattcgtgagacatattacatggtaaattggtcatggacaggtggatataatgttcatcatgctgggagacggaaaaaataagaaacaagaggatatgttgtctacttgtctcgaagaatgaaaacactttcccatcacgctgtggtgctagctacggagtactaactagatactgtatttcccttctttctgtccttgaacttctgatttgttcttcatatgtcatcactactggagaaactatctttgggcg

SEQ ID NO: 59761 - DNA, 751 bp, Oryza sativa
ccagtggtggacaatatattcccacagaacccaagatgtatcaaatttgaggcagaagacagtgcatgcaaggcaggatcagacaagaaatcactttttaggaacaaatatttcagtgctctaagggatgctaagggaggtataacatcatccatcagctgtgtattattcaaatttaggctttccaggtatttgagttcttcaagcgcagagagagacagtactttcacagagttttccatcatgaaacctgcaacatgattaaaatgagttactcgaagatgaggtacactgatattatcatataaaatgctgggcaagagaatcacaacctttgatacatgtgcgactcaggtttaaaattctcagtgaaggcatcatgcttatgtataataaagcagaatcatcaatttttgtatgagctaaagacagtgttgtcagacttggaactgttcctgccagaacacacagtgcttgagaagttacttcagaattactcaggctcaaaaacttaaggttcattccaatatttgcaatatattcaattgcatcgctaattattctgctgtagctaaggtccaagtgctctagattcctcatatttcccaagaaatacaagttgcttgaagagcaacttgacatatccaagtatgtcagtgaacttggtaggatgcttgaaaaaacttcatcaatgttgccaaatgatgctgcggagataatcaacttttccagatgaataagaacttggaat

SEQ ID NO: 59762 - DNA, 1236 bp, Oryza sativa
tttcttattttataaattttagttcttttctctttttttaaacaccaaaaaccatgagaacaaataatataaaattcaccatccataaaaaattcatcgtccatcatgtcacacattcatatgtaaatattcattgattcatatttatattgaacagcgactacatttattagccgttcacattcttccttactcctttattcctcatgtacggcttcggcgattcactaattgtttcttctacaagcttaatgtagtttccaaaatccatgaatagtgtcatgttctcgtattgattgtatgcctcaacatcttcaacatcaccaactcccaaaatcctttgttttccggaaataactatgtgtttcttcaactgagatggggttagtcacgtaaaaaacttgggtggctcgatcggcaagtaccaatgggttattcttgtggcttacgttgtcaaggtcagcaattgtccgtctaaatttgtccacaaacacgccagctgggtgtttcactcattgacaccgaaacggtggaatctgcatattgggttcgtagtcccgttcccaaatttcttctatgaattcatagtatgtgctcttttgacctgttgtgtcgatttcctatacttgaacgccattattttgagatgcactccttttgtctcttgctttggtataaaatgtgtacccattcagatatacgctcaccatgaggtgtacactcttgaatgcccgtcagccaaacttttcatagttttttccttcgtgctatcaccatatggtcggccgaggtcctttaaccattcggtaaagtcagatttgtgccatttcatgatccatgcttcagagcgcctgacatttcttgcttgtaattcctttaggtgctgctctatgtacagctccactatcacaagctgttacaggacaatgaaatgagcatctttcactgctttgtagtcattgtcgaggattcttttttcctttttgtccctcttccagataacctacctttatgtcgaggtactagtaaaccaattgctttcccatcttgcaagtaaccaatgcaacactcaatgactttcttggtagtgtatccctctatcatcgaaccctctgggtgggcacggttccgtacatagcctttttagattggacatatactgttcgaatgtccacatctgatgaaggtacaagggcccaagcacaagtatctgaggcacgatatgagggctgcagg

SEQ ID NO: 59763 - DNA, 817 bp, Oryza sativa
gattttaatctagcaacttcaaagttaagagattcaataataaactcctattttctatacatcttctcacacttcttattttttgcactcaaaataagaatagcttcctcaaaagaacggacctcattgtcttcacactctgaatccgattcaccaggtgccatgaagcaaacaccagagatgttctttcccttatcttcatctccactttcaccatctacatcgcttaatggctcaaaagcagcatagacttgagtcaaaagccttcttgagagtctctttgatcttcttccctttgaatgtgctcttcggcttgttatcattggtcttctcaccaccattttcttccttcttatctctcccaagcttaggacaatgcgaacgaaggtgatcagacgaaccacattcaaagcaacgatttggtccacctcttttcctgtacctaacattattcatagctcgagaaaatttgttagtaaccaaaaccaaatcctcctcctcgaactgttcgagttgctcatcggagatggcattaattaaaacaagaatagaagacttcgatgaaggagcaccaacatccaaaaaagtcgaggaagaaaccaaagcactaaacttagaatcaactttacgagaaaagaatattcatctcatgtgttttgagttttgtgtaaagcgaatccaaagtcaaagtagacatgtcaacggactcctgaatagctgtaactttcatctccaaataggcatgtcaagaccattcaaaaagtagcgagaaacctcagattgtgtataattaacatcataagaagaatcaacagat

SEQ ID NO: 59764 - DNA, 988 bp, Oryza sativa
gggagagatagagagagagagagcgccgggcagggagggggagatgggccgagagagattcggcccatcgaacccggggaggcaaaatagacttttgcggaggaattgatttgggaaggatttggattcgggattgaactcggcgatagatcggggatttgagatctgagatggcacggacactagaaaacaagcaaagaaacagatttcgcaaatagagtttttaagagatagttttcccgctaggcgccacgacggaacgggcgctacaacggttcatattgttttttattactagtagagggcaccgtaatgaggctctcgtgaaaaagtattctgtctaacggcatggagtagaaatcattgacaaactcgatcaatgacatattatgtatagagcaatctcaattatccaatcactaaaggagagcaatcaatccatgggaaggaatatattttcttcatagatacctgcaacttgcatgaagtaaaattctactagtcaactaatagtacacgtgacaattgctatataaagatctagatacctcccctctgcgtgggcagcagtgcaagctagaagccttgttccatacttgctcactagttagctaggacatggaaaagtctgagctcttgctaggatcgtattcatatgcagctctatgtggtgtcacactcatcataggatggttagctcactgggtatacaaatggatgaatcctccatgcattgggaggcttcctcctggctccatgggcttccctattattggtgagaccttccagttcttcagagcaagcccatcaatagacatgccaagctactacaagcaaagactggagaggttagtgataactttttagtaccagtgttctacttaaatatgcaacaaacatatgcacgttgttgatacgaacaacacactttctataaatatgaacaaatctaagttctatgccatgctggttttgcgcttgatcatca

SEQ ID NO: 59765 - DNA, 991 bp, Oryza sativa
agtggcaagggacaagctccctttctcccttccttttctccctttttccctctcgccggcgtcacctcctgtcgtcgtgattggccgctagccgggcgccagctcgcaggcttgaccgtccaatgtcggttcccctctcccaaaccgacattgccgcccctataaacccaagctcctccctcctccaatctccctcgttttcgtctctcgcctccactccattgtcgccgcctcccgtgctctgttcgctgccgcctttcgccgtcgcgcgtgtcggaggagcccgcacgagcaagggcgcggaaggggactccgggcgcgccctcttcttcctcttccccggcccgaggccggagagatcactcccgtgccgtcggcccatcgtcactacgccccgtcccgcacggtagcgcatctccccgttctccctcctcgttccatctcctccccttagactcgggtagtagcacgagtagcctccccgtagctagccggcgccgccccgactgctgccgtcgctcgccgtgtgctcgccgccgtcgccgcccgagctcggaagcgcctctcgtcgccggcctccctcgatgcgtttcctcctaatccggcacaagggacggattcccgtagccgcgtggatgctctcgccgccgggaatcggcccctcgtgacctcgtcgccgttcccctcttccctccccgccggttgccgccgccgcaatccgccgccgacgcactccctccgcgaatccgagccgttggctcgtctcccctcgtctcgcgcaaccacccggtgtgctcgctttcgcctgtatcgccgtggttcgctccgccgctcgccgctgtcgtccgccgtccgttctggccggcgtcgtcgtctacctcccgccggcccacgtggctgccacgtaggcgccacctcggccgcgaccagatcggctgacccggccagccgctccctccgtttccccccccccccccccccgtgcgcatgg

SEQ ID NO: 59766 - DNA, 2117 bp, Oryza sativa
acttgtcttatgttcgcatgaactccaaaggaacggtaccttaagtgcgagagcgggaaaccgtacacccggtacgttccccggtccacggttttggaaattcatttagttcacaagccccgacccaggtgtagggtttttcaagacttttgtaaaacccatgttttacccaagaagtttttcagattttaagtttgaaggcgtccgtcgatactcgcacagggtgcacgaatatcgagacgcaactagatggttacaaggggacatgatataacaattatcaaatgaaggatcaaatgcaacaaattaggtaggtccgccaatctgccttgcagacgggacaacagattaagtgcgatcctatcaatgcataatatttttcaagcaacataattaaatttcaaatataggctcaagatgttcaaaggtggcttgccttgctcgagatctggagcttgatcctcgaaatcctcgcactgcgggtcttcgggctccgaagctacacgcgaaacgggacaactcaacaaacggcgaaaataaagccctattaatgacccctaagcgtgccattagatagatctcgagatttgaggagttttggaagttgaacggagtcaaacggatttaggttgggaagatattgaatttctaagattattggatttttggtctaaaggaaaaaggatttaattaaatcctttttgaaaaagaaaagaaaagaaaagaaaagagggagggaaaatagacttttctcgggcggctagggcgcggcccaagagaattggagcggtccggccgagctaaatgggccggccagcccaagtcgggcgcgcgcgcgggagggaggagagagagagccagtggaccgggctcaccgcgcgcggtcccgggtgggacccgcttgtcggtgacacggttcaccgtgcggagcgagcacacggcgcacgcgcgtaggtgggggagggacgcggtgcacgcgcgcggttcgcagtggaaaggatgcggcgggcccacgcgcagcctcacggctcgcggtggaacgcgcgcacgggaggggctgaccggggtcggcccgacccgatctcgaccgagctggcgccgacgtggcacctacgtggcgcctacgtggctgccacgcgggctggccggaggaagacgaaggcgtcggccacgaatggacggcgggcggcggcggtttctccgggacgccttgcgacgatgaggggcgacggggcgtacaccgggatgacgagggagaatgagagggagcgagccaacggcttggattcgccggagggagcccatcggcggcggatttcggcggcggtaaccggcggagagaaaagggggaaacggcgacgaggtcacgaggggccaattcccggcggtgagagcatctacgcggctacgggaatccgttgctagcgtcggattgggcagagctacgccgagcgaggctggcgacgagcgggtgctacggagctcgggcggcgacggcggcgagcacacggcgagcgacagcaatggtcggggcggcgccggctagctacggggaggctactcgtgctaccaccgaaaactaagggggggagatggagcgaggaggaagaacggagggaggcactaccgagatgaggaggggcgctgtgacgagaggccgacggcgcgggagtaatctctccggcctcgggccggggaagaggaggaagacgagcgcccggagtccccttccgcgtcctcgaacgcaccggctctcccggcgcttggcgatgaacggcggaggcgagacagagctcggaaggcggtggcaacaatggcgatgggaggagaagagagggagggcgcctgggctttaagggcggcaatgtcggtttggaaccgacttgggcggtcaaggcgcgagctggcgctcggcgctcgcgtccaatcggcgacagggcggagggaggataacgccagcgggaggaaaaggggaaaaaggagggagagaaagggggctcgccccttgcttctttgagaaaaggaggaggggagcgggggcgacgcggcagagggaggaggggctctgcctccgtcccttggcggcttgcgcgcggagtggcgaggccgaggcgatg

SEQ ID NO: 59767 - DNA, 3763 bp, Oryza sativa
cctgcaccccagagaagtggtgtgttttgttttctatttttaagggggaatcggatctagagtcggacttttttttctgagaaggagtcgactttttttttatatattttcgctatttattttgttttgacgggagttggactcttttttattttttcttctggttttttgatcggacagattttgtttatttttctttttttgccccgttttttttacatttggtttttcttttctttttcggttttttcacccggtttttggatcggaccaatttagtttttttcttttttgacccggtttttttctcggttttttttacggacgatggaagcacctcttatttttaagtagtagagatatatactccgcttgatcacattaaaacatgtactagatgattagcgtatattttactcaaagggtagacatcactaatacatcttcttttatttttgaaattgcatatccacatttgataaaaactccaccatcatctcgttattttttgaatggtcgaaatcacgataaattttgtgcgtgatcggtaaccctattatttttcctccctcttcatcctcccaacggcgtgcgctggctcacatgcttgcctctcgcccccaaccattctccaccctaagcaggatagtaacgagtgccctgtctcgttgttttcacgtgcacttcctaactcattaggaacctatgactcctgttgccaacaacaactcgttgcatagctattgatctctatggcttcagcaatgtcacagctgcatcgcatcccgcgtaccaggctactgctttccacaacaatccttctcaacccgcaaacatctcccctcttttctattctcaccccctccgatattgaccccaatgccaaaccttatacccttactagttggaccgttttcgatcaccacatctataggaggagaaacctgacatgaatcttatcactataggtgatcccccctccctcccacctttaaaaaagggggtaaatataggatagcaaaaccgttacttttatttagcaagttaatttttcttcctctaactcctatatagtatacaaaattgtatgtttcgattccatcgaaccatccaaaacattatctctagtgctaatctatgttgaaatcatgtaatatcggttgagacaatctatttttttatcctgtttctgtgtattttaagaattttgtgattcaaaaccctgagattttattgaaaaagtacaaaaatccgaaatgactaaaatttgtatgatggttttgataaactaatgaaagaaaaggagaacctgctaaagtttgcccaatgccatctctgcagttacagatctcacgggccaacctcccgtgaaatcaccgaatggagaaaatacgcaaagcacaaaaaacactcgaaatcgaatcaaaacaacctcaatggcccgatccgatcgaactagctagcaccctcgccgccgccgccgccgccgccgccgccgccgccgccgacgccgacgccgacgcctcctcgcctcgccatgggcctcctcagctccttgcgcccgcaccgccggggcgccctctccggcggcggcggcggcggcggcgggcagtggcagtggtcgttcctcgacgccgtctgggcggtgttcctcctcgccgtggtcatcttcctcgcgctcgtcttcacgccgcgccgcggcgagcccctctccgcatcctcctccgcactcgccggcgcgacggtgccaccatgcgcagcctcggaggtggacctcctcccctgcgaggatccccgccgcagctcccgcctcagccgcgagatgaactactaccgcgagcgccactgccccgcgcgcggcgaggcgcccgtgtgcctcgtcccgcctccgcggggctaccgcgtcccagtgccctggcccgagagcctccacaaggtgcgtgtgctgtaggcattgccgcattggcgcttgcttccactaagccatagtagaaaaatagcacctgaagtgactgcctactgtggtctaagcttactgactcggtttccatgtattttggagaagcgtgagggggtaatttgatctgatccgtgtgcggttaggtgtgcttatggttgcttctgttggttatggaattgcagcttggtgctagtgtatgaccggcttctgcatcttatgctgtcaatggttagatgcacgtggctttctgattatatgcatgttccatatgggtttgcagatacacgattgcaacttgtggagtttactgaatgatgtataggtcactacatttgtacaacaggtgttggttagttgtgtttcgtttgcttagaagtaatttttggcaagcagaaaatgttggcatttggtccatcagatcaattgcttcaaagtttcatgtctagcccctggaaaatttagattgaccttacccactaataatgcgtaattggactggatggtataaattaaatgaagagtaattttgttctgattgcatgtctcaacaggatgtagactaatcgttccaactttctatggagagttggagacttatttcatttaattattctctatgcagatatggcatgataatatgccttatggtaagattgcagaaagaaaaggtcatcaggggtggatgaagcaggaaggctcatactttatttttcctggaggcggaactatgtttcccgatggagctgaacaatatattgaaaagcttgcccagtatgttccgctaaaaagtggtctcctgaggacgggtcttgatatgggatgtggggtaataagctaaatcttcacatgaatcaatttatgttttacttttaaagaaatggtatggtattaagatctttcctctctgaaggtggctagttttggtgggtttttgcttaaagagaatatcttgacactctcttttgccccaagagattcacataaatctcaaatacaatttgctctggagagaggaattcctgcatttcttttgatgctgggcacgaggcgccttccatttcctgcacagtcttttgatttcgttcattgctcccggtgtttgataccttttatggcctacagtaagtaaaccatttcttcagtgtttgatatggttcgtggaaatgctgtctcttacctgtatatactggcagatgggagctatttgattgaagtcgaccgtctacttaggccaggaggttacttgattatatcaggacccccagtccagtggaagaagcaagagaaagaatgggctgaacttcaagaaatggcactggctttttgttacaagttgatcactgtagatggtaacactgcaatttggaagaaacctactgaagcttcatgtctacctaaccaaaatggatttaacattgacttgtgtagcactgatgatgatccagatcaagcatggtaatacttgtctgcgccaattatatttgttgtgcctacaaatatatgtactttttttaaaaaaaaaagcatacgagaaagtctcttgtacatttttcatatgtttgcttgtatggtttaccatgcaggtatttcaagttgaagaaatgtgtcagtaaagtttctttggcagatgaaatagctgttggttccattctgaagtggccagataggttatccaaaccttctgctagagcctctctaatggacaacggagcaaacttgtttgaactagatactcagaagtgggtcaaaagggtatcattttataagaaatcactgggcgtgaagcttgggactgccaaaatt

SEQ ID NO: 59768 - DNA, 2392 bp, Oryza sativa
  unsure (1)..(2392): unsure at all n locations
ttaaaaagagcatgttcatactcctttgcagcttattgattgtagttattttgcaacttctttcaaattcatttttgtttgtaagttaaataccaaagatatcaggcaatttacatatgctcagacctgttctaccactcacaatgaactgtttgtttgagttttgagtagtattgatattcattggatatattggatatttgtatatcttaatagatctcatgcattctgtggcttttatggtactttcctgcaatatttattgttgcactatccataaattttcaagaccttttccccaagaaacatgtattcgtctgtcgaatcaatatattgaggatttgttcatggaatagattaatagtttaatgcttgcatgctgattaatataattattatgatatgcctttggttccaggtgtgagcctttctcaacttatcctcgtacctatgatctcattcatgctgatagaatcaactctttgataagagacccaatttctggcaagagcaggtacaccacccataaacttagctatcattgtctcatgatcttgtattcttaacttgttctgttctccctacatcttttggagtggtctaattcattgctgaaaagtcagagtagaatgataaccaagaaacatcatgttaaaattatcatcaccaatttaagatgttcggcccaagcagtatatatctccatcagcccttattgcctgttcttagcacattttatgatttatcatgtaaatgaattagtagttgaattatgcaggagtttttaactattaatatcgtttagaggattgaaagtttctaaaagtaaatttgtcgctccccagtcccacacaatacagtatgcaacacgtttactgacctttatctttgttttgatgggacgtgtaccatatgccgacttaactgtaaaaagagctctacctgattccatttctttcttagatgtgacctgtttgatgtcatgttggagatggatcgcattctgcgtccagaaggaattgctgttgtacgagactccccagatgtgattgacaaggcagcgcaggttgctcagtcgattcggtggactgttcaggtgcatgacagtgagcctgaatcaggtggtacagagaaaattcttgtggctactaaaacattttggaagctaccattaacttagttataattcaatttctacccgtgttttgaacacttcctttacaatctcagtcccctgattttgagcttttggggatgggtgacgggtgttcagtacctatcaagttagcaagaaaatagattaatcaaagtggtctttcttttctgaaatctatttttgttcttcagcgatgagttagggcatagaagtgtggtgtaattcttgacattttgtggctctccctgcatacttctgattgatgttatagaatgtatgtattgtgaaaatggttgttcagtttgctctatcgctggttgctgcatccatttatcatcccgcaagatcaactattattgcaagtcgcataagggattgcgttaaatccttatacaatttaattgtcaagtactccctccatcccttaaaaaaaaccaagttatggctgtctacgtccaccagaagttggttggttttttagggacggagggagtatatatgtttcatctttcacgcatatttatcacaagaattcattgagctagtgaaatgattcattcttcaagtgatctgtctttgagtcttaacttgctgatgggacatgctgattttttttttagtcttaacttgcaaatgggacaggcctttttttttaagacaggaactggctacttgaccaggtaagagagcagagggttacatggttcagcatatacaagcagatttctgatcaacacttcacagaagaatataggtaagaatggacaatattgaagttctatatagcgtaaaaattttacagtgtggtctcaaacagaaacaatatctattgtatctcgattgttccctcttagcagggtggcattctctcccctgcagtgacaagtgggaggcatggcatgctaatgcgtcactgatctcctgttcatttgtcgcatttccagctggatgtcggcacgcaggtgaggtagtggcaccagctgcaatgagcgttgccgtccactcccttgaaaacactgaccaacccagctgcaaacctgtttgtgcatacatggcctcagattaggcattcctgatcccattttgatcacataatactctgctcctaaaaaaaaattcaagttcttttgagttacaaggaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 59769 - DNA, 821 bp, Oryza sativa
ttttggaattctagacattgtttatgttttcttctatgcctgtcattctcaaaaaacaagaatgctaatccctctcacaaataaaatttgtcgtctttttcaagatagtatacatgaagggcatgagagttattttctcaagtcttgtgcataagcctaaaattgacttatatttggaaccatttgagcatgttttctttatattgttgatactggccattgtaaatagcatttgtagtattttcggatgctgatggagttaggccttgttaatgtctctggataactttgatccgatagccatcaggaaattctagtcctggagttcggactaccctgcttgctcccagcggtatccacctgaaaaagaaaagcgcaattatttcatctccttcgctctcgtttgcgagaccaaaaatttcagccatcgctgttccgaaatgttacttcaattggttggcacatcacagagatatgggatgacaaggatttggacttccccaaatatgccctcaagttggactgcgaaagagaaaaacactacctgtattttgtcacaaggaaatggaggaaaatagccaattgtagcttgctgaagtctgctccaacgcagaaccgtagtcctccgccgaatgccatgaagtgttttgatccacggtttatctctggtttatcctgcatgttacactcaagctgattaaaattttcttttagtggaaagctaactaaatatacccgaatgaatagatatttttgtgtctgtatagggggagacgggcttggccggggtacgtgttactccatccgtttcaagttacaag

SEQ ID NO: 59770 - DNA, 6171 bp, Oryza sativa
ataataaaattatcacaaaactacatattttagggtttaaattcttagcactagtgttatgttggacttataattgttcaagttttgtgattaaattgtcattaaatatgtagttttgtgataattttgttactaaatacgtagttttgtgatatttcaccataaatctatagttttgtgataaatttagtactaaatctgtagttttgtgataaatttagtactaaatctgtagttttgtgacacgtcatgttaaatctgtagttttctgataatttgatcaaaatacttgtagttttgtgaaatttactcttttttaaccggatgcatgatgtactgactcgttagcaaggtttcaacatgtgacatagtaatctggagatggattctaatatatcgctcaataaacatgcgagttcaaaagtgacttttgtagtttgtaaaaaaataacaaaattaattgtgaatatagatatactatttaaattttgatttgctatttttattacaacttgtaaaaatcaaatttgaacttgtatatttgtagagtgccatattatacatgaatctatcttatcaaaaaatttgatttttttttcataacaatttaattagcatgcaacaaatcggtggatatctagctaagtgatcaaaactgtttcaactgaccacgttaaaaaaagctcaaactaatttttttagcaaattttgcctgaatatcacatgttttcatcgataactagcatggtggcccccgcagattgcgcggctagcattattatattttctctcatataatactacatatattttctcaatttgttattaaaatatattagaatgacaacatattttaaattttatattaactttaccaaactactaatttgtaatattcatattttattgtatatacatgatagttactaatatcaaattttagttatttctgaattgtatttctatatggactctatactcgcctttcaatatttcttttttttaattccgaatttttgttatttgcaaattgtattttttatatagactctaggctattcttttaatattatttatctttaattctgaattttcattatttctaatagtatttctatgtggactctaaactcatctttcaatattctttatttttttaatttcgaatttcaattacttcaaaattgtatttctatatggactttaggctcttcttcccatgtgttttaaatttcgaattttagttatttgtaaattatattgctatatggactctaaactctatttgtaattttattatttttattcccaattttagttagttctaaattcctatatggactctatgctcttctactgttccttattttttaattccgaatttttattatttcttaattgtatttctatatggactatatactcttcttctaatattccttatatttaattctaaatttcagttatttctaaattgtatttctatatggactctatactcttctttctgtattttttttaattttgaattttagttatttctaaactgtatttctatatggactctaacctgatttttattttttttattttttatttcgaattacaattagttctaaattgtatactggcatgaactctaatctactcttccaatatgcggatttgctcatattgttttcttgcccaggcattgctgcagaagagtgaaatgaaaaacttattccttattttttaattctgaatttcagctatttctaaactgtatttttatatagactctaacctaattttaatttcttttttttaattccgaatttccattagttctaaattgtataccggcatggactctagtctattctttcaatattcctttttattaatttcgaatttcaggtatttctaaattgtatttctacgtggactctgtttttctttttctccgattaatatgagaatttctatgccgtgagagcgaacgtggaggctcatttttctattactttaaataagttggagtaatagatagattgggttattcaatgactggtcgcatttgtaagccttgctagctcatcaatcatactcctacctcattattaaatagcagcatcaagatatgattttggacccatgatcaacagattgtggggggctcaccattgaaccgtatgtctttaagtgcctttctgaagatgacaggagcgatgttggccaaacggaccgtctcgtttatgacctacataataggagcatgtgcgcgtatgattggtttagcaacgcacgttttgatacaaaacatgcatggggtgctataattggatccaatgcaatcagtagcataaactgttgcacagcaaattctgaaccctatctgatcgatatttatctagcagttttgtgcgagctagtactagtaactaacctgagatgtgaatgccatggatttgtactccttccatgtgattctatctagctcgctgcctgcctcacggtccttcagaatcgtttcatgctccacctgcgtacgtacatatccgtgtatgtcagtacatagtcataaacgtgtatgtcagtatatcacatcttgatttttgcgtatagtataggagcactcaccgtgagctcctccaggacgagagggtggtcggcgagcagcttgacggccagggtgagcgccagcgacgtcgtgtggaagctggcgaagaggagcacgaacatcaggtcgagcgccatcttctctgtcatgaccggcttttccttcgtgatctcctggatcacataatccaggaagtcgccgtgctgctgcgcttctcctcctcgctgcaatcctgtcgattgcttcctctcctccagaacttgctctagcaccaccatcgcgcgcctccgcccctgacaagagtctcaaaaccaagagaccatgtctgaaactttgcgaagaacgactaattagtgcaatatcgtgacgacataagttttacctgcatgcatgagtagtaagctgtccctggcagatacagcgggaaggagatgagccctcgaacgaagtcgaagaagctcttccgcaaaatctttgacctcgacggctccaggccgagcagcttgcttgcagcaagatcgaacaccatctgcgcaagtgcatgcactcgaacggaacatacatcacaatgagacagtacaagaaaccaacattctaaaatctgggtagaaaccgcgtacgtacagtggagacggcttctttgagctcgacggccggcaaggtggaccaggtgcagagggagctggagacggcgcgctcgacgtcgcggatgatgccttccttgaggctctcggggccgaagtacctgagcaccatgttcttgaggtacctgaacatggcgccctgctgctccccgacgttgtccttccccaggatctccacgaacgagtccgggtaccagctctggaacagctgcccctcctgctggaacaccatgtggttcagctcctcgtcggccgacaccaccaccgggtgccccaccaggctggtcttgaatatcggcccatatctgaacttgcagcccaaactagtaaaaaaacagcaaaagaaacccagcccgttctctggcccattaacaaaggcgtacctagccagcctgtgccggatgaagggagggatgtccaaggaggcgtcggaggagaagaactggaacgtctcgccaacgagcgggaggcccatggagcccggcgggagttggccgccgcagcgagggttcctccacctgcgcgcctggtgccgcagcagcagcagcagcacgagcgcagctgcgccgcccacgagccccacgtaggcgtacatctgcacgcgtgtaatatgcgctagtggcagtatctgcttctgttgatctacatgtgccgtcgtcgaaagcaaagcacatttggctgtaggacgatcggtatgtaaggagtagaggggggggggtcacggctttgaccgtggtttggtgaagccatcaacgtaaaggttgtgaaaaactagtggttgctcagcctgtcgttgttggtggatcgaatgttcgatggctgctgctactaggatgggccggcctgatccttcccgttagatcttaagattctggcccatctacagagatttcggcttcccaaaatccgcacaatgcccatcgtcacacggcctacgaaatcctttgctctctccgggtttccgtggcacaactgggaaggcaaacccggcgtctctccgccccccaatccgcatggacgagctgctgcttcgctcgtctgctgattgcggaggccggaaggatcacccgcgtagcgtggtcaggtactgttggcgaactcccgcaggtgttcgacgaaataccgatcaaaacagagcgagcgagaagatgatgtttgtgctgcgaaaaaacttgcagcgtttttagttgcattaggaaactttaaatagcaaattacatgtccacaactctctactggatcacgtcatcccacgaccgaagttgccgccatgcgttcctaccctcccgccacttcgccatgcctcccgagtagaccgcgccatcccacgatcggaaacacgcaaagcgcacgcactccctaagaaaacggaaagggctcccgcatgaacgcagcatgcgtcggagcgatacacacgccatgatccccagcaaaaccggaaccacgcgcttgactgataacttggagcagaaaacgggagatggcgccatggattatcacaacaggtacttcctcctcaggtcaaagcctcaaggccacatttggtttagggttgcaaattttggtacggggtagtcggtaggtccgagcattgaacggcagtgttctgaatgtatatatcgggtgaaagtaaatacggagaataggccaaggactcaccgacgagcgggcaccgaaaaaggggttgctcctcaatgctgcgggtggctttttccttgcttgtgctgggcaccaagccaccaaccgaagcagagagcagaggataatcccagctctcgtactgcaagcacgtggactccgccgtggctcatccaaatgtcaggtttctcggaacagatcagtgctcggattatcctgcctccaatcatgtggctaccctgcacgccttgcgtagggtcgttggggatagcactgagcagctgggatggatgtccccaacgcaaaactatccgcagtggagtactgaggttgttgcaaagctttcttttcggtccgcactgagatgaactttgtcaaatacctgaatccatttattacagtaaagaaacactacatggaaatgagctttcagctttgtcaaaaccaaaacaagtactacctgaattcatttcttcgtccgttaacagtaaaattgcctgataaagagccacggttttcattcaaaggtatatatacccacacacaggataatggaacccgacgtattgtctgacagaagatatcagcagcggaagtacttgctgcaccaatccccaaaggtatgggcttaatttttaggcagttataagagtacaagctaattaatcagtaccattaccagccatacttcttgttacagtatatcctgttcatacttcttgttggacatgaaaatttactgtattatttgctctggcctatggcattaccacaaactaaatgtcaattattttttctccgtgcatgtccttgacagaagattcttaaccactaccactagcatcctatatagactgattgccattgctagctcaacagctaacaagtaaccactgttgcgagctaaccagtaaccagtagccctcctattgtatacagagatgccactgttaagagctctgttattgcagcgttaggtgagattgacactttggttagctgtaaggtggtatgcatcactgttcttccggtggataatgggggatatctcagatgaatccttgtgacagggggacctcgtggtctgtcaagtgtcctcatcatttcaatacatgcaccgatcgcccaaaagtgaattgtttcttctgctcctcctgtcggggaccagtgcgttctgttgccgtcgcattgcatgcatgccaatggtgatgaactctttaattagccgttagtccattacttgcaagatctgaaactagacagctaacgttatcttctccataatac

SEQ ID NO: 59771 - DNA, 14578 bp, Oryza sativa
aaattcagagacattcacgatgttttttttaaaaaaaaatggtactcgttataagtaatacatgaaaattatggcatgacagtgacaaaatggtgtcaataattatgcaaatatattccagatgctgattgaagtggttaggacttaaaagtctttaggcccttttctcaacttggctgactctgtgtcagatttttggatgttttgcgtggcttgtcttccactaccacttccaattccagcaccgacgctgacgtcggcacaaaacaacgaaggcgtgtagacgcggaatataccagtacaaccgttttgtctcattttaaggcattgcagtcggtgctagcgtgcctaatgttcagctacactgtaactaattttgtaattttgacattattcacctggagttagtgtagacgaatgcatatggtacgctcagtgtgggccaccaaattttcagctgaatccagagtcaaacctcacaggcatagtagttgagttcagcactccagtagcatgtgcgagcaaacgtaaaggcagttcagacaatttgcgtctagccatgtaaacattccacggtagttctactgttctagggagagtaggcgtactatggtggtacactggtactccgtactaaaatgcctgatgacagcgcatgaagaatgctactgaccgtagaaaccagacctacgagtaatgtaagaattatatcagaatggtaatctactagtaaaaagtaatggcaaacaccgtgcattggaacaaaaaggattgacaccataattgtagcttctatttacccacctggaatactttggttgtcctttaatgtaaaaaactttgcagggtttccttctcagcacctcttttacacctaaacatcgagggctgaactccatatgtgaactattccacccaaagaatgaaatggaaaaagaaacttcaaatccacaaggcaaatggtaagccgattacgatatttgcccaatatgtcaattttttctaacactttatttcacgttattgctattccttttcttccccgagtgtccagtatgtctttacaacaaggaggagcttctcccggacgagcgggccatcttcgtgatcaacgatttggctgttccatctcataccgtcggtaatgctctttattttcaccaacatatcaacatcatctcttataatcactgtaccctcaggcctcagtattctgtccatttccagcagaatgttgtccatctggcatctgcaagagacgaaaactgcgtcagtccagtaccagggtaaacagtctccaagagtgactgttaacgatacctattagatttctcaaatacaggcataaagaataatgtgcagttactactgcataggagtacagatttatactccacggacaagaacagaagtcactgttgctgtgatggactgaattttactgcagcttatgattacctgtccttgtatagcgtgaacactgaatcggcatgaatgaggtcgtaggtccgagggtacgtggacatgccctcacacctgcagtaagcacggatagaagtcacacaccaacaaaaacatgagcacacacaccaacaaaacatgaccgtcatcatattcagtctcaaagagaggggcagtgcttgcagagttgcggtacaagaactcaccagtcttggtagcttccgatgagcccacgctcgtatataaccccaagagttgttgaattgccaacagttgggaccatattcatgacccacacagggtcatccaccaatgccgcagcgaagccgccaaagcgcgcattcatatcaagcaagttgcggtaccgtcctttctgtccaaattgacttatcacggacttgtagtgcccgaccctcttctgccatagtttggtgtcttccacgaacatttcatcagtgacaccctcaatgctaccactggcaattctgggtggcactgcagtgagcctctctggccatttcttcaactggccacccgcaatctcttttatgtcactaacctctgggagaggagttatgcaagcctccatcttatcgtacctataatcgatcacatgaatatgatttatcctgaactgtgaacgtgagttaacttcaagatggacaataaagatataattagtgttgtaattaccatgcagcatctggatttttatttgagcagaagggtggggacttgacgactttgcgggaggccttgcagtgaatgtggttagtaggtttctgccagatggcaatgtcaccaacctccttgagcgtgatcttcttccagcaaagactcttggccactgcctcaatcgcttgctgctctgcattcaggtcctccttggttctctgccaccccttccagtgcttcttccagttgattggaggtccagacaaaatccaataccctcctggccgcagaatgcgatccacctcagccaagtacagcccatctgcatttcaaattgcacctgagttatcaaaggattaacagagcattgccaacacatttaattttggacaaaatgttgccataccgtagagctgccagggaatgaggcagcgggagcaatgtgccatgtcaaaggcacgagctggataggtgagccggttggatgaaagaacaccgatcatcgccggcacaccacgttccagtgcaaattgaacctgtgcctcgtgagagtcacgtggcgcgaaggacatggccaggatgttgcgtgacagcaagtatgcgccccagctcgctacctgcaacaagcggcagagtgcaacacattaggaatccataactctaggcgtctggttataatatacaaagggtaacttgcccctctacacatgagaaaaactcagtttccacatatctagcaatacaaatagatcaaaatgacaactattggcacagcttgctgtagacgtgaaaattccattatgtgtgacattgtcactgtgtaaaaaggcactacatatcttccaagttttcaacgatattagtgcacagtgcacacaacagaacctctcctatccgcagccgacatggagaatttgatcaaagaatgcactatgcgcacggaatgctacaagcagtcaagtactagtaacttcagttcagtgcttcagttcagcctctaaacgaaacggtatgtcggattggtcacgttactctacagtctgacctgcctaatcacagaatgaaacgaacaaatgctcctctgatccgggtcggagcagaagctcgtttagggtcagacccgtttgcccgggcagaagggcccagaggagcagtgtgggactggaaacttccgacacgcgcaaagcaaaatcccattccggcgttgccgagatttccgcctcatgttctagtgcatcaacaaactggagtataactaaacccccaaattttgctacgaatgtacgaaacactacttaaaatcgagctaattatgcgcgaatgtcatctatcttaagcaaatagggtgtgcttatgtatgaagtggcctaccccacaaccggtgtcgagggcggtgcggatggatccatcgtggagggggatgatcttgccgatgtcgtcgatgtacgcgccggcgccgtgggggaacatggtgccgccgccggggaaccggaacttttcgccttcgacgcggatccagttctgcaccgccttctcgacggtgagctccttgtgcggcacgttggcgaaccacgcgacgtcgcggctggtcggccacgggaacgggttgcggtacccctggggcgccggcacgaggcaccggagccgctcgccctccgacgggcagtgccgctcccggtacacgagccggtcccgcgggaaccgcagcgagcgctcgacgtcctcgcacggcgtgtactcggagtacttggccgggcacgcctcgtacgtgcggtgcacctggcccgacgccacctccatcccctccgcggtatggtgcgccgcgaagtcgagcggcgcggacgacgaggagtcgccgccgccgccgccgccgccaaggagcgtcggggtgggggagacgcaggagacggaggcggtggtggcgatggagacggaggaggcgacgccgccggccggggaggcggagaagccgccgtggtgccagatgccgatgaggtaggacaccgtgcagagcaccgcgacggccgcgaggtggaacagggacgggcggcggccgcccgcggacggcatgtgcagcttcgtggcggtcgcgcccaccgccatggctggctggcggcttctgctgctcccgctgcgcgctctcctctctcccctcgcctcttgtgggattggggcgattcgcctttctgcaccactgccccccttgctggctgcttaaagcgcttgccgcctaggaaggattaggggcgtggggatcgattgattaggtggaggtgaagacggggggaggccgtgaaagggagccgcacatgcatccggttttggtttaatcgtgaagagagagcgtttattactccggagcggctggtttattactcttgggaggatgcaaatggttgcgctttgggaacacgacactacgccaccctacgctgctatcgctggcggcgcgtgtgctgcgtgtgcatatcgcggcgtggcagcagtttcagcaagcattaactcggtggtgttactgtatattttctgttgatacgatcctggttggcgctattaaaagtgtaaatgctgagtgcacgagcccactctgtaaggttccctctgaattgtagaagtgaaaaaaaagggaggaacaagaaaagtacagggattatgatagaaattcaacagcaagatgtatgaaaaatacataaataatcgtttgattatttataggaaaaatataaaaatcggatgaaagagatagattcaaagaaaattttccatgaggttgaagctattgctaagttttcttcaaaattttgataggattgtatattctatagaaatttcaaaggatacgataggattcactccattgtttcaaatgttttcatagaaaatattttctatagaattgaaatcctctaaaatttatatattctttctacaaatcaaatggccccttattcgacatttgctcgaaaaaaaagacaaaatatgtttatgacgatatattttcatccataaacaaccatcgtaagtgaaaagggaagaagttaacaaaactataatcgtacagttaatcactcaactgtaggtccatacatagtggtttaatagtttgctatcatgttcaagatttatgttatatctgcgaaaaaaccgtgaaaaacaaactaatcgatcaaaaataatctgtatgtcggtctcgtgtgtatggatcgttgttgacatgcagattattgatgctcttaccttgttttccatatccaagtttaaaaatgaagttattttgaacggagataagtagtataatgacatggcagtactagagcaagagtttgagcacaatttattccttttctttctagagacacatccaattatatactcctactacaagtaacgcaatgacactgaatttcttctataataatatgtataaataatggtttagatatttattgtctacccccgtcctataatatagcaacctaggactggataggatattttatagtacaacgaatctgaacacactcatgttcaggttgctgtattatgggacggagtgagtatagagaatatagagttttttttttcacatcatgtctaacagaatatagagaacccacattaaccatccgtttagctgtttcaaatagatttatataattactttttattctataaacaacacatacaaatagtgaagtagatggttattttaacttgtctattagactacatgttaattaacatacaacaatcttttctgtgttctctcttttctgtacaacatcgcaccattattcatgtcgtaagattgttttcatcaatcaattaatttgcccttgctcgtattattttttaaaaaaaaaaacgaaccgcacaagacagtgcgcgtttcatgtattgataaagcaggagaaaaatacaatctatagtcctggaagaccacagaccagaaaaaagaaaatacaaccacaccgtgcgtctacaacaagacccactgcaagagcgaaacagaaggtcttcgagacgacacctccaagaaggaaacgacaccaaaggtgccactgtcgtctgtcccgggaggccaggacaaggttttcacctgaagaaagtaattaggagagataagaaatacaaaaacaccccaagaggaaaacggcacccacaggcgttgttgttgccggcccggaggcagagctttcgcccaaaatttcgtccctcccaagaactaaactcctgcacgctctgtagccaccaccaacgaaaaccttcgacgcacggccaccgcaccggcgccacgccgccagtcgatcatcatggggaagctcgaacctcgacacacaccggctccatccacgcagatgggttggatggggagagggtgagagagaagaatggatgccctctccccccccactagcccgctcgacatggacaacttttgtcgacaaaggcgtcgtcacaagaggacataagtctggaaatgtgcccgtcgaaggatcgtggctcctccctgacagagaaaccgccaactcagccacgaatctgttgcccatgtcacctcgggccgccggaccgtttcgccggcgccttgccaccctccacaccgtgctgatgaccccctccgccacagtgcacccgccgtccaatggcgcggcactaggacgtccaacgaagcacgatgctcacgccccaaaaccggtggaggggaccggttcttgccggagggaagccagacgcccagcactcgccaaagttgccagcataggaaggttcgcgccgcacggagaccataaggtcaccatcgtcgccacatctccaccgtccaccgtggcctggcaagcgtgccgctcgtcgatggctgcccaccacagcttgggctccgccaacaccaccactcagtattgactttaaggaacctacagtagcttgtcatgcaatgatttataatatttgtcatcctattctaccacaatttggtagagtgatttttcataggtaaagaattaaaccaaccctgtaattcttttgtcgtggaggtttggattgcgtggaacatgggctagagcctaagcctttcgataaagtattatcctcctacccaaaccttgtttcttctaggtctagtagtaacctgtagtactaacaacgaagtattattttagaaggacattcatcccaaacacgtttagaggtgcagtaatttcgagcaggcggaatgttggtctctcagtcaattagggaaaatgcgcagaatcataatccactgctctgtgagcactctactcttcctcacaagaacaaacaagatcacaagtttcatcgatggatcaacaagatcgcatcgcctccgccgccttaaccgctgatatattgatctttctcagatgagtttcatcatacagaggagtttgtttatatatctctctctctcgttcggcaacaacgccagctcacaactgccagctatgcattagctattacatggcccaatccggcccaacgaatctagtatttgggatacggagtcttgcagcccgtttgcgcggcccaccatcttgcggttgctgttgctcgtccgaaacgtcagtagctgggctgctgacaagcccctccccttggaaactgacttgaccccaagtcagggcagctgggaacctttgcctgagattagcttcatcttcccaggtcgcttcatctgcagcagaatcagaccaacgaaccagcaactgaggaataatacggttacctttcttatggagcctagtatccagaacttggactggaaactgaatactggaagttggaccaggtagctgactctgaacaggatgcttgaacccacaagagcctttcaattgagagacatgaaagacaggatgaacagcacagtccaatggcaactgtaacttgtatgccacttgaccaaccttggcaatgatttggtatggcccataatacttaaaagatagtttgtgattagctctcttggcaactgaagattgcacataaggctgcaacttaaggaaaacccaatcacctacctaaaactcctgaaaactcctttttttatcagcttgatatttcataacctgtcgggctctattcagatgttgcttaagcagttgagccatcaacttcctttcagataaccattgagctaaatcaggtatactgcaagcatcttctctgatgccgaaatgagtaggaggatagccatacaaaacctcaaaaaggtgacttatacagtgaagaatgataagagcagttataccaaaactcagcaagatgtagccattcagaccatttagagggagtagcatggacaaaacagcgaaggaagatttccagacactagttaaccctctcggtctgtccatctgtttgaggatggtaggctgaactgagatgtaacttagtgcatgtcggagaatgaactcctccacaagggaaccgtgaggcccccctttgtgagttcggccgggggcagcggatgagattcgagggcttggtgagcggagctgtgtgatcttgagggggttagcccccccccccaagacgatgagacaaaagagatttatacaggttcgggccgctaagaagcgtaataccctactcctgtgcatgattgattgaatgtagaacacaagtgcttggggttgcgagacccaagcgccagttcgcccccctccctccccccctaccccttgaccactaggcctggacctccttttatacctcaagtggttaccacatggacccaacaacctaacctatctccggtggagaagtattataatctttgcattaaatgcatgtcttgtctctgtggttgggaagccaatcacacgttgtcttgatgatggggcctatctaagcttgccgcctgacacgaggggtacccttgtcagtcaccatttaatgggtgaagacttctgggctcctattacaccgggaaacatgagccttgttttgagcagaggtggaggaccgacttgagtttgggtaagaggataataacctgtgacgatctttattggatggcacatgttaagctgtacgccgactgacacacgagcagcgctcaggcgcactacccagggtcatcggtcattcgaccggtcacagaccggttgagtgcactgcacgccgcattaaatgcggcatggcgcgaccgctcgggacgccataaatgcgggtaggtgggcacctggaggcgaacacctaacccaccgtacgtggtgacttagagagggggtcgggggagcccgacccctagtcacgggagggggcggccgccgcccaacctcgggcccgatcccccctcgggggggagccacatggcgccaggggcggcattctccatctagtctcggccagggagtggccgccgccctacctcaggcctgaccctcctctggggagggccacgtggcattggagggcagcctcctccatccagtctctgggaaggagtggccgccgtcctacctcggcctgactcccctcgggggagggccacgtggcatcggggggcagcctgctccgactagtctttggggaaggagtggccgccaccccacctcaggcctgactcccctcgggggagggccacgtggcatcggggggcagcctcctccctctaaacctgatacccccgggcccatatcaccgacagtgcctgacctgatgaacaattgctcccacaatgtactggtaaaaattttatctctgtctgaaattatagcttgtggcaacccatgcagcttataaacattaagcatgaagactttggcaacatccatggcagaaaaaggatgagatagggtcataaagtgggcatacttagagaacttgtcaaccactaccaaaatacagtcctgcttgttagaacgaggcaaaccttcaataaaatccatggatataatctgccaagctccatcaggaacgggtaaaggttgcagcagtcctggatatttagctctgtctggcttggattgcaaacagattgaacaagcattcaactgttgttggatggtatccttcatatgaggccaagagaaaagagatttgattctgtggtaggtaacaggaaatcctaagtgtccccccatgggactgtcatgcaaggcagagatgatttgctgttgcattgaagaattattgccaacccacactcttcccttgtgtttcaagagccccttgtgcagcttatactgagggtgagaagcaggattaacggccaattctgtcagaagcttaactgaaacaggatcttggtcatatccctagattatgtcttgcaaccacacaggagaacattcagatagagccaagaattctgacacttcggcaggaacattccttgaaagggcatcagcagctacattgtgcttgccctttctatagacaattttatattgcaacccaagcaatttagtgaaagccttatgttgccagggagtgttaagcctttgttcagcaaggtgcatgagactatggtggtctgtcaagatcaggaactcttggaattgtaagtaagggcgccaatgatcaactaccatcataatagccaaacattctttttcataggtggaaaggccttgtgttcttggtcctagaggcttgctcacataagctattgggtgctgattttgggaaaggactgctccaatgcctaggtcactggcatcggtttccaaagtgaaaggttgctggaaatcagggagagctaacacaggagcagaaaccaaagattgtttgagcaattggaatgcttgttctacttctgcagtccaattgaaaggagcatccttctttagcaattgtgtaagaggtttgctaatagcaccaaaattcttaataaatttcctataatagcctgccaatcccaggaatcctctcagctttttaatagtagtaggtctgacccaatcgacaatactctggattttagaaggatcttttgcaactccagccccactgataatatggcccaaataggatatatgttcctgggcaaatgcacatttactgagtttaaccttccactgatgattagataacagctgcaggacttgtctcaaatgagtaagatgagtaggcagatcaggactgtatatgaggatgtcatcaaaaaacactagggcacatttcctcaacactggactcaaggtgtcattcatagcaccttggaaagtgccaggggctcctgtaaggccaaaagacatcaccttatattcatagtgtccactgtgggtttgaaaagctgttttgtgctcctccccttcagccattctgatttgatgataaccagctcgaagatctaacttggaaaaatatctagcaccagccaactcatctaagagctcatcaataactggcatggggtaagttcctttctgagtgatattgttaagctgtctgtaatcaatacagactctccaagaaccaaccttctttttaaccaagagtgcaggtgaagaaaatgcactgctgctgtgctgaatgactccattttggagcatttcttgaacctgtctctctatttcatccttatgtccaggtgtatgcctataaggtctgataaacactggtttggagtttgggaataagggtatcctgtgatcacaataccgtttaggaggtagcccttttggttcttgaaaaacttcttggaactcagtcagtaagggctgcacaatctcaggaatagagggagatagctgattagtagatttatccaattgaacaaggtacatgattccaccagacttagccaatccatgtaactggcccggagttatagggagacagctgagagtactagacagtgttccctacaacctgaccattgagtcattcaactgaaattctagccacttgtgtacccaatccaccctcattgggctaaaccgttcaagccaatccatttcaagtatcacatcgtaggcacccaatgctaaaagtctaaagttgctcttgaaatgtattccttgagttaaccaatcacagtcaattatgtgcagtgagcaagtgaggaacccaccatcagcaaccttaactctagctagtactggcatagccttaacccctgataatttgagaccaatctgttgatacacaaacgagtgagtactgccagaatctatcagcataagaacttcaatgccctgaacccatcctcttaacctgattgagtgattggagtcagtaccattaatagcttgctatgatatagccattaaggtgtcagattcaggtggttctgaaacagcctgctcagactgagatgaaccttgtaagacgtccagcaactcttggaccacatgtaactgaatggaggaagcacatttgtgatctctgccccacttctccccatagacaaaacaaagtcccttggatctcctataagacttgagagctgacaatctatcatattcccttgaatgattgcttaattcagttcctctcctatcatttgaaatgattggaggccctcctttagtggttggtggcagaggcaatggcatagcacctttgactgactgtttctggtatccatcagattttttagattcttttggcttatcaccctccaatgcttcttcctgtaaaagagcaagagtacaagcaacattcaaatctccaagtctttgaagcagaatagcagacctaatcgcatgccttagcccctcaacaaatttagtgacaaagtagactggtttcaaagatgggtcataagccatcatttgatgcatgatgcaatcaaaatgctctacataatcagctactgatcctgtttgacaaattttaatccattgtctaataagggcttgctgcctatctttgttaaacctagtacaaattttttcacatagttcagaccaagtaaccccttctagttgagacctaactgcttgcagccaaaaggcagcattaccagtgaaattgagtgttgctaccttaacccaattacccggatgtatgccatagacatcaaaataagcctcacaattagacttccacatgattgggttatctccatcaaattttgggcaagtcatgggggctaccccaccagtcataccaactgacaaagcagactgaaacgaattcatggcagaagcatccaaatggaaaggaattggagagacattgtgagacgcatacgtaccattggccgggattggctttggggtaaaaccctcagcctcctcacgattcaaaatttgaacgcggtggtcaatgacactgaatgaacaggctgttgtgggttcaagcatcctgttcagagtcagctacctggtccaacttgcagtgttgactgaagagctctccagttgatttacttgcatttgcagcagatccacggtggattggagtacatccaccttcttctccacagctgggatccaagattccaccgcctccttgaacaaccgcatctcctacgcctgcctcttctccccttcctccctcttgcgctcagttttctccatcttctttagaaggagatcaagttttgcttcgttctccatgattttagcggtctacttcgtcacaaaacgtggtttctccagggcttcagatcttgtctcacctcaccccgaattcggccaactcgagcaaggcaagttaccttttcacggatctacccgagggtaatccaatccttgcccaagaatttcacggccaaatcaagggaaaaagaggattgacgaagctctgataccaagttgtgagcactctactcttcctcacaagaacgaacaagatcacaagtttcatcgatggatcaacaagatcgcatcacctccgccgccttcgccgccgatatattgatctttctcatatgagtttcatcatacagaggagtttgtttatatatctctctcgttcggcaacaacgccagctcacaactgccagctatgcattagctattacatggcccaatccggcccaatgaatctagtatttgggatacggagtcttgcaacccgtttgcgcggcccaccatcttgcggttgctgttgctcgtccgaaacgtcagtagctgggctgctgacatgctcacgtgtaaataccaataatgcaaactcctatcaaatcatggttaattcgcaaaattttatttttactatacctcactctcagaaatcaaatgacacttgtaaaaattaaaccttcggaattcaaatcattaatttttctttcaaaccgaataaaccctaaatttaccgggggaaaataagcccgggcccacgccagccgccacccatacggtgcacgggcagacaacctgcaaccgaccaaccggactcgcacggccgatagatcaacctcgaaccagaccgcgcgcggcaggtctctcgctggcacgtgggccagggaagaggtggaggagccgaggaagagcctgcacgacagcacgagtaaagtaca

SEQ ID NO: 59772 - DNA, 9832 bp, Oryza sativa
cccccccccccccccccccctcccgcggcgcgcgcgggtgttgtcgtgaccacccccacggtggtcgacggtgaatggacggtcctgccgcctggatgatgcctcgcgcctggccgcccgcagtaaacgccacacatgctgcgcggtgcctactcccctcccgtaccccgtactcctgatgccaactatgcaccgtcttttgactcggacataacgcatatagtatgttactgtactactgctgctgctgtctcgtggtacaccggtgcgaccgcctccatcctgtagcactagcacaaagagcagtggctacccagggcaacagggtactggactagtggaggagtggggttaatacagtcagcaaaggctgtattaggcccttcttgaccgctcgatgagttgaaaaccgggcacgtaacctgttcacaactgtccatcaggaggcgtgcctgtccctcactagaatcattgttgtagcatgggaagcggtaggatcttatcctcgagaccttgacggcgtgacgaatgcctaatctgatccgactgaagtctggatattcaaatcttgtgagcttcttattgtaacaataggataaacggccaagttgcggtgtggtatagagtacggcatcttaacaaatgctagtcggcgagatcaatgtcagcatgctccaatcaattggcggagatttttgtgggccgtacctttgtgtgagactgaagcaaccaacagaatggactactctgtgttcggataccccttttcccaaccatttttcatcgttttttcacgcgcacgttttttaaacagttaaacggtgtattttttgcaaaaaaattttatacgaaagttgcttaaaaaaattaatctatttttttaaaaaaatagcaaatacttaattaatcacgtgctaatggaccactccgttttccgtgatcactgttcttggtgggaacttgtcctagcgaatacttagggcttgtttagttcccaaacaaaacttttcacactgtcatatcgaatgttaggacacgtgcatagagtattaaatgtagataaaaaacaattgcacagctcgttgggaaattgcgagacgaatcttttaagcctaattgcgtcatggtttgacaatatggtgctacagtaaacatttgctaataacgtattaattaggtttaataaattcgtctcacagtttactgatgaaatttgtaatttattttgttattatactacgcttaatattttaaatatatatcagtaaatctgatgtaacatgcagtggtaaaattttttaccaaataaccaggcccttactaaaactatcaaaggcaaagcaacgacaaaagcaatactaattaggaggtgacacgccaacatctcgtcaaagaaccgagctgtatcaatttttcgcgccatcaacattatggttttcctctgtttatttataagctagcattggcacttttcaagtgctactatactgctatacatggttggataagtatagtacaactagtatatacttttataaataaaagaggaaacatatattcggtcattcgggtgccattgttcttttcaggatatataccatcctagggcaaggccaatgtatgatgtatatacacatattaaggtgggacccatgaatagttagcatttcttatggtatgatgcacaatgtatatggtctttaacatgggtctcactataaaataaaaaaattaagatggctgccaacttctttgagatagtagtagggagagagaggatgtgtaggagaaaaaaatacttgtttattcactatggctagttgtaagcttgagttgcatcataagaatttttttcctattgctaacttacacaatacacaatgtataaggtgtgtctcgagaatatatttattccttaaggttaactttttagcacattttggttgcccttaacacatactccacataagggggacgtaattggcaatatgtacatatggagtgtgggaatcggctgttttgacttgttagctagccgtattaagagtacttaatagcagttggtccatcgcccaagctgatccagttaatcgctaatctctatgctcccctctgataaggatgccatatgtctgacactcgttttctagtacggggtaccaggaaaactctgttcagagtatggtttggaggcacatgggttggccaggttggtctgcggcacccaccagccaaaatcagtagtaccactactcagttcttggatctggagaattttctttactggaagatggtgtgcactgtaacttcagaactccggcatccagcggttacaagtgtaccactgtagtactgtagtgctagtagttctagcgctgctagcatgggggcaactcagccaactgccatgacaactttccactcgaaaagacgaggaaactaacccacatgccaaagcatgcacgtggttcatagagccctaaaacagagtaatcctggtttattttagtggcccctttttgcagcaaaccgacggcctccctcatgcttcttctctatagcttgggcaaagtgtagttaccagtagtagaagtcctctctgtcccgctctctctgtttctgtaacgataatactataaaatggcaggagtcatccgtgatcgatgccacgacttggtttagtccgagccacatgccaaatacaacggtctaatctaggagtagtagtacttagcatcatcagctggaggaatggaaaaattggaccaagacatagtgggtcgggctgcttcaaagtatgcaaccaatcaccaaagtatggcgatcgatatgtatcattatctacacgaaggtcaaaccgttgcacagctcgcgaagttcagaagacatcaagacaacttgcgatcgatatatgtatcggcggcttcgagacgagccgtgcgtgtgtagcgtgcatggacgccgtctgttccaggcagcagctagctagcggatgaggcatggctcccgcgagacggcgagaagacgatctgaccggtggtcgctgtgccaaccacagcgaggctgcggcgcattgccatgccgccatcgtcagaactcagaagttcccttttctaccgtgctatgggatcgagtacccaccagtctgctacacgacatgcgtgtggagccgtggtgtatggagtaggcgctagcatagcaggagcagcatcaggccgggggagacggagacaaacaaatgcttccccacgcaggacggaacgaagcctgtgcgtaccttcattgcccggcaaagaacagaacatccgaagttctcaacatgggatatattgctatcttgcttggtcttcggtggattcgtatcatcgtatgcgctgcaacggcagatcaacaatccatctacacaccgtccaccattgcggtggagatataaacacactgtagaacatttcgggtgaagaaggccaaaagtggtgctaaagctacaataaaattcagtgtgaaatctgaagccatgggaggcccaaaaccccctgtctcagccaatatcgtgcagtccgtttgttcagtttggtgcctgggaagtgggaacagagggaagcagagagtgtgaacgtgaaattcagaatcgggtgaagctgcattctacaatgggcctttaaatttaactggaccaaaggcctcgtgggctttaaattcaaaaggaggcttaagctcggggttaagggccttaaatttaactggaccaaaggtcgctgttataagctggccttcaaaaggcccactaatcattagttgttgggggaaaaagtgcaccgaaggtccctcaacttgtcatcgaattacaaaatcgtcctccaaccacaaaaccggatacaacgcatcctccaacttacaaaaccagtacaaattaggtccctcggcgggtttgactcctgttttgtcggacgtggcagctgactcggcgtggggtctacgcgggtcccacatgttagcctcttcttcccctcccctctttttcttttttctctcctcttcttttctctcatcgggcaaggcaaccatcggatgaagaggaggccagtgggggaggcgggaggtgggactccggcggccagcgacgggcgacgagatggcggcggcaacgatatgggagcaggagggcctccccccacgccgccaccaccgttgccgacggaggaacacggtgagctgcctccggtgggctcgccggaggaagtcagtggcggtgtgacggcgcatgcggtgaagatctcctgacgagggacagcagcaggttgttcgtctccaacatcatggccgcgccccctacgtgctccgatctctcgccggctggaagaggagctcgcgagcggaggagacgacgtgcggctgcggcgacggcggctcgggttaggagagggttatgagagggcgagagatagtgggggtgggagatgcatggatggacgacggcgacgacacgagagaagggaggtggcggcggctgcaacgcttgagaagggaggcccgggctccgacgccgaataccacctccttcgccgcatacccccgcgcccacagccgctgggagccactgccatagacgactctgcgccgctcggcctcggcggcggcggcggctccgggcagggatagggccgccgccgttgcccagctcctccccggcggcgagggagggcgggcgcgggaggccgtgctgcgccgccgccgcctcatcacctgtcgccggccgccggattcccgcctgccccaccggccggttgccctggcgactattgaagtgcggagcaaatggagagaaaagaagaggagagaggaagagtggggaggggaagaaggggctgacatgtgggtcccacgttgagtcagctgccacgtcggacaaaaccggagtcaaaaccgccgagggacttagtttgcactggttttgtaggttaggggacgcgttgtatccggttttatggtttaaggacgattttgtaattcgatgacaagttgagggaccttcggtgtactttttccttgttggggagagatgtgtctaagacgggaggaagaaatctactggaccgggccaaattgacagatactcaatggaatattggttgtctgtatacattcgaaaaacttacctccctcgacaatggaccgaatctaattctactgtaaaaacaggtatatattgtctccttcaactatcaaaatcagctcactttatctttacgagtggtttttatttgacgtagcacttgacttggtcttctaacatggtgctctaacatggtgcttaattagcaattcaaccggaaaaaacccatagggtccagtggtccacatatcgataatattgttgccatctcacacctctatttgctctcttccctctcaatagtggagggatctacagtggtaggcctccttggatcgtgatagtagcaacactagcatgaactcgaggaagagtagggggttatttgtggagtgcagagcaggccacacttcgtcgggtggagcaagcagcaagcgacgagcgatgagacggcgtggaggttggcccctatctcggcttccttctcaactccaaccattagaccctaccaccaagatagccttcatagctccatagatggagggtattcgagaacaatgaaggagaagacgttagcgatggtttcgggcttgcctagcgcgaggatgatgcggcaaagtagggcttcgtgggtttaccagctgtcaccaatgacttgtgctgttgccggcactagcacgttggtgagaaaaacagactcccgtcgaggtggtcgagcctgagctccaacacatccccaagccttgttgtctgcatggagccatcacaatcaccgtctcctacgacctcgggtcttttaaggagaaagggataagatggcaataatgtttttttttactgatatacgagtctcttttaattttgtcatggctaaattacttggcagatgaatcgaatcaatgtggcacgtcaaacaaaactatggactatgatttgacgtaagcatcatgtagcacataacatcttcaaaatcacttgtggtaaaatgagatgattttggtagctgaaaggctatatacatagttttgtcagcccatagttaagggaggtaaaatggacttttcttcatatccgttttattgctgcggcagtgcgggattacggaatggggtttgatgggagttgcgtcataatcatgaacttatcaatggcttaaaccgatttaaaattgtcgtaaaacatgggagcaccgagcacatccttctctcctgctttccatgatatttgaccgccacaaacaaattacaggcgatctaaaccgtccgttcaacctccaatacggatggcccgacgcgaccgacgccccacggcccacggcaccttctcgaccctgacgcgtggaccctctaggctactactactcatcaccgcgggccccgcgaaccagccccacacgacggacgccaccacgctcgcggtggactcggtccaccaagaccgcaggcacaggcgccggcggcgcacacaacaccggaccggagcaccggaggcgggatcaaggtgaaaggccacttgtttgtgtggactgtggactgtggtctgtacctccacggctccacctcactcgtcgcagctcgagagttcgcccaagtctccccccgatccgtgcagagatcctcgtgcgtccgaggtaagcacacccccccccacccccaactcccagttcctaagccctcgtagattcgccattccaactcagttttcgcgcacgaaatgttcgtcttctttcttcgtcctaggtgagctttattgcagattcgccggttcagtttcgtttgcggctagaaatgttcgtgttctggggcagtaggatgggtgtcgggtgcttgatccgtggttcatgaggagggttttggagtgtgagaagatccgagacaccgcactgaattactgatcccattctgtgcgtgtgagcgagggagagggagggagggagactgggagaggaggggttagttttaatgtagccgttgaatgattgtgcctgatttgttaggtgagcatggaggtgatgcatgataccactgggaagaaggaagtggttgtctgttatatgaacgcccctctaccgtacatgattgaagagaattacgggggatgcttctttgaagacgacgttgatcttgcacaggttctccaggaccaggttgggtgcgaccgcctgctaccttcttgtttgattgttcctatgctactgatttgtttcttgttttgttcctgttctccttgttgcatagaaatcttaacatcatgtgttccaccccatggaaaattgtgtgtttggacaacacaatgtacaatgttatggaaatgcagccaaacacttcatggattaggttgttaatttgtcttttgttttgttgtagtattattgaaagtagacctgaaaggtgaaacatctttggctctcgtggtgccataataatgtgtaaagaatagcctcttgatgacatttacattgtaaaacttctagctcatccctcattgttacatggtgctaattaccattatcacaaaatattttgtacagtactagttatttgtcgaaggtttttcagtaggattgtgatgtttctcttttatagtacaactgcacaagtcaacagtgcatgatacatatgaaaaatatgatcctcatttgcttgatatgcttgcaccttgttcaggaaatagtctatcaattaatacaaggaaattatggtactggttcatccaaaactcattcaaatcctagttctagttatagccatggatgtgaattgggtgaacggaaaccatcaggagttgcaagttatgaagcgcaactagttgttgatgaagctttagctcgagagctgcaacagatggaggaccaactagcaagtgcatcaattgatgaccataacataatagaacatggttagttgtttactggtactcttctatatagtacaggacaactggtgagtgtctttcctctcgtaaatgctaatacgtggttcaaaaatatctgttcaggaagaaagccaatagcttcttcaacatctagcggtggtaatgcttctgcaagcagacctcctcaggtagtgatggaggatggcattgatccagataacatgacttacgaggtgaattccttcaaaccattgttttgccagtattttctctactgtttcgtaaggggacgtgccattgtcaactggtcttctactccatgaactttcatttcaaagtacctgtatagtctatggtaactactgttgtgtcatagaaaattcaagtatacaaaaattggacgtctccattttacacacattgctctaaccatgtttactatataaaaattgtaaagttgttctttaacagcttattgcttttaacaaatgcaaataaatgggataattgaagctattttcttttattttgttgaattttgtttgtatttcaggaactgcaacaattaggggaagctataggtactgaaagcaaagggttgccggaagatgtgatagcgctcttgcctacttcaacatacaaaattaggatattctcaagaaaggaaaagcatgacgagtatgtccctgtcctgattagatatttcagtgaaaatgtgatgtgcagttatcaacaggttattaataaacattttctatgcaacactctcatttacttattattattgtagaaggatatttggttagtacttttctgatcttaagttgcatccttcatcattgtgctagcaaaggaagctcctagagtactcgttatctatggctgcatgttcatgttgagttatattgcttgagtatgaaagtatttttaatacccacttctttgaatgtttacaaaaacagatgtgtgatatgctgtatgacttacaagaaccgagataggctgactaaattgccctgtgagcatcagtaccatcaaacttgtgtcaccaaatggttgaagatcaacaaggtaggccaaccatgcttttcaatctttccaatgtttagtagtgataagtgtatatgtgtatttattgtagttaccgtgaatatgaccttgattactttgctcaccgtaaaattgttctgcttttcgaaattccatcttattacctggtcaggctagatttaggctgagttcaaatctacgggtttgtcacccgtcctccctagcatgcaaaatggagcggcggattagtgcatgatcaattaagtattagccaaaaaaacttgaaaaatggattatgaattttaagcaactttcctatagttcttttttttttgcaaagaacacactgttaagtagttcgggaagcatgcgcgtggaaaatgagggagtatagaagttgcaagaagggagtatagaacacacccttagatagaatgacaatagtaatgtactgacaagaagacttaaataggtaatgagatgggtaagttatgaggaaagctacccaagaaaagagcttgtaatctcgtgtgttcatagatttacaaaatttttgagaccatgtttgcatccagaatgtattgatactgatcagccttgtgacacatttgtcaggtatgccctgtttgcaacaaggaggtttatgggtcgggcaagtgaaacattacggattcatctttcatgaaaaaggaggcaaacatgacggattcatctcacgccagttcaacaggcttaagaagtatcattgttcactggctgtgcactcattagcatgcatcatggtggcaggaaagg

SEQ ID NO: 59773 - DNA, 1128 bp, Oryza sativa
  unsure (1)..(1128): unsure at all n locations
agctcctaatctagatgcttaagatcgagaaaaacaacagatgggcaactagactgcaaggcagactggaaacggaaagtggagggagcgatagtggggatgggaatgaccggtctggaggagggaagagagaaggggaagagggagagacaccaggtatagctgacatgtgggcctctagcccaaattgcatgctcaagtaactatgtctggttgaaagtgaaaatgggttgataacacctagttcattgtgaaacatgggtaagacaccatagtccaacatgcaattccctcaaggcgcgttnacaaatagatcctcggcgccagcgtcattggcactgaggaccactttgtaaatattttttatttataaataggtcccttttcaaaaaattacaatttagtcctcgacgccaatgtcattggcgccaccccccttcacatttgtaacttaactttcatcggggggctagggagacggcgccaacgtcattggcaccgtcatattggaccacggcgccaatgacattggcgccgcgaaaaggatgatttttagaataagtttttttaggtgcctatttgaagaataagtttttttaaaatggtcaaaatgtgaaaaatctagggcatatgccattcttttacgtgtgatattaccgtggatatatgtatgtttctatatttcaattgggacggcacgtaaatttccatttctcaaaagaaaaagataaggtgacaaactatgcttgtctttaccaacagaggggaacaactccaaagtctgcaaatattcccttggtccattattacccccatgcaagtggataactatactagcagcaggatgttaaactagtgacactagacaaggagaactcaggcccaaagctgataaacaaaatggccagcacgtacttccctgatctttgcttcgatcgcatggcacaagctgataaaacaattcgccatcaatcgccgtctgacattgtttcatctctcgccgcggttcctgatctccggccggtcagaggcagaaaggatctcacctttggatatggcaggggctgggggtcaaatgtgcagtttactataaccgggaatcgtttgggtttatagaccccaaatcct

SEQ ID NO: 59774 - DNA, 1174 bp, Oryza sativa
  unsure (1)..(1174): unsure at all n locations
ctgctatcgtctagccagagagtgtttggtcttgtttccaagtggccaatctatgcttggataattctttataatggaacattggactattctacatccattaacgaaatataaccttctaaacaggactaaatgatgttggcataaaggctttgtacaagggaagcagcttatgaagagacaaatttgtgggagcttctgaaatgagcatgaaaatgacaaattcgacgggaacaaggacacaaaatggcaaaagtcgccatgaaactgcatgcgtggtgctcgtcagagcggaaattcgacgcacacaacggcacaaacgcgataggatatcgttaaaccccaaaacttgaccatcacaggtggcgcgtcgaagtactcgtttgaccagacaactacacaagttcatctggattagctttgtttattaaagtgtaaatttcacttcgggccatcttttattaccgatgtttcgttttgtaccaccctttaagcaatattttcattttggactgggtaaacctgcctttgtttcactttggaccacccgactctcttctcaagcatataaacgatctcgattacatcgtcccctactcgtcaatgaactgccacagctatatgtaagactatttcttcgacatattataagttggatgtagatggataaaaaagtaagggtggtccaaagtgaaataaaggtaaaaatacccagttcaaagtgaaaacattagtcctaagatggtacaaagtgaaacatcgataataaaaggtggccaaagtaaaattaactctttattaaaccaatcctgacgctgctctgcccgaactgtcacgcccactgctggtttcagataggaatcctatcctgacgacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 59775 - DNA, 2023 bp, Oryza sativa
tagtttagcttattcccgtgataagccaagcaacggggccgtagatgaacttaccctcgccacatcaaatcaaaccatggaaatattggcatcttgaggctgccggctactgtagatggtcgacaagtcaattccatcacgttaggattccctcgccgtaccacctgggatttatatatatacgtcgtcgtacgtagcacatgtcaataggataagataaaaaggcggttactagcatgtcctacaaactgttgacgtacacgtactggtactacccttcctcctccgtacaaaatccatccatctgccctggtagatggattaggctatgtgggtgggtgccgtcgcttcctactctagtcaggtgttagctagagccagccgatcatgtgccgggtgtacgtgctagaccgcccggccccctcgcggcctacgtgccgtgccgccctgggcggcgccgagcggccacagttctcttccgcgtcgctttccgctggtgcattgcatccacgatcgccactcgcttcgcccgtggacgtacgtacgtccgttgatttggccccggggatgacgcaggctacttgctggacggcgagtccaccaccggtttccgtcgggccggctcgggcggccggactcgtgttgtgagtcaataattgtagtacttgccggctcgcggctctactgaatcgactgtttgacacacagatcagatcaacgagtggcgtagttagaggacgtacgcaaaaggacaagataaaaaggggaataacagagccagccgcagagggcagaaaagaaaacgcgccaaggcacgctaatgcaattggcgcccagcaagtggatgccgtgcccatgggtaaaattggcaaggcggatcgatcccattcatagagagcacagaacaccaccacaaggaaggcccttctcaagacaggcactcaaaactaaaccggaagaaattgcgcccactgccctgcgcagcgcatgcataacgcagtgtgtggcagacacatggaacgagacgcatgacgcagaggcaatggccactttcttggcatctggcatgcgacaaagcaccgcatcgcaggcgcagcatcctttgggttctctcctacgcctccccctcgcacatgctgccctggcgctctccccgcacggagcacagacacacaatgcgcatcgaggccaaaacccggtgtgctgcgtcgaagcaaccgggccgttcggctcccgcgcgctcgcggaaggagcgggacacgcgcgggcgacaacaacggcgagctgggcaaaaggacccgcgtggcgccgtgggcagtgtcgcgtagcccagggcatggacgtgtgtacgcgcgatccaccgatcggtcggggtagattcgatctctcccagatcgccctcgctgcggctgcatgccttcatggcgtcgcatgcatgcatccacaccgaattcctcgaagcgttccgctaatccgggcgggcgcgctagacgggatggcgctgcctgccgtggcccatgtgcacacgggttcgcgatctcggtcgcacgttcagggcgcaaaacggcacgctctggagacccatgctgctcaccgacgtttgcctgctccacagtgctgtagttttgtgatttttcctctagaagcttcacttcatttcctttctcatctactatacatatacattggtggaatgggccctattgggctgaaatacacacgcctacactcaacactccctctcaagatgggcgataaatatctatcatgcccatcttgccacacgaagaagtgcactctctagcacctaatgccttcgttaaactatcagctacttgttcaccagagtttacaaagcctaagtttaaggttccctcatccattctctctttaataaagaagcgatctatttccacatgcttcgttcgatcatgctggactggattgttagcaatatttatggctgatttgttgtcacaccacaacttcatggaagtgcttgtcgacagcttcaattcagcca

SEQ ID NO: 59776 - DNA, 21459 bp, Oryza sativa
ttattcttatcatcattcacacctgagcttcaaaaccatacctttgtggaggtttacctgcattgcttcttaccccctttcttatagcaataggaagattagtttcttctccccctgtttcaaactcctctccttccgtatccgatgaaatctgtatagtatcacactgatcagatggtttatcccatccataggagactcatgttgccccattgtttgcgcctccaaagaccttgttttcctcctagtataaacttgtagattttcttcttcacgtggccttctccaattttgctcatgaatgggttcactaacaggatatgggattgagccaaccacaaatttcatgcttcttgattgtgtgtcttcttcagtacctgatgagccattctccccctcttgtccatcctcatcaataattggattgtcaagatcaacaaacaaggaactcaaatctgttctttctccatagaacggaacagactctctaaaagtaacatccatactaacaaaagttcgccgctcagatggactccaacatttatatcccttttgcccagaagagtaacctataaaaatacacttgacggctcgaggatccaattttccaacggatggtctatgatctctgacaaaacaagtacacccaaacacttttggaggaacaatgaattcattcttcccaaacaccatttcatatggagtcttcatcccaagtattcgtgatggcatgcgattgatgagatatgttgctgttatgactgcctcactccatagaaactttggtacattcatcgtatacatgagtgaacgagttacctccagaatatgtcgatttttcctctcagctactccgttctgtggaggtgtgtcagcacaagaagtttgatgtactattccttctgctgagagaaaactcctaaattcatcattcacatattctcccccattatcgctcctaataactttaacaccagtgtttaattgattcctaacccaagcatagaaattcttgaaacatttcaatacttcactcttgtgtctcatgagatatatccaagtcattcgtgagtggcaatcaataaaggtgacaaagtactttgctccacttaccgaagcaataggagaagtccatacatcagagtgaaccaacacaaatggcaaaatgcttcgaagtcctctgcttatgtatgtggttcgtgtatgttttccatactcgcatgcatcacacattaatttgcttttgtccaccttactcatctcatcaggaaataccttagacatagtatcaaaggacatatgtcccaattgacaatgttttagaatcaatttagcctcctcttcacttgtgctagctaacaaagcactacatagtgctttgtccgtccctcttctatccagataccacaacccattatgcctaacgccggttccaagctttcttccaattcttctctcctcaattagacaattctctcagtcaatagtaattcgacaatccatatgatcaaccaacgagcttacggatactaggttaacaggaaaagagggagcatataaaactgacgacaatgtaattgatggagtacatttgactgttcccactcccctcacatgtcgtaaagttccgtcggcagtttgaattgtttctttaaatgatgactgaaatggagtatatgatgtaaactcactcgacattcctgtaacatgtctagatgctccggagtctaatatccaagttgagttaggtacctgcataggatgtgcgagattaacaaagttgccaagcactgttgttttctccttcactttctgaattcttccccttatttcttcaacttcttcagccaatttctcaagtatttgctcaattccttaaatttcccccatggcagatcaaccaaatcttctaggatactagccaaatcaattaataggagtaacaacactactcctcagtttctcaccaaaaacagaacagcagcagtagcactacttcctcccagcagcactacttttcagtttcccccaaatcagcacaacagcagcagcaagccaagctctcgtactcagtttcttccccaaatcagaacaacagcaacagcaaaccaagcttccgcttcacctccaaatcctcaccttctcaagtagcagcagcaccagcaacagcaccaccaaagtcaccaccactggaatggacaacaatagccaatagcaccaaatccttctctgttgatcctacagccaacagctgcgcgtctctcagccgctgtgctccctacagcttgtgctacaccaaatccttgcgcagctcaaccagcgagtgtgcgccctgctcctccttcacgctgctcgcgtcgagaacctctgcagcagccgtcgccgcctccgccgtcgacactgccgctccgcctccgctgtccgacgtcgccgctccgcctcagccgtcgacgtcgccgcagaacccctctggtcacagcgccgccgccgactagggttcacgtcggcgaggtcaccggtgacccaactctgataccatgtagatttgtgatttttcctctagaagcttcacttcatttcctttctcatctactatacatatacattggtggaatgggccctattaggctgaaatacacacgcctacattcaacaagtgcccgccgcaacacagcgagtcggcgatacccatacaaaaacgtggcggtgtaaacaatatgcgacactgttccctcctcgtgcgctctgatgctgccactggaattcgctagtgtcattaggcatttaggcttaccatgtgagcgaacgaactgtaataaactttgaccgaattcataaacaggaattgtgggggtactgctgctacttcaaaataagtattcccaacaaccagattaggaatggactagtagtggatgacaccaacgcaataatcaacgaatgtgatcactgatcacaccatcattacgagccagtagggtatcatatatcaagattccagtgtcaaataaacaacaggtccagagaaaggtgacaatagacgaaaaggggcgtcacgaatcactgaacagtctttgccttcattgcaaggcgccaaggcctcgaacgtcaaaggaaggagaccgatggttggagccttggagctttcattatgcttctcctccatcatagcactacaacgagtcaagtaaacatacagcatttcctatatatcatccatgcatgccagattatgcgtggtccccgtcgtctgccgttgctcataagcatcagtcttcgtactaaactactactcgtgcgttgtgtctcatttctatccaccgtgcatggatgcttggaattatttgtacaaaccaccaaatccagagtaattaggaggtacggaaatttatttctggcgcagggcaagcacatccagccccagagacagcttcgaggatggtaccatgtaccattaactatgctagtgtatacaagcatagctaagattactgtagaagatggcaacgaaaatgttggagttgtgaccaccctcaacaactctcgcaggccggacgagcaaggccacaggcagagtttgcaacaggagcatctctataatgctttggtttttgtttggtactgcagtacatttgtctctcaggatggtgcagcgcttcgtaacttttttttttcttcagctactgtgatcattgatcaaaatcttcagcttgttacgtgacattaatctcgccggctggatggatcaatatgctaccagtacggggtgcacattgaccccatctggagatcagataaccggacattttcttcccaccaatcgctatctccctttccacaagaacatggttctgacccagacatcaaccgctaatctttattacagatcgtactactaaccgatatgctactactctaccagtatgttctaaacctgtctcgtgtgaagcaaatgctataggagactaaaattaaggatagacgaacctggtcagggaccaatcctttgacacgggattagcattagcggtaggccctgatcgagctagattctctgccagtttggcctccatttgtgcttctatgaactatgatcagccgagccgaaagccggaataggagtatatgtgggcgcaaggaaggaggaggaatgcaaaattaattgcgtgttggtgccttgccgtcctccgggggccatgcatccatccgttcccgacggaatggcgactatttttggcattgaaaggagcaaatacagcgacgaaacgtcgcctcaccggcgcggcatgcacgcccaccgacacaactgcaccacccatctcggaacgccaagcacaaaacccccctccctgctcgcctcccaaaacgctcgcaaaggcttcgaaaccatactctactcggctaattccaggtggtgacagtttggaattttggcggtgtcatttcgtcatcgacacgcagttgatagtacctgtggctgcggttaacgatgacttgaatttgcttaagcaagtttcccttttcacggagcatctcgtaattgtgcaatggaccaatggttaatggttatcgtttactaagagcatccgcaatggttatttataggctctatacaagagatccatgtcagcatatttttctacttgaaagagattaaatgaagagagagagcaaagctatctactaacctgaagatagtctatagagaaaaacgaggcaatggattagagagctatagatatccatgtagacatactattgatgtggattactattaatttagtttattactgagatgtatatgttttatatagagtatcttattttaccattgcaggtgctctaatacaccggtggttagtacgggccaaaggcaactgattgcaccagcctatcacaggcgtgaacagatccaatggctagaggacagctacggccattaaaacaagtctcacagctcaccaggtaggtccgaggcttggacaaacatgccaaatggaccaccaatggacaatgcaggctacctttcgctaatatgcagacgaaatggtgaataggatgatcagcttgtggtactaaccatcatttttcttaccatggcatgtagaagtactagcgatgagcaacgcaccaaattgcccaatcatattgcacccacggccagaggcgacagtagctacagcatacagaacagtgtgcacttgcgcgccgacagttatagtactaattctagctatagtagtaaatcaattcatgggtccagttgtagccagcagatttctagagcaagaaatgggtaattagctgctgatctcctatgccgtaattagtgggctaatatgtatggattcattcacccgcttctgctctcgtgtgttgtttagcttgcaagatgcattatcgctaatcaatacaacgaggtcagattaaaacccgtgcaggagtatcagagcgtacggagtacggagtagatcgacaccctgtcaccataggagtattaccgaagcacaagactggaattgtcaggaaggttaaggacgcatagatacttcaccaaacagctaccagcaacttacacttcataactagttaaaaacaagaaagaaaatctgtgacggtaacagcacccataaaaagctcaagcctaacaacgaccaattgctaaattcactcggtccttgctaaacacagtttgacacacttgtcgctttcattcacttgtcccggttgatcgcgagaatccggcatatgatcagtacttgacgggcatgcctagccgatccaacctgcccgatccagggtaggccttgttggtgaacttgctatgcaaggaggccgttgtcctctgtgccaccggcgcgcacgatccgggtccgaacgcgtgcgccgacgccttccggagggagctggacttctcgtactgcggcctctgcttcggcgcgctctgggagcgtgccttggcgcggaacgactcggtgttcgccatgtagttcgggtagtcggagtagccgccgaacaggctgcgcgagcactcgctcttggtcggcgtgaacgccctgctccgcgagctccccggccgcgacgtcgccgagaagaactgcgggctgtcgcagagctcggcgatgtcgacggccatgagcagcgggctgagcgcctcggccatgcccaccgacggcgggctgggcacggactgctgcgcggtcgtggagtccttggacggagactccggcatggtcgcgtagctccggctcttctgctcggatgtcatggacgagcatgacgagtggtggtgatggctgccgctgcgcctccgtgaggcgtgccgcccaggcttgccggtgtccacctcgagaatcttggcgttcttctcgtcatccaaataccgttcctccacccacttgtcaagccagttcctcccgcaagattctgacctctcccgggtcagtctctcacttcccggcgtcttcgacgagctcccctgcaacacaaatcgccatgccattaatctccaaggctgtcgcaatgtactacacataaaaatctgaacaaacaaacggagcaataccttcagagaaccagaacggccgtgcttaggcacgccctcgtgagtcgcctggtcgtacttctccggcgtcggtggcccctgcaatgcccaaccaccaccaagaaccatcatgagaagacgtcaacgacattaaaattgaaaaatacagaattgtgacataacattttttttaatctgaagtatctacaggtgaaaatacaggaatcatacagaatttttacttacgggatgggccgagacatgctgggagcggatagcgcgacacgcgcgcgcccgcctctggactcggacgagagcgtgcatgcaccggagcgtctccgccgcctgccgccgcacgatgttgccgcggacgagggcctgcagcttcaccaaccctcgcaacgccttcagtgcccgtctcgcctacgtacgcacgcgcgcaacgacaatcagagaggttaatcagcaggggacccccggtaacaacgggagcatgcaccgcaggccggaggttgacatgccaaccaccaccgccattactagagctgcttccaagaacagtaactcggtggtaacaaaatgcaaacggcagtgttcttgatgtgcaaaatggagttaaagcgccggagcccatgccttgcttggataaaagaagtctagggactaaggggcagtaaagacgcaggaatggcagagcagaagcacaaagaggcttctcttggctggagatgacaccacggcgtgttttttcctcacaagagtacatttgctaccggaaatttcttttggcgaagcgaaaaagaaagatgagatttttggaagaaagtgttctcctttttttggctttaaaattaaaagtggagtttccaccaacttaattctaaaacgtgaagttatcagaaaagattaggaactgacgagtcgagatgagaagctttaccaggtagccgcggaacgcggcctggatccgaacagccgcatactcctcccgcttggcggcggccggcgcgcatcgtccgctgctcgtcagccgcaccacggctgcggccgcctgggcagcggcgacggcagcctcggccaccgccgccgtcgccgccgccaccgcaatggcccgcttgctctgctcgtcgtccccctcatccgacgccgtgtacgcccgccgtggcgtcaccgccctctgcaccgccgccgacggcggtggcggcggcggcggatgggccggggacttctcacggaacgacttcccgaacccccagcgcttcttctccctcgccggcttcgggtcgccggagccggagttgggcttcttgccgccgccgagcagcccgcgcagccacctggacgcccaccccatctcctaggccttcagctcggccgttcccatggcttaacctcggctccgcttccagcacttcgccggagcggcaaaatggaagagcgggagatgaaaccgaaacagtgaaacgcgcgcacgcttacaccgagaaaagaagaagcggagcaaggtcggagaggaagagcctagtggaaggttagaggggattgtcttatagaggaagcacaagaggtggggccatttttgcaaatagtttatccgttttaggggccgcttgtgctaatatttttcggcgaagcgatcgtaaaactgtaaaatgtccttgttttgagggaggtatggggaaagtggtaggtgttgatcttctgctccgccggccgcctagccgtttgactatttattgttttgatcagacggccattccgggctccggcaaaataaaacatgcaacttctttataactttgttttactagctttccagctattacttctcttcttacgggtcacaaattattattagagacacatttctcttaagctcataaataatgcttttttcatcctaaaatagaccccctcttttcagatttatagttataggaaatattccatctcattctaggttcttatattttgggacggatggagtaagagattttgaatagatatgacatattctacacattcatatttgtattagttggatacgtcccatccattcaagattctttatattttgagaaaaaaaagaaaatatgttttagaataatctctataaaagttttttaataaataggagtactttttacttgactgagtaaatcaggatgtgtacttcaattgtttacttagctcaactaatatagtatttgatatgtaagtgttttgcgtgttcaaaaccaaaacctattacgactttacgagtttatgtccctctactaattctttttcctgtgctaatggaactatagattcgatgtaaagaaggcgggaaaaaaaggaatatgtttaaatacaaatactaattgcaacggttagttgtattagcgccttgccttaaaattgaaattatgctaacgtcaaaagtggacatcgtctagataccattccataaaacaagtttcactaatttgtcactttcgaatgacggttacacgctagagtgctaactcggatgaaattgtccataggcttctcttgtcgtgacctattcctttccaactcgatatacttgctagtgatgatgacaaaaacaagaggagcctcatcacgctcgccctctatgcctacttgcaacccactgcaatggtcatcttgcttaacctccagtatattgctcttatgccatttccttcttgctctacaaccactgagccactatggtgggtgtgtcaacgtaggatagtcactaatcccctatagcttatctccaccagcaaccttcccatgatgtctgtctccaccgtggaccctagtggctccaaccctcgatatacattggggctcgagaaggttgcaacgatgtttaggttggagaaggccggtggtgcaagagtgaagagatatcgtcgtcatcacctgttggccatggcatgtcaccgccgtagttatttttctcgccacgtcggaggtttaaattaaagcagaggcaatgatatctcgtctattcaaaggacaaatatcgtttcattattgatgcacacatcgcttaagaaatcacattttaattgagttcatttgcgaaacgacatttaaacgaagctcactttcaatgatgtggcgtaattctaaatttctcgtcacaacgacatacacatccgaacaccaccactatacttgctattacaacaaatccagaaatcctttatgaaattcgtccattgtcccggacgagggttttccttggtgctatatttattgctcgctcattgtacggcagagtgaccattgcacaattcagactcttcttctcataagatccctgcaacattactgggaatactagcagtactgttcttccctgggggaagtcagatcgtcggggcagacatttcttcgacgccccgctgacagcagggaccaccgcaacagcagcaacccgccacctccgtgacgacgacgccctactcgtgcctcccagcgcatccgcagacacagccatccatcgtcatcctctccctcggcgccgttggatcgaatgcgacccttccttcccacaatccgcgcgacgcgcgtctcgcaagagaaggcgtccccctgtcccgcggtagtagtactgggcacgctgtccacggagctgtgcggttgtctcatgtgtgcggtgcacctggttgcctacgcacggctggctacccgggcctaccccccacactgtttttttctgtttgcaaagctgacgaaagggggagctcgctggctcgtagtactaccgcgcgggacgtgacggggccaaaagcgcacccaagcctagcaggaaaacctgttgttttgtgctctgtagcctggcctgtcacggaggggggtggcgtgagcacaagaaaggctaatcctacctcgcctcgccagattcacaggacggtcacgtggccggaccggcgggtcgacggattggtgcttgcgcggccttgcgctgcgcgctcggtagagtgtggggccgaagccgaacgggggaatcgccagtaggttgccaggattccaggacgctgttgcagcctttgcagcgacgaggtgcgtccaagatatgggcctattacattgttgggcattagcagcagcccaaatccatcatccatggaagcagcggttctccctgttatatgggcctgaatggtccagtatgatttccgcccgccatgaaaaggaataagttcactttgagtcccttaactagtgaccgaatcaaattcatatacttgaaccacaataccggatatcttgacccctcgactattaaaaccggtgcaatttaactcctatggtggttttgaagggtgatttgctgatgtagcgccaacatggcagcgttgacctagtctttatccaacgtggcgttaacgtggcacttatgtggtattagaatttttttaaaaaatatgtgggacccatttgtcattcacgaaaataattgtgggggcccacatgtcatcctctttctttgcttcctttcttcctcctccccccctctgaataggcacatttgtaatgcacggatcaaattaacccttaattatttgtcacttatagtctatgacacatggattcttatgtgtctataacatatggatccaatgaaaaatcattgattatcacatttaagagtggtaaatttaattatcttttattttacggtgatgtctaaccctgatatgaaacaaggctttaaggtggtgtttggatccatggactaaattttagtccctgtcacatcggatatttggatactgatttagagtattaaacatagactatttgcaaaactaattacataaatgagagctaattcacgagacaaattttttaaagcctaattaatttataattagagaatgtttattgtagcatcacataggttaatcatggattaattaggctcagtagattcatcttgtgaattagtccaggattatgaaatgaattttattattagtctatatttaatacatttaattagtatctaaacatttaatataacaggaattaaaaaattttagtcccatccaaataccccgcaagttctggactaaacttagtcaccggagaccgtctgaccgctgacgtctactttcggtcacagtacactgtaataacaggtcaataatcacagtgacgttgccatgaccggaaagtccaaacttgttttcgtgctaaggtcccgtttagttaaaaaacttttcacaagacatcacataaaatctttagacacatgtatgaagcattaaatataaataaaaaatactaattgcacagtttgcatgcaaatcaagagacaaatcttttgagtctaattagtccataattagccataagtgctacaataatccacatatactaatgacgacttaattaggctcaaaagattcgtcttccagacgagtgatgaaattagttttttcatttgtgtccaaaaatcactttcaacattcgatcaaacattcgatgtggctctcaaaaatttttatttccccaactaagcaggccctaacagagcccaagtcatcaccattcagaaaaaaaaaacacagagaatcgagttgactacaggtcacacgacgcaaatatgcaatcatggtgacagacgatgggggatacgattaaagttggctttgccctttttacgtggaccgtgtcgcggtcacgaaagacggacgccatcattcgggatgatctgcccggacccctggatgacttgagcgatccttgttggtctgcgtagcgccatatccttttttgttgatcctcgtttactcccaaaagctctcacggccggcacaagcgacagcctaatcgaaggcaactcacgtcgcaatgagcgtcttctgtgagcacttcatctggtccttgtgcctttttctttccccgcggtccaggttgccaaaaggcacgctcgcgggcgcggtggcttcacaaaagcaacggggtgacggcgggttgatgagagccggaccggcccgaggagcgcaggcgtaggtgccggtgatgcttacgtccacacagctcagctgtctccctgcctgctggctttgccgctaccggcaaggcggcacggcaaccgagcccccggccccgcgccggcgccgcccgtatcgcacgggccgcacatccgccgtgacaacgacagcgaccttttctctgtccgctcttcccttgtcgctcggcgtgccccgttccaccacagtgtagtgttgtagctagataaaaaaaaaccgagattagaagggagagaagtctttcgaaacatttctctactgttataaaaaaataaaaatatttttatcggtactttggtacgtcatctatatatatgagacggtttttaagctcattcacttttgaaaatacatattcttatttgagttagtttttaaatttgttggctttgggaaatataaaatgatctctttaaaaacctcgcatgttaacttgagacgatcaaacttctaactgcagctcatgattagattttctaataaaaattatatccaaacgaattacttgagatgatcgaactcctaactgcagcttatgattttctaaaaaaaatatatccaagcgaattcccacagtgaatttcaccttaactaaccgtacaacaataataagattaaaatagccttcacttgttgcaacgtacgggcatttttttctagtttttttttaaaaatatgaacatgttaaagattaaacataagacatctgattaaaaccacacacaacctgtcactgtattatcaggtgcatcgctttagctggactggatattactccggctggcaaagcaaaaggacacaattcagtttgttactctggctgggccgattcagtttgttactctggacgggccgggcctgaccaggccagtgcacagcaggactgcacatctgtctcctgctgaacctctttgttcggcccaagtactaggaaaggcgctcatcaggttcatgattcatctaagtcatctgaacataaaactgcaactgagcattatactaaccaacacaaaactagctgatctcacggcgttgatgctctgcatttgctcaacttctgcatcaaagcaaaactgtattgtgttgagcgcgcgccattcctgcgggcacagaccttctggaaacaaaggtgtcatctaccagctaaaagttcagacttcagagatacctcgagatccacgtcgcggcttaaccaggcatgccattcaaacctttgagctgacctgctggataccataatctctatcccttgattttgttcctgcgggggagatcttgtcgttgggatgtctacagaaagtttatcttcatcgtataataaaacaccccacttgtgtgtatcattctttatcaagtctctgaacattaccagtattaaactcggcttgggctatacgacgtcttgcaaatacagaaagctaaggttagatttgagtcgcaaaggatttcgttcagagcaacttggcctgtggggcttttggttgattacaaccagggacacacaaagatggcgcaattcgagactgttctgccaggggaacagctaggactgccaacttatgcagttccatgagattcctggtgtccgaaacacatcaattttaaatcttcagacaaatgctgggtttgcattattaagcgcgtctgttaacctgccatgagacatatcggcattgtgacagttactcctgctgctgccctgcaagtgagtctgaacaagcttgagaataattgaagccctaagtatggctcacaaacacttctatgtacataacgaatatattcttgcttcattagacatgtataggttgatttatatacggagtacaacacatggatagttgacttgactaaccacatgaaaaacgaactaccaaggtacaaaaaccccttttcacggactagaggtagcactcggtaacatgacattacttctatctgagatgtgtctattctatcactagactaagtatgtgtttccatccttttctgttgtccttaaataacctaaaactagcctaagttatgctcccccacaacaatctctcccatcatacatcggttcattcagactggccacttgttacagcccccaaacgcatcttggatccagtctatcaggtctagtcgaagccacaacttaaggtcgacgggtctacacaacccgagaggttgaccaagtgagtgatgaccactccatcttttaagttgtgctctctatcaccaattatcgacgtaggataaaaacccaacgacatctttgcacacacatttttgtgtttagtggcaaaaaccaaaccgccgaggtaaaaaaacgatcagttcttagggaagagctggatatgaaaaccatctggaaagctgagaccgggggttcggactatgtttcctcctttcactgtcctccaactgccatgagaaaaaaatggttattcagatgatgtccacaggatgagccaacgtgagaatgttatatttaggttgagaaatggtacctgtattttgtaactaaagagtgtatgaatgttgccatcaaaaccttgctgagatcagttccaacgcagaaccgaagcccaccaccgaaggccatgaaatgcttcgttcctccagtgatctctggttttccctgttcagacaagggctagtttagagccatatattatttcaatgcagatattccttactaatgtggaaaatgcatgtgatgctcccattctctccctttcctcgttatgctacccattactcattttccacaacttcaatgcaaacagttgctttttttatagggtaatggaaacacttgtttattgaaactcttggttctcactttgtttatttctttatacccaatcacctaggagagctcactgaacctgaaatcagcttgttactgcatctatagatccatgtcatagacaggcaagacagcttgcctttttacagattgcattgctctttatgcaatttatcatcctttttgttttacaagggactggtgaaatagcacatggttcacctaccggattgagatactgtcggattacaaatttattaccacaagccccaatgatagctaacaattttctgtgcacttaagtagtacttgacagatgagatagcttcatggtacttgttttttcataggttacactgtacttctcttggcatttgaccttgttgttaaactactgagcaggaagtttctctgttggttctggtattaaacccctgaccgatcaagctggtacttgagatcagaaccttgcaaccttatactaatcacagtgctaataattgggaagttgcagttaattaaagtattcttctttcataatttccgttttaatgtcgaggcttgagaggagaatatatgcaagttcggtgagcagatcagataattacagttcctacttcctagatgaggagagagctcttttttttttaataaaaaaggtagacgcctaaaataaactgaaggaccaaagctcaaggctggagctgccgctcaacctggcaagatggaaccctaacctacgtgtaaacttagaatgtacatgcagaaactgctaattactgaaagttcatattaagaagactaacctgccacctccatggattgaaggccaacggatcttcatatatctcagggtttaagtgcactgccggtgggcacaccatgataccccatcctgctggaattgtgtagcctgcacaaagttcagagttcagttttgtgctgcaacttgctgaagtgaacctttctaattaacaagagatgtcatgtgctagatagtattcgagatatgtgtacctttgatctcaacatcctgcaacgccttccgaaaaattcccggcacgatgtttgcgagtcttacaatctccattatgaccttcacataaagaacatggaagcgttagttttggcagttatggattcagaaatcgtacggaaatggcatctactacataacctgcagttgccaaaacaattaactgcggtaaaaattcaggttgccgagttctgattctcttcctcttttgctattttcaattgtaaaaataggagtttttcttaatcagccaagcctgttcaagaaagttcttacagttattattaactaagattatctatcattcttgaagattgggccttggttaaacaacaggggaacacgaactctgcacttgcagagttgcagtcttgttggcaacagctttgggctcccaagattcttgcactagttccagatcaatctcattgttccccaagtaaattcgagcgggggtattacagtacgtagcagtgcagattggtctagcgcacactagtcccgggttaggctcacctgagacgtgaacgtcatcgatttgtactcggcccacgtgacgccggaattggggtccttcctgttcctgatgattgcctcgtgctcctcctgcatgcccacgcgatcgacaaggtttaattctactttgctttaacttgtcgatcgattgatctgatcaatgacgagctagttgaactcatcacactcccgttgagtgaaatatgatcaacagcgagagtagagagtagactaacccttagtgcgtcgacgactttgggattctcggtgaggagcttgacgccgatggtgagcgccagcgcggtggtctcgaagctggcgaagaggaggacgaacatgaggtccagcgcgatggtctccgtcagcagcggcttctccctcctcagctcctggatcacgtggtcgaagaagtcctcgcatggccgctccggttcggccatcctctccttcatcatgcccctcagcaccttcatcgcgttcttcctcccctgtgtacgtatcaattcaaaaaaacaaatttaaaatcggaattcattttttttgagtatatatcagctagctgtgtaacagtgagaagcaggagtttctgaggtttatggagtgcatgtgcgcggctatacggccaagtacaccgatctgtctgtgcgtgtggtccttagtttagtggcgtttcgcatgtgcagacggcctagctagggtgcaatttgaagttgtacaaattatatcgtgttcaagagtatgggggcagttgccgagttgcgggcggctgcgggcgtgtgggcgccgtacctccatgcactcgtgataggccgtgccagggatgttcagtgggaaggatatcaacccgcaaatgaacgcgccgaagttcttcctcaggttcacctgcgacggcttggacgggtcgtagccgatcagcttcttggctgtgagatcaaatatcatctgaaatatatatacagaattaatcctcgtcaattacgcgcaatgcggctagctaggcagctagcacatgctgatgcatgctggttgatttggcgtccggtgtgtgcttacagtggagatgccttccttgagctcgacgctgggctgggaggcccaggaggcgaggctgccgcggcaggcggcgtccgtctcggcgaggagcacggacttgaggttctcctggccgtagagccggagcacgagcgtcttgaggtacttgtacatgaagccgtgcagggagccgacgttgtcgcggccgaagatctcggtgaaggtgtccgggtaccagctctcgaacagcttcccctcctgctggaacacgtagtagttcatctccgggtcggccgacaccaccaccggccgccccaccacgcttgtcttgaagatgctcccgtatctgcgcccaacgccaacgccaatgtcacggaccgaactcgatcgatcaacaacgtcaatacttccgcacgccattgccgcatgcgttcttggttctgaggtggaggtgtgtacctcttgatcctctccttgacgaagggggagaggtcgcaggtcgggttgggcgcgaagaactgcagcgtctcgccgatgacggggaggccgagcgagcccggcggcagcctgccgttcgacctggggtggctccacctgtacgcccagcggaggagcgcgacgacggctgccaatgccgcgcacaggagcgctatataggccatggaagaagccatggccgccccggaggcggcgagaaggttcgcgtcgtataatcttggggcgagagggatggtggtggcgaggcggagagaagctagctgaagatatggctgcatgtgcgtatgggggagagttgtgcgagaggagaggtggtttgctaatgctagctagagttgctagcaaaggccaaaggggaggaggcggaggggttatctgtgggtttgtgggtaaggatggaggggggtcagcttatataaccaccatgctgaaagtcatggccttaaaataaaaggagggagggaaaattgcatacatgcccaagattaaactctaattgcatgcagttaatatatttgctctttttttttggctaatagatttaccaaactttttctttactactggtaggcgtacgattgtaacatatgtgttgatgtatcgaagcacatatataattcaacaatcaaaaggaataggttagctagtcttctggttctaaagtaatgctcgattagcttgaaacggttagacttgaaaatgcaatattttgaacccacaagtaatatatgcgggtgtaactcaatttcaccaacatatatgattgagtttttcctttctagttttgtgcaactagtttttaatttctaaggggtgccaaattatttttttgctctttcaaaactacatatatggttaacatttttttaaacaaaattaacatatttttagattagtcccttgtttactttgcacgcccatgggaacttgatgtgttagaagtagggtgggtattcggtccgactgatcggttcggtctcttgttcatttaaaatttttgtacatctaaaaccgaacactaaattcattgcaaatagttaagaccgagtaattcagtatcattatttcgtttcgatctttggtcatggctaaaataattggtagctttgtacgattaaaaaaaacacaaaacacaattaaattttagcaacatttcctctcttaaaggacatgttttgatagtaaaatatcacaagatatattgtttgctattgcaaacaatatataacacatcaagtcatcaagatatcatcatagtaagtccaatttagcattaatatttacgtcacacatgatacttaaataggctttaatgatataattcgatctattcagtcatttccaccgtactaatttcagtagtaagaattacttatcaaaatattcggtttcagtcttggttagttcgatttcagtcattcttttttttttaaatcgaagccagtatttgctggtgttatattaagtaggatagaagttatttatagagtcacgaaatatgaaagagataaaaccgaaaagaaactgaaaaggaaggaaaataacaagacaagacatcctcgcatgtgttatattgggatattctcgtaatacctttggcgctgcacataatccacaccttgttctcatatgtgattttggtcactagttgagggaattgagcctactgattgtggaacactcgtttatttcgttcgcaccagattccccaagctaccatcatatgaattaattcaattgccttcgttttgtgtttttccccttgggatgtccccttattcaccggtcaaacagtggctcgtcaccatcgtgcacgtttggtgtcttgcatcccaactgttgtaagatcttctcccaaacttgttgtacaaaggtgcaatctttgaaaaggtgttcttgccggaacctagttagaagcatagaaggacatggctgtgatatcaacattttgagggataggcttgaaatattcatacatcgacgaggcagagtgggaaatggggatgctttgccagtccagtgatcaatttctctggcaaccctattggctgttgagagctggtcctgattggttaaggattatatagaaggggaaagggaatagcaaagtattgccggtgtgtctccagaccatggattattctgctgtccctatcaaccccagacgatgcctttgtttatgcaaaagcatggtgcgaagtgtaccatactgaattccatcggagtgtgagatttcagcgtcaacttcaggtgagtctgtgtattgtacagtgtacataacactcttggagcagagtattactacctgacaagtactgcagctggcaaatactgcctcaacttcagaatattcagacccattatagggggaaaaaaagattcagatgcctaacatctgcaggctatctgaaatgtagtatacatgcaaagtacattgtactctaatcacctatcttgcactaatttcagagcttatagtcaagaatccgaacttggcgtgcaagaaactgaaccttttgttaagtaattcgtggcctgcgtgctcatcacagaaatgaactgattgaataactcacctgggacgccaaactgtgtagtgtgcttgcatggatgtgagtcaaaagcatagctttcaggatccatacaaaattctctcttcttcttagctgtgcaaatatgtgtcacaatctaagctctacaccttttggtaatcagtgacagtatactattccaccagctagccagacagtatatagattaagttgtttcccctagacaattatatcaagattgctagcctgaatccagcccagaaattggcactggagcgaaatacgtcagatcgatccgatttccgaatcttcctggaagcatcagaagaagcggtcctgaagcggtgcatttccgtgtcaaatagattcgacatggttggctgtccatttcgggaattttatacaggagtttaatttcttctgccattcgatgcctatgc

SEQ ID NO: 59777 - DNA, 4773 bp, Oryza sativa
agctccttttgtggcccccgttggcttctcccatatcccaacattatgcatgcacctcgcaacatgcgtacgtgttctggatgcatatgggtacagatcatttggctccgtatgggaagcagtacgaacagcgggggcgcgcacgtactacacaagtcacaagtggcccatgccgcgagtaacatgacaaacagcgaaacataagaaacggggtttcccactggcaattaaaaaaggaaaaatctgaagaataggatccaaatcatggagtagggtaagcggagcaaagagagaaaccaaaaaaatttgcccagaaattctgaacagttctccataggcggggctggttttcacaatttagaccatgatctaaagtgattccgcggctgcagcatgcagccacaacaatcactgccgaaattttttggaaaagtattggtctgttcggctgcaacatgcaacggttattgacaaccaattactgcttagttgctgccactaaagaactatcgtccggctactaggcagagttgcaacaagccgtggaataggctcatttttttttaagctagacacctagtgaagctttttaccgaaatggagttttgtaagcaatgctatgacatttgaaaccatgtatatgccatgactcatatgatttggtgccatgtagaaattaggacaccacataggataatccatgaagaggttaacattagcacacttttcaaattgttaagcagtgtgttttgtgcgaaagcttttatacatgaaagctgctttaaaaaactaaataaatctatttttaagtttgtaaaaattaaaacttaattgatcatccgctaatggttttcttgtcttatgtaccctaactttatcttcatctttcattagaaaagaacactacttacatatcacaatttgactttgtcgctaactcggagtaaatcaattgactgcttctaatcggatagggttttgaagacggggtttccaacttgaattgtaggtgacacattgagtgactacacattatactactccctccgttccttaatatagggcgcaactggttttttgatgtgtatcaaaatatagggcgctcatgcacatgcaagcaaatagcattaaaacaaaagtataaaatctggttgacttccgcacgcatacatgcaaaggctttcaatgcttcttcggtttttgcgttgcttatcctttcacatgccaaaataacaggttgtttgcagggaagaatgcaaagagctgcatgcatgcatgcaaagaccgatgcacacgggagaagcaaagcatcgcatgcgtcgctcgagaaaatcagttaagtcttcttggtattgccgtccagagcagttgcgctctatattaaggaacggagggagtatgtgcttgccatctttggtcaaatcgattgatgccggtgatccccttctctagtaccaaaatacggagtagatgtaaaagagacacggatttttatgtagaaaacacttaataagaccacgaatattgtcacgccccgaactagtaccgaccggaactagcccgtgacgctccaaattaacctgttaatcgataccagtcccaggaaacagtgctggtatcacagggagacagaatatcacagcaacagaggtctctttattatagagtagaagtacagtcatgttgggctgcggacagatcccgagctcacaactgcattacaaaagggaaacggaagccatgacttggaccaaacatcacaggcgcgacttgggaactaggccgaaaccctaaaactcatcgaagctggcttgctcctggaagaactcctcatcagcgggatccgcttcatcttcttcagcaactgggggggggggagattatttatatagagcaagggtgagtacgggagtactcagcaagccaggggaaataagtgtttaatgcaggcctcaaagaaaggctggtgtttttgcaattgattttattcgaactcttttttgaaacaactaagtgagtgcttctcaaacgacacggatgagatagtgcgtctcgtccggtcggagtatgtgcaatgtatcagtcttttagaattgaaacaaggttggcacccggccaacagcttttcaacggccacccgggccaacaacttttcaaacggccacccgggcctagctgatcccatcagctacagattttccaaacatcgaacccctttccacaacagcaatttcacaaggcagtagtcaaacaacactacgctaggaatcacctcacatccgcccatgaccgtgggcacggctgttcgaacagtttgttaacctctgcagagggggtacaccttacccacacgacattactaacccggatcacccagcccgtggggatcagccacgtcgggagacctccaagctttcatgacaaggcatttcgaaagccgacacaggtttaccatatgccgacgagaggggtcccagaccaacaacaggttaggtcccagaccatactgtgccaggaagcccaggggtcctccccgacaccaccccggtgaatccacatgtctctcggcatcaaggctcccctgataagctagttacttagccaggggtgtcccattccacccatgtggtcgtactggtcttatgtttggatgaaattccaaggaaacggtccttaagtgcaagagcgggaaaccgtacacccggtacgtttcccggtccgcggttttggaaaattcatttagttcacaagcaccgacccaggtgtcgggttttccaaatcttttgtaaaacccaagttttacccaagatgtttatcatattttaagtttgagggcgaccgtcgatactcgcacagagtgctcgagtatcgaggcgcaactggatggttacaaggggacatggtataacaattagcaatggagggatcagatgcaacaagttaggtaggtccgccaaactgtcatgcggacggaacaagcagattaagtgcgatcctatcaatgcataatatttttcaagcaacataattaaattcaaatataggctcaagatgttcaaaggtggcttgccttgctcgagatctggagcttgatcctcgaaatcctcgcactgcgggtcttcgggctccgaaactacacgcaaaacgggacaactcaacaaacggcgaaaataaagccctattaatgacctctaagcgtgccattagatagatctcgggatttgaggaattttgggagttgaacggagtcaatcggatttacggttgggaagatattgaatttctaagattattggatttttggtctaaaggaaaaggatttaattaaatcctttttggaaaagaaaagaaaagaaaagaaaggagggagggaaaacagacttttctcgggcggctagggcgcggcccgagagaaagagcggctcggccgagtttaacgggccggccggcccaagaaggcggcccagagcggcccaagatgcgcgcgcgcggaggaaggagagagagagccggtggacagggctcacctcgcgcggtcccgggtgggacccgcttgtcagcggctcggctcaccgtgcggagggagcacgcggcgcggcgctagggtggaggatggacgtgatgcacgcgcgcggttcgcggtggacgtgggtgcggcgggtccacgcgcagcctcacggctcgcggtggaacgcgcgcacggggagggactgaccggggtcggctcgacccggtctaggctgagctggcgccgacgtggcgcctacgtggctgccacgcgggccggcgggaggtagacgacgacgccggccggaacagacggcggtcgacagcggcgagcgacggagcgaaccacggcgatacgggcaaaagcgagcacaccgggcggttgcacgtgacgaggggagacgaaccaacggctcggatttgccgggggttgctcgacggcggcggattgcggcggcggcaaccggcggcgggagaagggggaaacggcgacgaggtcactaggggctaattcccggcggcgagagcatctacgcgattacgggaatccgatgctagcatcggattgggcggaactacgccgagcgaggccggcgacgagcggcgcttccgagctcaggcggcgacggcggcgagcacacggcgagcgacggcaacggtcggggcggcgccggctaacttcggggaggctactcgagctactaccgaaagctaaggggggagatggagcgaggaggaagaacggagggaggcactaccgtgcgggacgggcgcggtgacgagaggccgacggcgcgggagtgatctctccggcctcgggccgaggaagaggaagaagagggcgcgcccggagtccccttccgcgtccacgaacgcaccggctctcccggcgcttggcgatggacggcggaggcgagacagagcacgggagcggcggcaatggcgaggaggcgaatgggagaggaaggaagggagggggggaggcttgggtttataggaggcgggaaggtcggtttgggagagaggaaccgacattgggcggtcaagccggcgagctggcgctccggctagcggccaaaacgacgacaggaggtgacgccggcgagaggggaaaaagggggaaaaaggggaaaatgagggagagaaagggggctcgccccttgcctgtttgggaaaaggcggagggagcgggggcgacgtggcagggggaggaggggcgctgcctccgtcccttggcggcttgcgcgcggagtggcgggggccggg

SEQ ID NO: 59778 - DNA, 2735 bp, Oryza sativa
aggccgccaccgggggagatgggccgagagggattcggcccatcgaacccgggggaggcaaactagacttttgcggagggatttgatttggaaggatttggattcggaattgaactcgacgatagatcggggattgagatcttgagatggcacggacactagacaacaagcaaagaaacaaatttcgcaattagggtttttaggagataattttcccgctaggcgccacgacggaacgggcgctacaaatatcaatcagcaataatcattattaaaaagttggttacaaatgaatgggaagaacaatatataagacgtcatcttttctatgcggtttatagaagatatataaagtacaaaagtccaagagtcctagggtgaaaaatcttgaagtctactaggaaactacttcaaatataatatgcagtactccttttttttaatagatgacttttaaatacgtgtttgaccattcgtcttattaaaaaaagcaaatgtataaggtataaattatacttaaagtagtttaagtgataagacaactcataacaaagtacattataattatgtaaattttttgaataagacgaattgtcaaatgtgtgacaaaaaaaaatctcttaaaagacggaggtaatattgacttggtgaaaaccagatcacgtaaaaacgcccttgttttagcacattatcattgcggcaaagcaaaatcaaggccgagtttagttccaaaatttttcttcgaactttcaacttttacatcacatcaaaactttcctacacacacaaactttcaacttttccgttacatcgttccaattttaacgtgaactaaacacaccccaaatacaaatacccattctaataagattctgtatagattcctatgcatcccacttggccaatttccaaagcgatacaaagtacgtgctttgcataattttttatacaactacgatgatgagctcattactcatactcaaaactaaaaagttcaacggcgagtgtgaatgtgtggctcagagcgaggtggaataaacataacatgtactagctacttcgtaccaagggaatgggagacagatcctgtgagagtgtgagatgcgtctcatcgtccatgcctctacttgtgcttccgctgccaataattctgttcagtgtttgggcgaatatttccagttcatttcgcgcagcagtgagccgtggtggacagcattgatacagcaccgaagtctgaaattccttcccttttcaagttgcatctgccagtagactttctcgtttcagaagcctcgtgagaggatagattaacagagtgttctgtagcatgagctagctgggcgtggcaggtcacgataatcgcagcgccccctaattccagtgtctaaatttatttaagcagatcgttcttcgcgtggtgtgttaatttaacttcagccgcaaaagggttgaaaaaaccgagcgcttagatccgtgcgcgcgggtgcgacttgaaaagcgaagacctgatctgctactcgatctcaaccaccgaatgattgtaagcaaaaacgcgcgaactgaaaagggcctcgacgacatgagatgcagagaagctagctctccttctgaactaaggaaaagatccagagagagaatatatatttggagcaaatcaatgccaggatctcaatgttttataattcatgcagctaggagcgttgccactgtgtgatggagctaatttgtaggctacagcagcacaactgcacaagtgaacccagtaggcgtttcctcgttggattttgtcaagctactgttggattcatttttggacgatggagatatgttactgttggattcattcacatgcatgccttgttcacaaatccgtcgagaattttggctggtctcgcatcttggcaatttgcaagcaactcgtattcttgagttgtgtagctaaggaatttcaagcaggtaaactgcatgcatgcatttggccactccaaatgagggataggaagcacttctgaacaaatgatgaaagagatgatttcaactgcctgccagcaacaggaacgtggaattatttcattttctcccatacgtatggatcagagagagggagtaggctgttggtgttggagcccccaccgacagaagaatacaatcctcgtcagcaacgctgaaaacacgtcctgctgaagtagaccaagtacattaataattcccccccccccccaaagatagattaaaatgcagttcatcagcgaactttgcaaaccagagtttttggctagtccattaataagtacaaatgtacaatacaattttcttgatctcgcaacgagttcacacaaatcttccttcggaacagagcatgtcaaccatgaattttcggtgagtcggtttagtgaaccaatggatgacacctgctagacatgcacaacagtgacactgtgacagtgatgccacaaacgcgcagtcatcacacccatgtagcagaggtagatgtgttcatccaccatggcatatctggatttttcacattttagtccttttaaaaaacttatcctccaaataaactcctaaaaaaacttattctataaatgattcttttcgcggcgccaatgtcgttggcgccgtgattcaacatgacgacgccaatgacgttggcgccgtcccccccccacccctggatgaaagttaagtcacaaagaagaccagtttgtaaatttttttaaaaggacttattt

SEQ ID NO: 59779 - DNA, 2104 bp, Oryza sativa
tgcctaatacccatggtagtgggtgcattatttgtagatggaccaatcaccccattcaccattggagatggcattggcttgggtttgggtttcttgtggaaagtcataaaagagatgcttgtggaagtagtcacatagaaacatcgaggtgcactctgccgcttctgagtatgcggtggagtagtgcatcttgccagcgttggtgacggaagtgttagcttagccactaccattgttgtctgtacttgagagggtacaatcttagacggctcctgcacggggcacaacgtgttgctcgatgcaatgtgaacttgtacgagcagtcaatggagaatgcgcacgctgaaggtgacgttgccgtcgagctccctgatggctttgccctcatacttgctatcgtgttcttgcatgtgatgactataaaggacaacaattatataactaacagaaaaaccattctggtaagcacaactgaactacataaactatcttctaggtgaaacctatagtagtataggatgaaaccaaggagttgtggcattgtcgcgactgttacatccttcagcctccacaaaggtttacactgctagataaaaccggcgatctcttcaattgtctctacggaaacaacataattccagatttatggttgaattgttgattttctagaagctctactggactaaacaaaagattgccacaaagttatacttcaaatctaaggagcactaacatcaatcttgttgactaaggttgcataagcggttggcgctcaacccgaatagagaccatgtcatggttactactctctccgttacaggttataagatgttttgattttggttaaagtcaaactgcttcaagtttgaccaagtttatagaaaaaaatagtaatattttcgaccaagataaatttattttaaaaatatatttaattattaatttaataaaactaatttggtaatgtaaatattactatatttcactataaatttagttaaatttgaaacagtttggctttgaccaaagtcaaaacatcttaaaacctgaaacggagggagtattatgaaagaaggaaatagaagacaccctccaaatctagtatacattaatcgtcaaaggatccagatggtggcgatgcatttaacatgtataaatgacggtggacaacatggaaagcagcaatcaacatgttggcaacagtgaccttcagatagcagtagttgagagccaagccatcttgaagggtttgccagtaaactagcccttcggctctccagtttagttgtttgccgacgctggatccttgagactccattggtacatttatgtcacgccccgaactagtaccgaccggaactggcccgtgacgctccaaattaacctgttaatcgataccagtcctaggaaacagtgctggtatcacaggaagacagaatatcacagcaacagaggtctctttattatagagtaggagtacagtcatgttgggctgcggacagatcccgagctcacaactgcattacaaaaggaaagcggaagccaagacttgggccaaacaacacaggcacgacttgagaactaggccgaaaccctaaaactcatcgtagccggcttgctcctggaagaactcctcatcagcaggatccgcttcatcttcttcagcaactggggggggggggttatttatatagagcaagggtgagtacgggagtactcagcaagccatgggaaataagtgtttaatgcaggcttcaaggaaaggctgttgttgttgcaattgattttatttgaactcttttctgaaaacaactaagtgagtgcttctcaaacgacacggttgagacagtgcgtctcgtccggtcggagtatgtgcaatgtatcagtctttaaaattgatcaagattggcacccggccaacagctttcaaacggccacccgggccaacaactttcaaacggccacccgggcctagctgatcccatcagctgcagattttccaaacatcgaacccctttccacaacagcaatttcacaaggcaatagtcaaacaacactacgctaggaatcacctcacatccgcccatgaccgtgggcacggctg

SEQ ID NO: 59780 - DNA, 2435 bp, Oryza sativa
ccccggggtagatgggccgagagggattcggcccatcgaccccggggaggcaaaatagacttttgcggaggaatttgatttggaaggatttggattcgggattgaactcgacgatagatcggggatttgagatccgagatggcacggacactagacaacaagcaaggaaacaaatttcgcaaatagggtttttaagagatagttttcccgctaggcgccacgacggaacgggcgctacacctacctagcttgttgcatttgatccttcctctgttaattgttataccatgttcccttgtaaccacccagttgcgcctcggaaatcgtgcactctgcacgagtatcaacggtcgtcttcaaacttaaaatctgaaaaacatcttgggtaaaacatgggttttacaaaagacttggaaaacccgacacctgggtcggtgcttgcgaactaaatgaattttccaaaaccgcggaccagggaacgtaccgggtgtacggtttcccgctcttgcacttaaggaccgtttccttggaatttcatccgaacataagacaagtacgaccacatgggtggaatgggacacccctggctgagtaactagcttatcagggaagccttgatgccgagagacatgtggattcgccggggtggtgtcggggaggacccttgggcttcctggcacagtatggtctgggacctaacctgttgttggtctgggacccctctcgttggcatatggtaaacctgtgtcggctttggaaatgccttgtcatgaaagcttggaggtctcccgacgtggctgattcccacgggctgggtgatccgggttagtaatgtcgtgtgggtaaagtgtaccccctctgcagaggttattaaactgttcgaacagccgtgcccacagtcatgggcggatgtgaggtgattcctagcgtagttttgtttgactactgcttgtgaaattgctgttgtggaaaggggttcgatgtttgaaaaatctgcagctgacgggatcagctaggcccgggtggccgtttgaaagttgttggcccgggtggccgtttgagagttgttggccgggtgccaatcttgatcaattctaaagactgatacattgcacaaactccgactggacgagacgcactgtctcatccgtgtcgtttgagaagcactcacttagttgttttcagaaaggagttcaaataaaatcaattgtaaaaacaacagcctttctttgaagcctgcattaaacacttatttcccatggcttgctgagtactcccgtactcacccttgctctatataaataatcccccccagttgctgaagaagttgaagcggaacctgctgatgaggagttcttccaggagcaagccggctacgatgagttttagggtttcggcctagttcccaagtcgcgcctgtattggttggtccaagtcctggcttccgtttcccttttgtaatgcagttgtgagctcgggatctgtccgcagtccaacatgactgtacctctactctataataaagagacctctgttgctgtgatattccgtctccctgtgataccagcactgtttccagggactggtatcgattaacaggttaatttagagcgtcacgggctagttccggtcgggactagttcggggcgtgacagtaggtccgccaatctgccttgcagacgggacaaagagattaagtgcgatcctatcaatgcataatatttttcaagcaacataattaaattcaaatataggctcaaggtgttcaaaggtggcttgccttgcttgagatcttgagcttgatcctcgaaatcctcgcactgcgggtcttcgggctccgaaactacacgcaaaacgggacaactcaacaaacggagaaaataaagccctattaatgacctctaagcgtgccattagatagatctcgagatttgaggaattttggaagttgatcggagtcaaacggatttacggttgggaagatattgaatttctaagattattggatttttggtctaaaggaaaaaggatttatttaaatcctttttgaaaaagaaaagaaaagaaaagaaggagggggaaaattagacttccctcgggcggcgagggcgcggcccgagagaaaagaggcggctcggccgagctaaatgggccggccggcccaaaaggcggcccaaagcgcgcgcgcgggcggggaggggagagagagccggtgggccgggtccatcccgcgtggtcccgggtgggacccgcttgtcggcgactcggctcaccgtgcggagcgagcacgcggcgcgcgctagggttcggggagggagacgcggtgcacgcgcgcggttcgcggaggatgcggtgcggcgggcccccgcgcagcctcacggctcaccgcggaccatgcgcacggggggggggggggggggaaacggagggagcgg

SEQ ID NO: 59781 - DNA, 4770 bp, Oryza sativa
ccgcctccctcggggtagatgggccgagagaaattcggcccatcgaacccgagggaggtaaaatagacttttgcggaggaattgatttgggaaggatttggattcgggattgaactcggcgatagatcggggatttgagatctgagatggcacggacactagacaacaagcaaagaaacaaatttcacaattaggatttttaagagataattttcccgctaggcgccacgacggaacgggcgctacaatttagcatgagcactagcttcactagatatccactatgtccaattaatgctcactgctattgaatccacctttccgaggcccaaccaccaacggagccgatgactctgagcacctctaccaaccattttgttgcctccaagcagtagcggacgcatatatcagttcaaaaccacagtgggtcgaatgatgctaaacaatcaatgagtgtaagactctgtttagatgggctaaaactttaagagcaatagaacaaaacacatatcatatttatatttcaatcgcatactgtctcaatcattgtttgcgacatgcatacgttgtgaagagacggactaatatgttatacgttcacaccttgttatacctaattttgatggtccatgactactgtaagggggtagggggtctcgagggtgtggcgacacaggtcgtagctgtgttggtcgacccaccctgactaatgggtagattggtccctgcctctaagatcctcctccctacatgtgctgcatgtgaggctccaaatatggaccactggctcctgtacaacacacaacatcgctccgccttcatcacaaggacaaaggcgttgaattccagctatccctcaagctatacaaatggaaataatcctactagggcatggtttagttcccaacttgttctttaaacttacaactttttcatcacatcaaaacttttctacacacacaaacttccaacttttccgtcacatcgttccaatttcaatcaaacttctaattttggcgtgaattaaacacaccctaggaagagatccaaccatgggagggacccaactaaactaaaactagcctattagataagtttttttttgaggtggggggatttgatagtgaggtcaataaaagtatatacatgtttggtggaacgatttcatttataattttgtactgggacggatttcattccgtacacgatctcaattagtaaaaaaagaatcttcaaaaggcctcatgatataaattagaaattaaattatgatctcgtctataaataaatcactccacaaatatatatacaacgccaacttttagaaaaaaaaactggttggaatatgattacatattttaggccttcttgaaacataattttttatacaatgtttataggaaatagtttagttcccatagtccaaaggacgtctcacatgcaaatgcatcccccccccctttcatgtgctgagcaagctcctcgcacgcattaaacacaataatttattttgtaattctcttataatttttcatggctattttaaaagcatgcagaaatgattaataatggttgaagcagcagagatttaaattgctgaagcttgccagcaaatctcccaagtcatcccaaacttcctggagatccaacgtaagcaacgtgtcagaaaactcaaacatatgcatggtctaaaatattacttcaacatcggtattgttgagaagcatgtgcaaattcagtaaaacacggccaccaacatgatatacttgtcaattcaactaaggtttattttcgccatattctccagtcaaatggtcgaatgcctgctctaagcatgagtgttacactcatgcaactggtcaaagtgttcgcactagcactcaacgtacatatactctgtacgccacctgcacgacacggccaacacagtcatgtgcgcttaggctgaagatttgtacaaatgcatgtatagacgataaatgcagaaatggaattcaatcaaagtgtaattaggatatcagcaacgacatcgcccaagaaatttctctataagtatatatatcaccatatttatgtggttgggttcttcctgggagatggattttcaaaaaaaaaaaaaaatcataactggcatacaagagaaaccagtggacatcctcttgaggaacaaaattacttttccgtgctggttcttaaggggccatcatcgtttccgtttctacccagagaagtacgttcttccggcaacaactataacacattgtcatcaaatttcattcaaaacaattcgtcgatttccttgaattggaagtgagattaatggagatgctagctcgacacgaatcaccttttggtccttattgaagttgaagtgctcgcctccaagagctataggtgcatcacataaagtcatgaactgcgtacatacgcagggagtctgagtggctgaacaagacaacaagcatgagcatttcctgacagaagatcttcgagtggatgataagttttgactgtaaagttcagatggagctagctagctagctactctagctgcttgcactcacaatctcacatggtactggtaggaggaggcaatagcgatatgataatacgaatgcctctttgactaccagttggaccagcaacaggctacgacccttttctttttctcatcaggcaccatggatctccatcggttaaagttacttggagactgagcgatgcaagtctcgcaaaactcaccagagagacaagcaacaatatgcacaagatggattctaatcgatctctcgggtgcatgatgactagtagttgtacgaactggaactgctcaactgcatcgaccacctaaaagcaacacgattgtcgttaaaccaggctgggctattaggctactccaacagagcgcgacagcgcatgacatactgagctgtcaagttttggaacttacggcttcaagagcgacaggtgtttcctgcatcaagctttgatgcttggtagatatagagcaacatgcctgtagacctgcagatgttgcaactcatgtgacatggacaagtagctgggctctaggcagcatctgctctcctgtggattactactaccctacgtaccaccctattaggcgacactggatacattgccatcgatctctatgtatacgttgccgccgaatgcgacgaagctgccaggctacgcgtgcaactctcatcactgtgaagttgcattcattcaggcttgcaggaagctcgtgcagtggcaatatgcaggcataactgtatgtatggcagaaaaaaaagcttttactcagggaaatgagacatgctatgccagcagagactgtctgtgtaactagctacatcctcatggctgacagtgtgaaaacatttcgatgcgttattccggccaggttgtccaactatcaaaacacgcgacaagttgtgcaaatcgtggcgtatatagtacaatactattctctctgtgggacatccacctagccagataagtatcagtatgactgtatgtgcaggttggaggagtggccaatgcaccctcacgcacacgaagggacgttgtacactagctcgtttactgtacgagcaagttctcatgccacgctagacaagcacatgcatgctttcccctcgatcccgaacggcgggatacttgcttgggtctgctgcgagattcgtcaaagtaaacctcggatgcatgcgtgtacgagtacgatggaatctgattttgtacgtaccaaccgcagaaaacaaatgcaatctgtgggcgcccttgcatgccatggccccacggcctaagcaaaccgctggattttgagcagtagagaaagctgtgtgctcgttgcattcgagtttttcttggtctcccgtcgcaagatggatttagaactttttagacgatcaggcgagccgtgccgcctgaaactacctgggcttgactgtgccgagtgcccagaagatgtgtttcctgccctgtcccgctgcatcagccgtatcgcggtgcaaggtttcgccgggcgcgcgcggcgcggcgtcgactggtcgaggcgcatgcgcaaacccagcaaaatttgggcgggtggtggacacggcatccgcacaccgcgcggtcacacgcgcgacctgcaagtcagttggcccatgacaccctgtgcttccgcgacgcgctcgatcgggaggtcgggagcaggatggtgtgtcgcgcgagaaggtttgcttccacaattgagcccacgaggcacgcgggtagagttcttttcgtggggcgccgttcgcgtgtgacacgcacgcacggagtcccacagggagaggggtacaaactggaccgaaactcgcaaggggatgaacaaaaaaaaacagggcctagtaggcctggagcaaagaagaaaaaggttcaatgagcctggagctgttgtatgtcaactgcgaaaaagaaaaagggcctagtgcagttttattgtccaatgcacaaaaagaagtggatgttgctgcccaggatcgaactggagaccttcagtgtgtaagactgacgtgataaccactacaccacagcaaccgacttgtttgcaagtatcacaaacgactacaagtaattgaaggctactgtaacgtttcatctctcagatttcgcattattgaaggttactgtaggtgctttatgtttttataagaaagaatagtgtcctaggacgctttatctaagacgaagaaaagcatgcgaagcttaaatagaacaatattttgaatccaaacttga

SEQ ID NO: 59782 - DNA, 3182 bp, Oryza sativa
agtcaacagcgtcatctattaaaaaacggaggtagtacattaataaccaagggctgcatagttgcatagggtccgaatgctagataaaggaggtgctctagcttcagatgccttagattttccaccctttgttccaataatactttttgacacagtctgaaactgaagacacacgagctgtttatttcatagttacaatatagatatcatacgcaacaagttattgggttcacaatttctttattattacaacagtggaatatccaataggtatattaagtctgaggaactagttggatgtgatagccttgagggaacatgatctctgatatgcgcagtacttcccctccttcaatctccgtccaactaaacggagagttcacccggcaaaagaaaagaaacagagttcaacatgtatgtcagtgagtttttctaagactatatcagtgagcatagcaggcaacaaacgaacatcaacatgcgtatgtacctatactcggtcaccaagatgtggaggaagagtgcaatgaaaagcttgctaaactctgccccgagacacagcctgacgcctcctccaaatggcatgtaatttttcagcatcgagcttctcttctcctcctgtatttgccatttgcttcagtgagtcagatagaaacattgtggtaaaacacaacacaagtgaagaccaatttaacaacaattcatccttgaatactaatagatcaatattgaaatgtgtcttccactaaccctccacctccatggatcaaatttaagtggatcctcgaacaattttgggtttaggtgaactgccatggggcttatcatgactaaccacccggatggaattgtatatcctgtgtaaaaaccaaatattataataaccatttgtatggcctgatgtgattctcatgagtaaatactatgctatatgcacaatatattatcttattgtttgtgttagaagtttacctttcacttgcacatctgttaatgttttcctgaaaactccaggtgtgacgttactaattcgagtaatttcattcataaccttcaggtaaaacaagctcaaatgagttaacaaaagcaattgccgaaatcatcactatggcaccaatgatgcttcaaacataagcggacaacaacgtgaaatcacctgagtactgaatttcaaggacctgtactcctcccatgtgaacccggaattcacaccttctcgcttctttagaattgtcccgtgctcctcctagaatgatgtgttaattttagaattcatccaatatttcattatttgtctcgaacataaactacccgcattaaaaaaaatacagaccttgagctcttcaacaacttttggattgtcggttaggtacttaaaagctacagtcaaggttgatgacagtgttgcaaagctcgtaaacaagagcgcagcaagtgcgtctatagcaaagttttcatcgatcattggcttttcgctctgtagctcttcaacaatgaggtctacaaggtcaccatacttctttccaggtgcacttagcctctctttcattatatcagtaagtgtgttccgcacatttctcctacccttcattagggaacaaaaaaatcaggacaactgaaacaagtaatctagaagaccagtgtcctagttaatattcaggacatgtatttctaatgaagtagatgagtataccctgattaagctatttggacaagtaggaaagaaacccgcgcagatacacaggaaacttatttattattcataaaaagaatgttaaagaagtcatatctcaccgtatttactataagaactttaaattatcttataacaataaaagaaaaaatatctctaccataaaatagaccataaacattgatatcttaaatgataataacatttcttatattcaaacattttgtcctggttatatgtaaactcacatattaccactacttattacttgttttcaaagcaggatgcatttttaatagatgaaactatatatgtaaaaaaaaaacacctagtacatcattaatatagaaaaaaatatctctcacctatgtctaaatctttgtgcaaatatttaaaaatacaacaactaccaattaatgggataaacccattaaaatgtgtataaataccgctctaacggatgaaaccgagggctttttttctctgatgccttgaaacatgagtctcgcatcaatggagttgtacccctcgagattagcgtggattataattttaacgcctaactcaccattggcacactgataaaagattgcattgttaagtaccctggttacatcttattggggccactcaacttaagcatatgcatgcccttactatacttacgtcggcgtagaaaatttcaatgcaatcccccctggcccccggcccccggcccccgcccacacacacacacataatgcatttgtcatccacctagtaaactctaatacattgattgttttaaaaatagaaaatgaagaaaaatgaaaaatgccttatatttgaaaagtgagggactacataaattcaaattgtgaatagctggttcttggatggttttgttggtattgattctgtaactataattttgtagatgagtttgctacctgggtctaaattcagtgcccgtttgattacacgcgtgttgtgtttcatccaaatcttcttgtgacttgtgagatgggtcgctgtaatggatcgactgcatgtgctgtcacgcttgatgtggagaatgctgaacatgatttataattttgcagggtaggctaagatacattttttttgccgggtattccttttttttctggcgttttctctctcccacatacacgagatctagagggatatgaggaattagttccatagatctaatctaatgcatggttgaataagatggatccaccaatttaagtgtaaatcaatggtttagatattttttagaacttttctaatttattagacacgcgtgacgtcttagtagcgtttgtaggagtttcacatgatggcatgagagcatttatagtaaatttaatggacttttagtatataatagaggatacaaatacctgcatggatcggtagaatgatgtccctggaaaatatattgggaaggaaaccatcccctgaaagaagtcctgaaagttctttctcaattctcttgagttgg

SEQ ID NO: 59783 - DNA, 1523 bp, Oryza sativa
ccgcgcgcgcgtgccgtggtggccgaccgcctggtcgccgccatcgtcagcctctgccgcgcctgccgcccgtgtcgtcgccccgctccaaaccgccccgccgtcatcgccgtcgtcatcgcccggcccccgccactccgcgcgcaagctgccaagggacggaggcagagctccttctccctctgccgcgtcgcccccgctccctcctccttttcccgaagaggcaagggggcaagcccccttttctctccctcttttcccctttttcctcctgccggcgtcatcctcctccctcctccctgtcgccgctttggccacgaccgccgagcgctagccctctcctttgaccgccctaagtcggttcccaaaccgacattgccatcctataaacccaagcttccccctttcctttcctctcccattcgcctccacgccattgccgccgcctcccgtgctctgttcgccgtcgccgttcgtcgttgcgcttgtcggaggagccggcacgagcaaggacgcggaaggggactccgagcgcgccctctccttcctcttccccggcccgaggccggagagattactcccgcgccgtcggcctctcgtcactgcgcccgcccgcacggtagagcatctccccgttctccctcctcgctccatctcctccccttagactcgggtagtagcacgagtagcctccccgtagctagccggcgccgccccgaccgttgccgccgctcgccgtgtgctcgccgccgtcgccgcccgagctcggaagcgccgctcgtcgccggcctcgctcggcgcagctccgcccaatccaacgctagcatcggattcccgtagccgcgtagatgctctcgccgccgggaatcggcccctcgtgacctcgtcgccgtttcccccttctcccgccgccggttgccgccgccgcaattcgccgccgtcgggcatcctccggcgaatccgagccgttggctcgtctccccttgtcctgtgcaaccacccggtgtgctcgctttcgcctgtatcgccgtggttcgctccaccgctcgccgctgtcgtccgccgtccgttccggccggcgtcgtcgtctacctcccgccggcccgcgtggcagccacgtaggcgccacgtcggcgtcagctcggccaaaaccgggtcgagtcgaccccggttagccgctccctccccgtgcgcgcggtccaccgcgagccatgaggctgcgcgtgggcccgccgcatccgcgtcctccgcgaaccgcgcgcatgcaccgcgtctctcccccatcctagcaccgcgccgcgtgctccctccgcacggtgagccgagccgctgacaagcgggtcccactcgggaccatgcgaggtgagcccggtccaccggctctctctctcctcccctcccgcgcgcgcgtgccttgggccgccttgggccggccggcccatttagctcggccgagcccccccttttctctcgggccgcgccctagccgcccgagggaagtctaattcccctccctcttttct

SEQ ID NO: 59784 - DNA, 4490 bp, Oryza sativa
ttcaatatcttcccaaccgtaaatccgtttgactccgttcaacttccaaaattcctcaaatctcgagatctatctaatggcacgcttagaggtcattaatagggctttatttttgccgtttgttgagttgtcccgttttgcgcgtagtttcggagcccgaagacccgcagtgcgaggatttcgaggatcaagctccaatctcgagcaaggcaagccacctttgaacatcttgagtctatatttgattttaattatgttgcttgaaaaatattatgcattgataggatcgcacttaatctgtttgtcccgtctgcaaggcagattggcggacctacctagtttgttgcatttgatccttcctttgttaattgttataccatgttcccttgtaaccacccagttgcgcctcggaaatcgtgcactatgcagagtatcgacggtcgccttcaaacttaaaatctgaaaaacttcttgggtaaaacttgggttttacaaaagacttggaaaacccgacacctgggtcggtacttgcgaactaaatgaattttccaaaaccgcggaccgggaaacgtaccgggtgtacggtttcccgctcttgcacttaaggaccgtttccttggaatttcatccaaacataagaccagtacgaccacatgggtggaatgggacacccctggctgagtaactagcttatcaggggagccttgatgccgagagacatgtggattcaccggggtggtgtcggggaggacccctgggcttcctggcacagtatggtctgggacctaacctgttgtcggtctgggacccctctcgtcggcatatggtaaacctgtgtcggctttcgaaatgccttgtcatgaaagcttggaggtctcccgacgtggctgatccccacgggttgggtgatccgggttagtaatgtcgtgtgggtaaagtgtaccccctctgcagaggttaacaaactgttcgaacagccgtgcccacggtcatgggtggatgtgaggagattcctagcgtagttttgtttgcctactgtttgtgaaattgctgttgtggaaaggggatcgatgtttggaaaatctgcagctgatgggatcagctaggcccgggtggccgtttgaaagttgtaggcccgggtggccgtttgaaagttgttggtccgggtggccgtttgaaagctgttggccgggtgccaatcttgatcaattttaaagactgatacattgcacatactccgaccggacgagacgcactgtctcaaccgtgtcgtttgagaagcactcacttagttgttttcagaaaagagttcaaataaaatcaattgcaaaaacaacagcctttccttgaagcctgcattaaacacttatttcccatggcttgctaagtactcctatactcacccttgctctatataaataatcccccccagttgctgaagaagatgtagcggatcccgctgacgaggagttcttccaggagcaagccggctacgatgagttttagggtttcggcctagttcccaagtcgcgcctgtgttgtttggtccaagtcctggcttccgcttcccttttgtaatgcagttgtgagctcgggatctgtctgcagcccgacttgattgtactcctactctataataaagagacctctgttgctgtgatattctgtcttcctgtgataccagcactgtttcctggtactggtatcgattaacaggttaatttggagcgtcacgggctagttccggtcggtactagttcggggcgtgacaaccgttgatctcatttgatcgaagggttcagatctatttatactactaccccagttaacggtagtacaaacgtggagggacattattgtcaaaaataataggtgggtataatcgccatttaacagtgagtatacttttttcctcctttttagctttttcgatgaaatatgagtgatgttggcgcaataaatggtcatagatggaattaaccgggaaaaaacataaatgacaaagtaacctctagtcatcgtgttagtaaattgctaatctatcctaataatactagtagtataacaggtagagagcatctgagcatcgctatttccaaaaacgtgcaaaatatatttatagacataaaggggtggtgatgactcctttttgaagagaaggggttaggggtggcaactaattggcccaacccttacaatatacgagtaggagtcggtaaaagaattctggctaaggataacctggttcattaggggttggaaaagctgaaatgcattctacttttggtatgaaatccattacctggtagagtcgatgtttttttttctactaaggaatttattgatggttaggatgacagcaattctgcgggtgttttgcaaaatttcaaccattattatttgatgcaacctatataagatggctgtatttattcttccccaattaacttgattttttttctaggggttgttttaattagtgtaggcttcgcaaataaatatgtaggtaggtagataagattgggaatacaccgattgctacaaacgaggccatgtttaggtcaggagtgaaaagtttttgcatgtcacatcagatatacagacatatatttgaagtattaaacgtagtctaataacaaaataaattacagatttcgcctgtaaactgcgagacgaatttattaagcttaattaatccgtcattagcaaatatttactgtagcaccacattgtcaaatcatgacgcaattaggctttaaaaatttgtctcataatttacacgcaatctgtgtaattagtttttttctatatttaatactccatgcatttgtccaaacattcaatgtgacgggatgaaaagtttttgtttgggaactaaacagagcctaaatcagcatgaagaatacaagtatcgaaaaggaatgcatagtcaactatgaattcgagtttcatgcagtgtgactttttagaatttagaatgtctcattttccttaattaccagctcgattttgatattttcttttcatgagaaatcacgatatttatgcttttccttaccaattataatatgtgtatagattgacctttgattcagttcgagctaaaattattattgtttaatcttttttggggagagggggactattttcatagcttcttttccaagggtacaagcgcacaataacttgcacaaaagctatcacattaaagaaaaattccttgacgtcgtctagacagccctggctgaatcctcccagacttttctcccagacttttggtgcaagcgcgctctctagacgcatgtcctcttgtgttagcgtcctagcttacgcaagttggccatgtcggagggtctagaggggagagcggttccatccttctctctcacctctctctctctcaatcccaaagatgttgctagagttagggtttggtttcagttgttagggataggttcgggcgacctcggctgtagttcatttgttggcctagcggcggccggtcacgcttagcgatggctggtttggtgctagccttctcccgggtttgtgtttgatgtcgtcggtgcgtggagaaatctttgtattttttttcctggttacgacctcccagggttgtaatcttatattttttccctgctctatcaatatgaacgttcgcactgtctggtgcgagtcgttcaaaaaaattccttgatgattgttgcaaaggatgctttgcccttgtaaatgatgccttatttgcccgcggtgagtcactgacatgttattaagagtgagggccaaataaggggttgagttaacttttaggggtgaataaagattttattccttcaagtaacatttttctgggtgaaaaccatatctttcttagattggcgatggcggtatccttgatgtcgtgacctccatggtggcatcgttttcggagtctcgtccctgtgatgctgtcgtaggcctagcggcgattagccatacttagcgggggtcatttttggtgctaggctccactctcagttgtttgtgcttgtgtggttagcacgcggtgtttggtcatgcactttggtgcattgtggtgttttttcttgtaacttttctccttcttaatatattcgaatagcctccttcagccttcttggtgaaaaaaaagcaacattttttcagcattttggcattcaatcgttcaaattaactgcaatcaggagcagatctagcgtgggtgctcgagggactcgagtcccctagtccccaacccctacccggctaaatcactattgataaaaggagagatgggaggaggaggaagaacagagaggggaggaagagtaagggacattgaaggaggaagaaaaagataagtctctctccaattttgttctagatctgcccctaactctgattgaattattgacttgagagttcggaaatagacatgcaacggtaccactgttttcgaaggatgcattcacctaacaacccgtttgaattgg

SEQ ID NO: 59785 - DNA, 1327 bp, Oryza sativa
aagttgtaccgctcaataatataactcacacagagctagttttctttattttcaagcatattatttatagattcggtatacctcaaattttcactacggatcaaggagcttcttttatgtctaagaaagtaaaataactttgccgaatcttagtattaaattgttaaattcttctccttacactacgctcaggctaattgacaagtcgagtcgagtaataaggttttcttgaaattagttaagaaaaagattggggaacatccaaagagatggcattaagtgttctttgaagcattatgggctaatagaatatctaggtaaggtgctaacatgttaacaccttttgagttagtctatggacaagaagttgtttgacttggctctcttagatatatcaagtaagatgatttatcggtgacggagcgtggggctcctcaccgggagaccgcgcaggcccccctttgccggttcggccgggggcactaagtgaggttcttcgccctcgatctgaggaatgtcagcgagagaggaagtgcacaagacacgggcgacgtagacaggttcgggccgctgagaagcgtaacaccctactcctgtgttctggtggatctgtgcatgaaggaatacagagagccggagagcgagagagagagagttcaggctctagaaccattccccagagtcccaaccctccttcctcttttctttcctccctttttttctccctccttctctttttttctccctctttctctttttttctcctaggcctgggcctcctttttatctggtcaggggtcactacatgggcctctagctgcctaagaagggaaacatgctttttacaatgagggctagtctacagccggaagtgacctctgacaagcagagcacacgcctcctgccccgctcgcctgctttcccggtggacgcccatttcaaccttcatttaatggccagcgacttccttgccatacctgcgctgaagcctggaatggatctgaccgggactgacataccaactccaggagttagcacgccggctccggctagggacgagagccaggaagctctcatcattccgacgggacggggcgaggcgtgtgacaggccgcctgttgccacctaacctgcgatctgaccggtctgtgaccggtcacacaccgcgactggtcacggaccggataagcgtgcgcggcgccgcattaaatgcggcgtggcgcgctcgtccaacctgctataaatgcgggtaggtgagccccgctgtgctcacctaacccacacacgtggtgccaaaaccacagggggtcggggcgccccagccctc

SEQ ID NO: 59786 - DNA, 704 bp, Oryza sativa
aggtttaacaaaattttgagtgatcttagatctgttgattcttcttatgatgttaattatacacaatctgagatttctcgccactttttgaatggttttgacatgtctatttgggagatgaaagttacatctattcaggaatccgttgatatgtctactttgactttggattcgctttacacaaaactgaaaacacatgagatgagcattctttctcgtaaagttgattttaagtcgagtgctttggtttcttcctcaacttctttggatgttgattcttcttcatcgaagtttccgcaattgctttgtgtaatgccatgtccgatgatcaactctaacaattcgaggaggaggacctggttttgttatctaacagactttctcaagctgtgactaatgttaggtacaggaaaagaggtggtccaaatctttgctttgaatgtggtggtacggatcactttcgttcgcgttgtcctaagcttgggagagcaaggagggaagataatggtgatgagaagaccaatgataacaagccgaagggtacagtcaaagggaggaagatcaaggagactctcaagaaggcttttgatcaagtctacgccgtgtttgagccactaagcgatcgtagatggtgagagtggagatgaagataagggaaagaacatctccggtgtttgcttcatggcgcgtggggctgcaggaat

SEQ ID NO: 59787 - DNA, 1718 bp, Oryza sativa
aataaagtaaactaatcttgcaagataagttgaaacagttgaaaacaggatcacaaattttgcacttttgaataacaggtttcaaaagacataaaataaaagagtgttataaaatcaacatgctaagtttatgatatttcaacatgattgaatgaaaataaataatgttgtaaaacttttgctggtaaatgggccattagtacagtaatagatgtacaataccaacaacacaggaataatgagtaaattttgaatgagaacaattgaagagactataatctgcatgtgccattagcttggtttaattaaaagagaaagagaggagaataattctactttttcaatatttttagagggcttctataggtaaccatttggcataacctagggttaaggaggctctgataccaacttgtcacgcccggaatttctatccaaaactccaaacgcttacatgtgtgtaaaccctcgtccaggaatcagctgaggcacacaataacaaattgataatagagtgcaattattaatctaattaagaggcgaataaaaagtcattacagagatggatagttcctctcaaacaataaagatctaagcagcggaaaataaaataaagagcacaggcgactccatcccacaagcagcttgaccagggctacgcctaatcctccacaccttcagcatcactgtagaactccttctctgatgaatgattgcaagatgagtatatgacatactcaacaagccacgcagcaaatatgcaagtgcaggggataataaaggatggcataatatagtctcatttgcataaatggcattcaataaatacttcagaatttagaaaaacagtaaaggatttaattaaacaatattattcaacgctacacaacatacccgttgcataggcccaacatttctagacaaccattcccggctgcacagttctatctccaaaccaggagctaagcaagttattaccaattacagcatcatttattatggtgagaggtgtgagactaatcacgaaagacattgttagacccgcccataactgcgggcacggctattcggatagtttttactctggctagaggtgtaccactatacccacaagacacaacctcaacatcatgtcaaccatgcgtcgcgatacttgacaagtacccgaatagagattgtgacaataccctccgcataacacaattcaaagtagtgcaccatggactccccagcgacccccgtaggcttatctccgccacttctcagtctggtgccccacaatgaaccacactatacaaaaggtaaagctgttgcccacgctggcttgtggttggcacggttaatgtttcacaaccgaaaattgtgaaccggtccttaattgtcatgagcacgaccatcaaaaccatgtgctcacaacccaccgttaccatgttttagttgacatcttaattaatcatcctatcatgattaaccatcatgagctaccattaatccatcattaagtaataatgaatcattaattatcccattcatatgagctagtgtctctaagcatggctaagcatcctaattactttagccaaaaccatataatgttatagctaatccaattattaaccaggtgacaaagtataggtaatcaataacaaaaggctataacaaaggaaataggtcattcccactcgatgacattcaaaaataaatgcaatagttgaata

SEQ ID NO: 59788 - DNA, 4846 bp, Oryza sativa
ccccaagaatttataaatttgggatttttagggtgtgacagatcttgtcattggcagtgagctttttacttagagcatcggtagttttagcttgcgcaaaaactagatccttcaaggaggattggttagaaaagttaccgttgttattacctcctagataatacgggcgtggctagttccacccttgaccgccttgtggatggtaaccgttgttgttgttgcccatgtacatcgcctcctcataggtttctgggcaatcattcccagaatgacccatgttgccgcagacctcacacgtaacgtgtgagtccaaggccttgatggtgccttgaggccgtttgtcgtggtcgtccaatcgcttcatgagaaggtccagcttggcagcaagtaattccgtctccttgacggtgtgcatgcctcgctgacgggtctggagtcgttcctcgctccaacccatattggagaccatcttctctattaaatcagcggctcctcgaaccaatttagagaagatagctcctccagctgccacgtccaggtgatcgcgggacatgggagtccattgtagaagttctgcatgattagccagttgtcaatcccatgatgaggacaggcggccacatactcttgaagtcgttcccatgcttcaggaatggcctcgtcccttgtctgctggaagaactcttggttttgcccatcgggaagaacttcgagaggaataccgtagaacacttgtcccaggtgttgacagcagcacggttagcgtagaaccactgcttcgctctcctgaggagggaaaccgggaacagccttagcctgacggtgtctggactgacgccctttatggcgtacgtgttacagttctccaggaactgctgtagatgagcattggcatcctcgttaggcttgccgcagaacgggctagcctacgccatagtgatgaggctggacttcaagtcgaaatccatgtctcccatgttgatctgtggtccaatggccacattctcagcagagggagcagcgaactcatggagagtcttgtcagctatagtcttgaaagtcggtggcgctggtacggctggtttctttgtcagtagagttttctgcagagcagtggctcacggcctgacgctctggaagaaagcttctggattttctttgaaattttccggcaagttgaaatcagtcatgtactaccctgctttcacaacaaaagtaaaaacaaccaaggttagcttgcaaagggaaatgattatacaaaggtaattagaaagtattaggtcaggtaatctctattatgaatcttccctggcaacagcgccagaaaagcttgttagtatttcttaatgatattactagaaatataattcccagcaatggcgcagaattactcctggtatattatggttacagagttcatccgcaagcgcacggatataccattgtagcatttcacccgagagttttccaagggtatcgtatttattttatcccgtgggaagatcatgtggagagaagccgcccctgactgccgagttccttacgacagcccgtcatgaccatacaaccggggctaaatacggaggagtaccctccccagggaattaacttaggattatatacgcgcgcggaggaatacccgtactgagctatcaccatcagtggcccacctctcatccgcagcatataactccaaataataatatcccgtaatccagacgcgacgtctaaactaccagatactactctaatatcatcgtcatgacatagagtaattgcgtaagcaaacattatacccgcaccaaagcatctcccatataagctagcaacatattcagtataacatgaacataatttaaagtaggcattaatatacttggaaagtatttcaatatcataaatgtataaagaagagtattctaataatagtacaaagcttacaaaagagaaaaggaaagatactagagccattcccgaactcttccaaaggctttcggactcccgatttctactctatttctattccactagcttaataacactaaactaacttgagagaatatgagagagctcttgcttgaggtgtgtgtgtgatgtaagaatggcaactccttttataggcaggtaatgacggttatatggttggaatggtcggtaatatcctgcaaccgtcattggtgatcaatcccagctgtccatcaaaaccctgcatccatcagcgccacgggaggttaggtcaaacccactggttcggccgaaccaggggccggaccaaccagcccaagtttttgctagtggcctcctccgttgcttcacttcgtagacttgtgaattttggcccaattcatcgtgtcaattctgagttcttggcccattcatacataagtctgatcgtcgacatcgtccgattgatttatcgtctgagttgatttatcgtctgatcatcgacatcgtccaattcgtctgactcattgttattctctgcaaaaggttagtaaacctaatactagtggaatattattattcttacatgtatatgcattgcaagcatcactagttctcctctattttggtaatattaacgatcaaaattgatcgataacgaccgtcaacagccagcgtggcatcgtttagtggagaggtcggagaccggcttggcacagagaggcgcagccgatggcagcggaggccggctcggcgcgagaggcgcgggcggcggagatcgaggccggcttggcgtgagaggcgcggccgatggagggaggccagattggcgcgataggcgcgtccggtggaggaggccggcttagcacgagaggcgcggctgacagtggagaaggctacctaggtgtgaggaggagctggcggtaggtgtggtgcggtcttcggtgcccgaaggctagccggcgggggacgccagtgtaggggtcccacatgtcggcagagcttgtgtggtggtggagcatcggtgtgtcagacgtggattcgcaggtggtgagcggcgagtgaaaacctagtccggccttggccggaccgacaacgatgtcatccccctcctgagggcgttgtcgtgctatctcaccccttaagggtgattgccaggcgaaagcccagtcttagctcctttgagtcccgacggacggcggcggcggtttttccgtcgcctttcttcttgaagacgtcattttggcatcccctagggggcgatctcctctgtgtccctttattggtctagtggcggtcagtcatgcttagtgacagccggtccgatgctagccttcttctgggctggtgtgttggcgatatcggtgtgtgggtggtggtatatttttttcctttttcctggttacgaccttacagggttgtaatcttataatttttttctgctctatcaatataacttcgcacagtttcgtacgggtcgttaaaaagaaagatgatgcatatgcagtctcgatgtggttgtagctgtgataaagaagcttgctgtgcagagttttggtactcgagctcttgcttggtggagatactctctgagccatgtgcaggatgtgattagacaatggatttggtactagtttgctagttgcatggaagagctgagacctgtatatatggtgggcgcatgcagcggcgcgcgtggtattggagttagtctttacttatcggagatactagtctttacttatcggagatagtctttactttatttctttatcgggttgttttcgtttttgttaagattttatattttgtgtcggatcggttgattgacgcgtatgcaattagtataggcaaaatagaaagcaattagcccacgattaattaagttttaactattacaaacttgacaaattgatatatttaattcttttaaaacaacttctatataaaaagtcttcgcacataacacaccgtttaataatttaaaaaacgtgctaacgaaagtcgagataaaatctaaatcttaattaatcagaaaagaatatggccacatagtaagttaattaatttatttttttttgttttagcgactgaaataatatttctaacaaattttttagatggagggggaatatataacagcaggtacaatagcagactataagccagctataaacatattttgagaagataaatgatgagagagaaaagtagtgggttacagccagctgtgcaacatgtgctctaagataaatatatgtatgacacgtgggactaggtattaattgtgtactatatgttataggtaactattggataaattggctattaaattaaatatagataatttagagttagtagttagctatagtattaaacttgctctaaagcgtcttaatcaaaacgatttaattatagatggtttcttgtagcatcgaggtcctagctagttgtaaaaaagatatacagtagcccgtcatcatcaaagaatgcctatataagaccgagctttggtagccagagatctcaaagctatagctacatcatttcctcttagagtagttgccgtccactccaatactgcctgatgggatcctcgggggcaccggagttgacacatgaattgagcaacaatcctcgtgccggcgggagagcaacaagccaacaatcttgggaatcggcacggctgtgccggtgcatgtgtatgagcagaagtcattccctgattattactttgagattaccaatagcaatcacttggtcgatctaaaagccaagtttgcaaacatctgtaagtgcatgcgaaactaccattctgtatctgtcacgatcgatccataaacttaactgccataaaatcatcaaacacacacacacacacatatactatagagggcgcagg

SEQ ID NO: 59789 - DNA, 2051 bp, Oryza sativa
tgaggagggcatacctcggctcggcgcagaggcggcgtgcaacgccatcggtaactggggaaagccggcgtcgagcatcacgcacgtcgtgttcgccaccaccagcaccggttgcctgcccagcgctgacgtcacgctcatcaagctcctcggcctcccgctgtcgaccaagcgcgtcatgctctaccagtccggctgcttcggcggcaccacggcgctgcgcgtggccaaggacatcgccgagagcaaccgggacgccagggtgctcgtggtgacatccgaggtgatgtcgctgatcatccgtgggccctctgagtcccacgttggcaacctcgttgcccaggcagtgttcggcgacgccgctggcgccgccgtggtgggttgctgccgccacccgtcgtccaccggcgagcgccccgtgttccagctggtccgggcgtcgcaggacgtgatacccggcacggacgacgctgtggtggtgaaggtgcagcaggaaggggtggtgatcaccctgcaccgcgacctgccgctccacgtctccaacgccatcggcggcgtggtcgagagcgcgttccgcggggtaggcacgacggtcaccagctacgacgaggcgttctggttgttgcacgccggcggaagggcggtagtggacggcgtggaggagaggctgggcctcggagaggggaagctggcggtgacgagggaggtgatgaggcagtacggcaacacgcgtagcaccaccatcttcttggcgatggaggagatgcgaaggaggtcggaggagcgagggatggcgacggcgggggaaggccttgagtgggggatgctcatggccttcggccctggactcaccgtggaaaccatgctgctccgcgcgatgccacgcaattaacgtgtgaaatcggccagcacacgaataaattaagcaccaaggtactctacatgttaccagtacagtgctgttacatgttacacgaataaattatttccagttaactgctgcttattactgcacggttaatttagatgttgggttcggaaccagctgaagtattgtgtggacgcctggaacattattgttccatacggaataaagttatgcatgatcaattctaagcttgctcgtctggtcgatcggaaagaacatttctagcacgattattgctttgtatggttagttcgacccttgcaagaaatgtggtgtctgtcagcacctgggaggtataataattttctgaaccttcgtttttgttgtccatatatatagtttccatactccggtcgacgtcacaagaaaaaaagtaactgaaaacgaagtaagattactccctctacttcagtatatcgtgatatccgatgtacaactctgatcactactgtatatattacgtaaccacatgtaccactagctagtcaatggtttggatgttattacagcaaatccttagttaaccaagctccctagctatctcagcgcaccttgtgttgctacagggtaacagtgtcgggctgtgcatgcgccgtccgatgctcccacaccgcttccatccactcgtccacgtatattctctccacaaccatcccgtcgccctaacctccaactcccgatccctgccgccgctcattccagttgaggagagaaatcaagaatcctgcctttccacagcgccttacgacggccgccatctttcttcccatcctcctctcctctcaatctccctcttgttacacatacgtcaccgcctcctgcctttcgagttgctctagcacgacagcgagggggtcgatccagtgaagtgtgcttgatttggtgaaccggccgatggcgaggtggccgatccggtgcgcaactctttgatatagtggcgtgctactagagatcaaagttgagacttaatctggtgccatggagttctatcttcgctgcgaggttctcctggcagcgattggtcgctcctgtctggctattggcggtgagggtgaacgggttaactttgctagggttgtcagcaccaccaccgtgtactgcttcctccatgggctgcaggaat

SEQ ID NO: 59790 - DNA, 1662 bp, Oryza sativa
cctgcagccccgttctgtagctgcacggtctttcccgaagtaaacttcagatcgaccgtaccaacaccatgaacaaccgcaagcgaaccgtttcccattaacaaggaggaacctctcccgacctgataagaagaaaacagagaaatgtcagcacatacatgaatattagcaccagtatccacccaccaatcaggtgagtgaaaaatagagagaactgtaggtaatattttaccgtacaccgatgttcctccgccctcgctaatgaccatgttggcagacttcctgtctttgcgctcaggacagtccttggcccaatgcccatacttaccatacacaaagcagtctccctttgcctttcccttgcctttcttcttaaagttggttgcagccttgggtttgacatcagacttgactttcttgttgttgtgggatgcatgagggttcttcttctgtaccatattggcactagaacctccctcaacctttttgccccggacgtcctttgccctcgccttctcctcaacacccaaagagccaataagatcagaaacactgaactcttgtctcttgtgctttagagaagtggcaaagtccgaccaagaaggtggcagtttggcaataatgccacccgccacaaacttgtccggcaactcacagttgttgttctcaagttccttagccagcatctgaatctcatgagcttgttctactacagaacggtcatcgaccatcttgtagtcatagaactgctccatgacatacagctcactgccggtgtcagaaactccgaacttggcctcaagtgcatcccacatgtccttcctagaaggcatgtgcatatacacgtccactatgttgtcagcgagtacactgatcaatgctccacagaacaggcaatccgaagcctcgaaattagcctcctcctcaggagaaagaggtggttcacttcgtttgccccgtgaaacatagaagcattgcatcgctgtcaaccacaatagtacacgtgctttccatctcttatagttagaaccatcaaaagcatgtggtttcagtgcagcagcaaagccaactaccgaaaataacctatcaggtttttggattgttagaaatatggtcataaatcggcatattttaatccaaaatgttaagacaataatcatggcataaacagtgtagggtgatctagtgacaacatgtaacataaccagtagcatactaatggcatcatgcgcattatgaatatcaggaacaagaacatagcagtaacgcagtagcatgctagagacatcatgaatatcaggaacaggaacatagcagtaaagcgctaacaacgggaacaggaacaggagaaggatataccccgagaatggccctccactggattgcgaggcagaattgactccgttggtgttgttgttcgcggcacaggctccagctcctggcgcaccacctccagctccagctcctggtggcgcaccacctccgccatctcctccagcagcagcagcggcgccggctccaggcgcagacatggtgggcgaggacgagcagtcgtgcgggaagcactccccaaaaacctgatcacccgcctacccggtgcagatctcaggcgaaggtgtggttccggaggccctgctccttccgatctctcgtgcgcgcaag

SEQ ID NO: 59791 - DNA, 1550 bp, Oryza sativa
cctgtcattgtaccgttttctctctatttgcaaaggtggtgggctgtcatgatgactgatggtgccatggtgttgtcatccctgacagcacacttgataaattaagtagagagagcattactataatgtgagaaccaacagtattattttcctcgacttctgcaacaagtacattgttttattaagctattctattatctaaagctatttggcggtatctcgcatatgatatggtacgaggagggcaggttatagataccttaatttgtgtgctggtgatgtccctcctattggtttaggacacgtttcgccaccatcccgcaaagtgtggctggtttccggtttactgctttccgaatgataaactgtgtgcgctctattattaaatagagaaaaatctttgtctttcctttgcagttctcgctctatctcttccatgcttttgagttttgtcttatcccttacatagccctaagttttcttttgagcttttctgtatatactcattttgttagttcatctcaattgagcttttctaatgattatattgtctctcactcatagataagaacataatatatctagaagaaaatctttagttataaaacttaaagggagaaagttgagtgaccccgaatttgaacaataaaatttaaattttttaaatgaattgcaataaaatttgatgaaattacaaaagggaaaatgacacatatcatcactgtttctatcttaaactaaaatttgtattttaatttaaaatcaacttcaaacaaatttgaacaaatttctatgaagagatacaagtgaaattatcattgaaaacttcatcaaacataactagaattaatttcaaaatttgaatttttgttttcaaattaatttgggtgtcaaataattctatccctttcgatgttaatttttgagttgaaattgctttcaacacaagacttaggctttttaagttgactgttatatgtagtctaaggaatggctataaaggtgattgaaaacaaaaactaaagggcatgaaagggatgagtaaaaactcaggggcacacaattttctcttaataatatgctagcttagtaagcgagaaatgtaaatacacattttatttttctatttggtggtatctcgcatatgacatgatatgaggagggcaggttataggtacctaaattcgtgtgctagctatgtgcttcccgttggttttatacacattttgccaccatcccacaaaatgtgtctggtttctggtttactgctttccggatgactatctgtgggtgctacaatattaaatgctagcttattaggaggcggaaaatgtaaattggcaaccagtcaattatacatgtgtttgttagctccatggtttgctcttcagctttgctgcaaccaaaatttaaatattttaaaacttaattttagaattgattttaatgtttattcaacacagtttattttcaatattgacttttaagtcgtcaagaacacatatgtaaaagttttactataattttttttgttgctaatgagcattatg

SEQ ID NO: 59792 - DNA, 3124 bp, Oryza sativa
agactccacaccatagcatcggggtctcaagctgggcaagtgccaatgaggaccgatggcatgcacctcatcacatacaatgggaggacaaccaaccccccagatcaagtggagtacctccatctacaagtgaatgtcgctcgagttcctctcgttgggacttgggtgaaatcactaggagaatggatacccttgatatgcagacaggagagatccagtacaacctcacggaacacatagcacagacgcaagaatggtaacaaactgctgatgctcagttcgccaacttcaccaacatgatgcagcaatagcatgatgaccttcaagcgtacttccgcttctaggggttcaatccttatcaaggaccttgagcgaaagacaagcttggggggagactccccccactgaggtaacttgtatcacattgcatatttccctttctaattgcatatttgctttccaattgcattttataaacttgaaaacaatataaaaatttgcaaaatagaaaattccaaaaagataggataggtttgagtcattctagttaagataagctagttctctttagtaaaatgatgaatagttgctctgtgttatatctcttatatatgggttcataggtaagtgctctctcaaaggttaaatataagtagccaacaattatctgcgagcctgaggaaaatgagctgcacttgctaatttgagtctaggttgttgcgagatatgatatagtaaataagagttgcgatgatcctgatcctagtttgacttgaattccggatgttttgtttttttcaaaatgataaaaatgagagttcctcatttgatataaattcctacagagccaaaactgtgctatcatgattgaaccatatagattttggttacttgccattccattgaactttgtcaaactcttgtgacttgtggatacttctcatgctctatgatcaagatcatatacccacatttatgcacatgctaaactcctatactaggagctagcattataccattccattccatttccatactaccataaaaataaattctccatgctttcatgtgctttctttttctaaaaagaaaaaaattcttttggaaaaaaaaatagaaggagggaacggaatggatatgaaaaaataaataaagttatgctctcacaagcatgagcatgatgttgaaaaaaaagtgtagccatgccctctcctaatcaataaaagaaggatttttaggagaagaaagtaagcacaaaggagaagcattttctttattttccttcataaaccatttccaccttatatcacacaatttgcacgatcttgatcttgagtatgtttagttatctgctttagtctaagtttttgacttagtaataaatgtgaatgcaagtatgccatgtttgatccctaccgggctccacatatcaaaccttagagtaggaatcaaaaaggcaaaattggtgaggaattcatattgatacacttagagaaactgagtgaatcatttgaggaacttggctttctttgcaaattcatttgaaaacttccggaatgaaagttgaataaagattgggtaattggtgctctaattgctgttatgtttttcaaccgcccaaggcaaggagaagcagtgtctcatgggaatcaggggtaagggtaagccaccgtgccaaagattatttaatctgagagatagtacatataccttggacctgtacctttgagatatacagcatagtagcaactcctgatcaacaaccaagtttttatttccttttgtccttcactcgggacgagcaaaagttcaagcttggggggttttgttgacgatcgttatcgatcagtttcgaccgtcaatattaccaaaatagaggaaaactagtgatgcttgcaatgcatatacatgttagaataataatattccactagtattaggtttactaaccttttgcagagaataaccataaagtggaggagaatcgacatcaactcagatgataaatcaatcggacgatgtcgacgatcagacttatgtatgaatgggccaagaactcagaattgacactaattgggccgaaattcacaagtctacgaagtgaagcaatggaggaggccgccaaccaaaacttgagcttgttgggccaggcccctggttcggccgaacgaggggattcggctgaacctcccgtggcgccgatgaatgcagggttttgatggacggctgggattgatccccaatgacggttggagggtattaccgaccattccaaccgtcacaaccgtcattacctgcctataaaagaagttaccattctcacttcacacacacacctcaagcaagagctctctcccattctctcaagttagtttagtgttattatgctaatggaataggaataaagtagaaatcgggagtccggaagcctttggaagagtggggattcggccgaacctcccgtggcgccgatggatgcagggctttgatggacggctgggattgatccccaatgacggttggagggtattaccgaccattccaactgtcacaaccgtcattacttgcctataaaaggagttgccattctcacttcacacacacacctcaagcaagagctctctcatattctctcaagcctttggaagagttcgggtatggctctagtagctttccttttctcttttgtaagctttgtactattattagaatactcttctttatacatttatggtattgaaatactgtccgagtatattaatgccaactttacattatgttcatgttatactgaatatgctgctagcttttctgggagatgctttggtgcgggtataatgtttgcttatgcaattactctatgtcataacgatgatattagagtactatctgatagtttagacgtggcatctagattacgggatatctcattatttggggttatatgctgcggatgagaggtgggccgctgatattgatagctcaataagggtattcctccacgcgtgtatatgatcctaagttaattctctagggagggtactcctccatatttagccccggttgtatggtcatgacgggctgtcgtaaggaactcggtagtcaggggtggcttcgcgaagta

SEQ ID NO: 59793 - DNA, 2509 bp, Oryza sativa
atgattatcacaagtaatatataaattattagtcaagttctctctacaagatcatcctatgggataaaataaatacgatacccttggaatactctcggtgaaatgctacaatggtatatccgtgcgcttgcggatgaactctgtaaccataatatactaggagtatttttgcgccattgctgggaattatatttctagtaatgtcgttaagaaacaccaacaccggccagatgcagccgtctcccacgccctcggctagccgtccgaggccgtcatgcttccggtgaccgcagtcacggtcaccaacaccgcagctgctgctgtcaaacgcccaccatcttgccgttgccatcctcacctcgcacccgactccttccccgccgccgacgtcgccaccgcctccacagtcacggctgccgtcgccgctgccaccgacgctagtcaccgcctccgcagacctcttctgtgccatcgccctctgccaccaagcagccagcaaacgccctgacgccgccgccatgtcctccgcccgccgtcgccagccgacgccgccgctcaccgctgccaactgttgcgaccaccaccgcccgccacccctccaccgctatcgcggccaccacacctccgtctccagcgcctccgcgccgtcgtgcccatcgccgccagattcggccacctccgcaccagtcatcgtccggctctaccgccgccagttccggccgtcgtggcatcggcgctgccagaaacctccccgccagatccgcgccggatctggcggcctcgtccactgccgccagtgcctgcaaacctctgccgccatccccccaaataacgccgcccgaacacactaccctgccgccgactaactccccgccagctccggccggacagcgcggatctgggcggtttccgcctcccgacatgagaagttcccctgcccttgtgcggaaagcggagcgaagccccaccgctgccatctatgccatcgcgcggctttgccgacggccgctcgggtggcggcgaggtggaggaggagggatggaggacgggagacgacggcctgggcgcctcttgtgccccccgagaggaggtgacgtgagagtcgtgactacactcagtcacctgaattactgcatatgcatcgtcacaattggtgaaaatggtaatggtaattcacggccaaccggcattcgtttttgactttctcctggccgagccatatggtcgggccttcatttttgactttctactggccgagccatatggaaatggtaaacgactgaataaaatggaaatggtaaaaaatatggaaattgaaatagaaatggttttgccgttataccaatcgtttccgtatttaccttgttcttctgaaaatcaccgtttcttataatatggtaattaccgcatctctaaaaatgtcgatattcataagacatatttctacttgacccacagtttagagattgattgactcttcaatcaaatccctaacttgagtgcatggctaaaatggagttaatttgtaatttatatagtataagcttgaatttatttatacatataacatacttatgtaaagttaaatatatgttttacagtttaatatatgtttccgtatttgttaccggtttctgatatgtatcaatatgtttctgtccatattgttccgattcaggttttccgatattgtttttgttcctcacattaccattttttatttttgaaatggtttaggttgttttccgattgtttccgaccgctttcatccctactgcacacactgatcaagacactacagctccccagcaactcgtacccctcagtgcatctccctgcatacaaattgaattgattttccatgctaattgccagacaattaaaccggctattctacataatatggccagctcaaatgaaaccaaatattgaccaaattatggcacaaacaaagtaagatctagctagtccaatcagcggttccatgtgagaagcgtgtgcactagcttgaagatcacaccaaaaacaaaatgcccccgtttcccacttgtacctctccttgtgtgtcacatctacattttgtttgccttttttctttcaaatccatttgactattaagtagtaattgttgtttttttcatagtactcattattttttcaacttcctttgaatgtagttctttaaaaagtaaatgtgacaatctagtggattaaaagtatattaagtattcggatagttacataaacattttcttgaagtacgtgattacacattgtcaggttacggataagacatacctccaatcctacaatttactaaatataccggattggcaaacctcatatccaacgatatttttccgtatgcaataaggaaatatacaagatattatggaaaatatcctcacgggctgatgattatcaaagtcctactcggagaggatagggactattctatatcgtgcagggttcgttgtctccgagttctacttgaagactaaggcaattc

SEQ ID NO: 59794 - DNA, 10113 bp, Oryza sativa
gtcggtatcgtcggattcatctgttccctttttactctgtggttttctatatcaatctcatataaactggattagggctattacctcacgaggggcctgaaccagtataatccttgtctcttgtctactttgatatcgtatcgtatagatcctcgtaccaacgtacctcaatacacattttatccggtctacaggtatcccccatcgacagtggtgcgccaggtaggggactttggtgctcaaggttctgccgacatgacttcaagccgctccgacaacttcatctacatcggccccaatgcaggagatccaacctcaattccgatgatgtggactcaagtcggatccatcatctttccggtctactctgtgataccgatctcgtctggcccaatctctgttaggaacgagaacgtcgcagctacgactttacggaaaaggcaaatttatgtcatcagtgcctccctccgactgtacggaaaaggcaaatttatgtaattggctaggagacatcgtaaaattgcgtcgttgctgatggacaccacaaaattcgtgtaatttgctataggacacccgagacaatattttttatttccgagaaaaaagaggagagagaaattttaaaaaaggcaaagttgccctcagccctatctaacacccctaacccatcggcaaagcaggccaggtgccgacttcgacgactactggcgagccccggggtagcagcttcggcagtggctggcgagcttggcagtggcctcgatgatggtcggcaagcccggcagcagcggcttcgatggcagtggtggtggcggaggcaatggcttcgacggtggcgatggcggcagcggcgggttagacggcggttggtgagtggctctagaaagcacgcagcggaggcagctttgatgatggttcgcgagcccgacggcagtggcttcgaggcggaggtcaaggcgaaggccacagcgggtggtgacaaacggcttcgatgatggtcaacgaggccggcggctgcagttttgatggcagcggtgacggaggcagtggcgggcagcgctgggaagcaggcggggattagatagggccaagggcaattttgtctttttgaaatttctctctcccctttttgataagaaatgataaaaaattgtctcgggtgttctacaacaaattacataaattttatggcgtccatcagcagtgacgtgattttatagtgtcttctagccaattacataatttttgggtgtcctagggacaattttgcctacggaaaaacagacgtcgactacgacaacatctagggaacaacctcaagcggccaacctctggtgcaagaaccttgtgccttgaaggcgtgttccattggcactatgctgtagagacgtgggatgcatctctttttgggcaaatatgcaagtaccaactggaccggagcagcaaacagctagaaaagaagagggcatctcctctttcttgtgtgcgagtaggtgttgcggaagcaagaagctgtgcatagctaagagtggatgaaggctaaccaaggcggcacatgagctcaagagaggggctgggtgcagctaagcagcatgatcacaactggcgaggtgtatagccagaaaagactcgcacataatgcggtctttgatctagatgtagcccgtcagccctcttgctctcttcctcttctctcatctttttctgcttttcttccgtctctcttttcttctctttttttaagcaaggtgacaccaacttaaaaccttgatggaactcatcatgaaaatcttgtcgatcgccctcccccacacttggacttttatgtcatgagacgtcaaaaaccaagtgtctgagactgggatcttcataaagtatgttccaacatcaaggatctccaaaatgaatagttgatgtagctcccatgttcttaggcatcgtatgtccctcgttcttaatcttaacctgaaatggttactgaccaagaatacctgaagatgcatactattttagaactggttcttgcttttattggaaggaaaacgtaccaagataatccgggatatctcccgtagtgctttgtttatggtcacaagctcgaccatggagacatctagctgcaagattagtgccacaaaaaaaatacgagatttgcaatatttctgataaacaaaagcatccacaaccacacttctaatcatgttagaaatgaggaccataaggtggttgtggtcctcgtacaaagaagcggcactaatcggacaagactttggagattccttatgtgagtatcaatcctgaggaactttgaaagaaaaactttcatactcatttgtggagttctcatcctctagagttgatgtctcgaacttgtccttggcttgaaggttctccttgtcaaaagatgtgtcatgcaagatcagggttatttcttgaaaattgttgagaacaacatcttgagggctagagggacaagattttggcttgataggaggttgtgatggcggttctaggattggaagttcaaaagtttcaccggaatcaacttctttttcaatgaaatctgagacatcattttcaagaaatgattcgggggactcagatggcagaacagtcgtcacctcctttgcgtacttatctttaggcagaaagtcagtcaaggcaaatcttgactgcgagaatggcagtgagaattcattcccgcctaaagagaaattgaacctgcctactcgaggggtgttgatgagatgtttctcaatagggtgcccgattagaatattgaaatcctggacttcaaaaacatggaaatccaggataacctcgttgctatcatgaatgactggcatatcttggacaaccccaaatccttcaataatgctcccattgggatgcttgaagaatttgtcagttggtgtaattgtcttatcacttaggtatgcaaacgcaaaggattctgagacaatattgacaccgactattgggctgtagagaatcacaacattattcccctctaagtgacaaggaatgggccgaggagtggaatttatcggaattacttcagaagaaagctcaacctcctttagccattcgtcactcataatagaggtcaactctcgaactgtttccttaagaaactggaattctatcgagtcaggaggtagtgagggaacatatggttttctcttgctaaagtagttcaaggtgtttccgtaatcttcatcaagatcatccctcaacaagagagcacaacccggagtttgaatttcttcggtctcaatgggtcatggctcgggaagaggttctcgggtcgaatcaggagaagtagagacttcaactgatgcctcggggaggggctcattatattcgttcatgaaggaggtgttttttagaattcaatctagaattaccttcctttcaatcggagttttgtgcatgaatgatcctacagcagtgatgtctagatagattgcagactccttttctaaacccgaataaaaatgttgcagcagcacatgatcgggtatagatagggatggcattttcacccgtggggtcaggtccaggggacccgccctataggggtgggggtggggccatttttcaatccgcggggcttcatggccgggggagggcatccacccgtgggtgacccacggggccctggggtggtatgctacatcacaatacacagcccattctaggccgaataagtccgacttgctgaaatagtggcatataaaaggccaaaacctaaccctatcctcactttttcctttcccctcactccatcctcacagctagctgccactccaccatctaggcgagcgtcgcaaccgagagaccccgccgcaccgcgcactgcctcacacaccagcaggctcgacgcccgcgcatggccctccccatccggtctcatgtcgtcgtcgcatcagccacctgagcccggcgaccaggtaaaccgatgtggcgtgcgggtgggcgatggctagggttcacgcgtgcaagcgccaggcagcgagcagcgcaacgggctgctaggctgtcacaccctaaaaatcctaaatatataaattgttgtttaattggaattattagaatttattttaaaaacctaaaagagaagatctaattttaattaataaattccaatataaaatggggccagataaaatttcattaaatactttgcttaattctataattcctagatttttctgggatttatttgagctaaggaagtatttttaataaatggaattgcatttcatgaataatttaaattgaaaaaggtttttaaaatcctcttttggctttgggccgaaagtcctctctctctctctccctcggcccagtcggcccagtccggcagcagccgcccgcgcgcgtgtccgcccgctgacaggtggggcccacctgtcaggcctgtcgtcttcctccggccgcccgccgcccgaaccctagcgccgcgccgccgtcgtctccttccaaattcggccacctctttccgtttccggtgaaatcaatagaggggaaatgatcttcgggatcccctctatcttttctcttttggaatcgtcggctaaaatcgtttggaaatccgtggattcgagttcgattcggatcgatctctctcctccgaaccctagactttccttcgccgtcgccggtcgccgtgggccttcgccgccgccttccaacccctatataaggacccccaagcccgccgctacccgtcgccacccttgctttcgcctctcgccgtcggtagcgccctagccctgtgagacctcgcgtcaccgtcgtcgccgccagccgtgcgccgccgtcgctccagtcgtcgccgtcgctcggggaggtcgccatcgtggtcgccgtcgcgtcgccgtcctcgtccgcccctccgccgtcgctgtcgatcgccggaacaccgccgtcgtcgtcaagccgaaggtcgccgccgcttcttcctcgacgccgtcgccgtccgttgatcttccgccgttgctttggtcaccggtgagttcgccgtgccgtccgctacccgtgggtgctctccgttcgcgccgccgcgccgtcgttcgccggcgagtattgtcacatcctgatttttgtttcaggatttataaatcatttaataaattattattagaatttatattaaatgatctttaacttacaagtgaagttaaatgtgggaaataaaatttcctaaatataaagcatggatggatttaatttttattaaattctccatgattaagtcaactctctgaaatattctcggatttttcagagctcaattcctaaatgatacaaagaacagttcagtaattatttgatcattaatgatctaattatattttttaagagcttttcttgtttaaaaatccttaaattacaaattgttgtttaaaaggaattattagaaatgatcttaaaagcctaaaagagaagatctaattttaatttgttaaatctcaatataaaattgggctagataaaatttttttaaatactttgcttaattctataattcctagatttttctgggattaatttgagctaaggaaataattttaataaatggaattgcatttcatgaataatttaaattgaaaaaggtttttaaaagtctcttttggctttgggccgaaagccggcccaaaacctctctctttctctctccctccccggcccagtcggcccaggccgccgccgctctcctctctctctcgctgtcgctgacaggtggggcccgcctgtcggacccgtcttcctccttcggccgccgccgcccgaaaccctagcgccgcgccgccgccgtctccttcccaaattcggccgcgtctttcccgatccggtgaaatcttttgaggggaaacaatcttcgggatctcctcttccttttctcttatagaaactccggtcaatttcctttggaaataggcggattcgagtttgattcggattcgtttttccccgacctttccttctcgtcgccggcagccgtgggccttcgccgctgcctccttgcccctatataaggatctccaagtccgccgctacccgccgccaccctcgccttcgtccctcgtcgtcggaagagccctagcaccgtgagacctcgcgccgccgtcgtcgccgtcgctccagccgtgcgccgccgtcgtttcggtcgtcgtcgttgctcggggaggccgccatcgtggtcgccaagtcgtcgccgtcctcgtccgccgcttcaccgccgccgaagaccgccggagcaccgtcgccgccgtcgacccgatctccgccgccgcttcttcctcgtcgccgacgccgtccgttgcttttccaccgttgttttggtcaccggtgagttcgccgcgtcgccctctacccgttggtgtcctccgtttgcgtcgccgcgccgtcgttcgccggcgagcatgcgttgccgagccgccgccggtgctgacgtcatcgctgacgtctgtcacatcctgattttttcgtttcaggatttataaataatttaataaattaataatagaatttatgttaaatgttctttaatttacaagtgaagtaaaatgtgggaaataaaatttcctaaatataaagcatggatggatttaattttttattaaattctccatggttaattatactctctgaaattttctcggatttttcagagctcaattcctaaatgatacaaagaacagttcagtaattatttgatcattaatgatctaattatatttgttaagagcttttcttgtttaaaaatccttaaattataaattgttgtttaaaaggaattattagaaatgattttaaaagcctagaagagaagatctaattttaatttgctaaatctcaatataaatttgggctagataaaatttcattaaatactttgcttaattctataattcctagatttttctgggatttatttgagctaaggaagtatttttaataaatggaattgcatttcatgaataatttaaattgaaaaaggttttaaaagtcttcttttggctttgggccgaaagccggcccaacacctctcttctctctctccccggcccaagttggcccagtccgccgagccgccgctctcctctctctctcagccgctgacaggtgggccccacttgtcggtttcgtcttcctcctccggccgccgccgcccgaaaccctagccgagcagctccgccgccgctttccaaaattcggtcgatcctttccttctccggccgaattgatagaggggaaataatctcctcgatctcctcttccttttctcttatagaaactccggtcaatttcctttggaaataggcggattcgagtttgattcggattcgtttttccccgaagtttccttctcgccgccggccgccgtgggccttcgccgccgcctccttgcacctataaaaggacccccgagctctcctctacccgccgcctccctcgccttcgtctctagtcgtctgtagcgccctagcgccgtgccgcctcgcgccgccgtcgtcgccgtcgctccagccgtgcgccgccgtcgctccagtcggtcgccgtcgccaccatcgggttcgcaaggtcgtcgccgtccccgtccaccgcttcgccgccgccgaagaccgccggagcgccatcaccatcgtcgacccgatctccgccgccgcttcttcctcgtcgccggcgtcgtccattgatcttccgccgctcctttggtcaccggtgagttcgccgtgccgtccgctacccgttggtgccctccgttcgtgccgaagtgccgccgttcgccggcgagcatgcgagcttgcgcctcccgagccgccgccggtggtgacgtcatcgctgacgtcatcgtcgccctctcccgtgagccggtcgtggaccgatcgatctcggccgttcgtcccgtgaaccgctgccgtgcacccggtccaccgcaaaccctagccgctgacacaataatccttcttttccttttcaaaaataattcattattgcgtcataattcaattaaaatcaatataagtgttttaatccgatttaatctttaaaaattcataactaattcatttgaactcagtttaatgtggttcaagttgcaaaagttgtgtaaaataaagatctacatattaaaattgtccataaattgaattaaatttatttaattctttttaaatgggctttaattagatttaatcttgtaaaattcataataaattcatttgaagtcagaatgaggccgttcaagtctcataattcatctaaaattatgatctacatgtttgtttactttttatgtattgtttatttggtttttattagtctttttcttcgttttgcgtgttagcttgtcgtttccgtcgttgcgaaggttcgcgagtgcgccggaagtattcaagaagattaattgaagaccgattattgcaaggcaagtcacacagatcccaaacacaatcctttgagcatgttgatcctatatttaaattctctatttatttcaactatgcatttattttcgaatgtcaccgggtggtgtgaacttattcctttgttatggccaatttgcattgattactttattccttgataccttgggttattataacttgactagttgagctttacatattggttcagctagatattagttatgattgcttagccatgcttagaaacattagcacactattgggataacttatgactcattattatttaatgatggcttaatgatagttcacgatggttaatcgtgattggttaattaattacttgccaactaaaacttgataatggtgggttgtgagcacatggttttaagagtcgtgctcatgacaattaaggaccggttcgcgagctactattgtgaaacattaatcgtgccaaccacaagccagcgtgggcaacggctttacctttcgtatagcatggttcattgcagagcaccagactgagaagtggcggagataagcccacgggggtcgctggggagtccatgccttgtttataagggggtgactatgatccaggaatggtgcgctttggtgggttgtgttgtgcaaagggtattgtcacagcctctattcgggtactttccagtatcgcgacgcatggtagacatgatgttgaggctgtgtcttgtgggtacagtggtacacctctggccagagtaaaactattcgaatagccgtgcccgcggttatgggcgagttgagcaatgtttttcgtgattagtctcacacctctcacaataattatggatgttatacctggtaataatttgcttagctcctggtttggagattagatctgtacagccgggtatggttgcttcagaatggttgggcctgagcagcatgggtgtgctgttcagtgttgattaaaatttctgattaattactccactgttttacttctcttaaatgttttgctaaaagctgcttttgcaaatgagcctatattatgccaacctttggtatccttgtgcacttgcatatttgctgtgtggcttgctgagtatgtcatatgctcaccttgcaataatcaatcaacctcagttgaagaaaaaggattcagaagaagaagacgtttagcttataccccagttgagctgcctgtgggagtggagccggagcttcgctagattttattttccgctgtaattttcttcctggtgaggactaagtgcctcataagtaagtatttatcgttttagttaatttgataaatctgtatattaaattgtcagtttgtgtacctcggctgattcctggacgaggattttatgcacaaataagttcggaaattactagtgaatttccaagcgtgacaacgtcatcgttgccattccccgtgagccggtcgtggaccgattgatctcggccgtccgttttggataggatcgatctcggccgtccgttcccgtgaaccgttgccgtgcgcccggtccaccgcaaaccctagccgctgacgcaataatcctccttttccttttcaaaaataattcattattgcgtcataattcaattaaaatccacataagtgttttaatccgatttaatctttaaaaattcataactaattcatcttaactcagtttaa

SEQ ID NO: 59795 - DNA, 16530 bp, Oryza sativa
cctgtgggagtggagccggagcttcctagattttatttttcgctgcagttttcttcatggtgaggactaagtgcctcttaagtaagtatttatcgttttagttaatttgatgaatctgtatattaaattgtcagtttgtgtacctcggctgattcctggacgaggattttatgcacaaataagtttggaaattacgagtgaatttccgggcgtgacaagtatgcacgcccgagccgccgccggtggtgacgtcaccgctgacgtcatcgtcgtcgttccccgtggcctggtcgtggaccgttggatcttggccgtccgttttggataggatcgatctcggccgttcgtttccgtgagccaccgccgtgcacccggtccaccgcaaaccctagccgctgacgcaataaacccctttttccttttcaaaaataattcattattgcgtcataattcaattaaaatccatataagtgttttaatccgatttaatctttaaaaattcataactaattcatcttagctcggatttagttggttcaagtctctaaatttttctcaaattgagatctacatgttaaaaatatccacatgtactgttcatgcttgtttatgtgctgttttggtattttgctcttttctgtttagattccgacgtttccggagagtccgttttcgcaggagaagaatttgaagagttccaaggccagtaaggcaagtcacccagatcctaaacacaatcctttgagcatgttgatcctatatttatattctctatttatttcaactgtgcatttatttttggatgtcactgggtggtgtgaatctattcctttgttatggcctgtttgcattgattactttattccttgataccttgggttattataacttgactagttgggctatatatattggttcagctagatattagatatgattgcttagccatgcttagaaacattagcacactcttgggataacttatgactcactattatttaatgatggcttaatgatagttcacgatggtcaatcatgattggttaattaattacttgccaactaaaacttgataatggtgggttgtgagcacatggttttgagagtcgtgctcatgacaattaaggaccggttcacgagtttcggttgtgaaacattaaccgtgccaaccacaagccagcgtgggcaacggctttaccttttgtatagcatggttcattgcggagcaccagactgagaagtggcggagataagcccacgggggtcgctagggagtccatgccttatttataagggggtgattatgatccaggaaatgtgcgctgtggtggattgtgttgtgcaaggggtactgtcacagctcctttccgaggtaccgtggtggtattgaggcacatggtgacatgttgtggggctgtgtcttgtgggtacagtggtacacctctggccagagtaaaactattcgaatagccgtgcccgcggttatgggcgggtctaacaatgtctttcgtgattagtttcacacttctcaccataataaaagatgctataactggtaataatttgtttagctcctggtttggaatggtatattcctggtttggagatagatctgtacagccgggtatggttgttcaggatggttgggcctgagcagcatgggtgtgctgtttagtgttgattaaaattgatgattaattactctactgttttataattctcaaatgtttgctaaatgctgcttttgcaaatgagccctatattatgccattctttggtatccttgtgcacttgcatatttgctgcgtggcttgctgagtatgtcatatactcaccttgcaatcattcatcagaggaagagttctacagtgatgctgatggtgtggaggattaggtgtagccctggtcaaactgcctatggagtggagccgtctgcgtcgtttatcttattttttcgctgcttagatctttattgattgagaggaactatctacctctgtaatgacgttttattcgcttattaattagagtaataattgtactctattatcaatttgttattgtgtgcctcggctgattcctggacgagggttcacacacatgtaagcgtttggaattttggatagaaattccgggcgtgacataggcgagggcaagcaggcacataggcgagcagcaaagcaggtgacggccgacgggcaaacaaaaactcaggaggtgtcgatctaaatttctgtaatgtgttctttcattgtttggtaattatatatcccgatgacttagaacatgattctggtgctttctcagtttgatgatctttggtttgaacgcagaacaccatttctttggatagaatgtcaaagttataaattatttttgatgaaccactgattgttctgctatttttttttttgctaattgaatggtgcggacactcaatcggggccccggtcgggctagggctgcgggctgttttagccccgcaactaacctcgggggcggggggagaagttgggagtcgggggcgggggcgttccagcccaaccccccctcgacccgccctgttgccaatcctaggtatagataaggttgggccaaattgcactagattaggatgtgtttggatggagggattggctgggatagggtatggccacccaaattttggaggtgtttggatggtgggcggtactgggatatggccaccccctagggaatattccctccagatgccggctctgtgcatccggccaattcggccggacagggcggcccaggaccgcgcgcgactcatgcaagtgaagtggtcgcgtgccctcacctcctcccatccttttctctcttttttctcctctgttctcaccggttcacagtggcaaaccctagctctcctccctcattcagcggtgcaccaggcggggtggttcggcggagcgggtggccgcgccggggacgagcggtaggcggggcgggcggcaggtgtcggcggcaccaagtagtgatacgggttatcggaaaaaaggcaagacaaaatctgtctcgcagcttttccagtcaccattcacacatccaatggtagatgtgtatcaatggttcgctctctcgtgaagagagaacggaaacaatttcccctgaacagtattttgtctcatgccacgaatcttaaggcacgaacatagctgttcgaattcccgcaaataatggtaaggattttctcggtcaagaccagaaaaaggattttccttaatcatacgtattaattcagggcagatctcatagccagttgtataaataggctccgatgaaggaggtggctcgtaagattcgcctcgtggagcagatagctgaaaaattgatgatggctccttcggtcaagaaggttttactggaattcttctctagggtagcaggggtgatggtagaagatgaacaaggttcggagatagacagcaaccgttccccgacaacggcggcagaaatgcttgttggtatttattaacctcacagataaaatccgcaagcgcacagaaaataccgatgtagcacttcactgggagtattctcaggtatcgatttccatagggagcgtgtgtgtcaactccagatcaggttgatccaaggacacgaagctaatgataggcaaaggatagagaggaacagtgtctacggaaagcttaactttaatcctaacgcgatacttcgggcactggccagctcgctgctcctagatatcgctctactatgcacccgggcaaggaggacttcagtgatctcgagggttgtcaccacctctacacccacctcacacctactgtgggaagcggagcaaacaccggaaatcaactacctagacaccgcgtataagcagttaataacttactttaatgttagctataaactaaagcactcactatattttactggattatagtgaacgatgatcatgtccgctgattaggaactaaccaagacataattttcaccaagcaaaacaaaattactcaaaagatatttctattataatcagagtaattaacatggcaaaaaataagaagaggattaccgataactccagaactcctccgacttcttctactctactctccctaatcaagtataaaataaagttcaatagagcctcttataattcagcgcaagcttgcagtgtgtgtgtgtgaagtgagtgaggtgaggtccttaaatagggcaggtataacggttaggaaaacgtgacatgtcctttttgcccttcaaccgccattaggagctcatctggaccatacacgccaaaccctagcctgaacggctgagattgtggttcggccgaaccctggccaggcccaacaggcctgcactttggcctgttgcctctcctcctcctcttctatccatttttgtgtgtggaaggcccatttggtcgtattttaatgtagttcttggcccacttgtgatatggacaggaattctccttcacttaagtctatatttcatccaacttcgacggtttatcacctgcattcaaatgtacacaacacttgtggaatatgtcataattaaaccctatcactatgttggatgttttatttccttgatttatgcaggtattttgttaggagctaccataggcagcccccgattacgcaatgcgtatgtgtggacgacgggaggacgaggtcaatagcttcgcctccccggcgccgtgctgtgagatggaacagagagggagagattagagagaacagaggaaggagacagtagatgagattaaatttcttgcttggatttaaccataacaatccacggcttaagtagccttacatgctagcaaactttagctaacaaacttgctaattaaaagggataacagaaacaaattatcaagctgatcctaatccaccgaattcagtggcacgagatactattcctcgtccggcacggtgttcgtccgtccgcccgcaccgctgaaagggaattccccacataacatattggcggcataaaattggcatttagcaactgccaacagttaagttgagggacctccggtgaacttagtccttttaattattgggctgtgtcttctactttctacaaagcccacagatattttttcgggcagattggaaaaagttcactttgactccttcaaatagaggttcgttttgacccaataagtattgaaaccagtgcagaatgactccctcggtgattttgtgggtgattttcgctggcgtggctagttgatttggtctaacctgctgagtcatcatgtaaggcccacatgtcagtgtcacatatgtttccttctctcgttcctttttctctcctccctccactttctctctcaaccttttctctatgctccatgcatctccctcggtgatggcgagaactcttcctctctcgataatcatggaagctgcagccaagacggcgtccaagaaggaaggaagtgggcgacgagcagatccaagcagcgtggtggtccttccatactcccgcctcccgcgccacgccctcggtcgttgtgggcgtgctcccttgaggacgcgtcgccactgctgacgcaaccaacggagccgatgctggcgctgccgcctccgtctcaccttcttataagtcccaacgctaggactcgtgtttgtgctagatctgctggccgaagcaggcgagatagagaaactgctggggaaactgaagcctgctcgagtggatcctggtgacctccagaccttcctcggatcctctgcagcgacggaggagacaatggagttgcgcatgcgagcttcctcctctgccattggtgccagttcatcaaggacgcacgccgcaggcatgaagtagtgggtagcgtagatcgagtataggtacgtatccactggatgggtggtgatcagttcattcctatttcatagatcttgttggtaggctagtcagattttttttatctaaatctctctttttcgaactgcatgagtgcttaaagttttgaatttttcatggccaagttcatgtgtattgtgttgttttagttctaagtttcttgaaccatggttcttctctcctgtgttgtttttgtgtttttcagagccttgattacatcttttgatagcaaagttcaatgtagttgtgcagacattcgatagttgccgccaccgacagccgtatggtagacatcaacgagctcgacgagtgggcagctggcggcggctcaaccacttcggcacttgtgcccatcatccccaccgtgaagaggttgttctcgacggctcgctgaagagaaggtggggaagttcctgacaaactgggcccactctttttttttaattcatatgctgactgggctaacacgtatacaccacgtcaaccaaaaccgctatcaaaatagctgagagagtcgttttgcacggttttcatagttataggggtcgatatttttggttttacgtttaagggatacgaattagatctgacgtatatttgagggagtcaaattgaatttttttccaggtagattaggagcataggacttcattcaaatgtttcttgttttttttgggcttcactgctggagaaaccatttattctcccggttggtaacccctttagtcccggtttttcaaccgggactatgaatccgggactaaagatgcccatatttagtttcggttgaaataaccggggctaaagatccatttttgtcccggttggtaacaccaatcgggactaaatataccttatctttagtcccggttggggactaaagagagggtagcgacagttccatttggtctctttttttttcattgttttttagctggagtttaatccctgtattttctcccaaatcaagtgggatacatatcccaaatcaaacctcaaatcaaagtaacatcccaaaacattcccattacaaatcttaagttacttatacacacaaatcaaatatatcataaatcttaaaaaaattacacacaaaccaaatacatcacagattatacatctcaggtcatgtcacgtcccaaaacgactctaaaatacatcctctaaattatgcctagaataattaaaatccgtgtgaaagcctccaacaattaaaatgtgcaaagttaaaagtcaaataaggcttggaggatttttgtatatttcctaaaagcctaaaatgcgtaaataaattttagtggaattttcagagcacaaataataattattaagaaataaacaaagttaaaatggttttataaaaagaaaagctctaaaaagtcccctttccctccctctccctcttgggccggctcggcccatctccctccccctccctctcctctccccgcggcccatccggccttcccccgcgcgcgcgccgctgacgggcgggcccgcccgccaccctcgctgacgggtggggcccacccgtcatccccttcctcccgccgctcccgccgcctcgcccgcgccctagcggcgccgccgccgcgaatcccgccgcctcctgccgtccccgcgtgcaatcagtagggggaattattccccgtgattccctctccctttccccccacttttccctctctctctcgcgttcaaacgggcgaatttgcccccgcaaatctcgccggcgccattgatggcggccggacctcccgcgcctattccttccccgccggccgccctctcccccttccaaccatatataaaccctccccgcgcctcctccgtccgtttccgcctctcgccgcccttcctcctcgacggaatcgagctcgcgccgtcgctctctctctccgccgtcgccgtcgagctccggtccgccgtcgtcgtcaccccggaccatctcccaccccggcgtcgcctccttcggcttcgccgcatcctcggcgaccttgtccacccctccgtttcgctcgccgaccgccggaacgccgccgtccccgtcgacctgagccgcgccgccgccttcctccgctccggctgccattccgtcgtcgccgtcgacctagggtgagccgtggaccgccgcttcttttcccccttcccttcccctctctcggccgccgctccgccgtgcctatggccgccgccggcgaccataggggcgcgggtgcgccgcctcccgccggctgtgccggcgtggccgccttcgggcgcaccgtgcggctgccgcgtggggcccggccgtcagccgcccgcgccctcgggtgcggctgacgcgtgggacccacggcgccggccggtgtgagcccgggtgcgcccggtccatcgtggaccgtgaggctgccgcgtgggccccactcccgtggacccggtccgcgcgcccctcccctcggctgacgcaataaaccttttttttaattaaaatttaaatgaagaaattcgcaaatattcatttaaagagcatataaacttcaaatggccaactcggaattggaccgttcaagtctctaatttttccttaagaagtcaagaacccatttttgtgctttgtttcagcttgttatatggagtttattagagtaaaagccttttcttttccgttggtcgtgtagacgctgcagcttcagaagatccgctcttcgtggaagttgaagccgacgtttgggaaagcgagcaaggcaagtcacatcatccttgaacatattgaatcccagtttataaaattattttgatttaaattattgcattatcgctttatttaaattcccgcgttatcactgttttatctagccatgcctatttacttttgttatgaccttattattgttattgttattatttccttgttcaccctagaataaacaaaaccccaactagtggacactctactcatggtaccactagtatgattttaggtagatgcttcgctggttaattaggcaacattatgtggttttacaactctagactttgggatattcatatcacctggacactatggaatggtttgattattgtggaattggattcacacctccccctctattcaaaaccctcaaaatggttttaggctgggctcggggtgcatggttttgatagtagcacctcggccatacaaggaccggtcttcgggcctctgttgcaaagcactaccgtacttccacatgtctagtgggtaaggcttagtttgtggctcagtctggttataaacaaaagtacacggatggagatggacgaagtcgggggtcgatggacatctctaggacaaatgaaggctacacgagctgcggcccggtagtcgagatgtcatggcacagggccggtgtcctgctgctcggggctcagtcctgactacctgtcacatcctgatttttgtttcaggatttataaattatttaataaattattaatagaatttatgttaaatgatctttaattttcaagtgaagttaaatgtgggaaataaaatttcctaaatataaagcatggatggatttaattttttattaaattctccatgattaattatactctctgaaattttctcggaattttcggagctcaattcctaatgttaataatacaaagagcatttcagtaattacccacatattaaattaatcattaaatggtctgattataattttgttaagtactttgagtgttcaagtattttcaagatttttcttggaattatttgagcataggaagtatttttaacaattcaaagatcatttcagtgattaatttaattggaaaagtatttaaaatccccttctccttttcgggccgaaataggaaaagttcagcttcagtcctcggcccattctcccattttttcggctggccttatccctcctccaaagtctgctttgtgtccctctttcaatcgggccaagaagtagaagcccagccgaaagtctagttggcctccctgcgctactgttcatcttccagctctggacagagcccgagccagccgagcctgtgcacagtgccgccttcttccaccaaatccggcctcctcgttgctcctctttccaaattagttgcgggaatggaatcctctcaatctcctcttccttttccccaagaaatccccaaaattttatatggaaatcctttccaatttcgcggttcaacctttcctttttccggcgaaccctacctaatccgtcgccgattccatccgttcccgagtcgttctctccctcttctggctatataaaggaccccctagtcctcctctttcgtttgccccctctcccgtggtctcccgtgcctcgtagcgccgccaccacgtgctccaccccgccgtcgtcgccggcgccgctccagccgccgtgcgccgtcgccccggccgtcgccggtcagtgccgtcgcctccctcagcttcgcaagggtgagagctaccccggccacccgttcttttgcgccgaaccccgccggaagtcgccgtcaccgtgaaggccgaaccgttgccatgttttgatctccggcgaagctttgccgtcgactccgtggtcgccggacctcgccgtatccactgtcggcatcgcagcagtgaggagaagcccggcagccatctccccgaagccaaaatccaccggagctccatcgtcgccgtcaaccctgtggagattatggatatcccatatctacacggcgatggtatttggactgggtacaggatacctaatgtagatagaatatcttatctgtatctcgggtttgtttcttaacttgtgtatcaaggaaacaccctgagacttagtcggttacgactatatttcatctgtatttgcatattccgttagggatatagattatcttttgtaacacggactcctccccatatataaggggggtccgggtgcctctaggggcagatgttgattttccctaaatcatacaatcaataatacactcggcggattcatccccggacaggagtagggtattacttcttttataagaaggcctgaacctgtataaatcctttgtctccaaacccatacactttcctagcttgatagccacccccttttattattgccgaaatctagtttcgacagttggcgcgccaggtaggggtagcgtcaagcttttcgccgatcagtgcaatgggttccgtctccggcatcgacgacctcgtcttcccacccgggcagacgtttcggttcggcagcctcgacttcgtcaccaacaacttcggcaagatctctctccttgactcggaatcaaaccagtcgggagagaaccggctttcagtcccgtttggattcccgaacgcggctgaaagctacttcaaaaccatctcaaccgagtcggcttcaaaccactcggccgagatcgcatcttctccaacgacaccagatcaagatgatggggcttacccaccagtcctgatgaagctccccgacgatttggtggccgtctccatcgcgacagcgtcttcttcccgtaggcctaggcggaagtcggcttcaacactgatttcgcctagcttcagggaagttggcgtcatcctccaaccactcggcacggtttcgacggatcagctagatggcgactacagctctcccaccgtcgactcgcgccccaccaacatcgtggagtacgacgagtttagctctcgctaccacgatccggatctcgacgacttcgacggaagcctagatgacaactacacccctctctactttggcgtcttcatggccaataacgagacggaggagcaacgccaagcccgggagaccgaagcgcgtcgcgagactgagcgccgccgactggaagaggagcatcaagcacaagaacaagaacgattacggcgtgagcagcaggagcgtgagcggaccgcgaaggaggctgaagatcgacggcagcgagctttggaagcagggcgccgggcgcgtgatctcatcggccagcaagatgttgaagggacgccggttttccgcacccctcaacagaatgcggttgccgcgatcacccttctcgacaccctcctcaaccaaaacgagctcaatcaatccgaccacgtcgtcaacatcttgaaccagacgaagaccatgattgcggcttcagtcccagttaactccgaaagcgtccacacgccgactggtagccgagtccctcacttccgatctcatgactaccgtcatccaagcctcagcatcaccggcgcaggatctaatcgcaggagcaggggtcacgacgagcggtccattcactcacctcccgaccaatatagggagcgccgagtggaacggcctcgctcaccacctcgtcgccgccccgtcgatcttcgcgacacaatcatacagcgccgagcagctcgaggccatcatcattcgccgaaccgccacgacgacgaccttgacggagtagcagccttcaccgacgatctgcgtcgagtggattggccagccggcttcaagccgactggaatagagaagtacgacggtaccactaatccagaatcgtagcttaccgtctacggtcttgcaatccgcgcagcaggaggagacaacaaggccatggcgaactatttaccagtggctttagcagattccgcccgatcttggctccatggattgccccgtggtacaattggatcttgggctgaattaagcgaccacttcatcgccaacttccaaggcaccttcgagcgtcccggcacacaatacgacctctacaacgtcattcagaagtccggagaatcccttcgagattacatccggcgattttctgaacaacgtaacaagatctccgacatcaccgatgacgtcatcatcgccgcattcaccaaagggattcgccacgaagaattggtcggcaagttcgggcgtaagccccccaggacagtcaagcttatgtttgaaaaagccaacgagtacgccaaagccgaagacgccgtcaccgcatcaaagcagtcgggtcccagttggaagcaaaacaagggtacgccggctacgggaggaggtggaagtaacaatcataaggaccgcaagcgtaagcctgcggaacttgttgcaaccgccagtcactcttctcgacagcgttcgcgcgtcaacacgttcgacaagatcatgaactcccaatgcccgcaccatcctaactccaaccacgtggccaaagattgtttcgtctacaagcaatttgcggatcaatacaccaagactgcacgaaagaactctgacgaagaacaaagcacgtcaaggaagaaggacgacggcgacaccccggcaggttttcaagatcaccgcaaggagctcaaccatatcttcggcggccccctggcttatgagtctaaacggaagcagaagttgactgaacgggagatcaatgctgttcagcccgacacgccccagtatcttcgttggtcagagattgcaatcaagtttgaccgctcggatcatcctgaccgagtggtccacccggggcggtaccccctggtactagacccagtggtccgtaatgtcaagcttcgcagaaccctcattgacggtggcagtgcactcaatatcctcttcgccaagaccttggatgatatgcagattcctcgctccgagctaaaaccaagcaatgcgcctttccacggagtaattccaggattatccgcaactccactcggccagatcaccctcccagtcacttttggcactcgggaaaacttccgcacagagaacatcagctttgaagtcgccgatttcgagacagcataccatgccatactcggacgcccggcgttagccaagttcatggccgtcccgcactacacttacatgatgatgaagatgcctggtccccgaggagtcctatccctacggagcgacatcaagcaagccgtcacatgcgacaaggagagttgcgacatggcccaaactcacgagatggcgtctgcccgagaggttatccgactggctgcagccacggcgagcgaaggagaagtgcccgctaccaagatttcaaagaatggagaaagcgaagccaagactaagaagattcccctagatccctctgatcctactaaaactgctgtaataggcgccgagttagattgtaaataggaaagcgcgctcatcacctttcttcagaacaataaagatatctttgcgtggaaaccatctgatatgcccggtattcctagagaggtgattgagcactccttacatgtcaaagaagatgccaaacctatcaaacaacgactccgccgatttgcacaagacaggaaagacgcgatcaaggaggaattaaccaagctgttagcagcaggcttcatcaaagaagtccttcatcccgactggctggcaaacccggttctagttcggaagaaaacagggcaatggcgcatgtgcgttgattatactgacctcaacaaatcctgccctaaagatccttttgggttgcctcgcattgaccaggtagtcgactcgaccgccggctgtgagcttctcagttttttggattgctactcggggtatcatcagatccgactgaaggaatccgactgcttgaagacttcattcatcacgccttttggtgcatactgctacgtcaccatgccgtttggactaaaaaatgcaggagcaacttatcaacgtatgattcagagatgcttctcaacacaaattggccgcaacgttgaagcctatgtggatgatgtagtcgtcaagaccaagcaaaaggatgatttgattttggatctagaagaaaccttcgcgagcatccgcgctttcaggatgaaattaaaccctgaaaagtgcaccttcggagtaccgtcagggaagctgcttggttttatggtgtctcataggggcatccaagccaacccggagaaagttactgctatcctcaacatgaaaccgccaagtacccagaaagatgttcagaagccgactggatgcatggcggcgctcagccgatttgtttcaaggcttggcgagcgggggatgcctttctttaagctgctgaagaaaacagataacttccagtggggacccgaagcacagaaggccttcgaagatttcaagaaactcctcaccgagccaccagtcttagcctcaccacacccgcaagagccgttgttgctgtatgtatcagccacctcccaggttgtgagcacagtcttggtcgttgagcgcgaggaagaaggccatgtccaaaaagtccagcgaccaatttattttgtcagcgaggtcctagccgactccaaaacgaggtaccctcaggttcagaagctgttatatggtattctaattactaccaggaagctatctcactactttcaaggtcactcggtaacggtggtcacatcatttccactcggtgatatactgcacaaccgcgaagcaaacggacgtattgctaagtgggctttggagttgatgtctttggacatatcattcaagccccgaatttcaatcaagtcccaagcgttagctgattttgtcgccgaatggaccgagtgccaggaggatacccccgcggagaacatggagcactggaccatgcattttgacggatccaaacgactttcgggcactggagcaggagtggttttgatttccccaactggagaaagattgagctatgtgctttggatacatttttcggcgtcccacaacgtcgccgagtatgaggccctccttcatggactacggattgcaatttccctagggataaagcgtctgattgttcgaggcgattcacagttggttgtcaaccaagttatgaaagagtggtcctgcattgacgacaatatgatggcatatcgacaagaggtgcgcaaattggaagacaagttcgagggactcgagctcagtcacgttcttcgacacaacaatgaagccgccgacagacttgccaattttggatccaagcgcgagacggcgccctcagatgttttcgtcgaacacctttatacaccgaccgtacctcatagagatactactcaagatgcggacactcatgacgtagctatggttgaagccgactggcgagagcccttcatacgatttttaacttctcaagagctcccttgtcacgcccagaaattcccgaatagaattccaagcagaatgtgtattaaaacccccgtccaggaccagccggggtacacaaacgacaatgttgacatacagatccacgtcttacaaacattataaaagtcttacagaaatgcagcggaaaacaaaagaaactggagctaagccttgacttgaacggcagcgggaacaccactccacaggcatcctcgacggcacggacgaagcctactcctcggagaacccgccatcggacacatactcgagctctgaggttggggggaaaagtagagcaagactgagtactacccactgtactcagcaagtcataccggaataggggtatgatgcagggaattaacaaagaagagctagagtggttcatttgcataaatactggcatttataaacaggaatttaatgcgaaaacagttgtaaaaattaaacagtattaaacatccgctgtccaacgctaacccacgttgcgacaggcccaaccatccacctaaactatccaaattcaacagattacactagggtgagactaatc

SEQ ID NO: 59796 - DNA, 10951 bp, Oryza sativa
ggatactatcttcttgggtaccccatgcaaacacatgatccttgcgaggtacaattctgccaatctctttcccgtataggtggtatgtactggtataaagtgagccaccttggtaagtcgatccacgactacccagattgaatcatgtcccgatgatgtccggggcagtcctgttataaagtccattccaatctcctcccatttccattccgggatttgaagaggttggagtaaacctgctggtctttggtgctctgctttcactcgttggcaaacatcgcagagtgcgacgaattcagctatttctctcctcatgctgacccaccaaaatttttccttgaggtcttgatacattttggtgctgcctgggtgaatggagtactgggtctgatgagcctcggtgagtatcagatccttcagttctttgtcgtcaggtacacacaatctttctcccatccagattgtgccatgctcatcttcatggaaatcccgagcctttccgactctcatgttctttttcagttctgctatttccggatcatttacttgagcggctctgacttgatccacgagcgtaggccgtgcctccaaagcggctacaaacccgtgttcaacaattcccatgttgagatgttcaaattcctgccgcaattcctcacacatgccctcgatgcatagggcagtgcagtaacttttccggcttaaagcgtctgccaccacattggctttacccgggtggtagtgaatactcatgtcatagtctttgattagttccaaccatcttcgttgtcgaaggtttagatccggttgggtgaagatgtatttcagactcttatggtccgtatatacttcgcagcggtttccaatcagataatgcctccagatcttcaaagcatgaaccactgctgccaattccaagtcatgagttggataatttccttcgtgtggacgcaactgccgcgaggcatacgcaaccactctgccctcttgcattaggacacatccaagtccgtgacgggatgcatcacaatagacttggaagtctttcgtctggtcgggcaggatcaaaaccggtgcggatactaatttccttttgagctcctcaaagctcttgtcgcactcagctgtccatttaaacttctcgtctttcttaagcaactgagtcatgggtcgggcgattcttgagaagttttcgatgaaacgacggtaataactagccagtcctagaaaactccgaatctgcgacacggtctttggtggggtccattttgtaactgactccacgttcgatggatcaactgccacaccctgggctgtaatgacatggcccagaaatttgacttccgtcaaccagaagtcacacttgctgaacttggcgtatagctggtgctccttcaacttctcgagtaccagacggagatgttgttcatgttcctcttcggactttgaatagataagaatgtcgtcgatgaacaccacaacaaacttgtccaaaaattctatgaacactttgttcatcagattcatgaagaatgcgggtgcgttggtaagtccgaaagacataaccgtgcactcatatagcccgtaccgagtggtgaaggccgtcttcggaatatcctcttcccggattctcagctggtggtagcctgatcgcaggtctatcttagagaacactttagctcctttcagttgatcaaataaatcgtcgattcgcggtaagggatatttattcttgattgtgacctcgttaagtgcgcgataatcgacgcacatcctcttcgtcttatcctttttctccacaaaaatgaccggagcgccccaaggtgaagtgcttggtcgtatgtaccctttctgcagctgttcatcaacttgcttcttgacctctgctaattcgttggccgccatcctgtatggtctcttgtaaattggagcggttcccggtgccaagtcaatccggaattcaatctccctcttgggtggcatggtagtgaggtcttcggggaacacttccggatactcgcagactatgggtatatcttccaattttctcaagttcttccccacggtgtccactgggatttccgtttcaatttgattcaaggagactccttgctttggtgagtctggtgatttgtacactacggtttctcccttctcgttggtcaaggtgactgtgcgactcgcacaatcgatgacccccttaaacttggtcagccaatccatcccaagaatgacatctaggtctttggattcgagaagaatgaggttggctagaaatggtgatctttggatttctattagcactgaagggctaaaactgactgaggttgaactatttcccggggtacgaaccctcattggtgtgctaagctcgtctttccttagcccatacattcccacgaatttctttgaaatgaaagaatgcgttgcaccagaatcaaaaagtactgttgcagggattgagttaacagggaacgtacccagtacgacctctggtgctgcttgtgcctcctccgcagacgcgtggttgacacgagcctggataaaccttggcccggcacgcctgggcttcgggcatttgtcagcgaagtggccaagctcgccacagttgaagcaggaccctggttttgctcccgtctccttcttggcttgcgcgggctgggctgactgtgccggtgccattggtgggcgtggagctgcaccgcggttgggctggcctccctggtggttctgactgccactagtgccctggtggaagttgctggagttgaacgggcggtgctggcggacgatcatggtggtaggtccaccctgctgtccgggagtgaagcgcggtcggtgctgactaccttggttggaccggaattgcgccgcctttcttttcctgtccattttgttgcgctgatcctcctggcggattgccttgtcaaccagcctctcaaagtcggcgtagtccccagatatcagttggttggtcagctcatcatccagacccgccatgaacttctcctgcttctcggcgtcggtgcggacatcctctggtgcatatcgcgcgaggcgattgaactcgtggaggtactctgtcacagtcatgttgccctgatggagcgcccggaattccctcttcttttgtgccacgaccccgtctggcacctgtgccttcctgaagctacggcagaactctgcccatgtgacttcagtacccggtgggcgggtggccatgtggttgtcccaccaagctgacgcaggaccctgaagctggtgtgtggcgaaagcgaccttctcctgatcattgcactgcaggagattcagcttcttctctatcgcatggagccagtcatttgcctccatagggttggtggtgctggagaaggtgggtggcctgacacgtagaaactcaggcaacttggactgggggggagggggaccaaactgctggtgctgctgttcggcgtgctgcatcatcctctgatgcatctgctggtgctgctgctgcatctgctgcatcatggctgccatcatctgagtctgatgtgccataacttgggcaagcgtcggattctcgggaagtggtggtggaccattgccagaatcaccgttggggtgcacaccatcagcgcgttcttcgccgttgctgccctcgcctgttgcgcggctaccagtcctggtgtagaccatctggagggaagagcagacggggaaaagaagaaaaacagatgctcaagaactaagctttattacaaaggaattaaaactgtaattgttctgatctgaattaaaaacacttaaaagggcaagcaaatatccttattaagacagccatatcataggcacatgatatcgaccgccgactgaccccaaacaagcaacctacacacacaaactaacaaacaaaaactagacagtcgatgaactagtggaaaaacgagcctaatgctcggaacggctcctgcggtcggtggagtcgaaggcgtcctcctgctcgtcacccggtccctctgagcgactcctggagcctgacggatcggtctcgccgctgccgctgggagtagcagacagccaacctccggtaccactggctgaacctctggcggctgatgctggagcgaaggagagagtgaacgcgggagttggagctggagctggagctggaggaactgcgggaactgccggagctgcgggcggaactggaggtgctgcgggagctgctggtggaggtgggttcctgggcgcaagctggatgcgcacgggtgcagtcgtcctcttacggggcgtagtgcggatccggactcctcctggtgctggaagacccttcaactgagcattctccttcttcaggcgcgctatctcgtccttcagagcgacgatcctcatgagcttcccatcattcaaggccttggtcgccttgtgcaggtccgagtgcatcctgtccaatcccctcatcacagcacacatgtgaccaaaggtggtgtcgttctcgccagctgtcggacggaaggagctgacgccatcaccatgggctcgacgggggtggtagcggtacgccgtgtcgtggaagatgtagtcgtggcgctcccgtaacctggccatcatcaagtaggctgcctcctgacaggcgtgatctgctgtgcctcctgatgcctcgaccgccatgttagcgaggcaagtccccacgtagccatggacctccaagcggacacggtaaggaagctcgccactgagcggtgggatggtcgtgtattccggcgcgtcggggtagcccactaccagtgtcatgcgtgccaactctgccacgaaatcaatcatgccttctccgcggtggttgggtgggtgaccggccatctagagaagacaaagaagtaggatcaatgcatgctcaaatccaaatttaaataaagcaataaagactcaaataaaggaatcaaataagagcaaaattttatgcatagatcattttacatgagcgcgaataaataagacagactcacataacgataaaataatgggaaattagatacataataataataacgaacaaagcataaataccttgcaacccatgataccgagctaggaccgaatgcatttcacccatcaaatcccaactgactgacgaataaatcccaataattttactaaaaccctagactgactcgttttgaaaaactcactttaaacgagcgaccaagatttttcccttgaaccacaagaacagatccccattttcccggaacaaatccaattgcgaagaacatatgcaatgaaaaaggattcagagggctcttaggtttctccatttggcttgtcctacggtcaaggtcggctctgataccaacttgtcacgcccagaaattcccgaatagaattccaagcagaatgtgtattaaaacccccgtccaggaccagccggggtacacaaacgacaatgttgacatacagatccacgtcttacaaacattataaaagtcttacagaaatgcagcggaaaacaaaagaaactggagctaagccttgacttgaacggcagcgggaacaccactccacaggcatcctcgacggcacggacgaagcctactcctcggagaacccgccatcggacacatactcgagctctgaggttggggggaaaagtagagcaagactgagtactacccactgtactcagcaagtcataccggaataggggtatgatgcagggaattaacaaagaagagctagagtggttcatttgcataaatactggcatttataaacaggaatttaatgcgaaaacagttgtaaaaattaaacagtattaaacatccgctgtccaacgctaacccacgttgcgacaggcccaaccatccacctaaactatccaaattcaacagattacactagggtgagactaatcacggtgaatctggttgaccgcccataaccgcgggcacggctattcgaatagttttactctgatcagaggtgtacaactgtacccacaagacatagccccacgacacgtttccgtgcgccgacatgccaccacgacataccggaaagaggccgtgacaggacccttcgcataaccccctctaaccaagcacaccacacctcaggtttcacccccactcctcgcaaggcagcgggcagtcccctctcgtgcctaggtgaatccggaagccgcatagaccgtcgcagggcccatccaaactccatcacgcccacccttgcctggatgcgtcggctagaggaaagctacactacaagcccagccgttgcccacgctggcttgtggtaagtacgataaattcttccagggcatcccgcgaaccggtccttaactgccatgggtgcgaccagcaaaaccatgcacccacagcccaccatgtggttcattttatttaaccaacaccagagcggtggtattaaaccaacattatcatataaacctatagtctaggttttaaatgagatccccaatgtgtgctagttgaactaagcatggctaagcaattcctagtccaacgtctaatcatgttataacccaagctaacaaaggagcatgatatccaaaagcatggctgtaacaataggtatccatcccatagtgatattataaaacaatgcaatatttgaaagaaaacaatagagcatttgcaatataggatcaacatgttcaagtgacaagcatgacttgccttgctctgctgctggaggtacctcggcgactatttcgaagtacaccggagcgtcggagggatcggaatctagcgacatacaaagcaaacattgcaaacaggctataagactactgaaacagagaacaaaaccatttttaatggattctacacatttttcttgatttactgagatttgaatgggattaaacggagctcggatgaattagatatgaattttagaaaattcactgtgtttattactataaaagaaatccttaaataatttattgcgcaatattaaccagggctgacgtcagcgagggggcgcggcgccgacaggcggggcccaccggtcagcgaccgggagagagagaaagagggtggcggcttgcgggcccaccggtcagcggcacgggaaaagaatggggcggcggcgccacgtggcgaccggaccggcggccccgatctacccaagggtagatcggacggcggcgcgggacctcgcggccggggcgcgcgggcgcggcgcgagacggcggcgaccatggcgccggcggcgcggcgctcacacggcggcggcgcacatgcggcagcggcgcaaagcgacgaccgacggcggcggagagcggcggctagaggagaggaaggggaaaagaagggaggggatgcctcaccgagggtggccggcgcggaggaaggcgatggcggacggcgacggcaagccacgggaggacggcgtcggctagcggacgagcttcggcgtgccctaaggaaggagaagatagggattagagagagagatggaccatggcgatcgggatccatggccgaaggcggcggtagaggtggcgctcacccgtgcgcgtggagatgagggctccggcgacgaacctcgacggaggaggggtggacgaggtggacctcggccgcgcgaagctaacggcggcgacggcgtgagacggcggcgagcctagcggcggctagcggcggccggagtagcaaaagcggcggcggcgggtggttgcacggcgcggaggcgttggggagctcgggagaggtcggcgcaatggggaaaaagcgagagggggtgccggtgatgcttaaaaaggggatgggggaaccgaacgtggccgggagcggcgggattcgacggccgacgtgggggagtggggaggagagagaggcgggattcggttttcgaatcccggccatctcgggcgcgggcgcgagcgggagagggaggggaacgggcgcggggaatgcggcgcacgcgcgggcgtggtcgacgtggcccgggagagacggaggcgtgggcgcggcgtcggttgcggcggtggcggcgcgagcgggatcggcgggaggagggagacgggtccgacaggtgggccccacctgtcggcgaccccgagaggagggaggcgggcggccggctgtcgggctgggcctcggcctgggccggcccagtaagggaggggaaggaagggagaagtgggccgacggcccacttgacaaaaaggagggaaaagagaggaaaaaggaaaagaaaaggaaaaaggattttccctggaattaacaattgcactttagtgatttttaattggttaaaaattatttctagagctctgaaaattccactaaaaatcctgttaatgaattttgacatgtagaactcaagaaaaattccacatgtcaaatccgattattatttgcattactttcttagggttttctcctgatttcaccagcattttcttagggtcaattataaattacaattttgacttgggaggaaaacttcggggtgtgacatccctcatgataaagatgaagccgagcggatttcaaggcggagcaaactttatgttatgcatgaatctgagttatacaagaaaagcccttcaggaattctgcaacgctgcgtatctttagaggaagggagacaattgctgaaagacatacattctgggatatgcggaaaccatgctgctgcacgcaccattgtcggcaaagcttaccggcagggttttttctggcctactgcagtgtccgacgccgacaaaattgtgcgcacatgtgaaggttgccaatttttcgccagacaaattcatctaccagctcaagagttgcagactatcccgctgtcttggccgtttgcggtttgggggctcgacatggttggcccgtttaaaaaggcagttggcggttacacgcatctctttgtggccattgacaaattctccaagtggattgaagctaaaccggttgtcacaatcacagcagataatgctcgagacttcttcatcaacattgtgcatagatttggagtgcccaatcggatcattaccgataatggcacacaattcaccggtggagtttttaaagacttttgtgaagactttggaattaagatttgctatgcctcagtggcacaccccatgagcaatggacaggtggagcgagccaatggcatgatacttcaagggattaaagcgcgtgtttttgaccggctaagaccctatgccggcaaatgggtgcaacagctgccatcagtactttggtctttgcgaactacacccagtcgggccacaggccagtcaccttttttccttgtctatggggcagaagcaatgttgccgagtgaagttgaattcgagtctttgcgctttcgaaatttccgtgaagaacgctacgaagaggaccgagtggatgatttgcaccgattggaagaagcccgcgaagcagctttgattcggtcggctcgatatttacaaggattgcggcgctatcataatcgcaatgttcgatctcgtgcctttttagtcggtgacctggttttgcggaaaattcaaactacacgagatcggcacaagttatctcctctatgggaagggccatttattatctctgaagtcacccggccaggttcttatcgactcaagcgcgaagacggtactcttgtcgacaactcttggaacattgaacatcttcgtcgtttctacgcttaagtttatcattgtacttccctatcttgactgtcaacatcaagttttcttcttgaagttgtcagtcgggggctatcatcataataatggagtgtgattttttatcaatttaatttgcttacttggtctatcattgccttgtttgattttttctacttagtctgcgaggactgaaagtttttaatagcttctttgggttttaggctcaacaaagcttgataaaagcttttaagaaatcaaagacttggctagaactatcaagcacagcataaatacaccggtattgtacaaattgagcctccatttgttacattcatactcagtcagagtcagtcctttcatcatcagagttattattactcggctgaagatcgttgttgcggaattgctctacaacatcacttgcaatcttgtcagccgcactttgagcattactgataagatcaagagcagcttcttcacttgtcccgtctgcaaagccatcaatggtatcaatttcaatcctcgggtacaaggatttggtcatcgccaatgccatactagctcccatacttccagctttcttgatattcttgaagtatacatccggtgcaactctcagcttgtcaaagatttcggttgcgtcaagtgcactcggaccactgttattaaggaacatagcttggacaagtggtgtagcgacattggcgacttcgtctcttgctccttcaagtttcttgatcttaccaaccaggacgtcaaactgagcttgagatttgattttacggtctacaaaacacatttataataagaatttgctgcattaaaaagaggaaagttcagattgtcagctggcagtaccttcaacctccttcaaggctgagtccctttctgcagccagttctgctttgtcttttttcaaggcttctatttgcttctccatttgagccatcctggtggcttgcgctgtttgaaatccaaatgtttgaggatccagttatgacagcacaaatgggacagatctagagattaccttttgatgaaccatcagctcgaagttggagtcctgaagctgtgcaattcgatcccttaattccttctccgttttcttggcatgctccttggcctcgtgtagctgttccctaacggcttcaagagttcccaaatgtggaaccagcttttctaaggttgtggtcttggcctcattgcgaagatggatcctctgcacggtggttcatggattagttttgctaacgagacaataaagtcatcaaaggcagtcacctagaagacttacattcacaatgcgag

SEQ ID NO: 59797 - DNA, 703 bp, Oryza sativa
tagaagacttacattcacaatgcgagtagcttctccaagtactttcttcagctggcacacttcctcatcttctttttggcgatttatgacaatgccagaaacttgagagttctcgtcccaccatttgagtaagataggaggacgagagtcatcagctgcctttatgcggagaatttcttcttcgtcgccgcctaatggacctgatgcattcccaagacattagacgaacaagctggagttattcagaacggcatcacttgagaatatgagttacctgaggatgtgcctagttgagcgtgaggtgatctttgctctttatccagagacccaatcaccgagtcattgccagcttttggtccttgggaagttgtcgcttgtgctccagcttcaggaatctcttgatttagacccacatccgactggtttccagtcaggggttcttgggttgttgcagtttcagttgcttccgactggtttccagtcggtggctggtcactcggatcggccttgtcatccgaagcatgggcgccagtcggctggtttttggcagtcggctggttttcggcagtcggctcagtgtctttggataaatttggctctgtcacagccggatcaggatcttttccagttggatcaatgtcggatggtttcctgcaaagtgtcctttcaacattcagcgtaatttctatggggctgcaggaat

SEQ ID NO: 59798 - DNA, 3553 bp, Oryza sativa
aaaaatataaatctatttagaaattaaatttaatcagcaaaaattatggaattgagtaaaaacaatgaactcaaagcattacgaaattatgagaagtaatttaatcaaatctaaaagtagtttttatataagataaaagtaacttacctatataataaaagtaatttacaatataaatgttttttcatcataatattatcatgtaagatcttgttataaagatttaattgcaacggacacaatggtgtaatcggattatatatcggataagtaatttaagagaaaattttataagaagaaaaaaaatatgcacaacctaatagcaaaaactacttgcatgcatgtctgtaacgctactagtacttctcacgtaattgtccgcgtcgctcgttaagtctaaatcgagatgcctctcgaaatagattttgcgtaaattattccctcctccgttctaaaatattttaatacagaagtagtatttagcgtgttaggtaagctgcttaaaaaaattatgtagttataatttattttggtatgagttgttttatcacttaaggtatttaaaatttttgaataagacgaatgatcaaacataaacatgtgttcaaaagtcaatggtgtcatcgattaaaaaccagagagagtagatttcaggacagagggagtattaaattagacacgtgtttgttatcattttttttgaaacagttgacggtaagatttctaccggatatattagaagaaaagagtttttacctaaagggggagagagttcacaaggcaacacctccaaggaggaaacagcacccgcatacatcgatgtcaccgatcctgtaagaccagacaaggatttcacccaagactgtcgccgatcctgtaagaccaggcaagaatttcacctaagactaccttaaaacgtgtagaaccttcaagaaacaagagcaaaagtgttgagtgttatcgttgcccaactcatcggctgacccgatgcagcagctccgactccgccttaacacgaaagctcaagcaccgtagagaaaagcacaccgctccaaactcggcactaagacagatccacacagtcacagggctcttatgcctcgccagtgctttgttatcattttgtaccatgtcttttgggcctacggtgtacattactacatgtggagcgattagcagcagccatttcgtagttagaatagaagaacacactcttgaggctatcagcaaccagctccactgctagctccaggccggtcatggcggcggctggtcacgatgtgcagctcccccacgtcgccatcttcccgttcatggccaggggccacaccgtcccgatgacccacctcgcctgccttctccgccgccgcggcctcgccaccgtcaccttcttcagcaccccgggcaacgcgccgttcgtccggggacagctcgacgacgacgtggccgtcgtggagcttcccttcccggaccatgtcgtcgcccgcggcgccgcggagtgcgtcgaggccctcgactccctgttcccccttccggcgttcgtcgaggcggtgtcggcgctccggccggggctggaggtgtcgctcgccgccgctcggccccgcgtcggcctcctcgtcgccgacgcgttcctgcactgggcgcacgcctccgccgccgcgctcggcgtcccgacggtggcgttcctcggcgggaacatgttcgcgacgatcatgcgcgacgtgatcctccgcgacaacccggccgccgcgctgctgtctggcggcggcggcgccgaggcggcgacgttcgccgtgccggagttcccgcacgtccacctcacgctcgccgacatcccggtccccttcaaccgcccgtccccggagggtccgatcatggagctgaacgccaagctatggaaggccatcgccggcagcaacggcctcatcgtcaacaccttcgacgccatggaaggccgctacgtcgagcactggaaccgtgaccaccgcgccggccccagggcgtggcccataggcccgctctgcctcgcccatggcggcaccggcaccggcaccggcgccgtcgagccctcatggatgaagtggctggacgagaaggcggccgccgggagagccgtgctgtacgtggcgctcggcaccgccatggccatcccggacgcgcagctcagggaggtcgccggcgggctggaagccgccgcggccgcgggcgtctacttcctgtgggccgtgcgccccagcgacgccgacctcggcgccggcttcgaggagcgcgtggaggggcgaggcatggtggtgcgggagtgggtggaccaatggcggatcctgcagcacggctgcgtgaggggcttcctcagccactgcgggtggaactcggcggtggagggcgtcgccgccggcgtgccgctggcggcgtggccgatgggcgccgagcagccgctcaacgcgatgctcgtcgtcgacgagctgcgcgtcggggtcagggtgccggtgccgacggcgatggcgacgggcgggcacggggtggtcgggagcgaggtgatcgcgcgcgtggcgagggagctgatgatgatggccggggaggggaagggcggcggcggcggcgaggaggcgaggaacgtcgccgcgctggcgtccaaggcgcgagaagcggtcgccgagggcgggtcgtcgtggaaggcgctggaggagatggttgccacgctctgccgccctgttgaaggagatacaccgaaacccacaaaataagtttatttgtttctacgtttgaccggcatcttataatctatctatctatctatctatctatctatctatctatctatctattattattattattattattattattattattattattatgattattatatactaaaagtccattaaactttctacaaacactctcaagccaccacgtggcgctcctacaaacgctcctagatcggcacgtggcgctttaacatccaaccatcggttttcatttaatctggtgaacccattatttttaaccattggatctttattttaagaaaaaacaaatcaatctatctaaaaaatcccacgttactcggccgtgtcccctgaacctgtacgtctgtacgtccgatgtacgtacatatcctctctatgtccttttctttttccttgttatatatttagattagatgaaaaactttagttcatgttaaccatatgttttaagttgtaaaaatatatgttattttaagttttattctaaatagtgcatctcatcgaaatatccataaaaaaatattaataattaacattatagactatatgattgtatatcacaattaaattggacttataattaaaaaaacaatttaaattttgagtagcattttaaaaatttactcactccctatcgtgtaatactgatatatccaaatgacattattaaatttatcaagaatgtatttttcatatattatatgttgctgtattcatatatttttttttggaaaattaacaaccatatatattttttacaccatgtggatgtccttttatctcttagggctgcagga

SEQ ID NO: 59799 - DNA, 1794 bp, Oryza sativa
attcctgcagcccaatatatcttacttaaatatgaaaagtaaatatcatcaagaaataacaaaacacttactcgtattaaggcaaacgtctgtagaggtacaagctaggataagagtgccaacagacccaacacttccccaggagaagagtgctgatagccctagcaattctctagacttcctctatctccctactctaggcactagctaagtagagcttcacttttagaatgaatcatatgatcttctatcttggtgtgtcttgagaatgagagtgtcaaagtgacttgagagagagtggagatgctaagagaatattctccctctatctcctctcaagcctccacctctcctcaaaccatcattcgatggtggtttcctgccttaagccttgcgccactgacttaaggattatgataaccgtcgccacgtgaagctgggcaagaggggagccaccccaggttcggcttgcgccgcctttcacctgggtcgctgcctagtgggcacccaagttggtttggggtgtatggatgaagttgaggcagttctcctcctggtgtggactatttgatccctgttctctcctctatttggttggagttgtgctttctcttaatttgcacaagtaatcacctgcatacaaatattcatcaacacttgtggaagtggttagtaataaaactgtaacatcctgaaaattcccaacaataaaaatcactaaaatttcgaactttttaaaactttttgcatcatgctggatgttatggttgcttttatttgccaagctataaattgtcacaatggaaaattaaactaaagttatacagctaagtaataatcataataataagatattattatgaaccctataaatatttacgcacgagaaaacaaagccagacaaagggaaggttaattaccaatttaatttatagatcaaatattaaatacttgaaccatgaaatataaacacttaggaaatgataatcattcaaataaatggaactctatctatagagtagttttactgggaaaaattaattagatattatataatttgaattgaatcacaaatgctaaattatagaaatccatgtggtggtaaaaccaatccaaaaagataaaccaatatatgtgaaaacatataaataccaaaatcccaaatatagggaattataaaaatctaggatatatattaaatattggacaatattaaattttgggaaaattcacatttgagcacttaatagggtcacccaaatgcttaggagtaaatacaaattaaaataaagattaggtggatagaaataaataaaatattatcgcgaccatatttggatcaattaaatttaagtacgatggaataagaattaatcctaattaaaactcaaataaattatataaaaataaaatatgagtaatattaatctagggtgaattcattagttgagataacacaaatattgagtaaacttcatttatgcaagatttagaaattatagaatcaaatttatatggaaaataaactgaaatcgggataaataggaaaatacactgttcattatggcgtaggtgttcgatgtggtccctagccttccccctcctctcccacctctgcccctagccgccccgagccgcgccatcgccgcctgccgcgcgcgcctcgcaccccgagccgtcgcgccgctgtcccgccgccccgcgcgcccacgcgccccgtcaccgcccatcccgtcaccgcgcgtcgccgcctcgcgccccgagccgccgtgcgccgtcgccatcgtcgcctgc

SEQ ID NO: 59800 - DNA, 1758 bp, Oryza sativa
tatacccataatcattggatttcaatgtacggtgacaaatggtcttgatgcaaagaacttttcatcctctacgtcaacatcaccttttactgtattcgaatctgtgatgaggaatgcgcatgttaacttggttttattagcatttgacctggtacacgaggccaaagccgatggcatgaagcaggccatacatgacatctccaaggataaataatatagaataatgataattttatctgttcagtataccgttgataaaacaaggaacaaataagtctaggagcttcatcggttacccatattctctaataaaccaaaacaatttattagagaatagcaattagtttgcaggcaaaacatttatatatttgttcgtagtgacttaaaagtcaatattaaaaagaaattacattgaaaatattttaaaatcaacttcaaaagcaaatttaaaaatttaaatttttgcttttctttgatttattagtccagcagatggggcttagacaggtaggtctaagttgggctcccaatcgtctaactaatgtagcgtccaacaaggacgagaagaaaacccgcatcagcagcgatcgcaaggcttgcacggctacaccacgagtttttttttttgttagattattaatttgtttattaagaattcactggcgtgctgctttctgaaacttgcctcgtttccttgttgcttgggcgcatagtgcgcacgctgaaaacgagtggaatgcaaatgcctttttttctctttcttttctgtttttgcaggaatgttctccgaaaacagagtgcagtagattgttttgctccgcagttcgtagtataagagcaaatgctggaaaatgtatgtgaattcacataaaaaatatatatttcagtacaaatccgttgtcacaggcttggaacatcgcctgatcgccacatagtggcctggtggtgttcatacataccgccagttttcagttttcttcttaaatagtacaaaatacacatatagagggaaatttcaggagaaaatcagcattcgctttcattggatattcatcttatacataggagtaatacttatctatagaatttatagaatttcacaattcatatcagctctagatcggattatccatgaaaccaagaaacatctaccacacatacattttcttcaagaacaacgagccttacgagtgaatttccccccatccatgcggtgaatgaactatttctctgtaaaataaatccaagaaagatccaatggggctcaaattgtcgccaccatgaggacaacatccaatccaatccaatgcataggtccaatccaccttcagtaacttactgaccaaccaatgcaaattcaagaaagcagataatgacgaagaaattgacttgatattaccatggatcaaaagtccacaagttattagcttcgtccattgatagcatcactcaagaacattaccatgaaaaaaagagagaaatcatggtaatagtagagacgtacatcaagttcaacatactagagagcaatagatacttgggttggggaggggcaccagctgctggggctgccctcgcttcgctgcaaaatcttggtttattttggcgtcggtggtggcgccgccgccgctgccggggcggttacttcttcttgtggagcagggcgacggtgccgtccttcttggcgacgaccaccgaggtggccatgccgaggaacatgccgtgctcgacgacgccggtgatccgtaggaggcggtc

SEQ ID NO: 59801 - DNA, 3773 bp, Oryza sativa
attcctgcagcccggaaaaagcgtttgtcgaccgtcgcctttttttttttttttttttttggcgctagagaacgagcaccggggattcgaaaaggatttgcgctggcgagtgttgactggtctagtatactgtagtacccttttcacgcgtataacgctgtggctgacggtaaattgatggagccacacgttaatctcttttcatgtttcacctaatatctcgtctcaaaatataagtaaataagaagacattttctaatactacaaatctgatcagaaagcatgtccaaattctttttcgaaaaatgctacaggacatgatgatatctcttatgtatcggctaatatccattcggacgggatgatactggtatcggacgatatctcagagatattatcccgcccgaacgggaaactgtcatgtagcattcctcatattttctagttctatgaatctaaatagcataatctgggtttctatatcctaagatagagggagtaaatattatgtccacatgctaatatgcacacgtataacaacaagcacacatctctatactaccttcgtttcaaaatttaacaacctgactcatcctaaaactacgaatttggataaagtgtatgtctagattcgtaattctaggatatatctaatcccattatagattgctatattttgagatggatggaataatatttgccgaaatattggtaaattgaccattttacataagctattttaagaatagattatgccaaaaactaaatttagaaatggattgtgacctcagcatcagcgggttagtgctgaaatcttgtctgatgtggcaatatttgccacatcatcaaatctccatattggcgctgacctttgttcaatatacaaagcagttatggtggcgttagcgcagtggtagacactcttgctcctatccaaaggtcctggagtcaaatgccagctcaatatctgtttatcctaagtactcatttggtaggtcaaatcttttttaaattcattcctttttagcttggaataaataaatttgagaacttattttaagtttgtttaggaaggtcatattttttaaattcatttttatttttaacatatttgagaaaataaattataatattaatcttactgaaatatttagctcaataactatacatttttcaaaaaaaagagatgaaaactgtataatttaattttcaaatccgtcggaacccactactttgaacagttggtgtccaacaaggcgtctcatggtggatgaaaaccggaactgggtagaaaccaagtttggggtaatttgcatgatattgaatgttggacgaggttggatgtctggtttagagttgaagggtgtgttttatgcaaaacaaagaattcaggggtgtaaaatggacttatctcttaaaacaactatgacatggtaaacattatatctattgaactttacatttgcaattctgtatatatggaatgcttgccattattgcaaacataatttcgaatcgaaaaataagctctcgtaaaaatcacagagaagataaagaagaaccgtcatttctcttcgctcatgtgcatgattcatgatgcctgaggccaaacaaagaaagcttgacagaatgatccatgttgcttgaacacagatgtagaccttataacagcgtgattcacgcttgctaagacatctcgagtacacataacctacgttcatgcctttaagatgaatagatgatgcaatatctcacttttttagctaccttttgcttttaagattgaggcgacaaaattttcattaattaattgtgcaactagattgctttcacaatcacaagtcaaaggtcgcaggagacaaaattaaatccaatgaggataaactttataatagtataaataaacattataggccaccactaagtagcttttagatttctctatttttaaatgaattattgttattcctcgtcgtcactttacgaagttggtgccctccatattatcgtcgcccatctgtggtcggctacaatgtagtgagagaaagcaaccatttatgtcctctgatataaatatgcaagtaaatttctcgtatgttatatattgtgcatcaatgttagtatatccacattaaaatgtcagtatatccaaaatacattaaaaacataagaattttataggcttagttaaatttggatttgtttatttttgttgcatatctgaatttatacgaacccaatgatcaagtgaaactcatcaaaccccaaaatactatagaaataaatatttttttgttattagcatatggaattacttattaatgctgaatgataaaaggttcagtcgtttaaccataaagttccagtgttatatgtttgtgccatgttctaggggtgcatgtgtacgtgtgtatgtttatgtggtggtgtggcatggttctgtgactgtgtgcgtctataattgtactctcttcttaaaaataaaaaataaatagatccttgatagtgtgttttattgctctataagatggaggattaatttatgaattgagaaaatcgtcaacactcaaggaccaaagctttgaccagaatattactttgaatatccgtcctgatctgtctgactaaataagcaattgaaaagtgtcgcttctgctggacttcccattttcttgcaagaaatttgttgacaccgcatggatttgaagattagactttgtaattttaagcaccgagcatattcttttgtactgtataccttaatttggtaagaactctctaagactgagtattcaagagtactaggattttgtttagggacggcaacaagaaattggataaagggtttctttttttttttctgttcgagtcgatcagacaaactttgaaggtattcctggccacatttgagtgaatttggagaacttttggggggcgcctaatgcgcgactgaccgcgcgtggggtaggcgcgcggcgccccctagtactactgttactagtactgtacactagtatagtacactagtactactagtatttactactagtaatagtactactacactactattactactatactactactactactaacaaatatatatttttatgtataaaaaaatatacacatatacaaactttgtatacaatatgtataaactttgtatacgatgtgtgcaaatttgtatacgaaatatataaactttgtagacgtacgtattaaaaataataaaaaaaacacatcatgtgtatacgtatacaagtatacaaaccttagatacgaacgtgtatataaagtttctatacacatatacaaactttatatatgacgtatacaaagtttttatatatacgtatacaaactttgtatacatatatataaaaagtttgtatacgtatatgtaaaaaaccgaaaaggaaaaaagggaaagaaaaaaaaaaggaaagaaaaccagaaaggagaaaccgaacaaggaaaaaaaaaggaaaatcgcgcggtcccaccttacgcacgcgctgccgccgcggccctctccgcgcgcgccacgtgcctcgccgcgcgggagggcgcgcgcgcgactagccgcgcattagcaatttcggaacttttgtgctgcaagttcgctttattcccttggctagtacataattttgccaacgcagagagatttgacatgaaacagaatcatatgctccgggaatttaggaaaatccctctggtctccaagcaaagtccatgggtttcaccagaatccaaatcattttaga

SEQ ID NO: 59802 - DNA, 5389 bp, Oryza sativa
aaactataagatgcgatttagcaaaattagtttggcctagaaaaaataggtaaagtgtggcttacagaaatcctaagctgaaactgaaattgaatggcctagcaatgaggcctgcatgtcacatgctcgctggagcagaaatggatgtggccgggcctatggccagatcaggcccataagccaggatgccccatttaattgcctgttgggtgacaattatggaataagttcatccgaggtcccttaactttacaccgaatccgattcgtccttatacctcaaagccagatacaatacgtccctaaactgtcaaaaccagtacaaattaggtccctcggcggtttggaaggcggttttgactgatgtggcgcttacgtggctggtttgactagatcttcgtctcacgtggcattgacgtggcgcttacgtgtcaattctactccggaaaaataataaaaaccgtgggcccacctgtcagttacacaaaaaaataatgtaaaaggtggagcccacgtgggccccatatgtcagcctcactcctcccttttctcttcttcctcatcctcactcctctcttcttccatctcctctctctctctctccttgctagggagcagacgggcaggtggggggcggagcgcacgggcggctccttcgatggccgctgtgtcacgggcgactgcgccagcgcgctgtcctgctccgcctccggcgagctgcccaccacgctgcccgagtacacggctacacgctcggctcccgacccggcaccggcgacgacttcctcgacctgtcgctcatcgacgggttcaacgtgccggtgagcttcgagacgaccaacggcggcggcgccgggtgcagcaaagggcgcgggccgagctgcgccgtggacatcacggcgaggtacgtgcccacccgagctctgtgtcccaggcggctgcgccagtgcgtgcgacaagttcggcggcgacacctactgctgccggggccagttcaaggtctgccctgttggcgttggcagacacggtagctagctggatgaacaaaagaagacttgctacatgcacaaagctaactaaccgatatacttgctccactagcatgcaggacatgcaagtacttgctcatgcaggacttgctacatgcccgccgacaagctactccatgttcttcaaggggctatgcgcctcgacgcctacagctacgccaaggacgaccagaccagcaccttcacctgccccgccggcaccaactaccgcgtcgacttctgcccgccgacgagtggcgtgacggccggcgacgacgatggtgtgcgtggccacggcctcccgcggctgacctgccggatttgtgcaaccgcggcggtggtcctcgtcccgccgcaggccacggcctcccgcggctgagctgccggatttgtgcatccgcggcgatggtcatggtcctcctcctgccgccggccacggcctcccacggtggagaccgccgtgagctgccgaattttcgtggcttcggggtcggtcttcctttcctcccaccgccggccacggtgaagaccgctattgagctgtcggattgtgcagccgcggtgactgtcctcctcccgccgctgttcacggcctcaagaggagcatcctggtggaggcgtacgccgcggcgcacgctgagcagccgccgacagcccgcctcgctcgcctgctccggcgcccacctgcccgtccgctcccgggaagaagagagagaggagagggaaacaaagaggagtgaggatgaggaagaagagcgaagggagagggtaggaagtgaggctgacatgtggggcccacgtgggccctattatttttaaattattttttatgtacctgacatgtgggtctacggtttttattattttttcgaggtagaattgccatgtaagcgccacgtcaatgccacgtggaacgaagacctagtcaagccagccacgtaagcgccacgtcagccaaaaccactttccaaaccgccgagggacctcatttgtaccggttttgatagtttagggaccagttatatctggttttggggtttaagaacgaaaatcggattcggtgtaaagttaaggatcctcagatgaacttattctgacaattattgcaaaatgctacaattgtcacaatgatgaaacaaaagcctactccctatgtgccaaaaaaaattcaaatcctatgaaaccaaacactctccatcgaatttgttcttcttaaaatatagtgctgaaaatctttacccttttcctgttctgaaataaacttatgtggataaacttggaaggtagcccgcgcattcgcgcggaaatgtatcttaggctacgctgacaaatttttaatagtagaatatcaaccgtatggcgccttccacgcattaaaaataatatttcttaacaattttttttcatcgatattgcttagataaattttccatgctatttgttagctttatacaatataatctttaattcatccatatgtgcaattatttgtttcgaaaacatttataacaaattatgtgtaaattgtgattttcctttttttagttgaatgtttagggtctcttttttaacaaaacctaaaaggatattattgccaatgcatatgtttatatgttttatttgtaccaacaagctaattggttcacattgactcattttgttacctgcaatcacgctagagggatgcatgacatagatccaacaacaaaatataactaagcgtagatgatgcatatagtatgtcgctagattgttcaattgtggcaaaaaataattagcaaagtaaaaggaaaaagtataaattacccctggaactatcgcggtcgaccgaattattcctctgaacttgaaatacagatatcgctcaccctgaattttcaataccagacgaattacccccctcaacccattccagagcggttttgtcctatgtagcgtacgcgtggcagctccaataagtattttcttttttaaatggtggggcccacctgtcatcctcatctttctcctcttcccctcttcacctcttcccctctttctctctcactctctctcaggcatgggcacagatcgcgcagcggcaagcgttcggcgcgcacgacgacgggcggtcagcgcaggcgcagtacgaggaggtaggagccctctttttcctcttcccctcttcccccccctctctctctctctcgatcgagtgtcgtcgggtgcgggcacaggttgagcagcgcgagtggtctacgcgcacggcggtgagcaggggcgggcggtggatgacggcacggtacgtggagacgggagcggagaactccgggagggagccggagtggtgggcccctgcctccatcaactcccatcctcctcctccttcatggcgctcgctgtcgtggcgctggcggccaccccggtggtcaccgtcctgaagggcacccccggctgggtgtcctatgtcggggacgggtagcttcaccagtgcgccaagtgggatgctgagggccggcggctgcttgtgtcaaatttcttcgatgtcggcgtgtccaagctctacgccgccgggacagcggggaaggagaaggaggaggagcgggttgtgtctggcatgtatgagctccaacgccaccgggagggtcgcgctggggttcaccatcgacacactgaaggggcgctgctcattgtctatgctgaccggatgccgcggttcgggtactccgcccacaactccggctccctcccggagttcgccgctcccgcctccgtttcctgcgccggcaccgagcgcacgcgccgaacgcttgccgccgcgtgacctgtgcccacgcctgtgagagagggagagagaatgagggggagaggggaagaggagaaagaggaggatgataggtgggccccaccatttaaaaaagaaaatgttgattggacctgccacgtgtacgccatgtaggacaaaactgctctggatcaggctatgtgggggtaattcgtccaatattgaaagttcagggtgaatgatatttggttttatggttcatagggtaattcagtctaccacgacagttcggggagggagggtaatacgtactttttcccaaagtaaaatggccaaaagtcttgctaatgattaatgggtgtttttaaccagcaaagtaaaagcctaaatgctgtcagatgagattttgatacatttttttatatggaatgaaatgatttagacgcacacattaagagaacaaggtcaattaagcgcttattatctgaagtaaaatgggagaatacggttggcacatatatcaataattatttttaggtgtgtatattctgagagctttctttaagtgcggtcagcataaagttgcataaaggtaggcgcgaccaataagggagtgccacctgtcagctgagtaaataatggggttaatttgttcgagggatatgacggtcatttggacactagcgtaaactctatttgttagtttactctagtcgtgattccacaccggaggaacgtacgcagtgttagaatttgccggagaggacaaaggaatccccgaaaagctaagaggcgagtggaaagtttaattacgtgctagtttttatggtttacgcactatatcggccactattgtagatcgcgtttagagaaagaaatagtggtacaaatgatctgatgtagaagatcctagctaaaaccaagcgattatggttacatccgttttacgttggtcttcaaatagaaaatacaaagtacatagccacataagattgatagcactcctctgtatacgctgtgaaaacgaaaaaaaatttatggtgggcccggcccacctaaatttatttagcagttaatcctctcaaccgtgtactgaataacgataggagtaaatcccaatgtcagtccattatgaagcccattttagctgtaactgttttatatagtagtcctttatatttccactattatgagccaaacacagcatcgatatccaaaatagagataaaattgctctcgatgtgctaaaaaatatgtcgaatgttttcttattgctgcaacatttgtcttttggactgtctgatttggctccaagatttttataaagagagggcttatctttgatgatccttctatttgaatttctctctccccttcaataccacgtttttttcacatgcacgagagagaaagggatgccgttctgcttcatagtgtcttcaaagtcagtcactatggcatcctcatctccctcttcctctaattcttcatcctaattgtcgaaacatgaattcggcaataataaaggggtagcgcacgagacctaaaagtggatggatgcggagacaaaggatttagacaggttcaggccctctcga

SEQ ID NO: 59803 - DNA, 1391 bp, Oryza sativa
ttagatcaaccagcagtaaagatgaaggcacccagcaatagcgacagagttttgtagccatggtgacaaaataatcagtcggagacagacgagacagctggtgaagaagatgaaaacgcccattagcggcgacataataagccagccgtgaaggcgagaatatcagtcggtggcgatgaaaacaagccaacgatgacgacgtagaagcgcatcaacgacgatggcaaaatcctccaatcatgaaaatgcaagaaatagtcgacgatgacaaatgcaaccgatggtaatgacgattggcagcaatagagatgatcaaatatgatgacgaagttgcccatcaatagaagtagagtgggctatgttgaagaggcttgacaggatgttgatgaagatgacgatgtcagtgatccagtcaatagtggtgtagcagccgatgataacaatgaaatcctctatcggtagttgcgtagtaggccaaccgtgaaaacgaaataacaagtcggcgatgaaagtcggtgatgacaaaaagcaaccgacggcgaggacgtggtcaccccttagcaacgacggagacatcaaggccgatgaagtagatgtgctggtgatgatgtcagtaacaacaatccatcaaactgttgagaagaaatccatgctcaagtattttcttaatgttggcatttgtgtgacgaagattgatgcaacgcctcttgatttatgaagatggcagtagaacttggtgctatatctgttgcagatgcttcacttagaggaaagtatatgctgttgttcaactcattgaatctgatctgagttgattggttgatgactccaaactcccagacatgtaaacttaatcttgaccggctctgaagcgcagacgaagataataactcccagagttgacttgttgattgattgattgatgcatcttgacaaaaaacttgtcgaattttgagagtcttgtatttgtgtagcccccgaccctttggttagttgggaaacaacttaacatagagtcgagaattgtagcttcttgtcgtcgagtagtcattgcttgagtgaagatgcatgtcgaagatgtccgagtagaaatattgaagattggaacaccacttgttgtaataaaataacacggtgtcatatttggtgacgcatgccgagatgttgaagctcttgtagacgtcatggttggtgaagtagcaaaacttgcgaagtagcggcaatagagtttgccggtgccgaagataataaaaatgaagtcgctccaccatgatgacaaagttgcatagtcatgatgaagtgaacacgagtcgaaggcaacataagcaaaccggtggcgaagacgcatagtcgtgaagatagaaacaccagtcggcgatggctgcaggaat

SEQ ID NO: 59804 - DNA, 721 bp, Oryza sativa
agctatggaattcactataccgggtatccaaaagtactagaagggtatagtgactcaaactggatatctgatgctgatgagataaaagccacaagtggatatgtgttcacacttggaggtggcgctgtttcctagaagtcttgcaagcagaccattttaacgaggtcaacagtggaagcagaacttacagcactagatactgcgacagttgaggccgagtggcttcgtgaactcctgatggatttgccggtggttgaaaaaccagtgccagctatcctaatgaactgtgataatcaaacagtgattattaaagtgaacagttcaaaggacaacataagtcatctaggcatatcaagagaagactgaaatctgtcagaaagcagaaaaactccggagtgatagcattggactatgtccaaacggctagaaatctggcagatcagtttatcaaggggctaccacgtaatgtgatagacagtgcatcgagggaaatgggcttgatacccacctaaggttgcacaatagtggaaacctgtccattgtgatcggagatcccatgaatttggatggcaaaacaaactattgtgtgactgagagaagagacccttgaaaagggcttattttcatgatgtacttcttttctttcctacatggtaggatgactcatgccttaatgtgatccgagtggcttttccaaacagagattttgacctgcagaaca

SEQ ID NO: 59805 - DNA, 4606 bp, Oryza sativa
taattcctgcagcccttcagttgtggtctgatgtagctcatttcctaggtggaagttcaacttaacagtctccaccaaaaccctggtatatcaaataggcacaaccttgagaacatttcttatgagccttgaaatttggtggggattgttagaataattgggctaggcccaatttatcctattaaatctcaaaggcccataataagtgttaaggataataataccacctcaggatttaagcgaggaatatcttaacctaaatagggagttattggaggccccctgttgactggttgaggtgggggtcggaaagccacacgcgcgcgcgcgccgggccgaggccgagggctaggcgtggcgtggcgctacacttttgcaaccatgaacccacgttcccacaactgcctccgcaacggcacgtccacgatcccacgttcccacgactgccgactgcctctctcctgatagataaggaggccgcgagtccgatcagaacgattcgcttgcttctttcccgggtgttagttcctcctcctccgtgcctgtgctgctctcgcttcctcgcttctaatcgcttgcacgcacgagagatcggaaggagcagggcctccggaatcacaccttcgcctgagatctgcaccgggtaggcgggtgatcaggtttttggggagtgcttcccgcacgactgctcgtcctcgcccaccatgtctgcgcctagagccggcgccgctgctgctggaggagatggcggaggtggtgcgccaggagctggagcctgtgccgcgaacaacaacaccaacggaggcaattctgcctcacaatccagtggagggccattctcggggtatatccttctcctgttcctgttcccgttgttagtgctttactgctatgttcctgttcctgatattcatgatgcctctagcatgctactgcgttactgctatgttcttgttcctgatattcataatgcgcatgatgcctttagtatgctactggttatgttacatgttgtcactagatcaccctacactgtttatgccatgattattgtcttaacattttggattaaaatatgccgatttatgaccatatttccaacagccattggggatgatgtgtctggcctcaaaggcgacagatctagcttccaacaaacggagcagcaaggggtttaggccctattggcaatgactacatggggatcttctcggggtgacaataccggtgacgaccatgcatgttgggaagagcccctttggggcatggtagactagcctgtggttgcagtgtagatcgggtgaagaggagcttggcggtccatcttgggttgtgacaagggcctcatggtatgcccctcccagtcgcctacccctactctgttgccgcctctgtcctctttgaccaaatcaccaaacaaatcacatgagggaaatataactaataaatcgtttcaggggaataccacctacaaatcgtgcgaagagaatgtcaccaacaaatcatgcaaagggaggaggatcatggcctctcccacaacacggtcgcgaccatgccttcgacgatgagtagcctcagtcccgccgagacacctgtgccctctgtagggcacttggatcttggctagggcactcacttgaccgacatagcgtgaaatcatcaccaacatggagagtcaagggcactctgcacgtctccatgttgtgtatagccttagtcaccaggaacaataatttgaataaagcactggtggagaaaccatctttggtcggtcggccgaaatccacaatagtcccgattccactaaaaaccgggactaaagatgatctttagtcccagttctagacctgtcagaccttgtcaggcccccgggatctttactcccggttggtgttaccaaccgggactaaagatcctaactttactcccggttggtgttatcaaccgggactaaagatcttgaagatttttagtcccggactaaaattcaacgcttaatatataatccttcttccctatcctctccttcacaaccgcctcgcacttatcctctcagatctcaatcaccctctcctccctctcagatcgatctccctctcctcctccgcctccgccttctccccttcctcctcccatccccggccctctcctccccgtactcccttcccatcggctcagatcgatctccctctcctcctcccctcctcctctcagatcgatctctctcctcctccccctccgcctcctccccttccccacccatcccctgccctctcctccccctcctcccttcccacgcagcaggcggccggctgggccgcgcacgggcccagtggcgagcggcggcaggcggcagccgctgccggcatctttttttttttttcaatttgtgattcactaagatgtataattttatgatttgttgcatgacctgtcacgaccggaattaacccaacgggcgtttcttacgtgcgtgtattattccttgtcccaggaggcaaggtacaccaaaagttgatacatttcagagtttatcaagcggaagcgtaaatagttaatttattacatgggcggcgaaggcccagcacacacaaagacaaacgggaaacagcagaagactagggcgacgaccataggcgcttgacggcaggcacgagccagacaccaaagccttcatcttccaggggctcctcttctgggtttgggaaaaattgagcaagactgagtacaaccaccgtactcaacaagacacacccacaagtgcagaataaatgcaagggagtacaagggggttataatataaagggttagggtttgcagtaaacagcattaaaagacacttaattgctcaaagctattttgtaaacacgattctagagctatacaatattattaatcaaggccgtgaacccacacgaacctgccttaacccaaggcctacgatgattcagaccgaactagcaacccgaccctgggtcccagctcgtcccaagctaacccaggccaaccattccacattttagttgttaagcatgttttaagaattaaaacactaacttgggtacattgctcggcttgcccataaccgagggcgcggctattcgaatagattatactctgatcagaggtgtacatctttacccacaagacacctcttcctcacgtgtaaccacgtgccacataccaccacggtatatggacggaagacgtgacatagcttccaacccatcctagccatagacaagagtaccgacccaaccccacctacagccgggacccccgggacaggtaggcaggactgagccccgagcagcaggacaccggccctgtgccatgacatctcgactaccgggccgcagctcgtgtagccttcatttgtcctagagatgtccatcgacccccgacttcgtccatctccatccgtatcatcatgttcattaactgagtctgttgagccagaacttgagcaagagttgggttcccttcattgttattatttccacttttattggcgcgagtgttcaccatccgttgcagattagagaagatagaaggagaggggttacgctaaagttaagaccttaaccatgttaccactgatctggtgtgtgtagaccattatattgttcaagttgattaagcaagcaacctagtatagttacacactcatcattgaaccacaccaatgacgggaatgcaaccatacctacacacaagcaagcaacaaacgttctaccctactaactattcttcaaggatagtttggcggcataggttctaaggtaggatccaaacttcattccatcttgaccacttggcacttcggttctttctcgatccacttgactgacctccataagtagacctcattaacatcttctagtttcaacaactagttttagaactactcaagttgaaagcaggaggggagaggatgataaaatgatttatagagaattctagagaaggaagaaaggaaaattttcacaaatcatgttttcggaaaatttgtccttaaggtttgaccatttggcttatcctacagtcgagatggctctgataccaacttgtcacgcccggaaattcacaagtaatttccaaacttatttgtgcataaaatcctcgtccaggaatcagccgaggtacacaaactgacaatttaatatacagattcatcaaattaactaaaacgataagtacttacttaagaggcacttagtcctcatcaagaagaaaactgcagcggaaaaataaaatctagcgaagctccggctccactcccacaggcagctcaactgggatataagccaaacgtcttctccttctggatcctttttcttcaactgaggttgattgattattgcaaggtgagcatatgacatactcagcaagccacacagcaaatatgcaagtgcacaaggataccaaaggatggcataatattggctcatttgcaaaagcagcatttagcaaaacatttaagagaagtaaaacagtggagtaattaatcaggaattttaatcaacactgaacagcacacccatgctgcacaggcccaaccatcctgaacaaccatacccggctgtacagatcgggctgcaggaat

SEQ ID NO: 59806 - DNA, 1640 bp, Oryza sativa
cagatctaatctccaaaccaggagctaagcaaattattaccaggtataacatccataattattgtgagaggtgtgagactaatcacgaaaaacattgctcaactcgcccataaccgcgggcacggctattcgaatagttttactctggccagaggtgtaccactgtacccacaagacacagcctcaacatcatgtctaccatgcgtcccgatactggaaagtacccgaatagaggctgtgacaataccctctgcataacacaactcaccacagtgcaccattcctggatcataatcacccccttataaaacaaggcatggactccccagcgacccccgtgggcttatttccgccacttctcagtctggtgctccgcaatgaaccatgttatacaaaaggtaaagccgttgcccacgctggcttgtggttggcacggttaatgtttcacaacagtagctcgcgaaccggtccttaattgccatgagcacgactctcaaaaccatgtgctcacaacccaccattatcaagttttagttggcaagtaattaattaaccaatcacgattgaccatcgtgagctaccattaaaccatcattaaataataatgaatcataagttatcccaacagtgtgctaatgtttctaagcatggctaagcaatcacatctaatatctagctgaaccaatatataaagctcaactagtcaaattataataacccaaggtatcaaggattaaagtaatcaatgcaaacaggccataacaaaggaataggttcacaccacccagtgacattcgaaaataaatgcacagttgaaataaatagagaatttaaatataggatcaacatgctcaaaggattgtgtttaggatctgtgtgacttgccttgcaataatcggtcttcaattaatcttcttgaacactcccgacgcactcgcgaaccttcgcaacgacggaaacgacaagctatcacgcaaaacgaggaaaaagactaataaaaaccaaataaacaatacataaaaagtaaacaaacatgtagatcatatttttagatgaattatgagacttgaacggcctcattctgatttcatatgaatttattatgaattttacaagatttaattccaattaaacctattaaacggagactattccaaattaattaaatcatttacaaatgatttatagctgagacagaagattaaagcaacctccggaaaagattggatcatatttggtagatgacatatattaaaaagaaataatatgccactgaaaagaggagaggatttatattgaccgagtcgactaagatcggatggcttggattgatctggcaagcgggcctcacgagataccgactcaacgagtcaattctacgtgacacgggatcacctaaatgatcaaccgaaaccggcgaacggaaccggcggctctgaactaaaggacgactcaacacggacgaacgaacgaagcacggggaacacctcattcgaacgaacgagcgaacgactcaacaacggctgcggctaatccggtggactagaaacgattcacagaaaagccccggtacgacaaacgatagaccggtaggaatttagggatgcacctacggctagacaacttgactaccgagcaac

SEQ ID NO: 59807 - DNA, 988 bp, Oryza sativa
atcagcttacatcatttgaatccgaactccatagtccatattgcaaatttcgtccatgtctgcgaagcttttttgggcattagacctcattttgctctgttccgccgaatatttttccttaagcctcaaccgaacaaaaacaaaccatgcgtagttggaggggctggatttcaactgagaggcactctgagccaaaagtatttctccatgcctttcaagacttcaaacaaaggatggcacgccaactggttttatattcaaaatcccgagcccgctcttcctgagtactcctgtcttcccccagtataccaagatacatggaactctcttcccatgggagatgaagctgcccaagccttagaactgatggaacgcatgctgaaactcaaagagcaaggcttacagggagagcaaatcactcggcatttcattaagtgccgattagctccaatcaaagaaagatcccgcacagcatttgaatttgacggcaagcacgatccaaaccgtgaagacccagattctctggattttaagatcatgaaggagaggatgtacaagatattctcgaacgctattgtcgtcagctactcacatcaactgccagttgtaccatacaacgcattcaatccgcctccgcaggtatgtatctgaaaatcttcaacccaaggtcaaaacataatttcatcttcatgttgagttagctaactgtggaagcatctcattcaggaatactattgatgaaatctgatcccccaattgctcagcgccgatctcctcgccagcacaccattcagggaagtggagggccgacaatcaggtcagacccacaacctcaaacctccaaaccggctgggcagacaggtcctcgcaagagaaagctggtgcttaatgacgacgagggcgatgacagcaacaaatctggggacaagggaacgcccaacaaactcccaaagcataccatgcccaggaaaaaactggctggccgtca

SEQ ID NO: 59808 - DNA, 837 bp, Oryza sativa
tcctcaatcttcacatgaaaagatcacagcaagttagttgccagaacagatgaaaatgcatccaacaatgtagggattttgagaagaaggcataagaaaataataaccttttgtgcgaattcattttcctctcgcaatctcttgtaagttatttccttttccttcacctgcacgacaacgaattgctcagtaaattcagccaatttggcaggctcctccaaaccagataatagaacaagcttgctttgctgaccatattgtcaaattctgatctttggaccgccctttcatcaacatgtaacttaagtggttgaacttcagtgagaggcttcctctctttctctggaagaggaatgggatccctgcaacaaaattaacagtattaatatgcatcttataagggaaaccaggaactgttgggacaagagaaaccgtaatgtgaaggcttactctttcattatggggtgtgccttcactactctcctctgggcctcttccctctccatcctctctctttcttccattatcctctgttgctccatctcatgcctcaccaaactctctaactgaaagccttctggcctcgtgcatggttttggttcaggcttcggtggtatctgaagagagagaaaatgttaaggctagcagaatatgagatggtcagcaaccaggacatgtaatattcggtatgttactttgcacgtaccactggatagtcagttgtgtagggataaggattagccttcggaatcctggctttctcttcctgtaattgcttttgcagcagttgtgcagctagctgcctctctttctcatgccctctttcctgtaacatgg

SEQ ID NO: 59809 - DNA, 1568 bp, Oryza sativa
gcaacttgggagctaccttgagagagtgtgaatcgtcacggtgcttcctcatggccgacaggctcatctcggtgcttcctgctagacacctcctctccccttgtgaggcagggtccttgtcttcacgttcagtatctaaccacgacggcaaacacaatgtttctcagaaatctcgcgcaacgcaaacacatgtatttgaagtgccatctttaatctcatcccagtattacctgtcttgtcctcccatcatcaagcttctgtctcttgacagcttgattttcttgtgcgatttcattcgcagcagtagcggccttcccagccagcaactcacgagggcatctgaaaaaccaacaattcagacattagtaagaaaataatctccagattaatatatttttttatgagtgagcatgactcttacttgatcacactcctcttgacgctcatcgactgcttcaaagcagatggatgtgcccttgagccagtcaagggtgcaagacctctggaggagttcgttgcctgcaccttcggagtgaaggcttctgtcttcactgtcagcttgggacaggtaggcaccgtagtgacagctttgacgggtggaggcctctgaatcttcggtgtgctagaagcaacatctgctgctaaagccatgcaacattgatatcaaaatccagggatcagagttcttccccactgccattgctcatatataactagcaacttacattttgcattggaagggacaaactcgaaggattttggcgattccttctcatcctcctctgctggtggcgactccaacattgcatcactgcccaaaacaaccaattagtcattcacatgccaaaaccagcaagaaacggaatgaaccaacaaattgaggtcttgaaatgcacctttcttggtgcttatgatcgccgtcagtgacacaattttcactgggatttgcttcatggacctgaagaattcaggatgtgagctgctagaaacccaacactagtacttactgaaactgagaacatagaaaacatgaaaacatcaagaaatcacgtacaagtttgatggagccgtccttattctgttgcacattcctgaacatccaaaagtgaagatgaaaaacacacgagaaatcgattaacttcatcagatcacaacgaatcatcataaacaatttctttagttctccaactcttacccatcagaattctgcgagggattggcggcgcttcctgctgcctcctccactgctacctcctatcatgacgaacgcagaggccaacggacaataagaaggggggagatttacagaaattagggcaaaattggggggttattcccgcagctttctgcttcgtaccttcggaatcggctccgcgtcggtgaagtcgcagaggctctcgatcttgacctccgccctcgactccttgatcctcggagcgaacgctgcaagcaggtaaaagaagaagagccctaatcagcgcaaaaaaagcaaaacacgggagagggggggatgatcgaggcggcggggtggggattggggagcgtacgggaaggggcgtggctggcgg

SEQ ID NO: 59810 - DNA, 1915 bp, Oryza sativa
tgatgtcgccgtctcttgaagactttgcagcgaggactccttcgagctgcaaacaaggaggtatcatgagctacaagctgagcacagaggtaaggtaagcagaggagagcacaggggtaaggtaagcagaggagcgcataagagagaacacaagtgaaactcagacctccctagccgatggagcattctgccaatcagcacctcacaagatccaggtagctctttttcgagatgcatcaaggaatcaaggaatgtatgaacaactggtccgttaaacttgtcaccagtagcctgcagcatgtcatcaatacagtgaagagtttggcatgtctcgagttgtacaaagatcaaactgataaaatgtggtgatgacacaactcattcgagattggattatccaatattaaggttaaggcttcattcgtttcagaatgttggctgaaactttcccccgttcactgtgcgcatgcttctcaaattgctaaatgaagtatatagaagtttctttaaaaaaatcatattaatccatctttcaagtttgaaataattaatgctcaattaatcatgtgctaatggtttatctcgttttacatgcagctgagtagctaagcacaaatgtccttcaaattcaacctaattcttataaaaaaatgttaagagcgtaaataaatgtgttttggggcttataaagaattttcaagaaacaaatgtataatgagtagtgtcaatgtagcaactaatagcaaacacagtagattgaaaagggaatgagttaaatatactgtacctcttttagagaaggaattatcaatgacgagagtgcaggtgaagatacagaaccagaagcttgaggagctgattgtccatcatgtatctggcgtggtttgcgacctttttccatgtcagcattctcactaggataaaaaaaaaagaatctgttaagaagcgttacaagaaatggacagaaaagtttcccgagtacaaaacaaaactaaaaccaaacttgcaataccttggggcatcatgactgtttactgccgaaattctgggttcatgtgattccttttcatgtttgctgataacatgtctttcacgagcattaccctttttaaacgcagcctggagagcagcctttgcctgcattaattacccaaatatatgaataagtatcaaccattaaccacaattgagaaatttgccaacaacattcatgtgcatcacctctgcaaggttagttgcactgtcctccagtgaagcatttggtgacttttcttggattcccagtctcgaccttgaagatcgtggagtttctggttcttcaatttgattccgaacgactgtcccactgatagacgtgtcttcatacgaggagaatctactgggaggctaataaataaaatgtatcagacgctgttgcttactccctctgattccaatattaagtagttttagacttatgccaagaatgaaggaaacagcacagatgacattattgcccttcatttacattacattgaaaagactagtcatttatttgtgagtaccatttatttagcatctgtaaataaagaatctatataactgaaaatgttagtagttgtggtgtccattcccacaccacccctaccactaacatctgagcactacaacaagtcctcccccatttcactattagcttcccctatgtttcaaaatcctacttgttcaataagaaaaataatagtagtacttggactaaataagtgcttataattgatttaataagctagaaactcaatttgttttctgttgcaacgcatggcctctaggctagtaaaagatgaaaaagtgcttaaaagtaccaaaacaacatacatttagaaaagaattgtgaaggctaaaatgacctatattcagaatcggattgggaggacat

SEQ ID NO: 59811 - DNA, 1578 bp, Oryza sativa
tcctgcagcccgttctttttttcaatcaatcttgagtatatatctcattctcaaacatatatctttttctattatttgatttgaattatcaaatactgtcgtagcgttagcacatgcatattactttgctatgtaattaacaatgtataaaaattctatattgttccttttttcaatcaaacttgagtatatatctcattctcaaacatatatcgttttctattatttgatttgaattatctaatactgccgtagcgttagcacgtgtatgttactagtatttaaggatggagaaagtacttgttctttgtaacatatggattttgtagtatttttgtgttttaaagagatctatttaaacggaaacaatttgcattgagcattcgacgcgagacgaaacatcgggcggttacgccatgtgggcccgcatcgatttaaccataacggctcgaccttttcatcttccttaatcctaattattctcacattttctcttaccttcctagctattgaacaggttcatcgggatattggcagaaccgccgttgctggtggccacgactgcaacaatggtagcagggtgttcttgatctggtcagacgctagcttccggaaccacacgattgagcacgtattgtcgagggtggcagcgatgaggttgacatttgtaggggaggtggagctggcaccagaacctaccttaggagcactcctcccgatgctagtggctgtcgcccttccactcctcctgtagtcgccaagctgtcgcatccggttctacgccaccttcatccgcatgtcctccttcctcatctccggcaagtcaacaataatctcgtgcgcgtagctagccagcatcgtcggtctgattcgagagttacattttgttttgattcaatgttctgatttgagtgtttcattttgttttgttttcatgtttcatccattgatttcttggtgttgcaattagtatggatgttgtatctgactgaaatactttcgatcaagcgatgaaatattttttcctacttgatgaaacatctgaaatttttttgttgaaacatttttttatcgagtagtgcaacatgtgaaacaatatagtgcaataccatgtgatgttctatgaaatatcctacatccaattttgtagtgcttcccttatttatactccctccatctatttttgatagtcaaaatctgaaaaatttatttttgatagacatatttcaatccaacaacctatcatcttaatgactttctcggattttatgcgtgactctccattcttccacacaatattggctatatgggcatcgagaaatgtaaatattaatgaatcgcttgtttacgataaatgactagtagcatgtttaaatagatgataaatagaattacttatcattgatttatgtaccaagatgaaatacaatactatcaaggagctctccttttaatcgaaaagaaaaaaaagtacctctcttttgctgggccccacgaagaaagggagccgcttctgctgcccatggcaatggtggcagtggcgaccggccggcctgcaacccggcggcgtcgtctcgt

SEQ ID NO: 59812 - DNA, 3328 bp, Oryza sativa
agccgtgttgggcgaggccatgtctctgtgacatggtctcgcccttcttattatgaagcttataatgatgtcagcttaattcgtcagatctaaaatgatggcgcaatggatgaaatcaggaaaaacggaacatgtatggtggagaagaaagatggacctaccaccacggatatcaccacatgaatgcaaaggagaaagaagatggatctaccaccacaggacactccacaacctccttctccctcctcacccctacccccaccagccggaaaagaagaaatataaaatgtcaggggctgacatgaaaaattaaagctaccacttaaaaccaatttgtcttatattcgctcaataaaaaaaccatttctaggatggagggtttttttaagacggagggagtagaagagatatggtactaacctacgtggtgcacactctcttctcagtggccactcataggagtagcctcgtgtagttatctctagagagatggtatagattgctcccatagtgcaaatatagcttgagcccgtaggaagatttttatttcactttgtttatttgcccatcaatccttccgttgattttatttacaaccttatccaaaattgtgctgttagcacccttaattagacaaaataatttataaaaacctctaaaataaaaataatccacattcttactagtcattcttgctcccctattccatcatctttgccacccttagctcgttgtcgctggctcctcctcctcgcctccatcatatctacgcaccactattccaccaccacttccccgtctacggtcgttgtcgctttcccctcttattaggcagcaaattggatggacaagcttcgtggctgcacaaatcaggagtagcttgggtcgacaagctctgccgagttgggggcaactacagctaatggatttggcgttgttatagattggaagcggttcggactaacaagctccacggttggagggagttacgaccaatgggatttagcaatggcttgggccaacgagctccacaaaggcttcaaccaatgatgtctttggcggcaagggccagtggcggagccagaatttttccaaacctagggctcaattagttgaatgtatataattttgcctttatcttctagcttttgaagttttaaaatggaatttcaatgaatacttaggatcaggagtagggctgcagccctagctgccctactcttgtctccgcccctagcaagggccaaatatagttcttagatcttggcattgcctatccacaaatcgccaccgtctttagcaagcttgggcacttgcgacgtcgtcctattggtggcgacaacctcttctcaacagcgacggtggtcggcggaccttcctaatcatacgcgcattagaggtggcttattcctagtcttcattctcttctcctccatccctgtttgggacataacttttttcatggaaaacttgtggcttgtagaaggtactcttgttgtcttacactttgtaaacaaacttcaaagtcagtccctttcctccatgatggcatccgagcctacgtgactagtggggttactcctcttaggccatacacagtaaacgctctaatgtttacaggatgtctggatctaagattttctaatttttagagatttttttattttactttcaatgaaaacatcacctatctcatcgtgcacttattcgttcatcggctacatccaaaatttaggttttaaaaattaattttaagctaatttgaagctttctattacaatctatttttcatacttgacttttgaaccgtgaatactatcgatatggaagtcttacatataaattatttttattgcttagttggttttacaaaccgtagtctaatcaaggactcctttaatcaatcatcatagccgaattcgttggttgaagttttcccaatcatccttttatggaacgtttctttttctaaaaattctcacggctccaaatagaggtccttgtagaaaattgaatgtgttgttgcttgttgttggactgggatactatagagctcaaagcctcaaattacgtgcaagacgacgttcctactcctgcgtaccgctcgatgttggttggctacgatgttttcgtgtcaaacttggtggcgcacgcacacgcacaccaagtcgatctctcgctgtcctacatggtcgatcggatactgtcagttttctttgtcctctacgcacaccaaagtcgcctactgctgcgcgatatacactgccaacgtactgcaaggatcccgaatcgatattggagtatgggctagcagtggcactgtggcagctcccggccggccctagctagcgtatgtcatgtcgttttacaccatataatttccaacttgtcactaagtgccggtgcatgacgtacctgcatgcagaggtttatactgtactgtactattcctatgtacggatccctccgttaaaaaaaaacgaatataggacataactgtattatttagaccttcaactccaaatttcaactttcgtttttcgttagcacactttttaaactgtgagcgatatatattttttaaaaaaatttcatatagaaattgtttaaaaaatcaaataaatttattttttaaggttacaataattaatacttagttaatcatgtgtaagtggtctttcttgttttgcgtgccctgaaaaattttcttcctacccatgaaacgaacgaagcgtaataattaatacattcgccttaaaatatcaactctagttcactacgaccatgaaaccccttttacactattaacctttttctttttttttgcaccattggattatagagatatgtggacatttttcaaataactgcccgcctatcaatgtattttttgttttggtccaagggctcgtcttcttctctctgtatcatccctctctcgtactgagtaaaaaaaacactcatgcttaacattaggagtatttacttatcacttaaaaccaagagtaaagtttttactctctgtggattttgagagtaaaaatattacaaacggttgaatcttatcagtaaaaaattacaagtggttaaatttaagagtaaacaaaatacacacaaaaaaaagtaggtggcagcaaggtcacaacttggcgaggtagctgcggcacatccacctgcgatctcgatgacagtttggtaagggataaccgagaagacaatgctaagaggtactgtggcgttgcgactagcgggagctagcttccgagccaacttcggtggcacatgggcgagtggatctggggtggcgcagcatgcgacgaggagcagg

SEQ ID NO: 59813 - DNA, 25648 bp, Oryza sativa
gtattactttgcatcattcgaccatttcggtaaactgatatagactatcaactgtcctattacctctgttttatagtgttttatatcataacccgctttgatttttttcatagtcaaacttttaagtttgacttagtttattaaaaaaaatatagcaatactttcaatgcaaaacaagcatattatcaaaatatatttaatattgtgtttaataagatatacatgttactaaattttttatatgaacttgtttaaatttaaataaattcaattagaaaaaaattcaactgcgacaatatgaaacagagggagttcagttactgcgagtcgataaccaaacttttttggtctcggtcatttccacgttttggtgtgagtttgtttggttcggttatttttagccagccctatatgtatagagcaatagttaatgaacgcatgcacgtattaaccacaccctaacgttggaaatattaataggcctgatgcatgacaaattgcatgcgcgcacctgtgccggggtcgttgcacgtattctcgcgatcattgccgaacagtcaatgtcaattatatcgacggccggtttgcgttagcgtttgcttaactagtgtactagtactaaatagaagtattgtactactagtatatgtagcgtattcatcgtgaggtaatgatatgatgtcgatcgatcgatcgatctaccgacctgttgatcatcagtgactgaatttaaagctgctttttatttgaaaaccattgctatcttccgtccaagttacgtatgtaccactgccgagcagttattttgcttttttctaagaaaaataaaaaataatatgattttttattgttttagtttctagtaatatgtaaaatttactagctcttctacgtcgtattaaagttgctagtcacattcatagtatgaaaaatttctaaccatgccgatatcattttcaataataaaaagtactttttagaaatttacaaaaatcaccctataagctagaagtttgatgtttcaccccataaattattttgttgaaaatgcctgcccacctacttagttttgtatcaaaaccacctcggtatgcacgtgtttaaccgaatcaacgtgttttcataaattatgagccatcaatgtagtctttaccaaatttaaatacttcaataatatggtcttaatactttttagagattccataaataatgagagcttaaatattgttgaaccaagtttcacaatatgcataaaatagtttaataaaacatgaagaataaatataatgtaagtacttggataagattgactcgattagcatggcgtgtggtatatctatatcaacgataataggctgatttggttaagtacgtgcgtcctaacatgacttttacaccaaaacttagtaaaggtgtgtatttgtaacaaaaataacctatgggatggtttctgtaattttctcttttttctcgaccgttttcatccctgaatacacaggatacagacgatgaaaaatattacgccatcgatcgatctcctgtgtcctgtccaattaaaactcgcgggaagccggcccaatacaggtgttggcagactggcagcacgcggcccacgtacccttcatgcatgaacggaacggctcccacttttgagtcttttgatccaccacaattttaagcacaatatgtcaataaggttgggttcttccttccattttcccaacccacctctctccattttcacgcgcacacttttcaaactggtaaaaagtatgatttatacaaaaactttgtatatgaaagttgttttaaaaaacatattaatctattttttttaaaaaaatagttaatacttaattaatcatgaaataatacgagcttcgttttacgtgccgggggagaaggagttcccaacccatcctcccgaacacaaccttagtccacttgctatacctcaacctcgattctacgtcgagtttgtttgaagccccttatctccaatagtagaaatcttcacccataaactatacaaaaccatgtaatttgggtccgataatagtatagatgtttgattttgctgacataatatcgtagtcagtaaagtaaacataaaaataatatgtgcgtcccacatgtaactgaagtgagaagaaaaaatattgggcccgcgtgtcagtcccatcacctttcttctcttttcttcctaagcctgggagatggggggcagccgataggacgggagggggggaggaggaggtcggtgagcctgggagggagggagagagaccaaatgcgccggcgggagagcggggagaggaggtcggcgagtctagaagggagagaagaggataggaggttggtgagccttggagggagagagggagagaggcggtcggccgcaccggcgggaaagtggggagagacggtcggcgagcctaggagggagggggaggcaccggtggaagagggaggggagaggtgaccggtgaggttgggagtcatgttcgctgccgctaccgcaatgacgacaaagacgatgacgcacacgcgccactgcgcgcgcccaccgttccaccaccagccccgtgcacgaaggcagcgccgctcagctccagcccgtgcgccatcattgccaaggagacgaaaaccacggagcgcagctcctttccgttaagccactgcatgacgcggtcggcctccatgcccacgctaacattgccacctccccctcccccaggctcgccagctgcctctccccccctctcccactcgctgcatccccctctatcctaggcttgggaagaaaagaggaaagatgatgcggttgatacgcgtgccccacatattttcttctcatttcactaacatgtggacctcacatattatttttattttgctgactaggatgccatgttagcgaaacctagcaaggctagcatccatactactataggaatgagatctaaattgcacggttttatatagtttaaggttgaagatttttggtataggagataagagatgtcaaataaactaacgtaaagttgagggacggcaaatggacttttttccattttaagcaccgccggtagggttggtaggtaggaagatccggcgccatgtacagacgtcgccgtcggtcggtatcgttttctatcttcgacgtacacgttgatgttactaatacgtagtactggtccacatggcagttagacacttaaacttggcgcctggatctggacatgccgacgtagatcggtcatcacacgttcaaaccccaccctgagttttttaaaatgaaaggtagtccctcggtttcacaatgtgactttctagcattgcccatatacatataatgaatctaaacatatatatatatatatatatatatatatatatatatatatatatatatatatatatatatatatatatatgtctagatttattaacatctaaataaatataagcaatactagaaagttttacattgtgaaatagagaaagtaacagacagtgcctacttacttcctccatcatagaaaaaaataatttctgcatatgtttagatacatatatagtcagaagatgattttcttttcttacgaagggtgcatctcacagtgcaacctgtttttatatatatttgttgattggtgagagacaatttcaactccgtacttggtaccttaataggtgtagcggcctattgaaattaagtacacgtatggttttctttatttatgattgttagttggtgtgcaacgtcactatatctgtatcttaagtttgtatgcgcatgatatatatgttcatctaatgaccatcccttttatcaatatccatcgtttatcacgctatatttcatgtctagctttaaaaatgatcttattttcatgggctggcaagtttcaaatttgatccaaaatattctttgatttgctaaccatttttttcaaaaaaaaaatcaaatttctgaactttcaatccatacgtaggtttgtggtttggctttttttttttgattcaaggttccataaccattgccaagagtgccacattatattttgatcttttggccggggtcggaagaggggctttaggtgtgggatatatagaatagatctccatgttcggagggaggtggctaaccaatagcacatgagcatgcttggaagcaagcggtgcagggggatgaggtcggtaacacgtacaacaagaactcaagtggctgggaggtgttggcgtcttggcgagatgtggtgctaagtgttaacaatagtggaggcttagtggatgggaatatcttagctaaagctgcacaaaacatctggtttgaagtggggggataattagtagggaagagggaattgagtgagtgagagagagagagaggaggtggctagtgaagcatgtggatgttatcaaggcaggggttgtgtctagaggaggaagggtgacgtcatcgtgttgcaactttggataaacggaggaaagccattgacagagacagctcccaggcaggtcggacaacctcccaagctccaccgctgccatcttctttgcggattgtctttcgacattaaaaaatcacagagaaacattgttagccgtttggatttaacaacggtattggttccgcccctaaagaggacgagtacggtgagggatttttttttccttaaaaaatgaagtacaggtagacactctcatttatttttcttgaccgaaaagtttctccaatatgaatttggatttccctccgacagtagcttctagatcctaacctcgtttggatgggccaaaatcctgacgaggccacgtctatcagtgatgatttccatcggtttttctgaaatgtacagctgcaccgaaatctcggccaaacggaaaacgggagttttcaactttgtgctgaattttgtcaattgcattgtcggttatcgaattgaaactactccgaataaattctgacaattggttagaatggtttgtcaattgcgtttgttcaatatctgcgctaatcgccaaatctcccccaaaatcttacaaagcaggggtcgacgaggcggaaacgagaacgacccggacactcacaacgggcaggagtgggtctcataataagttcatatttcatgtatccgtttaacctaaaaataagttaatttttaacaattattgtattattccatgcttccaaacgtataagacttattccattcttttgtttttttaaaaaatctaagtccaatttatagttactatgtgttaaattaagttgttgattagaacccaaaagccattgagggcggctagggaatgtatcccgtctgaacgggatacttgagattgacatcaatgctgacgtcattatacgtacgcggtaccacgtatgatacctacactactacgaaaacgatttttccgtgtggtccaaaagggttttcgcgtgcggatctcccgcccatctgcattgaagtgtcagcaaaaatccgattttttcgtgcgcacgcgaaaatctaattttcacgtgcgggtggcttatgtcgcaaaaaaaaaaaaaccaaaccctaacccaagccgccgccctcctcgtggtcgccgtcgtcggcggtggcgttgccgccttctgccgctaccggccgccgcggccggctcccagcagcgtcgctgccgcccaccgccgaatctgggcgggagaggggcgccgccgcccactgctggtcccggccacagccagggttttaaatttcaaaatacgattttatgccagtggggggcgaaattaccgaaatttcggaaatttctagccgaaattatttgaaaatttgactgaatttgaataaaatttgaccaaattcacaaaaacttgcaaaaaaccaaaaatttcgggcgagatttgagtatgccggtgggggtgaaaattaccaaaatttttgaaatttctaaccgaaatttcaaaccctggccgcagcccacaagcgaggccgtgctaccgtcgcccgtgagagacgagagagagatagaagaaatgaggataacgatgagtaggtggagaggataagatagaaatttttgaagtggttgagaggggaaaaatacctgaggagggtatttcgcgtgcggtgctcttaagatgcccgcatgcgaaaatttattttcgtgtggtccgcttgcaaaaataggtttattttttgcgtgtggactcttaaaaggcccgcatgtgaaaaccgatttttgtgtgtggtcctcttaagggtccgcacgcaaaaatgggaggacaatttttctagatgcggtcagttatggaccatatggaatctaacgaggggctcgtacaggaaaatcgttttttagcagtgcaattagttccaagacatgatatttgtgtaacaggtcagataccctataggtatcatgtcaaggtacaaaaacatgatacttaagtaacaggttagataccctataggtattacgtcaatgctgatgtcactgtatacgtatacggtaccatatatgatacctattggtatcgaacatgatacatgagtatcaagtatgatactttatgagtaccaagtatgatacctgcatgtaccagccatggtacctgggtaccaagttggtacctgtaggtaccaagtccgatacttatatataccagacttggtacctgggtaccaggtccaatacatataggtaccaaagtattatgatactactaaagtatcatagcacactaagaaccaaaaatcatatcttaccaagacagagctcaattaaaccaacaaagaaaattgattccgggaaaaaaagtcatcatagtggtagaaacacccatagaacatgtagaacaccccaagatcaaacctcaaacccaagccaacgcaaaagctcgggggtcacgagccaagatctaaatatatggatccgcaccacaagaggccttgtcctcgatgatggtgacctcatcgacgatggccacctcctgaaacgtggtgagtagctctgtcttcgtcttgtgcttgggtacctaccccacgataagcttcacgatctcctcctctacttcgcccacacctccagcgacagcagcggcgacaatggtggcggcagcttcctccactcccgacgtgccatcctgaacggccagccgtcatcgtcgcctctttgctggtggtagtcagagagagggagagagagagagagtgaaggggaagagataaaggagaggataagactgaatatgtggttggcgagcgagaggatatttacagtagtagttatcccgtacactgtcccatagtttttctgaaaggcatttgattacttattggttgcatgttcattagtttttctttaggaaactacggcgggtttgaacaccagcctgaactttattcatatggtaaataaactttacaaaggggggaggtacagagggacggggagaagaaactatcattagttttatcacattgtgaatgaattaattacttattagtcttggtgccaaaagaaataggtcttagatgctgacggagcgtggggctcctcaccgggagaccgcgcaggcccctctttgccggttcggccgggggcgctaagtgaggttcttcgccctcgatcgatctggagaatgttcgcgagagagcaagtgcacgagacacgggcgatgtagacaggttcgggccgctgagaagcgtaataccctactcctgtgttctggtggatctgtgtgtgaaggatttacagagagccggagagccagagagttcaggctccagaacccctctcgcctccttttttttctttttttttttccttctcctttttggtgggcaaggtcctccttttatatctcaaggggatactacatgcaccacttctacctacttttcttttgggtggggacctaccctatcttgaccaaaacttggcttgcaccttcgcctggaagttaaatcacaacttgtccttgagtgaggctcagcgccgtcactcgcctgacaccggggatctccctgttactccctcattaatgggcggagatttgccatggctgctttccaaatgaccatccgacgagatgggtcatacctacctccactccaccggaggcagatgcatcgtgggagcacggttgtctgccgatgacgcgaccggcgtcagaccagtcacagaccggtcattcttgtccaccacgtgtcagtttagcatgctacacgtctgcccttcttcatacaatgacttccttgcaatggttgcgatgaagcctggaatgtatctggccggggctgacgtgccaactccaggagttcccacgccggctccggctagggacgagtgcctggaggctctcatcattccgacgggacggggcgaggcgtgtgtcaggccgcctgttgccacctaacccgcgatctgaccggtctgtgaccggtcacacactgtgacctgtcacggaccgaacgagtgtgctgcgctgcattaaatgcggcgtggggcgctcgtccaacccgcaataaacgcggttaggtgagcgccgctgtgctcacctaacccacacacgtggcgccaaacccatagggggtcggggcgccccagctctcggggccgaaacgggagcggcccgacccctcgggaagacagagggaggggcggccacatcaccctcgggcccgacccccccgagggggtcaggccacgtgggtgactgcagctgccccaaacctctagtcaagatacccccggtcccatgtcactgacagtagcccccggcgttacgccagggcgatcgcccccccccccccgagggaagcgctcgggcatgacgccactccttagacctggtgacaggtggggccggtctccacaggcggcagaaacccagcggtcgcaaatcgcgcacatcgtcaaggaaaaaaccgaccgataataatgagcggcttccttcaagaccactacattacttaagtagcgcgcgaaccgggacgagccggttcgtttcgtctggagatgtgatgacggtgcatcggtcggcgagcgtagttaacgcgcgcacgatatgtcccatctcaactgccacggccgcacatccgcctcgtgcgccgcaaacgggcgagcgggattagtggaggcgtgggcgcgaaagacgagggggcgaggtagtgggcgcggggatcgaggagccgggcatagcgttggcaagggtactaagacatcaaggaagggatttgtttccttcctctcgtcactcttccctttgcctttgccacttgtgctctgactctccgtttccggcgccctacccttgccatactcgctcgctctcaagctcctcctccgccggcgtcatggcacggggctccgcaccgctcgagggtagcgtgctgccgccttcccgcatcgtgagcgagaggcaggccgggctgccgcgccgattcatgccggaatctgccaccggccgggaggtggtcgcgctgggcgagggacgcccggcgccgcattacccggggcggtccgtcttcttcctctctttcgcaatggcagggctggtcccgccattctcttctttcttcatggatgttctggagctttatgatctccagatggcgcacctcacccccaacgcggtaatgacgttggccatcttcgcgcacctatgcgagatgttcatcggggtgcgcccatctctccggctgttccggtggttcttcaccgtacagccggtgtcgccaccgtcggtagtcggtggctgctacttccagccgcgggggccggtgctgaaccgctacattccctgcgtccttcgcaagaagtaggacgactggaagagcgactggttctacacccctctcgccgacgaagcgcgcctccgacttccgagccagcccccggcgcaggcctccagctggcgggcgccggtagatctgggagatggctacgacgccgttcttgaccgcctggcgggtctgcgatcccaggggctcacgggggccatggtgttcggcgactaccttcgtcgccggatcgcgccactccagcggcgcgcccggggcgcctgggagtacaccgggtccgaggactacatgaggacccaccaggggggcagatgggactgggcccctgaggatttcaagatggtggtccaacgggtgctgaatctcagctccgtggaggcatccctcatcccccaaggtgtcctctccctctgcagcgatccagagcgcgccaacatcctgaccatcatgcaagcggtcggggcgtcaggggagcgggctcctcgaggccacgatggcgcgggcgggagccgcaggggggaacaatctaccccgggagggggtcgtgcttctgggccccgtgatgggggcccggggggcagccgccctgccgacgcccgggggaagaggaaacaggaggataccccctccccatctcctccccgagggggcggggcggtgcgtgccagcagcaggcgcccggagggtgctgtgccgacgtcgcagcccgagggggagcgaaaaaagaagcggctccgcaagatgggggggaccgaaccatgccggggaaacctcatctcccccccaaggtggtcgtttagccgacctcctcgcaggttcgtccccgcgcccactgcggccgtattcattctcccaaggtgagttttcacttacccgttttctttttgtcttctggtttttcttccgctttcagcgagattccgtcgcgcccccctcgccattccaagtccggccagtctgaggccgaggagacagcgaccgcggaggcccggaggcgggaagctgtccggcgagaagccgcggaccgcctccgggaagctgaggaggctgcccaggaagccgtccgggttcgccaggctgaggaggccgctcaggaggaggccagactccgccgggccgggaagtcagcccgggaggcagaggcgacacgcgcacgccaggcggcctgccaagcccccgacccgactccgcccgaggcaacgacgacttccgaggccacccacgacgaggccgcgggcgcgccgctcggacccgacccttcgggcgacgttcgggacgagccagcctcgggggacgcccctgagtccggcacgtcgattggcgggccgagccgcacagcgcccacaccaaggcagctctcccctctgccttccaccgccccactgaacacagagcccctcctgcaggccctggccgccgcgaacacgacggtgctggacgggttaggtgcccagatggaggtcctgcaagcagagcgggcggaactcgacgcggcgtgggcgcgcgtcgaagaggggcggcgctcggtggaggccatggtggaggcgggccgcaaggcataccgccggcacgcctcagagctcgaggcccgtcggtgggagctggcggagatcgccagggaggtggaggaggagcgggagactgccctcatcgccaccgccgtgctcaacgaggcgcgggacgatctccgccttcaatacgggagccgggtggcggagctagagaagaaactcgacgccgcccggggagtccttgacgccgccactgcacgggaacggcgggcgacggagaacgaggcggcgtcccggcggcgcgaagtggcccttgaggctcgcgccacggcgctggaagagcgcgcccgcgcgagggagagggacctggcggaccgcgagaccgccatcgctatccgggaggcaacgctggcggcgcacgaggccgcctgcgccgaagaggagtccgcactccgcctccgcgaggacgcgctcaccgagcgggagcgatctctcgaggaggcagaggccgcggcgcagcggctggcggacagcctgtccctccgcgaggcagcgcgggaggagcaggcgcgccgtaatctggaaggcgcccgcgccgagagggccgcactggatcagcgggccgctgagctcgaggcgcgggcgaaggagctggacgcgagggcgcgcagcggcggggcggccgcgggcgacggcgatctagccgcccgcctcacagctgccgaacacaccatcgccgatctgcagggcgcgctggactcgtccgccggggaggtcgaggccctccgcttggcgggcgaggtagggcccggcatgcttcgggacgccgtctcccgtctagaccgcgccgggcggcaagcgggcctctggggcgagcggaccgcgaagtacgccgccaaccagggggggcctcgcccagcgcctctcagagatggccgggactctccagcggctccccgaggagctcgaggagacgatcaagtcatcctcgagagacctcgcccggggggtagtggagcttgtactggcaagctaccaggccagggacccggacttctccccgtgggcagcactggacgagttccctcccggaaccgaggacgacgcgcgcgcgtaggtccgggacgccgccgaccacatcgtccacagcttcgagggtacggcccctcggctcgcgttcgccctcgactccgacgaggagggcggcgacggtggtgtggacgacagcgaccacgaggccggcgacccgggagcctcgaagtgagcccccaggcccccgccaatcttaaatagtttttcctttcttcttccgaggccttcgggcccccttcttgtataaactaatttaatctgcaatcaaataaagaagaaatttctgtgtcaattttatttgttgtgtgtatgagacgaggatggtctgtgccgcggtccttctgtgtcttggcttgaacaagggctcgtgcccaggtcccagcttcaaacggcgggggtcggggctagtgcctggggagatgcacgtgtcgagactagccaggccgggagcgtggtgactgagggttatggggacccgattgtgggcctttgccgattcccccccggagttcaccactccccggggcacggctcggttctgggccccgtttggcgatttccgccggcccgggccaccgagggcagggtcgagcacgagcgtgctaattcaagccaaaactcttcaaaaggaaacaatggcacagacacagtccttaggaaatcgaaaaagcttttattgaaatacggaagagaaaaaagataagtatatgcatatgtggtagcccccggccaaccctgcacgcccgaggggggtgcggggttggcccgagcccgagacctgacacccgacccccactaggggtagaaacgacgaaggtgttcgatgttccacgggttaggcagctctgtgccgtcgcccgtggccagccgaacggagcccggccgggggacgccgatcactcgatacggaccctcccacattggtgagagcttactcagtccagcacgcgtttggacgcggcgtaggacgaggtcgtctacgcagagtgatcgggcccggacgtgacgctgatggtagcgccgcaggctctgctggtagcgcgcggctcgaagggccgcgcgccgccttcgttcttccaagtagtcgaggtcatctctgcaaagctgatcttgatcagcctcgcagtacatggtggcccgaggggacctcagggtgagctcggatgggagaaccgcctccgcgccgtagacgaggaagaaaggcgtttccccggttgctcggcttggcgtggttcggtttgcccagagcaccgctagcagctcctcgatccacgagtcgccgtgcttcttgaggaatttgaaggtcttggttttgaggcccttgaggatttctgcgttggcgcgctccacttggccattgcttctggggtgggtgggagaggcgaagcagagcttaatgcccatgtcttcgcagtagccaccgaagagctcactagtgaactgggtgccgttatccgtaatgatacggttaggcaccccaaaccgagcagtgatacccctgatgaatttaagtgcggagtgcttattgatcttgatgaccggataagcctcgggccacttagtgaacttgtcgatagcgacatacagatactcgaacccgcccggggcccgtctaaacggacccaggatatcgagcccccagacagcaaacggccatgaaagaggtatggtctgcagggcctaggccggctgatgggtttgcttggcgtggatctggcacgccctgcaccgccggaccaggtcgaccgcatcgttgcgagccgtcggccaatagaaaccctgacgaaaggccttgccaaccaaggtgcgtgaggcagagtgggctccgcactcgccttcatggatatcggcaagaagctcgatgccttgttcccgaggaatgcacttcaggatgactccgttagccgcgtgccgatagagggtcccttccaccagcacgtagtgcttggagatgcgctggacgcgttcactcccttcgcggtcctcgggtagagtcttatctgcgaggtacgcctggatctcagcgatccaagcaatcaatctaagggagctgggagcgctcccctcgggtcccgaggcctggactccgacgggcctcgggggccgttcaggcgcgtctgtctcccctagggggtcgggtcgcgccgacggctgggcaagcctttcttcaaaggcgcccggtggggtctgggctcgcgaggaagcgagccttgagagttcgtcggcgaccgcgttatcccgtctgggcacgtgccgaagctctatcccgtcaaaatggcgctccatacgccgcacctggcgcacgtaagcatccatctgcgggtcagagcactggtactccttggagacctggttaacgaccaactgagagtcgcctaacaccaggaggtggcggatccccagtccagccaccactctgagtcccgcaaggagtccctcgtactctgccatattgttggttgcccgaaagtcgaggcggaccaggtatttgaggacatctccgctcggcgaggtcaacgtgacccccgcaccggcgccctgaagagacagggagccgtcgaactgcatcacccaataggcggtgtgaggcagctgcgaagggcccgagctggcctcggggatggagacgggctcgggagccggtgtccactctgccacaaagtcagcgagggcctggctcttgatcgcgtggcgtggttcaaagtgcaaatcgaactcagagagttcgattgcccatttcaccacccgtccagtaccctctcggttatgcaagatttggccgagggggtaggacgtaaccaccgtgacccgatgcgcctggaaataatggcgcagcgtaaagcatcttctgggcctgagggtattgggtcttggcgtcccggagggcctcactaacaaagtagacgggccgctgcaccttttgtcggggccgatcctcttcgccaggggccgcatctccagggcgcttttcgtccgagaggccgcgcggggcgcactcggcttctgtgtcgacgacctcggggtcggaaggcgacaggcgcggccttcccgcagtggccccggggccatcctgggggtcgggggctcctggcaccgtcggacaagcgggcagagggccagctccggtcgtcgggggcctcgggccgccgttcggctcgggggcctctcctccctgctctctcccgggtcgagtcgatacagggtgctctttgtccgagaggccgcgcggggcgcactcggcttctgtgccgacgacctcggggtcagagggcgacaggcgcggccttcccgcagtggccttggggccatcctggggtcgggggcgcctggcaccgtcggacaagcgggcagagggccagttccggtcgttgggggcctcgggccaccgttcggctcgggggcctctcctccctgctctctcccgggtcgagtcgacacagggtggggatgcgcggagcgagggtcgtcctcgtcgcgctccacgaccaacgctgcgctgaccacctgcggagttgccgccaggtagagtagcaacggctcatctggctccgggacgaccaggactgggggagaactgaggtacgccttcaactgagtgagggcccattcagcctcctccgtccagataaacggcccagagcgtttgaggagcttaaataggggtagcgccttctctcccagcctcgatatgaaccgacttagggcggccatacagccagtgacgcattgcacatccctaagcttgctgggggggcgcatccgctctatagctcatatcttctcggggttggcctcaatgcctcgggcagagatcaagaacccgagaagcttgcccgcaggcacgccgaacacgcacttgtcggggttcagctttatgcgggcggtgcggagactttcgaaagtttccgctagatctgagagtaaggtctcctggttgcgtgttttcacaaccaagtcatcaacataggcctcaacattacgtcctatttggctacccaaagaaattcgagtagtacgttgaaaagtaggacctgcattgtttaacccgaaaggcattgtcgtataacaataagttcctatgggggtaatgaatgcagttttttcctcatcctccctagccatgtgaatctgatgataaccagagtatgcatctagaaaacacaaaaggtcgcaccccgcggtggagtcgacaatctgatctatgcgtggcagggggtaagggtccttaggacatgccttgttaaggtcggtgtagtcgatgcacatccgaagcttgccgttcgccttgggaacgacgaccgggttcgccagccactccggatggatgacctctcggatgaatccggtctccagaagtcgcgccacctcctcgcggatgaaggcttgacgttccggggcctgccgccgcactttctgccggaccggccttgcgcccggccgtacggcgagacggtgctcaatcacctccctggggaccccgggcatgtccgccggtctccaggcgaagacgtcggcgtttgcccgcaggaaggagacgagcgcgtcttcctatttgtcgtccagaagaccaccgattcgtgtggtcttggacgggccgtcgcccagggcaacctgcttgatcgggacctcgtcgcacgtgatcatccgctgcctcggggcggctgggacggaggtgctgagcctctcgtcaccacccgcgggcttggatgccgcggcgaggtggtccgcgcgctgctccatgcaagcaagcgcgactttgaggtcgccatggacggtgatggggccaccggggcccggcatcttcatctggagataggcgtagtgtaccgccaccatgaacttcaccaacgcgggcctccccaggaccgcgttgtagggcagactgaggtccgccacatcgaagttcacccgctccgtgcggaagttggcggaaccaccgaaggtgaccgggaggtcgatatggcctagcggccaagtgtgccccggcgtcacaccgatgatcggctgggacggccggagcaccatccccggggccttgatggcgtcaaaggcagcgggggaaaggatgttgagggctgcacccccgtcaatgaggacacgccccaacttcacattgcaaacggtgggggaaaccaccatcgcgatctgtcctccccgggcaacgcacggtgggtggtcggtttggtcgaaggtgagggcaacctccgaccaccgcgcccgccgcgtcgcctcatgggtaggggccacggccagaagctctcgcttcatggccttgaggctccggcgagaagcgtgagcacgcgctcccccatcaacggtggcgacagtggcctcaggctcctggaaccctaggtcatcgtcgccatcgttgatgtcctcggcgggggccttctgcttggcctcacctcgccggttgccggcgggagccgccggggtattgccctcacggcgctcctgcctcctctcctcctcccacttcctcgtccgctcagccaaacttttgaccgcgcggcagtccgcgaggtcgtggagggaggtgttgtgcacggtgcaccacttgccggtcgggcgctccctgctaggagcgccggcctccttctttttgtcgctcgcaggcctcccctttcgggtggcccgcaaagcgccctcgacggcgaggacgtgaccctcgtcgtcggaatgggccgacctcttcttcctcctcctgtcccgtcgccctgaccgagcggcggatccgggggcggccgaagctgccacaccggaaccggaggagttccaggtccaggcctcctccttgcgagccacacggtccgcgagctgaaaaagctccgcggtggtctggggctccttggaggcgatcttctcgagcatgcggttgtggcgcacgccccccctgaacgcgtagatcaccgcgtgtgcagggatgcacggtatggtgttgcggacttgacaaaaccgctgaatgtacgagcgaagagactcatcgtcccctcgctgtaccgcgtgcaagtccgcttcttcacttgggcgcggatatgtgccttggaagttcatggtgaactgctggcacaaatcctcccaagagtggaccgacgcgggtggcaagttcattaacccaccccgcgcctgtcctttcagggccatggggaagaaattcgccatgaccctgtcctcacccccgggcggcctgatcccaatcgtgttgatctggaaaaactccgcggggttgacgcttccgtcctatttttcggtgatggtgggccggaacttgggggccaacggacgttccgaaggctcgccacaaaggctcgacagccggcaccgccaaccggggacacggggggctggcccccgtgcccggaccgaagtggcgctccggacgaggaagcgccctccgatgcgtgggcagcacggcgatcattgcgccggcgcttgatattgaagcgggcatctggccccctacgcacatcttcttgggttagaggcgttgacgagggaatggcggacgaacggcgggtaacggccgccgctcgcggcgccctccgcctcgacgacacggagccagcagtagcaacgccagtggccttagtggcggaggaccgccagccggcgcgtaggcgctgctgcgccgtcatgaccaaattggccacgtcatctagccaacgtcgggttggagtctctggatcagggatgacgggcgggtgacgcaggagcgcgcccgcagcctggagcgcgccctggggcgtgctgccatcaccgtagacgaggagacgacgctccccgtctcgccgtccttctccatcgcccgcgtgcggcgaagtcgcggatctttcgacctcctcgagcgcctcctcccgcccaagacttcggcgagagagggacagtggagtacgagctcgacggcgcgggttctgctccccgtcttcaccgctagcgctcggagagagattgtgcgccactgcccgttcggccattgggctgagcgggagaagcttggcgcacacgaaagaggacgagggcttagaaaaacacacgcaccccctacctggcgcgccagatgacggagcgtggggctcctcactgggagaccgcgcaggcccccctttgccggttcggccgggggcgctaagtgaggttcttcgccctcgatcgatctggagaatgttcgcgagagagcaagtgcacgagacacgggcgatgtagacaggttcgggccgctgagaagcgtaataccctactcctgtgttctggtggatctgtgtgtgaaggatttacagagagccggagagccagagagttcaggctccagaacccctctcgcctccttttttttctttttttccctttctttggtgggcaaggtcctccttttatatctcaagggatactacatgcaccacttctacctacctttcttctgggtggggacctaccctctcttgaccaaaacttggcttgcaccttcgcctggaagctaaatcacaacttgtccttgagtgaggctcagcgccgtctctcgcctgacaccggggatctccctgttactccctcattaatgggcggagatttgccatggctgctttccaaatgaccatccgacgagatgggtcatacctacctccactccaccggaggcagatgcatcgtgggagcacggttgtctgccgatgacgcgaccggcgtcagaccagtcacagaccggtcattcttgtccaccacgtgtcagttcggcatgctacatgtctgcccttcttcatacaatgacttccttgcaatggttgcgatgaagcctggaatgtatctggccggggctgacatgccaactctaggagttcccacgccggctccggctagggacgagtgcctggaggctctcatcattccgacgggacggggcgaggcgtgtgtcaggccgcctgttgccacctaacccgcgatctgaccggtctgtgaccggtcacacactgtgacctgtcacggaccgaacgagtgtgctgcgctgcattaaatgcggcgtggggcgctcgtccaacccgcaataaacgcggttaggtgagcgccgctgtgctcacctaacccacacacgtggcgccaaacccacagggggtcggggcgccccagccctcggggccgaaacgggagcggcccgacccctcgggaagacagagggaggggcggccacatcaccctcgggcctgacccccccgagggggtcaggccacgtgggtgactgcagctgccccaaacctctagtcaagatacccccggtcccatgtcaccgacagatgcgaaagggcctttagcctaatggttacaagaaccacagtggtacctgaggtcctgggttcgactccccataggagcgaattttccaggatttaatggcgtttgtgctttcagtggtaggcgacgtacccgtcgacagcgaggcgcctgtggtgacttcgtcaatctctccagaatttgccgacccagtcttcaaagatgctcataggggtagggtggccagcgaggcgcctgtgggggtagggtttgcatgcttgagttcatagggtacgtcgccagaatttgccgacccagtcttcaaagatgctcataggggtagggtggccagcgaggcgcctgtgggggtagggtttgcatgcttgagttcatagggtacgtcgccagcgaggcgcctgtggtgacttcgtcaatctctccagaatttgccgacccagtcttcgaagatgctcataagggtagggtttatgtgcgtgtgttcataggggtgagtgcgcgtgcgttgtgagtgtttgcgttgtactgtgtaatttaaaaaaaataggtcttagatttttggatgaaaggagtataaaagtagagaataaatatattgaagtataaaatggaaaaaaactatattgagatttgataaaatggaaatattctattatctttttatgctgcattaatatgtgtcatgtgtgatattgaataacgaacttactttaatacggaggagtattttccttgaaccgggatgatgaaatcattgaaaacgcggaggcaagaggacgtgcaacacgtgggatagcgcgacgtcggcgatctgttctaccttctggaaaacaagtctgcaaaaattaatttctgcctgaggcagtgaggctcgcttgtcagtcacccgtatacgtggaaaataaattttctctcgctttctcacgcgggtcgcgaggaactctctctctctctctgtgcacaccccgggaggaggaaccgagggaggaggacaagtcagagcaaggggcctcgacggcggcgaagccctccaactcacaggtgagagaccccccccccctcgcctcctcctcttctctccggcgacagcgacggcgacgagcgagtccgtgtagatctccgaccccgtagatgggttttgggaggggggcggtttaatcggcggcgcggatggcgtccgtaggactccgtaccccgccggggaatccttaggttgctcctctattgctcttggagtacacgccgcagccgctacccgtaggccttagcccgatggacatccatggttgggtggatctgaatggagacggattggagagagcaagtaggatggaagtaatggttatgatgtctagctgatgaatgtactttatacttaactaatagtactaatacgcaaagctttgttacaggaagcccaagattttccccgtgaattcctgtttttctccattgctccatccaaattttgcctattcctatgtctttcaaatgtttgcgataggaggcctcaaagggtctagttagtgtataacactgtactctgtaccgcgaagtagtgcctcaggctgtgaaatgtctgctgttcctttgtcaattgtttggatccctttgaacaatggaaagcatacaatttcatggaaggttattaattacatttccctgttaggttagttctgttatgccatttcagtactaatgaacaaacagtttgtccacctacgtgtcatcacttggcttgatagtgctgcaaccaacctatgtttatgtagaaagctgaggcatatttggattccctttcgtaggtaaaatctgctaaatattgtttgagttttctggcatctgcttcagatatccattcgctaatgactaaccaatttaatcacagaaacaccaatatctaaagcagcttaaattttgaaaccaaaatgcaagttgtattaaaacaattccatgaaaatcttgattatggtaatacatactttctaatttcattttgttggtgcttttgttttcttatgtgacctgtttttgaccaattgttatctcaaaatatatgttccttcctcctggtgaataaacttgaatatatctatctacaggcgccatgtcgatgtcactgttccctgggatggatcttacgaaaatggatgctcctactcttaccctccttggagcagcctgctgtgtaatgctatcgatgcattttacagtacagttggtgtcgcagcatcttttctattggaagaatcccaaggagcagaaggctatacttattatcgttctcatggctcccttatatgctataaattcctttgttggtcttctggatatcaagggaagcaaaacatttttcactttcttggatgctgtcaaagaatgctacgaggcactggtgagtccttttgggttaaccacattcttgcacccaatgccgagattcactaaccttctctctttgtttcactatgtaggctattgctaagtttatggcactgatgtacagctatttgaatatatctattagtaagaacatagttcctgatgagatcaaagggagggtgcttcatcattccttccctgtttcccttttcctggtaatttccttaatccttataccctggttcattctttaaatgtttctataatctgtaattgtgcttgagtgctaagatttctgtttgattacttctttacatagcactatatattgattaagttttgatgacttagcataataccttccctgcttctcttttactggcattttatcccataccatggatcacctttttgtacttgaattttaaatttctatttcattgcttccttatatagcattgtctggaatctggattaattaaaccaagttaccatgagtggtaattttttactataatatcaacagcagttttaatctttctcttaccaaattctcctgtatgcatgcacctaaagcgatgacttaaaaatctgtctgtgcatcacccttctacatttttattattcacctacaatctgcagaggtagtctggagctttcagcacttcagtttatagtttgagtcgatgttgtcctaagaacctgtctttgcatctcccattctcccttttagtgttctatcttgcacatataatctgcacaatctggaagtttattctttcagaacttaagtttgtagttagactttagggtgttctattacttgcttcacttctatctgttcaaaaaggaattaatatatttgtgatgttttgctatggcagccccgcaatgttcgattggagcataaaacactgaagcttctgaagtactggacctggcaatttgttgttgttaggcccatatgcgccattctaatgattactcttcagcttcttggtctgtaccccagttgggtcagctggacattcacaatcatactgaacttttcagtctccatggcattatacgcactggttattttctaccacttgtttgcaaaagagctggcacctcacaaacctcttcaaattcttatgcatcaaagggattgtcttcttctctttctggcaggtaatcatctacttttccctaaggaaaatgaaagccgtttcacaatttttcttactttatggaccaaataggttacttcttctttcttgtgtctgaatgctttagtgtaactttggacactgtttaccatgatgcatgcctctgaatgtttgattgaacaatgtcgatgtagactttctaaatagtttagatcttctgttccttctgggtactgtggtgtgacttctcatgacagtcatgaagcttcatcatatttattctctggatttaattaggtgctcaagatacaccaccatttctttttgtacatatagttgtttatgaattgaaaaagttcttctgcaacttaagtttttatgaactgccatttgaaagtcagatttggcaatttcctttatgaagtctcataactgaacaactatatgccttgttaccaattagtttagaaagaaagccagagtaagttgttaaacaagtttaattagataataaatcaatactgagcttttcacctttaaggcacaataagctgctatatcatactgcttaaagagacatccccagtggacaccttctaaagagtgcatgtcttcctcttttgccatgggaaacataaaagctggaatagtttttaatagttctcccattctgttcatttcttatgattagtgattgagctactgaatgccattgtctttttgcagggttttgcattagaggttttagctgccgtagggatcattcagtcccaccatttctggttggacgtggagcacatccaggaggcaatccagaatgtcttggtgatcatcgaaatggtcttcttctccgttctccaacaatatgcttaccatgttgctccatacagcggggctgacagggcgaaattcgagaagaagaatgaatgatccaggttttgtactgagtaataccctccagctcttgtatgatatctctctgtatggactcacagtgttataaactcagtgtttcttatgcacacgagtagagtaagtacattacaatcattagaaagctagaggtgcctgaataagtggtggtttcgtcttgttgtacacaatatcatgttggactgaggatcttgtgtgtacactgtacagtgcagcctttggaggcaagcaaatccattatcaataaagctatgtacttccaagtgccaatcaccaactgtagagccctccctcccccaatgcattgagttggtgaatgcaaagttattcagggacatcattaatccggttaactggatacaccgtatttaactagcccggtctggactctggaccacggtcgtgggtaacttttattgttctttcaatttttccatgtgaaaatttgtccagatagtcattgcctctggtcacaagttgtgactctgcaacaatg

SEQ ID NO: 59814 - DNA, 5272 bp, Oryza sativa
  unsure (1)..(5272): unsure at all n locations
gggttgctgttagcacgtccggtttatctctatccacatcaataatgccgactttagtttcaatccttttctttaaacttctaactttttcatcacatcaaaattggaggtttggttgaaattgaaacgatatgacaaaaaagttagagtttgtgtgtgtaggaaagttttgatgtgattaaaaagttgaaagtttgtgtgtagggccgagtttagatccacagaaacttccaacttttcccatcacatcgttctaatttcaaccaaacttctaattttagcgggctagtatgtttcattatcggcgggaacatggatagccgagaaagcttatcagccagcaacggtggtggcgctttgtttaaggctacggtaagaaatgcattctgatgtaacgattccatttttctttacaaagtataaaaatgacaccttcagttttgaagcgaatgttcacatatcgtacgtcataaactataggtccttgaggtggttgtgattatcatcaaatacatgtcaatggaaaaaaaaacaaccatgttctagtcagtgccaaaagaaattgatctttcggtcgtagagctaaattcgatgaggattagaaaatgcaataattaaacatgagcgcatagttgccaaatgtttttgaggaaaaaaagggtatttttccttgctgttgatcgagaatcttgcctaatgtcatggcaagtccatcttttgcggttgcgcgctgtttagatcccaccccaaaattttacaccctatcacattgaacgtttaaacaccggcataaagtattaaataaaggataaaaaaataactaataaatattacacacattgcgactaatttgcgagacggatcttttaagcctaattgcttcatgatttgacaatatggtgctacagtaaacatttgctaatgatggattaattaggcttaataaattcgtctcgcggtttattgatggattttgtaattagttttttattagtgtctaaacaacccatgcgacaccctatagaatatccgatgtgacacaccaaattttacacccctaggccgagtttagttccaaattttttcttcaaacttccaacttttctatcacatcaaaacttttctacacacacaaacttccaacttttccgtcacttcgttccatttcaaccaaactttcaattttggcatgaactaacacacctctagctttaaaaaccccagagttctttgccagcagtacagtgtatgcgcgaaaaggaaaactgcgagctgccataccacatcaccctgggcctagtcatgcatcctgactggagaccttgtcactttgtcagcactcagcacgcacccagccggccgaccaccttcatcaagctaggacccaacccaaaagagttgcaggctgcgaggctcatcactgagcctgactgcctgagaaggctgagagagagaggcccgtgtttgatgagggtgtgtttagttcacgtcaaaattaaaagtttggttgaaattgaaacgatgtgacgaaaaagttgaaagtttgtgtatgtagaaaagttttaatgtgatgtaaaagttggaagtttgaggaaaaagtttggaatcaaaatgctgacttgccgtatcgtcgaccaatttagtaggagtagtagccaagtaagttagctatagatatatattattatgcattaatacctagtcctagcaattccttcacaaactttgatagagcatgtagcattatagcttgctatatatttatggtccgcttctcttctctctttttttttcgctaagtcatctacaaatataagtggtaacacctatagactattatattattttatcatacaagctttgatgagtgttgaaaacattttttttctctctcattaggcagcacagctatagtgtagtactgcactgctatttccatcccaaaatataatctcttaggtctttattccccccgagggagggattggaggggatggatgtgaaattaactccctctaaatcccgcacaatctttttataggtgagattaaccgaataaggccttatggagttttcttatagagattaaatagagagatgaagttgaatgagtaatgattgtgattggttgagatgagtttgtaggtggataaattaaataagagatagttgagataattaaggtagtagattgagagaagttaatttgattgctaaaagtagctatattttaaaactaagaaagcagagtattctttgcattccgcaatataagggattatgctatcttttgtaaaaataaaaaacaaagtagcaaaatgacaagtcatggtataaaagatggtagttgaggaaataaagtactgtatcatcacaattttttttatttttgaacaaactagaagagaaaaattcaaaagaggtaatactatctttttagccttttctcgtagcaagaaaagagctagattttgtacattttagctttttaaaaacttattttacaaatatacctaacaaaaaaaacttatttcaagaatggacttttttttggcgttgaggttcaatgtctcagcaccaattgcttttaacgccaacaccttcatctcctgtgatatctaagtggctcatgtaaagggattgactagccttgaggacatatttataaaatatttttttaaaaatggttaaaatataattttttatagataggtttttggcgtcatcttcttttgatctgaggacctatttgtaagaaaataatatatacattttaacaattttcataaatttattttagtaggtcctcagtgcgagcctcttaattgacgtcgacctctctatatctcggctgctaaagggatgagggcattaccaatatcattgacgacgccaagacgttggactttggtgcctggatcgctgacgacgagaaaagggtctttgaataaataaattttttaaaagagccaaaatgtgaaaaatacaaaagaaaagagggagggagaactcatcagcggagaagtgatccgatgagtgacagaccggcccagcgggataagtggccgagtgactgacagtccggcccttgcctggcctgcatcggatcacgtgcaggcctaaataccaaggggccaagtgctactccttcgtacagcacaattgtacacactgctaggctgagcctctctactgctgatctacatcacttcgtcggatacgctcataacttcacacatttcaatgataattccaagtctaagtccagttcagcctccgaagacagcactaacttcaaacggacctaacgccttcatgccaactctgatttgggtgatcttggacttcgtggaaagcttaactcgctatctttcaaacgcatccggtctcatatctaaattcatctcgagtcaacgggaatcgccaaaaaaagacagtgttgttgctgaaaccgaacttgggccttgggccttgtaatagactaggcccatctcggaagtgtctccctccacctccacgaattagcacttaaccctagctttattttcctctataaatagctttgtacatcctcaaaaatatttgggttttgtttaattgaattttaccaagtgtcattcaccttgtctctagtcctcgcttgattagtcagtgactattgattcagagcccccaatagttgatgtgttgatttgccgggtcaattagatctaccacttcaatcgcaactattcctttgtacttaatcacctattcgcaatatttagattgcatcttatcttgttcttgcagtgttctctcatttgcattgcagggatcatcaaccgtgcgtcacggttggtacaacatcgtttgtggtgtagcgattgcacggcgtcctggacttgttctggttggtatccacgtcgcaaatgttgcactcgatcaaagcgagagttatcccctcaccagaagatcgggccacgagagagagcgtcatcatttggtatcagagctgggcccttgttaaggggttgggaatgatgaggacatccttccgcgaccgtgtgagcctctgaataatcccaccttgcttagcttgggaggaggaagccaccttaaaagggagagccacccttcctctattggactagtcttttagggagattgggcctatccgctagtgggtgtgcttaagaactgttggggtccgggcaaccttaatttgttgggcctcggccaaccccaattgggccggattgttatcaactccctacagctacagcgatcccctcttgctttcccatatgttctacgtgtacactctctatcgaaaaataagtttattttggtattgtgtataaaacactgctatgaaatccatttttcgtggcggccattttgggttttcgctagcagaatttggagccaccacaaagcaaaggccagtgaaaatcaagatcttcgtagcggttatcgaccactagtgataatttatttttgctggtggtcatcttaagctagctgtcaccaaaaatctattttcactggcggttagattaagacggtcaccagcgaaaaaacatttttgctggtgggttacaccgtgccagccgccagtgaaaatgctagccaagttttttaaaaaaatgacggacagagcaacaccgctctgtccgcctccatcaatgctcgaccattcaaaaatttcacagaaatttacccaagcattcaaaaatccacagaaatttacatcaacaatttacagtaaaaaatttccattcacccaagcattcaagcaacacagaaataaacaaaaatttgaagtcgtcgtcgcggcgctgcccccgtcgacgtcggcggcggcgggggatccggtcacttcagtcgtcgcggcggtggatccggcctcccccgttgttgggacggtcggatccggccggtcccgagcccgcggcggtggtggcgacgacagctggcggcggtggaggagggagtgggagaaggagagcccgctgctggacccgtcgcccgcgccgtcgtcgtcaccgagacacaccgccgagcccgccggatccgtcgcccaggccatcatcatcgccgagcccgctgatgcgtcgcccaccaccggatccaaccccaccctgtcgcccgcggcccgagactccccgcgccgctggatccaccgccgcgnnnnnnnnnnnnnnnnnnnnnnnnnnnnnnnnnnnnnnnnnnnnnnnnnnnnnnnnnnnnnnnnnnnnnnnnnnnnnnnnnnnnnnnngggctgcaggaa

SEQ ID NO: 59815 - DNA, 705 bp, Oryza sativa
tgtcttctggtttttcttccgctttcagcgagattccgtcgcgtccccctcgccattccatgtccggccggtctgaggccgaggagacagcgaccgcggaggcccggaggcgggaagctgtccggcgagaagccgcggaccgcctccgagaagctgaggaggctgcccaggaagccgtccgggttcgccaggctgaggaggccactcgggaggaggccagactccaccgggccgggaagtcagcccgggaggcagaggcgacgcgcgcacgccaggcggcctgccaagcccccgacccgactccgcccgaggcgacgacgacttccgaggccacccacgacgaggccgcgggcgcaccgctcggacccgacccttcgggcgacgttcgggacgagccagcctcgggggacgcccctgagtccggcacgtcaattggcgggccgagccgcacagcgcccacaccgaggcggctctcccctctgccttccgccgctccactgaacacagagcccctcctgcaggccctggctgccgcgaacacgacggtgctggacgggttaggtgcctagatggaggtcctgcaagcagagcgggcggagctcgacgcggcgtgggcgcgcgtcgaagaggggcagcgctcggtggaggccatggtggaggcgggccgcaaggcataccgccggcacgcctcatagctcgaggccc

SEQ ID NO: 59816 - DNA, 843 bp, Oryza sativa
ggacaagaatgaccgatctgtgactggtctgacgccggtcgcgtcatcggcagacaaccgtgctcccacaatgcatctgcctccggtggagtggaggtaggtatgacccatctcgtcggatggtcatttggaaagcagccatggcaaatctccgcccattaatgagggggtaacagggagatccccggtgtcaggcgagagacggcgctgagcctcactcaaggacaagttgtgatttagcttccaggcgaaggtgtaagccaagttttggtcaagagagggtaggtccccacccagaagaaaagtaggtagaagtggtgcatgtagtatccccttgagatataaaaggaggaccttgcccaccaaagagaaagaaaaaaaaaaagaaaaaaaaggaggcgagaggggttctggagcctgaactctctggctctccggctctctgtaaatccttcacacacagatccaccagaacacaggagtagggtattacgcttctcagcggcccgaacctgtctacatcgcccgtgtctcgtgcacttgctctctcgcgaacattctccagatcgatcgagggcgaagaacctcacttagcgcccccggccgaaccggcaaagaggggcctgcgcggtctcccggtgaggagccccacgctccgtcagcatctaagacctatttcttttggcaccaagactaataagtaattaattcattcacaatgtgataaaactaatgatagtttcttctccccgtccctctgtacctcccccctttgtaaagtttatttaccatatgaataaagttcaggctggtgttcaaacccgccgtagtttcctaaagaaa

SEQ ID NO: 59817 - DNA, 960 bp, Oryza sativa
ctccatatccaccagcaacactaaacttttcaattcatctagcgccaatactaatgcaatggcaaatgaaggttttcaccagcccttacatcttaatctgccagattttaattaaacaacagcaaatatctaattgttctgtgtatctgaggattcccaagttagtgaaaaagaaacttcactttaataaaaaaacagtgagtgacgatttatcttgatagaaaataataggtgtaagtatgcaacgtaacaatagtggatggggtgagaaagaggtgtcgcctcttgaaccacatcctactaaaccatccaacttaaagatgggataaatcaagaataatagtataatactagtaacatgatataattgacctttatcaacatcttttgagttctgacaataaagataaatgtgcaattggtattaacgcattagttctcaaagaaaggagtgttagccctgtccagaaagcctcctttataatggttttgtggatattgtacttggtggacaggacagtagatatgagggttatctggcccgtagttattaggaacacagcacaaccaaccaggggttgaggtactgcagtcagaatataccagtatgataacaaatgctgtacaaagggaggtatagactgtagagttcttcaggacatgttacatggccccaatttttccagtttgatgacccaaatgctttattaaatgctcatattcaatataaatccagcaataaaaagggaaagggagagaaataatcaagacctttaatgtcacggtgaatctttccttctgaatgaagatattcaactgcatgtaacaagtccctcagaatgcatgcaatagacaattcatctagaggagggccagtttggagctacagatgaaaacagaaatcataccaacttcaaatttgaaccaattgaatgattcttgaaactgaaatgatttatt

SEQ ID NO: 59818 - DNA, 5870 bp, Oryza sativa
atgtgaacttggttcaatttttcttaaacaacacatataggtatagtgcgatatttcgtatggatagaacaataaaaaaaaacaagaatatagccttgggaggctatagcctggaaaaaaaagcaaccacaccacacgtttacaatcagacctcactactaatgaactactaatgagatagtaatacgacatctcgaaggaaaaggattttccaaacgacgacttcaagaacgatatgacactgagatgccagcaccgtccatcctaggttcaagacatttcacctagaggaatccatcagggggcaaaagagatcactcaataataccctaaggggaaaagtggcgctcgcaagcgtcgcccttgctagctcaaagaggctaggctttcgtttgtaatcttcctacttcctcgtgtcaagatcttctgctggtcatagagaacaccaccaaccacactccttcgacgcacagccaccgcgccagcatcttgctgccagctgaccatcgagtagaagctcgacatccgacgcattccaaatccatccacacggttaggttggagggcgagagagaagaatggatctcctctccgcactaatctgccaacgaggccttcttatggtgtcgtcgccacaagtggccttcttatggtaggcctgcaacgcacacctcacaaggccaccgttgtcactgccacagctagactgctagcgtcatctcaggccgcccatccgcatcactgccaccttgtcctcgccatgcaccgtaccagctcagtttgccgctggccggcctgcgcctcgctgctctcaacctcgtcaccgtgccggcctcctgccaccgccggacacaccaagcttgcgtcacataggcctttgctgaccgcaacttgcttctatcaccaaccacgtcacgtcagcctcctactccaaatgtcgtcatctacccgctgtagtcggctgcgtcaacctccttctcatccgctgtcgtagcttccagcaccggcctcttacttccgccaacgcaggcgtcccgcggccgccgacgctgtcggcccgtagccgtcggccttctactgaggccaacgccgcccatgccgaagttcactgacaactttctgagctttgcgtcgcttcccccgcgctgtagatggagtgtcgtcgggttttggccccgccaccgccatccttgcttgtcgcccggttttccaggcggtgagctccggtggcagcgaggcatcgaggagggtgggagggacggcggcgggtggctaggatttcgcttcgagccgtctgtgcgtgggtgacacggatatctttcttccttttcggttcaaattctgatccccacaattaagaacacatgggaccatgagttcactttgtgtagaagtttcaatggggttcacgaatttatccatggccccctccatccatctaatgcgttaaaaaaacacacatttacggatatatgtaattgttatatacatgtgtgttgatgtgcttgtgtgcatttcccattaatataaagtagctcgaccagaatctcgtgtgtggcaactaaccttagctatcatggttgtcgtcggcttctatttaagatgtaaattgcccatcatttcattaacttatggacgttttgcatgcctagccaccttttaacaagaataaaaatgggttctatgggaaaagtaggcgtagtggtgaccggtgaagctgtcacccatgggtgcaagacttaatactatctgcgctttcaatagtaatttaacgagggcaaatatttgctactgacactacttagaaaaaaatgttttttcaggcggtcaaaacatgttctcacaggcggcaaaaccttccgtctatatctaaacgacggtaaaaatccctaatttttacaggtggaccaaagcactgcctgcaaaaatcagggggcagtttgaatctttccagacgctgtaggtgctacagtagtcccgcttgtaaaaataccctcagcgccaaaattttttttctcgccaaccccacccgtccctaggggcttcaaatcacaaaccacaaattctcacaaatctcatccaagaaacaaaatccaatcacaaacattgtaaagttgcaacacaaaatcattggattcaaatctacagcaagttaacaacaatgaacatgtaaacttaaaaaaaaacacgtcgtcatcgccggcgaactcctttgttgtatggggtggccgccgccgcctccctcccccctccagctggatctgggaagggagggttggggcagcgagctagcgacgcagccggcgctagtcatcgtcattgcgcagtagggccgtcgtcgtcctgcggtagtactcgtgtgtatagtagtgggatagaaaaaaacaggttatgaggaaatgctttgtgcacgtgtttttctctttaaaatccacaatataatagtatgtactcgatgtactaaatagttaatacatatagaagtttctgatacatgagaactaggagcgagaactagttcttatatgagaaatcatccaagaaagtaattttaagagggcttaaaaaagaaaataatgaaacaacccatgatcaattataaattaagttctacaactcaaattcgaaaagactggtaaggcaacgagcaaacaatgaaaaagttcgacggttcatatttttttttactatagatttgtatcattagatttatcatcgaactgctttaataacatacggtcataaatattcgacactttagtcaaacttttgaaatttcaaaataagtttttacaaaatctaataaatttatgaataatattttaggtaaatttaagtgcacttttttactttctaaaattaagtgtttcaaatggttgagatttaaaaatttgcccaataatcaaatataatgactagagatcggagagagagagtataaagatctgaaataagaaaatagacaatagtagctatagatatatatatgtctagattcatttagatcaatatgaatgtaggaaatgctagaatgacttacattgtgaaacggatgaagtaattcaattactctagatttatttagttattctcatgaaacctcaaatttcagatggaaaagaattatgatattatggtaatatttttgaggtaatttaagtgcacctcttttaattttgaaaattaagcgtttcagatggttgagatttaaaaaattatccaaatcttacatgaacatcaagtataatgaccagagagcgggggagagagtataaaaactcgaaacaagaaaaatagactgattgtttgtttgtagctaatgcactaaagccataccaagagaaccgatcccaatggtaccacattatcgccgatgtgcaaagtacaaaggagttgctagcagaggtgaaatatcgtcatgtcgaaagaggttgcaatagggtactcatgagttagcgcagctgactagtagaacgaagcattgtgcactatggtgggagcatattcccacctgcattcaaggccttgttctcaacgattgaaataactttgttctcatcagtaaagctttctctttctgaaaaaaaagaaataagaaaataggcaatactagctattaaaacataattcaattactctggattttagttattctcatgaaacttcaaattttcagatggaaaatttcacagggtcatctgtcagttctgtcgcatctctgtccacagttgatatatgaaaagaaaaatccatcctgaatagaaaaagaaaaacagaaaaaaaaaccttttgtttttccttttttctcacttgtccctacttgaccagtccttgtccctatctcccctttctcaggtcaaccgattctatccaagatccagtccccctttctccttccttccttcctcgagcctcatttcccccccaatcttcttcccaaaagcagctccatccaaacccaatcaagccccactccccaccaacccccttccctcaattataagcctacaactactgctgattgcttcagactgatccaagaaagggaagtttggttgtggtgcagagaggtgcagaagggggagggagggctctgaattttcaagaaagggaccatctttctgctgctgctgctgtccgggttggtgcttgttgaatttgaggctaaagaagtcggaattggaggttttgtaagagggaaacaatggctggcaaggaaatctaccacaagatgaaggacaaggtactgagtaatggaggactggaggatggggattcttgtttgttcttcctttggcctccatttccctttcatgtttattgtttttttttatttttttgctattcctgtgctatttttggggtaatatttaggtgcaccgttgtgtcgaatcttttccttttcatattagcttgaggggatcttgaaatggcgaaggctagaagtctgaacatgtcttaaaaatcttggaatgatgctaggctatggtgtctatttatttattttgggccaaatctgttgcttaattacgacaatccaatggtttgtggttctataaacataatgagtcccgatgccatgaaactccgtgttgacgttagattcttggagttatcatgtttctcgttcctactagcagaagcaggaaacatgtatcagtggagaaaataactactgaggaaacaaaacataactcgtctagaccagtagagagacaagcatttcaatatgttggttatgggaatctggtccatttcaccataaaacttcaagaacacgatctccggcttttgccggttaagcatgaattttattttatgcttagatttttttggatattcttttttatgaaagcttttggaactcaagaactcgtttgattgacgttgttccttgggagttttagagtttgcagcctggaaactagaagttatcttgaaatgttatactctactcaatgtagaatacacacatcactaaatccagactaaattcattttggtagactaccttatgcaccttctttgtgtttattcttgctgtgatgcaaccaatgtcaaaaaagcgaaaactgtttttttgctccattgtgctggatgttttccgcaagcttatatatttgctttgcttagtgttgtactattagcaacttaacatgcttgacgaacgattatgttttgtttaacaggtgaaagatgcttttagttcgtcaggaccagaaacagggaaaggaaaaacaaaattgtcaggcaagcgtgtcaagcatggttaccatcttgtgaagggaaaatcaaatcatccgatggaggactatctagtggcagagtacaggcaagaaggagagcatgatctggggctgtttgcaatatttgatgggcatttgggccacactgttccagacttcctgcgctcacatctctttgataatatcttaaagcaggtaatatttcaaattcaatgtcctgttaataggcttagcctcaatacttgctgcattgcctacatgctcagatagtaagattgttttgtcatcatgcgtcaattgttccaatattgtatttttactagctacatgtcctttgatttactatggataaaaatgaaccatccaagttctaatgctgttcacaataaatagttgtgtcattcattttttttgtcgttttaaggagcatctgacagtgtctgtacttacagtaaaaataacccattcgctatgtacttttatgtgttaaattctgagtttagaaggtttaaaaaaatggaattagaatatatggaatgaagattgcataatattaaagaaatgtaggaagcattttgagaaaagaaaaacaaggcggagttagtggggtggcgatttaccacc

SEQ ID NO: 59819 - DNA, 6544 bp, Oryza sativa
atgttttttactgaggtttttttgtttgctaatctagtgtatctaatgtttagttccacactgctttcttatttggatttatgtccttgtatgactatatactagccatgtggccctcaatactgcccatctatttgagcccgtttcattggttgacattgcatcagatcctaggtccaggatacaccctaacactaagcatacctatgccaatattgcattagtaattaccagcagtggcgtacacagaccctactcttaactgcttctatgctgttactgtcacaacatatgagatgcaatctatcgagcttcaattccaaaaattttttacttgcaggagatgtaccgcgtgttgatggtcagcttgcggttgcaagggcatttggagaccggagcctaaagaagcacctcagctcagagccagatgtggtggaggaacctatagacgagaatactgattttctaattcttgcaagtgatggattatggaaggtgatgcctataaagctcataccaaccatccatgatagattacacctaaatttattgttttgcattctatatgcatacctaacctaagctcaacaaactggagaccatgtcctaccttatttaattctatatacacaccaaatctcagaatatgcatacatgcatgcactacattatttaattttgaacatgaggtactggaggttgagttttgtctaacaggtgaaagtgcttattcctacatttcagctacttcctccgtcccaaaatataagcatttttagatatctacacggtcttcgagatgctactttgaccaacaatgtctataaaagtaatatgttttaaataaaaagagttgcatattatgatagtttgtttaatgataaatctagcaatatcaaatttacatgattgatctttttcattattttgctattaatagtcaacatttaaaaagtttgatttggcactattctaaaaatgcttatattttgggatgaatgaagtatgtaatttggcatgcataagcacatcctgactcatgagttgcgaaccttgatttttctattttcttaagctgcatctatgactattgcatgattgtttttttttttgttttagttgagttctttactctttttatgctagttttcccaactcacctcgctcgttttccacgtgcatgcttttcaaactgctaaacggtgtgtttttttgtaaaaaatttctatacgaaagttgttttaaaaaattatattaatccatttttcaaaaaaaaagttaatacataattaattgtgcaatagtacgtgctccgttttgcgtgccggggaggaggggttcccagccttaatgagctgctaagttgcattagcgacgttcttttatcatatgcaacgattataatttcaagatcatacatatccaggtgatgtccaaccaagaggcggtggatgaaatcaaggacttcaaggatgctcaggcagctgcgaagcatctgacggagcaggccgtgaaccggaaaagcaaagacgacatctcctgcatcgttgtaaaattcctctgctagcagaaacagagtctcatacaagtgtacaattgctaccatctgatggtttcagtgttgttacttttgttgaatattctggttagtcttgtcgaacattgccgattgttgaatgccccaatgggacatgttcatatattatccctacaattccagtggatggttcattaattccttttgccctatcactttttctttatcaaaattctctcaacgcgaaaaaaaaataaattgctgaatttttttatctcaattctgaaacaaatgcataacacaaacatgcaacaaaaattgaatggcctgaagaaaaaaaaaatgctcgcatggggaactagctaaggattaccagctgagtctaaatgtaagcacaacgtttggcttaaaacagcaaacaaaaaatattttatgaataggacttatatatgcttttagcaatttaaaagtaaacggtgaaaaataaactataatgaaaaaactaaaaaattcaaatttagagtggctttaaaggctgagttcagcaagggagttagaatccttccccttcaacatataaaacggaactgtgaattagcgcataattaattaattatatgcttaaaatttttcaaaataaattaatatgatttttcaagcaacatttctatagaaaactttttcataaagcacatgtttaataattgaaaaagttaaatcaagagcgctctcggtttcctcctatcgcgcgacgcatcttatagccgtctatccgtgtcttcgtgctgttggagagacacgattgcttcatcaaagtgaggaatctgtatagcgtccagtattgctacaaaggacaccaccaatcatcaaaactaaagattggctacactagcattgttattttagtttagtttgtaccattatgctgtactcaaaatatacgataaaacgagtctaacattgaatatatccaaacattttaaataattacttcctccgtttcatattataagtcttataatatgaaacggaggaagtacttgaatcgtagaagtaacttagctctgcaatagtaactacgagataccctttttggaaagaggcgcgccttcgtacatatgctaattaggagaagagtgagttgcgtgtttaggcaacgaagcgacttcgtgctacgtagtcgcgtccccatttaataatttaggaagcatatgcgtgaaaaaaaagagagtgttgaacccacggtcccacactagtcactagcgtggaaaaaaagggagtatagaagtaggaaaaagtgtaccggaggtccctgaacttgtcaccgagatacgaaaatgtcctccaaccgcaataccagatatggggggtcccctaagtatgcaataccggtcacccgaggtcccagggcaggatttctccccgatttgtctgacgtggcagcggttttgtccaccgtggcgctttgacctcggtcgtcgtcgctgacttagcagcccggtagttaggacaacccgtggcgcactgaaggggcattcacttcacttctccctcctctggaaaccctagatcggcgagggcgacgcagctagcgatgaaggcgattcggagcaggctgcggcggacgggcggagtgtcgtgcaggcgaggcggtgaccggcgtgcctctaccgtcgactacctcgagctcgaggtggatctgggggcggcttaggcgcggcgaccagcagccaccttgggcgacctcgaggttgcatcggcgagtacccctccaattgggaatccgaatctggcaggtattacctttcgtagttaactgtgtgtgcttgcatggtaccagtgggatttgggaagtgaaattttttatattgtgagatgccttttttatctgggatttgatgtaagttgggagttttttatttaggtatgtagttgattagaggttatttaggcttacctctgtgcaaaagtttcgatttggacatggtatgcatgtgtaggtcaattataatataccctaaatcagttttatatgttgtttagcatgaaggggatggacgtgttggacactctcgtggttaggtttcatatgaatggggtttttctgttagatgggagtgagaagaagtattgcggtggatctgaggctttgtcatatgtagatagggataagatttccttgtcggagttatttggacacctgaaggagcattgcaatatgttgtcagggacaatgctccactggttgtttcctggtagggatttgcaaacaggtctaagggctctttgtgatgataaggcttgcaaattgatgtgtgattgtactggagaattggaggtggcagatatgtatgttgaagagcccaaaattgtggatttgtgtgataagtctgatgatgagagtgatttatgaggtagagatggaattggaagttgagagtgaagaagatggggaaaaaggggatgtacatgtagatgcatctaaagggaaagaagttgacaagggtaaagcaatagcagaggaggaaactgataggaggatagttttgtaccaatctgaatcagcacctctagttagccatcaaccttttagcagtgctcccaaagctagccatgaaccttcagacagttcacccattccaaatcagccaacatatgacactgaacccatagctaacgatccaccttctgatagtgatgaagatagtgactatattccaggggatgaagctcagtcagatgatgatgaagaggctgctgagatagagaaacattacaagaaggtcaagaggaaggtgaaggcaggacagctagagaacctggatgacttctttctagagaggggacaaccaagtgtgcatggtggtgttgaagatgcagggaatgaaaccccttatgcaaacagcgatgaggaggactcagtagatgagattggtagtgatggggaggtgaggactaagagaagtaaggaaccaaggtacaagaagagtgaaggtgtgcctaagtttgaactagggatgaagttcaactgtaagaagcaattcaagaaggctattacaaaatatgctcttgcagagaagaaagtgattaactttattaaggatgatgggcaaagggtaagggccaagtgtgattggcataactgtccctgggtatgtttgctatccaaaaattctaggtccaacagttggcaaatagtaacatttgaaaatttgcatgcttgtccacctaggagggatagtaggctagttacctctgttagaatagcagagaagtatggaaacttcatagctgctaatccttcttggctacttgctcacatgaaagctattgtacaagaggaaatgtttgcagatgcttctgtggctaagttgaagagagcaaaatggcttgtgcaaaagaaaaagtttgaggctactaaggggcaataccagcagttgtataggtatcaactagagcttcttagaagcaaccctggtagcactgtggttatcaacagagagattggcatggttccaccagtctttaagagaatctacatatgcttggatgcattgaagaaaggtttcatagctggctgtaggaaagttgtgggactggatggatgttttttcaagagggcaaccaatggagagctgctgtgtgcaatgggcagagatgctaacaaccaaatgtaccctattgcttgggcagtggttgccaaagaaaacaatgaggaatgagattggtttcttgatttgctttgtggggacttgaaagtggggacaggggcaagctgggtattcatttcagatcagcagaagataatatcattacaaactgcttttttcacttgtaaatttccatcacatgtcactgaacctttattttttgtatttccatacagggtatcctaaatgctgttgagaagtgggcactggaggctaggggtggaaacgagccgagccaagccttagctcggctcggcttgcaatggctcgcaacaagctaggcttggcttggctcctctcggttagggaaacgagctaaaacatgagctcggcttggctcgtttcttggctcgagccagctcgagctagcttgcaagccttccgttgaagctatataatttgtaatcattaagaaaagcaataacaaatcatcaacatgtaaaattaaaataactttatatattcaattcatcaagatctagacgataaattacatattaacaaataataactccactacaaaataaaatcatccatataaatatatgatggcctaggctcacgagccagctcgggcttggcttgttttagaaacgagctgaaaaggaggcttgggcttggctcgtttggcattcaagccgagccgagctaagcgagctcgagccaagcctgagctgagctcacgagcccgagctttttttccacccctacctgaggctgagcacaggaactgtgctatgcacatttatgccaattggaagaggcattttcctgacaagcaattccaggaaagttctggaggtgtgcaaaggctccctgcacgatgttattcaatcttgctagggcaaaacttgctcaggtgactcaagctggagctcaagccatactgaacacacaccctgagcattggagtagagcctggttcaggttaggttctaactgtgactcagtaaacaataacatgtgtgaatctttcaacaaatggattttagaatctagattctatccaatcatcacaatgcttgagactattaggagaaaggtcatggttaggattagtgatcagaaatcaaatggtgcaaagtggacaaatgttgtatgccagggattgagaaaaaactaaatgtttacatagctgagtcagccttttgccatgcaatttgcaatggaggtgataattttgaggttaatcaccatgaccataggtttacaatacatttggacaaaaaggaatgctcttgtaggtattggcagctgtcaggactaccatgccctcatgcaatatcttgcatttact

SEQ ID NO: 59820 - DNA, 2411 bp, Oryza sativa
actttcccactacaggcagcaatggatagccaggaagtggtcagggttgctgcaaaggccaaggtttcaacagctcagggtggatctgctagagtagatcttcaagcaatagttccccattcaaacagctctactactgcgtctgtgaggctcacatctggcaaggcaactgtcactgtctcagctcaagagcctacaaaaaacaagccaaagaagagagctggaggattacttattcttctgccctgggaagcaaagaagctttgaatgtgccattgtcagtaatgttagtgcaatatttgaacttcttttgtgatgtaatggcagactatttagccaagtaatctgtgatgccaaaatgtttggctatgtgatctctatgatgccatgctatttggctctcttatcagtgatgtaagacaaattatttatgttgtcatgccagactgttaggctagctatgtcacttattatgtgtatttgaatgtcagacaatgaatgtttgcttatctgttactgctggaagccaaatatggagtcacattttgcattgtcatgaggtttgctgcagaaattggcaggtttcatacactgtttgtatttgtttcatttcctgctgacatggacatttgctgcagaaattgacatgtttcattcactacacaaatggatttttcatacaccgcttgattttgtttccctgaacaaacaccaaaatttgcacaacctgatacacattgcatgctgattttctttcagattccatattgctcttaacacccactcattcacaaatttaattccaactggatagcacaagtgcacaactgatacatacatattttgacacatcaaaggaaagacttgatcacaccattcagtccacatagcatatagacaacacacatctaacaccacacatcagtccacacatcaacatgtctcattccttcccaactaacaccacaaacagcataaaaatacgtgacagcatacagattacaaggatttttttctccttctctaacttttgattcctagccttcaagcttctaattttttcctttttcacagcaaccatagccctcacatcatctatttctctcctctctcgctcccccttagcccgactgtcttcaacttccttatgcaacaattccttctccctcctcaacgaattcaccatgtcccgcaagtcattcaatagctcactgatgaaactggaagtcgggtcgtcacaccatgcccagaaatcacaccccccaacctgaaaccacaaccctacattcaaatcccaaaccgtccaaatccaaattcaacaacagaacaaccaaaagccctcacttaccctagcatgttaacacttgtagtatcggcgcccagggttgtccgtgctccatgagatccacctcgccgctttcgccgggcatcggcatcggcacatcaccgcgggttggtaatccagaggaccaacccggtaaggcacgggagaaggcttccactgatgggaagacgacgagccgtcgctcatcgagctcgacatctccgtaccgccactcgccaagtcgccgccgctctacaaatcgctgccgccgccgccgcccgctcgctagggtttcggtgtttgggggagaagcaaaccgcgccaaacatttccctcgttatatcctaactaccgggctgctgagtcaacaacgacgaccgaggtcaaagcgccacgatggacaaaaccgctgccacgtcggacaaatcggggagaaatcctgccctgggacctcgggtgaccggtattgcatacttaggagaccccccatatctggtattgcggttggaggacgttttagtatcttggtgacaagttcaagacctccggtacactttttcatagagaagaagtatataatacaattttatttttttgaaaaagccatcgattctgtcgatgccgcagtagagcccattgggccaaacctggcccaggactagaatacgcgcgggccaagaaacagggcgccgtgtcgcacgtcgaaaaccctaaaaaaaccaccgccctttctccactcctcccgacgttgccgcctccgcctcctccccctccatcgccggcggccgcttctagccggagagaagaaggcatgccgcggacgagcgtggtcgagagccccggctgcccgccgctccgggccctcaccaccgacatcctcggcctcatcaaaggtagcccgtccccacccttcccgccgccgccgccgccgcggcggcggcgtgctggtttgcctcctccggtgagagggctgatcatgttttgtggtattcatcctcaaccgcgcagtcgtggaggcccgcacgaagccggcgggcgtcgccaaggtcgtcgagacgtggggcgcgcccgacgcgccccgcgccgt

SEQ ID NO: 59821 - DNA, 1572 bp, Oryza sativa
ttgagcatttttgtgctggttgtttattgctgtgggtgttgtgtgtaggttgagctgctgaatccactgaatggggagactctcgcaggcgtcaacgctgctgctgggcgggcggcaccggctgatagttctgcagaagagaccccttagccacgctgcatctcttcagaagacatgcgctggactcatccatgtaattttcatttgatgctctttggcaatttattgtgcacactcaatttgccatgtagatatgggttatgaatccacctgcatttgtggtctccatgctttagtgttctttcattttgtagataatggcatacttatgatgtattcattgcatatgtcaggttaggcacatttcttgcttgtacagagaaggggaaagcatatgtcaagtctgtcgcaaaggaaaatgcatcctcggacatggctgttgggccatcaagctcatgggatgtgagcaattcgggtacagtgcaattttcttcagtggatgctggtgaaagctacgcgatgttcggagggtgggtttacaataatctttatattcattatgtagcatctaagtgtactataaaaaaatattgcttctgattactaactactcaattggaaacatgagtagcttttatgaaggttgaggcgctaataataatatttcattttaggaaaggaatagaagtcaatttgtgggatatcacatcttgtagtaagatatggtctgccaagtctgtaagcactcactgactcacaccttttatcctttttctgggtctacttgcacttttatctgatgttatagcagactgccacgcattaactacttcattcttttttttacctgaagcctcgaggcaacagtcttcagatattcactgcaccttggttcactgctggaacttttttgtgcaaggatgaccatcgtaaaattgtagcctgcacaaataatcatcaggtattgctgatatgctaacaaaaaagatccattttcaactagtttggtcaaactgctctgtttctgtattgttgtctcattgaaactgatccaactttataatggcaaagcagaatgattgcaattgattagttttttcatgccagttagttgtcatgctgtatagtttcctcgtataataaatcatgaaaccgatactggattatgctaaataggatgttctcatacatcagttttcatctttcaaaataacactgcattgatgaggttttctcaatatttgtacctgtggtgcttcttctgattgttaggttcgcttatatgacactgcttcccaaagaaggcctgtaatttcaagttgattttagggagtcaccaatcaaggcagatgctgaggacccaaatggacatgctgtctacattggtacaggaagaggggaccttgcttcctttgacatgagaacaggtattatatgatagtagctggtgtgtgataattcttgctgatggcacttggaagtcaaatacattctgaattatattttcagagttgtagcttagtttgaattttgtatctagtatactatagttcaaataaaaatctcttttca

SEQ ID NO: 59822 - DNA, 2145 bp, Oryza sativa
  unsure (1)..(2145): unsure at all n locations
aggaaaccaatttactattgtaggactggacagttacttacgcatctgggacacaaatacaaggcagctgctctctgcggtacgtttaacagttaatttcatagtattcaaatactatattttccatgcaattaacagatactgtttcagttctgcttttatttgccattgcttcattttggacataccatataagtgaattattgtggtcatgaagacatcatgggctagtcaaacattttagacttaaccttggggtactcttttactggttggcatgcgcaagtgtattggtattggtattggtattgatttttcttctggccacccttttgctgtctagttaattgccttttggtggttgttttgctagtttgctgcattctatttaaaattaagatatatctcccttcggaaattacgtgcttcacagtgaagttataatgtaccatgattcttgtgcaacttgaaactgtgtccaggtttaaacattttatccttgtagttgcacgatctaatgctcttcactgtcctgtttcgtaacaggtcttcctcaagcagcacctgacagctgtggttattgattcacatttctccactgaaggtaccattccatttattactgttctttgtttaccaatgtaattccagcacacatcaccttaaataatagtgagacttaatagagcagtgcttctattatcttgaatagaagggctagttaagatagtaatctacatctttcagccctaggaccccaaagcccaagatgtagtgctactcttcaaactttttgaaacgaagttcattgccatatcgaattgattcatgaagaattccacgtgttcatctacttacgctcttgttggatgttcagaactcgaggagactaaatccaagcagccagatccagttggggcagaagttagaaaggaaagaaaggaaaaaagaatagaacgagtgaaatggatgaagacgaaactagaatgctcgaccatgatgacagtgattctgaaatgcacacctcaaagagaaaaaaatctggtgaaaaaagcaaaggaatgaaaaagaaaagcaagaagcagcaagtcgcatagataggacacacaacactggagtcagtgttgaccagttttgactttttgactaaggtgctttgcccttcactcgattttgtacaatgaatatcatttgtattagagtttattcgaactcgaacaatagcacttatctggattctcaattcttcaaatacttgccgggccaattaagtattttactatgccttctgagcaatataaaagaaatggcgtattatcaccccttttttgtgtgctagtccgtcctttcttatcaagctgaagagtttagttttgatcatagtgtttccttactctatataaattgataagagaagtgcacattttgtccaattttggtccatcaactataaaaccgttcattatagttcccttgacttcttggaaccagtccnnacatttcatcccctacatctaaactgggggtacggtaacatggcgcttgagttgggtccacatgagcaaatagtaacggtatgaatatagcaaccataatgaacgacagtgaaacaaaaacttgaacaaatactaaaaccttgcctccttttcctttcccatatctcaaattttttctttttgaacaaatactaaaaccttgcctcttttcctttcccatatctcaaattatttctttttgaaagaagctatatattatttaagaaatttctaattaagattgtcatgtcacacggagccacatcaccaaaagctacgaaagatgaggtggtttgaaagagatcaataatgacgaccctctaaaactcagtattaagaaaacatagagtagaaaaaaaagtaagaatagaatgtcatactcattgaattcctataagattctgaagcataggaaagtttcaaattgtctttgattagcacatagaaaaaacccaaaaattctacatgaaaaggaaagcatgtggtgagacctcatgtttatttttatctaaaattgctctaggatgatccattccataaaaatttcaaaggaatggataggaaacaattttgttttaaagggtttgataggataaaaatcagattacta

SEQ ID NO: 59823 - DNA, 4710 bp, Oryza sativa
atgtgaagttctttacttgccataggtttcattggttggctaagagctctgctggtaaattgctctttcaaattctgacattgcactccaagttcagaagattgtgctttctctttgtgaatttcctcctcgagcaaacggatcttcctgcgcaattcctccacttccgcctctttgagctcaaaccgactggcgaatttgttcttctgggcttcagaagcatccaatgcagtaatgtaggcagatgacaagttcttctggctttccagcttcttctccaacgaactgacatgatccttcaggcgcatggcttcagcctgtgccaacctgagctgggactccaatcctgcagtcaatggcttgtgcttctcttcagcctcttcaagcatcttaaccttctcattcaggccagcgatttctgagtttgcagattggagctgagatctgagctcatttgtctgcacacccagtgcctctagatcacaagaccgtgtcgcgagtttctcagacagtgccctctcctcctggattttcagttccaagatgctaactttcttctgcagagatgcaatttcctctcgtgccgactccaactcatgctctgtacccttcttcttctcttccagagcttcgattccatggcacctcactgcgagccggttgaaaacgccttctcctcctccagcttcttctctagaagagtgatcttatcaccgagatttttggcttcagattgtgatgcttccaggtgaccacgcagctctctcctctctgcctctagtgcatccatctgctgatacttagcagccagctccagcgtcagcgccttttcggactcgagacgttcctccagaatgcggcccttgtcgagcaagctcgtgatctcgccatgggcgagctcaattctcccctccagttcattcctcctgttctccatggcttccatttcggtttccatggaatgtttcactcccttgacaaggttcagttgcctctgcaattcgaccgatttctcctctgccaccatcgcccgatgccgggtgttcctgagctctcgctgagcttcgtgcagcgccttctccctgtccgccttctcattgccagcctcttgatcttctcctcgagcttcaccagctggacgctagcggcgtcctcggcctcgctcttggatgggctattcgccgacgcgatcttctccatctccaggaagtcatccatcatgccgatgtctgcagccgcgaggctcgcactcctcgtgatgctcttgtcgttcttgaattgatcgagctcggtgatcagaatcgaggcccatgagtccgagcagtctgactggcaatcggtgactgactcggcgtagaccgagcttggtgcacgcttgagttctctccgtgcattggcctgccaaaaattctcacagatgttagtgttagagagagttattagcggactcatgggccttgagttggtacgtgaaactaatgaaaatgaagattaagtaagggcacggaaaacaagaaatctcttagcgcatggttagatttatttgacattttagggtcagttctatatacaaagctttcgtgccaaatatatcctgcttcctccgttatatgtaagtcattctagcattgcccgcgttcatatagatgttaatgaatctagacatatatgtgtagctagattcattagcatctatatgaatgcaatgctagaatgacttacattatgaacagagaagtattatttagcagtttgaaaagcatgctaacggaaaccaaggtagaatctacgtactaatcagaagagatttgcttcggtcctggtgcatggttcctcgcggtactaaatcattttcatcgtaaatctagctaggtagggtggacattgttagatccaacgatcgaaaacgatttagtaccatgaggtactttttattgaactggagcgaatttctgatcagaaaagaacgggaactgtccaaaatgcagagctgttgggggaaaaaagaggaaatggcattacctgcagccttctgcattcggcttcgagcttggctatcttcttgatgctctcaagctgctgcttgctggccgtctctgctgccctcctgttcagctccttctcgatggtcctgagctccacctcctccgacatggccagcagctgaaccttgagagcagagttctccttctccaaggaggccagccttgagctcgcatcagtttcagcgttcaccgagaactcggacttcgcctccagcttcgccttcagctcgactactcgcagctcgaggtcggccttctccgactcccattctcgcgactgctgcgctagcgcgtcctggatgccatgatccagctcttccttggcacgccggagttgcctgacgcattccttgagggcgccgtcgaggtgaacgattctgtcttccagtgttgagttcttggcagttgcagcgttcagctgggtcttcagtgatgctatctctttctcggccttctcccatcctagtaggagaattgcaggtttttgttatgaagatctggcttgtcagttgtcagttctatttatgcatgtgtagaaataacactgtttctaggatcagattaaaaaaagaactctttctaggggattaagcttttgcttcaaatcattagtacattattcgtgaaaaaaatattagtacataaaacttaaggattaggttgagaggaccttagaataagaatgttctttttctaagtcagggaattgataaaactacaaatgagcttttggaccacatgatcagtacaaaaaattaaaagcaagagacaaggaacatatctgcatatgcatatgcagtatatccaggtccaaacagagtcatttcttaaattttttggcccagcgaaaaacaataatttgtttgaatttttgcttcatgtactgaaactgtacgattcagtcatgtttaacatcatacctagaacagcttcctccgcaacttttgaatgctgcttcacaagatcatcttttgcacgtatgtccaaaactgcagatgacagtctctcgctcaacaccttcaccttcacattgtcatcctgcgcttccttcgacgagatctccggtgattgaactgagcttggagaactctttggagtatcctaaccaagaacaaacaggatcaaacattgtcctgactagaaagtgcaaaattaggaggctattcatgcaaaatttcttgtgaacttcagctattagtcatgcaacagtattgcagaacaaagggagtggctgaagtaacaataagaaacctctattggatgcatctgaaaatttggaagaatcaattatcaaagtattaaatactgttttttttctggacaaaagcaaatgagcacgtgaagtacgacatggtactttctgagatcatgttcttgcatgattcccaacattatgctcagagaagcacaatgattaaggggattcttaggactttgagcaccattactccataatcatcatcatattaacttctatacaataggacacccctaattaaatgcacaactccatcagaattccagacatttctttggaggtacaggtagagctgatggtcaaagatcaggaattcacaagtaaatgttgcacatgaacagaggtgagagagagagagagagagagagagagagaggcatcttgattgctctgtgccagcagacacattatgaggcatttgggttgggccaaagggtgatgctgcagcacatggagatggatggagtggccaccaaagaaaatgcatcttgccctcatgcaagccataattcctgcagagaaaagctagtcccaactaacatcacatccttgttgtccatggataggtaaggcttgtcctataatcccttcccggtatagaaacaaacaggacccctctctctcattctctccttcagtttacaggcctacccaaaaactgtgacatatgatcatggactaattgccagtgtcacctaccaaacaaaggaagggaaactgaatctatcttacagtcccctcattttgtcatgtggctagtatgattgggagctgctatgtggatgtctacgaggatgtcgcaaacgcgcgattttcgcgatatcaccagacaagagaataaacctgctaggatggatgaatcatcaaacagaaagaataattcttgtaccctacatggtacaactaggattggtcaggaagaactgagctgtttttatgcagaggaactctgatcctccatcaaaatctttatctaatgccatcagagcttcaaatcttaaagagttcacatctgcaacatggtggtagattaccaaagcttccagcctctacagatctgaaaccggatgaaacctcacatgtttgccatatcagatggacccttattttctctgtactgcacatgttacatgatctgttcaatggaaggagcgtatggctcacaaagtcaattgacaatcatcaattcgtttgagcatgcttgcacaacactcctagacactagacaggtattatcattcttcaacatttgagcctcttttactgttacccagttactttttcctgctccttggacccattggtagtttgagaaatgtgagataaacatgcggaaatgaccgcgatttcggaaaaaaaatatgaactttattttccgagaacacgcagaagagctgcgtgtctttg

SEQ ID NO: 59824 - DNA, 1547 bp, Oryza sativa
agtccagtgaccgtgagacaaaacctccttgatcgagacatgaaattcagctcaagttcagaagtttatcagtgtgcgacgaactcacccagaaaaaagtttacaaatcctaccaaattaccatcccggcaccaagacctatcactctatcagagattcagagccaaaatttcacccaatgcatccacatctaatcagagaagaaacaaaaacagaaagaaaaaaaaaagaaagaaaccatcctacctgccatccatggagaatgaacagaaaacaaccatcagatggattagctcgtactgggccaatccaagaacaagcattgcatatcgttttcacctcaaaaaccacccaaatcaacccgaaagatttcatcaagaaaaccaaaaatcccagaacacgctcccctccactacaaattaatcaccaagaaatgggagaagcgaaggcagagtccacacgaacaggacatgaatccaagcagagaagaagagcagtggagcagcagcacacgcacctcccggaggaggccgagaagcgtgacgagccgcggccggaaggaagcgaggcggcgcgatacacgagacccgacccgctggattcctcctcctactcttcctcctttacctcgcctatttaaaaccgcgaggtcggagagtacaaaaggagtgtgaaaaataaatacttgaaaaaaaagagagaggaagaaaggtgtggcgtctcaatagggagaagaaagaaatggaggcttcgatgtggcattttcacgcgagataagggtttgatgaaaaaaaactgagaaataggaaaaaaatacagtattttaacaatgataagggcccctttgaatcaaaggaattataaaggaattttatagggttgaaatactataggaaatttttccacgtagccctttgattcaaaggattgaaattttccaaatcctacaaaattcctatggaatggcttgttgcatataggttttagaggaaacttagcaagaggtccaatctcttggtaaaaatcctttgagtctatctctctcatccgattcctgtgtttttcctgtggtccaatcaaacgatcattcctgtgttttgtaatcctctgttttacacttacattcctgtcagaatcctatgtttttcctattcctccgtttttttattcctacgattcaaaggggcccttaatagtgcaaatgttgaaaatataatcataactaactgggtgacccgcgcaattgcgcgggtagcacccaaacaaaatcatatatttttttaatatgattttacttaaaatttattaaatagctatctaattgtcttaaaactttgaaggactaaaccttatcatccctgacggagcgtggagctcctcaccgggagaccgcgcaggcccccctttgccggttcggccgggggcgctaagtgaggttcttcgccctcgatcgatctggagaatgttcgcgagagagcaagtgcacgagacacgggcgatgtagacaggttcgggctgctgagaagcgtaataccctactcctgtgt

SEQ ID NO: 59825 - DNA, 6572 bp, Oryza sativa
tggttcaaaatgaacattggtaaaaataccataatcaaccaaacctaaggggaattagaggtgactgtgactcaaactacctcttgcaaatttacaacttacacttgcagtataaaagttcgatattagatggaggctctaaaaaattattcaatgtgtatattagtatattttaaacattagcataccaggaggcataggtggcttgccccccgaaagtgcttgtacaaaaatccattaaaattatatgaagaagattggctagctcgatcggtggtttggtttaaaaatgctctagtaacaacatttcctttaatcaaattaagatttgttgattttttgactggatcggttctttagctcctttctgaatttggtctcaactaattgtatagaaaaaaaaatgaaccaaactaaaccatttcaagcaaaggtaaagaaaaagtgaagctgacttatcatcaacccctttagatactgagtagttggattgaattttgaattgtacaatggtcctccttttgtggctggacataaattgcaccttcaatgatggatttctattttccaatccatcctataaggtggtaagcaaacaacaattccaaatacaagttgagatggactcaaaagctaagatgtgattacatgacttcatgtctatatatcgtggttgtgcatctagcttataaagattcaaatccgatttaccaccggtatatatcaataatctttgagtaattacacaaatgcatgtttggtaggtgagtacatgtgcctcaaacaatatttaaatgtgtgtaaattacacgcacgacacatacgtgcgtgtatatcgtacaacagcgttaatgtgattacaaccgtataaaataactccctctcaagggaaaaagagttgaggagatacaacaaacttaaggcacctttggattaaagaattttcatatgaattttgagaatccaaatccttagaattttttcttatctaggttgttaacgtaagattgaagtatggaaattcctttgaatcacattcctatacgttaattccatatgaatttaacccatgacctcaaacctcatttttattttttcctttgattgcttttctttttctaatctcagctttcctagtataaacatatcctctactttttctttgtgatgttttctcttccacatcttgtgtagctgcaagacgcgggagatgggccccggctgcggacggggtgccggaatgaacgagcgagcgtgggccccggccgcggacggggtgccggaatgaacgagcgagcgtaggtgagtgccgatgactaccactagtggagctcttattggctgtggtggaagagtaacatgagggattgtggccaccaccatccacactaaagtcgtcgccctatttgaccgagaagctagttagcacggtgaaaagtagcaacttgatcgatcagtcacctacacccacactagaagaagaatggcaagaacgagtgagctatatatgtgggaaggcgagagccacgatgccggccatcacgacagtgtggggggatacaggtgtgacgttgggcaaggcggcgtggtgattgggtttgggtttgaggccgccccggtgttgacagcaatgacggaggtcgggatcgactggagcgacattgaactgccagctgggacgaccggtgtcggtgtgagagggcgggcgtccaacgtcgatctactgaagccgaggcaacgattttttttttttcgacgccagaggagcgaagaggatggcgcacatcaggggcacccatcttgtgtgcgccacatgtggatctggcacaagggcgaagtgagacgaagcacatgggatcaaatgggggtgatgtgggacccacaaaacatgtttttaatcgctagtactggctgcatgcaagttgtttgacatgtgaagttgtgctaccgcccggtgccagatttatagctcgctctcttctctttccttaattatctccccctccacctaggaatatgatgacattaaagtttttggagcctgctgattcatcttattgtatatgctcttaagaagtcaattgcgtcttctctctgtctctctctcctttagaatcaatccaaattcaaatattatttttctgttagtcattcaaacacatcatcttttgaattatcaggtgttatcaacaactattgttcctgcaacagttgaaaaatagctataacctaccacggtgttcaattgatgcagtcgcaacaacaatcccggtcgatcaagcccacaatgttttagattcttatgagattcgctagcaaactactccctccatcccaaaataaactaacctcataatagaatatgacgcatcctagtataaatgaacatgatgtctcacgtcctagtacgaagttggtttattttgggacagagggagtagcatttaaattcaatgcttattttatttttaaatctagcgtagtcatcaaatccatagtagtcaaatcaaatgctacataacctgaattcaacgatcaacgacatacataggagtaagtaccagtaccagagctcttcgaccgtctgcctaagcctaacacacatgacacatggacaccgaacacaaccgtagttcactgcaaaggtagcactactggtaggctagtagcaaagctgatgagagcagcggccgcagattcacagcacgatggggtcggacgactgcgagcccttccctcccacgcgcctgaacctcttcgcctgcacgcagctccggctgctccgccgcaccgcgccgccgccgccgcctgatcccttcgccgccccgtcctcctcctcccgccgccgccgccgccgccacttctgctcctcctcctcctcctcctcctcatcctgctgctgctgctcatcagaccgctccttcggcggcacggcgtcgtcgtcgtcggcgtcgccgcgcacgatccccggagcctccgcgtcccccgtgccatgcggcgcttcctgctcgcgcggtggcatcacagccaggggagggatcaccgcgatcacctggggctggggctgtggcgcggcgtcgcctcgcttaagcggcggagcaggaggggaggcctcgatgagaccgcggatcctggacagggacgtcgccagctcggcggggaggcggtgttgctccagaaaccgcgcgacggtcgggagctcctccctgacgccctccacctgcatgaaccgatccaatcgatcacaacaacgaaacgcacgatgcaatcacccgaactgaaccgcgatgacacgctcacgtcaatgtgacagcttcctcagcacgagtgttagggagatggattctaatctaatcactcggtgcatgtccacacgtttattatacgttagctatatgactatgatttttttaaaaaaaatgacaagatagattgataacaaacatgccagcaaattcgacttctgtaagttgtaacaatgataacaaagttaattgcgaatatatctatactaattaaaatttaatttgctacttttattacaatttaaataagtaaaatttgagcttgcatatttgtaggataacatattattacatatgaatctaccttgttattttttttttaatttttttataaccatttagttgatagtatgtagcaaaagggtagatgtccacctaagtgattaaaagtgtttcaccgacaggtagttttaccacggatatcaggctgagcccaagggaagctcgcgccatggtcgccggagtgaaaacatctgcggcggcggcggcggcggcatctgctgtatgaccatgatcaccaccatctgcagcgttgatcagctgctggaaccgttcgatctctgaagcgtacatcaggctccagtccactgccgggttccacagctgccgctggaacgcggggacatcgttgagcgggcgatgctgttcttgcccaaactggcgagcgaaccggtccggggcgtagatttccttgaggttgaagctgaccagccatgttctggagaagcagaggttatccggagcagcgcaatgcttcggaatggatgcaggatcaacgcccttgtagggctcccagttgacctgaagttgttgttcatatcatcatatggtctcaaatcaaatggcaagggaaaggatgaaatgctgaacacaaaactgtggtgatgactgatgagaatcacaactcagatggatagacttttacatcagaaacttgaagcaggccgaaggctttcctgatgtctgaaacgttcttggccggttgagagatcgtgctccctgtccacttgagtactcgtgggaagatgtgttctggaggatcatacatgtcagggcgcaatgccggaatatactcatatatccagccctacagacagatattcagaatatatcagaacattttcgcaatggacacagtgaaggcacaagtcacaaacttggtctgtaaggtaaaattttgtgagaaacaaaaatggagaattttgttatttcctatcatctttatgccttactatcaattacaattctcatgttgaagttcattaatccttttcagaaaacatgaacagatcataacaatcaaaatagttttttgatagtttcatagaactggaagatcatttcctactcgaaattcaagtgatattttcctatacaatggttttgttaaacataccatgagcaaagccgcgctaccgaatagcctttttctggcagaatgggccacggcgatggagagagccttgtagagatgagcaagagcagcagcaccccaagcatattcctgtaccttgtcaaagtctgacagaagtggcaaatactttggtgagacatagcccctgtccctctctggaagtaaggctgatccaatcaagaacaggagatatgccctggtgccatacatggtctgatcattggtggggcgttccgggatccggctaaacttggattgcagccaagagagcttcacatggctgcccctgcagtccctgcaatcaggcacttgccccagatactggaagcagaggtcttcgaccgacttgttgagcacagctccggttgtcaccacacggcctgtcaccggaatccccagtatgtaggcggcgtccctgagtgagggtgccatttcaaagccattgagctgagcagtgttggtctccttgctccacagttcgaagaatgccatgagcgcgatgcgatcgatgactaggcctgctgtgtgtatcaggttgccgagcccgcttgcatcgaccaattgttgctgctgctcattcagcttccatgtgtcgagtctctccgtcgtctggcatacggttagttcatgggttccctgtatgtttgagcatcaaaatgttatgatttaggtacaaactatatatcacaagagccaaaggaaggttcagcaaattggtgtcgcttgctcgttgttgataaataataattacctgaatgacgcttttgtttgttggttctgcctctgcggattccatctggttccattaagagaaggaatgttatgtggtaagtgtgcatacaatccaagaattgctcgcagagaaatttcagtttaagcatccaggttaagtacggcaagaatttgcataagtttgataacaacttaacaagtcctcaatgagcggtctattgcttatatgagcaactgaacatgtaattgagactttgttcccctcaaggaaatgaaaaaattaactagcacagaatctggaaactttgacattggtaatcaaaaggactgtatatatcaggcatgatgataataaggctgggaaaaactgtagataccaggtttgattcactaaagttcaccaaaaaactgtagaagtttttaaacagatgacgtgagctctacccttaagaggaagagaactgcaaccacaaagagcaaaagcactaggaacaactggctttaaattttcttcagaataaggagaaagcaaaatgccaggttgggccacatacaaggtacaaaaggacagcagcaaccagccaagaaaccatcaaagtttccctgacaaaaaagatacgttgtgaaacaggaactgaactactcatctaatcaactgtaaaaataaagaaacaaaatctggaggaaaattgaatcgaaatgacgtagatgaagttggttgtgcgcctaacagcagccatttccatcatcttaaaatattgcagcagatgaggaagaataccagcactaaattaacgagtatacacttgatcaagaagatggtataccattttaatcatagaaaacatcacacaaaagagggggaacaaaatatcgaagaaatacatccgataaccatccatttccttctaaaactgactaggaagagcaaaataaaattgaccgctatcctctaaaacccaaccacaaatatggaaatcgggacagaaaacaaaggggaaaggagaaaaaaaaaactgaagaccatagatgagatggaacccttacacagaagctggagaccatccatagcagttgaaaaattcagcaggaaaacagaaacacacaccccacacaggcga

SEQ ID NO: 59826 - DNA, 2107 bp, Oryza sativa
cgccaaatatggctataggagccttcaatggtgcactgccagcatatcaataagctggttttaggatcaacagcagcaggagtagctggtgcaacaaacaatccaagcgtacaaggctgatgaattgatgtgatagcacagtaggctctctacatctctacttggatcattctacaagcagtcaaagcttagcatcattataaaatcaccaattcaccatgttgcaagagctgcagattaaacgggagagggcacaatccagttcacgagcaacacagttaaaagggtcttggtggcatcatctacattttgcccaactacatggtagagactagagagagatagtattaacaaggagataaagcttgcaagctctgcgcagtgaatggcaaggcgctaccagcaaaaagtctacgacgctacataaaccagttaactgtcagcagcccaagtttttctgctactttgtacataaaccatggatgatcagaggaagatcgggttggtcgcctcggctcccaccccgtccctgtgcttgaacattttcagctgcacacagagacgcccgctccttcggaggttctcggtgtccctggggagccggatttcgtcgcggtcttgctgcctccgcttccttgattccggcgagctcgagtccagcgaggaacaggacggcgtcgtcaggtgggagttctgccagaggtccatgaccccttgttccttgaactcctccgctccatcgagcagagggacggtgccatccagaaccatgtcgcacttgctatcctgataaggtatcagcacggctgggaatcggtccgcccttgagttcggagggcttgaaggatcttgaaagaatgacggcttccccctctttcttgggttctttgacctgacattgctgtcctggccctgccctgcttgatctttctttcggctactctgtggtggggagtaactcttgatcatcatacccactctctctagaaagcttgcaacttccacagggagtaactgtccctccaggtaacgatcaattactggaaaatcattcctcagatcttcaacctgcatctcacaaacagcaattacaataaggaccactatgcaagcaaaaacatatgaaggattagttcttatttgtagcttaccattgaagagaagttctgagatgtgctccgactacatcctgcagcatcttgtttagttatagactcaattgggagggagttgatattggtttctgcaggagtgaaacgacagccaaccaattgatggaactcctcgatttcacgagcatactcaaccctccagtccttccacttgctccaagttcttcttgcccacatgggcaccccatggaggcgaccttgttccctcccaaactgcctagaaaaccgatcaggtacatacacctcttttatgttaaagctgattagccatgtccgagaatagcagatgttatctgctgcaatgcaatattctggaataattgcaggattcatgtccttgtaaggattccagttgacctgaaaatataattaattaatataaaataacacaacagcagttaaaatctttgttataaatctataaaataggtagacttgcacttgcatcagaaaattgaagctcatcgaaaacttttctccattccatgactttctttctctgtccacgcgttgctcctccaaagttccatcgacaggcccggggcagcaaggtgttctgattcttttgttggggttgagttaatggaagatattcataaatccaagccttgagagaacaaaataaatctcattaacaaagataccaaatatcatcgacaatcattcaaatttattcaaacaagaacagtaccatgagcaaagttgcactgccgagaaactgggtagtagcattcggtgttacagcaacagatagtcctctgtacaaatgagcaagggctgcagatccccaggcatattcacgtatctttctaaaatcagccagaagaggtaaatatcttggtgatacaaatcccctcatcgtgtcaggaaataaggtggagccaacaaggtaaagaaggatgcccgggtgctgtaagcaatctcgttgatagttg

SEQ ID NO: 59827 - DNA, 2006 bp, Oryza sativa
acatcacggagtgatggggccatttcaaatcccatgaaatgtgcagacttagtatcattggtccatctctcacaaaaggctgtaagcaaagaacgatcaatagtaaatcctgtggtgagggcaagatgtccaagaccactagcattaactagttgttgctgttcgtcagttagaacccattcttttagcttccgtgtctgctggctgggaagcagaacaccatatcgctgtggaaaattgagtgtctgcatgtaattttgttcacgatggccaagtgaaaacaaagggagaagcagctacataccgtccagatttgtgagcttccaaccggtctccgtccacttggtttttgttgttgtgttaccacaccttgagatgcaaggtccatttctcctggaaaacataagagggacaataaggtaattgttctatgatgcttggtccattgttaaacaaaaaaggaaaaaaagaaaaagggcagttgtaacttgtgtggataatacttaataaaacagtgtgtaaaaaaggaactatcaacacaaccagaacaacaaagtccataaataatgaagcaaaaacaaaaaagtgctctctcatacttgtttacgatatcagtgatagctgatgataagtaaattcacgcacaccatttatgaccaattattttgacaagttcaattttttactatattttgctaagataatgatagttgtcagcacaaagagagtcaagagcaaacgaattcaggtagtctgttgaattatttttctgcttactgccaatctaatagctggatataagaactaaccacacaaaagtgtgcagtatctcttgtaataaagagatagccggattcttcatgcaatttgcagggctagattatagtctattgaaagtagaaatgcatttgctatataactcttaggtttatttctagaaacacaattgtaactttcatacaggtatagtaaagaaagctctaaaatatatccaataaatcttcaccattataatctgagctcatcctgatgaacagtgacgatatttctccttttatttgataacgttgtaatttctagcccttgatagagaatatggtggcttctgttcagcctgttctaatagtaaataaatgctagtggtagtctggtggataagaatgtcgtgatgctcacatcaaagaaaaaagggggatgccgtgatgcttgaaaaaatagcatgtgagggcagttctatgtacctcaactgtcggcaaatgaagatcatgtagtaaaataggaagccatgcactaaatcatactacattatggtgatatttccatgtaataatgacaaaatgcaagagtatatagtaaggtcgatcgcttaacacaaggaaaggggtaaaaaaaggaaagcaggaaaaacaaatatcatccatttctagtgtttcctttttacattcttcagtattgtactcttattattttattaagaaatgtaaacagtggcagagaggttttgacagagtcattggcttatgaattttacccctaagtaattgatagttgagatctaccaatgctaatcccttctcatcctaatatctgtctagctatccagcaaataaattagaaaaaaatattctaactatttattttcaataaatgttccaggatacactttaaaaaaatagctccagttgttattaagtgtgtatggatttcagttcagttcagtgtggggtacatggtacccagatacccatagcaaggcgttttgggccatgcggcatgaggtgggccgagtgccctaggcccacatggttaacttgtaaactaagaaagagataagggataagttggccaatcctatcccttgtaaatagatggtaggtacccggattatgaaggctacactaccatatctagccggttgcctccgcacctatataaggagcaccgggaaaccctcattcttccataagcgccacgtgctattcctacgccgtgctgcgcactccaat

SEQ ID NO: 59828 - DNA, 3556 bp, Oryza sativa
aaggaagaaagaaagaaagagagagagaaaagcttatcgagtgcgccccccaccctccctctgccaggtgggccccacacctctcccccgcaacccccatgtgggccccgcgcgtcagcgtcccgagcaccccgcggagccagccagccagacggttcgagccggaccgggtcaagggcttcctctttcctcttccgagttccgaccccgtcgcgttaaaaccctagccaccacaaccacgcactcctcttttttttttccccttccccaccaccaccaccgcctctctcgccggcgaagagaagggggaagcgcggctgcggcggcggcggcggcgcgcggcggaggtagggcttgaggtcctgaggtctctcctccgtctcgatctgcctcctaaccccgaagcgagagggattttgcgcggggagggtgggggtccgtacagcccggccgccgtatcccggggtggcgctgaggctgccatcaggttggttcgctactcgtttccttgtcctcgttccgctaggcaatttcggtgtggtggtggtttcgtggagtggggttgggggggggggggtctgattcaatttctagggtttcgagcgaacaggtcgccttatcatgaaacggtttcgtcgattggggttgggattattgcgattggtactgcgtaggtgagtttatggggattgcttatcgagcttcgtcttccacgggtagagatccggtggagatttccggcgggcctgtagctcagaggattagagcacgtggctacgagaccacggtgtcgggggttcgaatccctcctcgcccacagacttccaaaggggaatcgggacttgtagggttagggggggataaattggggcttctagggtttggtcgcgaactcacgatatttgctagtgttatgctgatgtgtgtctctctgctctgctctctagctgctaggttaatcgagattaattctgtatgtatggatgctcaccctagctaacggttgttggtgcatcaaaaatagaaaccaaaagtggaaactgatctttttgttgtgagttatagccattaattgcttctgttactgtccacatttaagtgcctccatgttttttgtaaagcctccatattattacacatgtatcaccataaaaatggaaatgaaggtatcttggtagttacctacctaccatagaataaatcaagtttacaccgtaagcatatactccctccatcccattatatagggcgtacctgctctaacgcacagaccaaggattttcaactgttccgttcgccccgatacgtgaagttttgcttcatccgtggaccttgatcttcacagtgtgtatcccagcaggccacgcccacgtattgctgggagagagaggccttttaactaagagcaggtacaatagcaggctataagccagctataaacatattttaaggagataaaagaggagagagaagagcagcgagctacagatttgtagccagctgtagcacggactccaagacgcagtgtgtatgacaagtaggaccatatattaatagtgtagtatgtaactattgtacgaattggctattaaattgactatagatgatttggagctagtagttggctatactattaaacttgctctaagagcacccgcaatggtaaagtaaggtgctatctataaaacatgtacatctcagcaatagactagaataatagtaaaccatctcaatagtatgtctacatgggtatctatagctctctaatacattgcctcgtttttctctatagactatctccaggttagtagatagctttgctctctctcttcatttaatctcttctaagtaggaaaatatgctgacatggatctcttatagagagcctatagataaccattgtgggtgccctaagcaaactaatcagcaataatgcatgcttgtaaacggaagccgaggaggtgatgtcttgaatgcttgcatgcatatgaatggaaacgagcaaaacttaaatgcttgcatgcgaataaacggctgtcgaggagatgccgtcttatattgtgggatttgagtaaaatacaggtacaccctatatattggggtggagggagtggtgctgagcaagaaaaaaagagattgctttctctcatagctttacttgattgttcctgttcctgttcctgttcctattttttctttttctgaaaaaaatgaattttagaattagcatgcaatattttcattgcacgagaaaaataataggtgcttagttctttgtcatcggttcatgcatgccacatgacacctcttatcttgctgtatctatatctgcccatgatgtgctagtttgtggtactagaactaagttcaagcatacatcttttagggtatgtttggatcctaggcaagagaaatcttatcctagcttagcaaggacagcagtttgctaacgacaataaaaatcttacttctgtgggaaagcttgcctataactgcccaggaaagcttgcccagcttgaaggacataaggcacttctgtgtgacagttgatgcatgctaggctacaaagccaaatgttgtgcttagtttctttgagctatggcattgctgggccaatttgtgctggatatgtgatgcgaactgataataagatataaacctacccttagtttcgagctgtgttgtttcaattaaaagcactggttgatctgccagccggcaatccttggttgtctgcctgcgcctgtaggtgaaccatcagcaaacctttttgtgagttgaagatagtatttttcggtagcctttgctagacttaacaaagctaaaaacaggattcctcaactgatcaagaattacatttatgcccaatattgagttcacaccatgagtttcattcacaaaggatcccttgctgcccgcctgccatgcactcctctaaccacatgtcaatatattattattccttattacaataccctaattactcgaataaagtaaaaaaaaaaagaacaaaggagcgaagtatagtgtagttactccttccccaccgaacatatctcgttccaatcttctatatctacttccctcctgctcacgtacaacaattccaccaccaaatctgtcaaccatgatggcgtacctcgccaccggcgaccactagaggcctctgtacttgggtttttgattttaggcagttccatgacgtgtcttaaaaaagagttgagttgatctggtgttgtcccccaccaagaccagaaccgccagcacgctgttggtttgcccagtttcgctgcatcccttgcctctgcgctgatgatgcaggcagatcaactgcttcctataacgtcttggcccatgcattgttatcatcgaatggccttggcacagccaacattgacacttacccagcgctgtgggcctgcgagatatggtgagaggtatcggtgtccgatgtctgttaggcaggagcggatgtgtggtgaatattgacacgtgaaaaaaattaataagcaagtcatatctggttgcatgtatgagaagtttaatgtttttgcca

SEQ ID NO: 59829 - DNA, 1813 bp, Oryza sativa
caactttgatcgtccgtcttatttgaaatttttttatgattagtatttttattgatattagaatataaaacatgaatagtattttatgcgtgactattttttttagtttttttaaaaaaataataaataagacgaatgattaaagttggaaaaaaaaactcatggctgcacttattttaagacggagggagtaccaagtttgtagtttgaacgaacgcttattacttatcacagcttatggatcataagaaacctaattgaaacaccatcctaaagacatacaaagataacacacctctactttcctaactcacctttctcgtttaccgcgtgcacgcttttcaaactgctaaacggtatttttttaaaaaaaaaaattctatatgaaagttactatctttcaaatttattttaactaatactgaattaatcatggacttaacgcttcttcgtttcacttgctatggagtgagggttgcaacacaccttatatatgtttgtcctcctcaaatacgatacctaaaaacagagacaacactatatgtttgtcgtcctcaaatataaacactactataaaaaccatttttcctaacatagaagatcttattttcgaaggcggacatgaccctcagagccaaatgactatctacaaaaatataaatcggggtgaaatttaatgtccgtctgcgaaaatattttcgcagacggtccacttaagcggcgcaggcggaccacttcacaggcgccgcttaagtggtacgcccgcgaaaatagacttaatataaatagacaggcgggcctaaattttttctaagtcccctcacatcttctcctctcccctcccctgccctcacctctcctcctctcctctcctcccctcctctcccctctccccggccgccggccggaggcggcggcgtgtgctcccggcggaggaggcgaggcggcgcggtggctgtgctcccggcagtggcagcgaggaggcgcagccgaggagggcggtgcggccgaagttcgggcggcggcgtcggctcccctcccccctccctcccagatctggccggaggagggaggggggagccccccggtggcggcaacggtgtggagcggcagcggcggcggcggtgacggcgctgtccgggcggcggcggcggctcccctccccctccctcccagatctggccggaggagggaggggggaggccggcggcggcggcgacggcgctgtccgggcggcggcggcggcatggagcggcgacggtgcagtccgggcggtggcggcgcgggccgggcggcggcggcggcggcggctcctggcgcgattttcttttgttcgttccttttattttcgcaggcgggccgttgccccaactgcgcagtcgtcgtggtgcaggcggacctctctctcgcctgcaaaaatgagttttggccgcctccaaaaatgccttttctagtagtgaaaaacaaattctcaaaattagagtccaatcattctactgattagaacttacacacatcaccgtctataattgacgtcgaaccaaagcgaaagatatcggaaactgaatttcaaaccagccgctcatgcatgcaaatatagccgcgtaacgcacatggaagccgatggcagccatcaagcggccaccgcatgaacacacaaaacgctggacaacgaaacgcctccgtcgtggttgtgagatgaggcggcggaaagttcgacgagagggacgagacatcgtggctgtgagattaggcatgatttgatcgtttgcctatagaaagttaatttagtacccatccatcttcatacata

SEQ ID NO: 59830 - DNA, 7804 bp, Oryza sativa
  unsure (1)..(7804): unsure at all n locations
cgacaaccaaaataaagcatacatgcttagtactatcaaaaaagcaaatatcgctctacaatataaagatatattggcccacaaatatacacatacaattgaacgattttcgatccattattttatccatatatgttatcgatttataaattattggacctgttattttttactattaaatatgtaatacctttctcatgtgcataatgtttgccggaagaaaaaatatatatgcacgtacttactataagccaaaataaaatataagtacttagtaccatcaaaaaaatcgacggtctttaaaatagaactatcaacgatataaagatgaaatatattacttcacaaatatatagatgcagtgttaaactagatctataatataaatatcaaatcaaccatctttaaatgttcatcttttcaaattatttttaaattatatatccaatttgtgatctacaaaacagtactaagtcttcatattggcgttcctacaaatactcctaaaccgccatgtggtactatataatctcactgtcgattttcatttaaattagcggacccgttattttaaaccatgagattagatgtatatatatactaaccgtgaaaaaaacataagtacatatacaaacgtacgttagattgaaaaagaaataaagcttcggtactactattcgcagcaagaaaaactattatatactaaacgttcattaaactttatatgaatattcctaagtcaccatatgacgctgctacaaatgctcctaggccatcacatggtactatataatctcaccatcgattttcatttaaattggtggactcgttatttaccctctaacgtggcgtacaaatggccgagttgagtggctgtatgatgccattgaattttgatatgacatcttaccatttgtattaaaaaatataaatgatattttttttaccatgacttgttttatgatcaacaatctataatctcaatttataattttacatatttatacaactttttaataagataaatggtcaaatgttataagaaaaaaggaagtaatatattttagctttctctaacatggagtatcctaattcaaagatggttgaattttcttttccaatcatactaaggaatatatgtaagtgacatggacaaatctcatgtgttcattgtcagatccaacggtagttctaaggtttccattacgtatgtgatttgtactgtatattttccaacatcctatatatataggtatgtttgttttgagttttttttttctttcggctgtatctttttcccgatgaactgtacgtacctggtgaactttatgtacatacatttttcctagtgaacatgacgaacgtatgcattttctctcgcacgtggatggggattatgacgggaagacaaattacatttttatttttttaagtaagatctaatataatggtataaaataataggcccatcaatttaagtaaaaataaatactacatattatttttttctccgaatatctatgattttctctaatttattatagcgtcatgtggtgatgtaggaacgtttgtagagtaccacgtgatggcgtaggagcgttagtaggaaatttaatatattattaatatataatagataaattataatatgtgcttcgggctgatcttgaggggacacagctacccaacttttaaggtaatagagaaagaaagtatctacggctatgaccggcttcacccgttagtgatatttttaagaatatttatatgtggatttggaaataagtgagacataaacacttagctaagtagtgtattaatgatatattaggcttattttattatgcgcaatttcatgtattgatagttagcgagcttttaaaatagtgataatgagttgttacgatagaatttatatgtaattgggacaaagtgtttttaattctgggagacgttcttataatttaagtatattgaagtctacgatctatctcacgacgtagaaatagtgagatatgacttgttttagcactattatataaaacaataaataaaatgcccgcgcatccgcgcgggcttccttcctagttgcttgaaaagtgctatcataatattacaaacttattagtagattaaataacttgtttaatataaagttgttcaaatttttcaaaagtttgatagaatctttgtcctcaactttcatgatgagagggagtgtttttattagcatataaaaagtactcactccagtcataaatgattaaattttagataagatttagtcaaacttatatatttttttattttttttattttttccccgcaaaaaaaaacttttttattttttttataaattaagcacttgagaagttatctatggtcagagatcaaatctaatttttaacatcaaaatcaaatatttatgaccggagttccaagaagtactttatcttttctaaggtagtaaaatgcattaattatcataccaaccccaaatcgtgatggttagctcatatttttagcggctgtttatcatgtatctttcttaattttaacatctcccagtgggcaatttcatgtagtacctttcttaaatttaacatctcctagtcccattcgagttgtagtaatcaccaaccaatgcaggctcaagtttaagctgctaaatacagctgaaaaacatatatatctcgatatatatacagtcgaaaactcaaaatgagccctgcacaacatctctctgtatcctgagagcagggagaacagtagttcacgacatggtcaagatcaatcaggctcgaacagaaaaaagacagaaaaattagggagtttcaaatttatatgaaaaaaaattcctaaaagcatatttgaaacaaataattaaatcatctcctttccattgaaactctaatataatggacgatactacagagatcttttttctagggaaaatactacatagattttggaggaaaattcgtaaaagctacaactttagaaaaatttcccttgaatctgtcttttttatttaattatgtcagtgtcaaggataagacatacctcctatacatggattcatggaataccgcaataccatatacctgattatatacgacaatgtatcatttgattacgaaatacgacagataaagaagaaaattaccttatcggaatagaatgtgttagaatcctgtcggagggtgaactcctcaagcaggggatagtgagagccccttgttggttcggccaggggcagcaggtgagactcaagggctcggtggatagttcagtgcataggggtcaggcccctcaaggacgatgagacaagaggggtttatataggttcgggccgctgagaagcgttataccctactcttgtgcttagctaattgtgggagaaattacaagatctccttgttggagtagaaggtgttaataatgagggcaggagaactcctcaagtgaaaaagggctcaacccctccctaagtaggcctggacctccttttatgaataaatggatagagcctggctccaattctggtgaaacaaaaagcaacgagcttaacttcttaattggaagaactccctgatctaattagacgttaaaaataaattagtgcctgatatagggaaaggctgattttcctatgagtaacccagtatcgaatactggtaataatatcagcaaaagaacgttctcccgtgcttccagacacgctgagctccccaaatttttgtacgttcaaaaaaggaattgatgccgtaaaagatgggatcaaccagtaaatagaaaattactgatatttcatccttgtgagattattaattttgtaccaaaggtgtattttgagtataacgaattagatatgacccaaaaataacaggggccaaggtcggccagtgagacgatgggggataagcttcatcgtcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggggttaccacatgggcccaccgaacctattcagggaggataatcacattaaatgcatgtcttgttgcttgccttggaagtctctggcatgccttgctatggcgtggggcccgtcaaatctatcagtctgacacgggggacacgcatgtcattcggcatttaatgagtgaagatttttgggtcttcacttgcgctgggaaacggaaattctaccctgaccgggttaggcaagccgtctccggtcttgatgagagtctaagcagcctctcctcatcacgacgtgacggggggtgtcaggcggcacaccgcctaatatgcaaccagtgcgcaggcgcactaccctgtccacatcggtcattcgaccggtcgcagaccggtcacagtccagtcaggtgcaccatgcgccgcatttaaggcggtgtgcatttaatgcgccatggtgtgctcgctcacaccgccttaaatacggttaggtgggcgctgggggcgcccacctatcgtagcacacgcggcaccgtgcgaagggtgtcgaggtaacccgaccccaaggcatggagggggcggtcgccaccctgcctcgggcccgacccccctcagggggagggccatgtggctaccgggggcagcctcccgggggcagcctcctctctatggccctgatacccctggacccatatcaccgacaaatcctattcagggaaaaatatgatctacactatatatatacaagacccccgtattcagggaagggcatcgaattacaagccatagccaaagctacattgagaagcaatccagaggaagtcatagccgtattcgccgagtagatctcctcgggccgtcctcgacagtttctagtcggcggattagtctagtcgtgaaattcctcattgtaatcttggtgatattccatccataaatccatataatctagattagggttattactatccttgagggtccaaatcagtataaatctttttccttgtctgctcgatctgatctcacgtctgcaggttccaacgattcccatactctacaaatcccgtctgcgggtatagcccgtcgacaaattcctacttttctttctatacagtatatttaagcacttattttttctaattcctactcttttacacattatattcaaacattcgttttttatttttctgtattttgtaatctgcatatttattgttagaattaaatgggctagccccgatttaatcatactaatttcaaaggcacacaattaatgttaaaagattaatcccaccttggaaccaatgagaagtaagttgctaaatgagagcacatgtcgagcggttaagatggtggtcgaactgccaccgcgcgctcgtgcgccgagtcgagccaaccgggccgagttagcggagcggagcaacggggctggcgagccagccgctcgttttcttgtcttttctgtttttatgagaaagcggaaccgatagacaataagctctctacactgcttcctctacgccaggttcttcttcctctacgtcgagcagcaatggaggagaagacgccaacagcaacggtcttcctctacgtcgactagcaatggaatggaggagacgccaatggcaacggtagcgacaacaccaacaccatcgcctttgaatccggagcgttctccgcatatcactctattcactttagtgttaacatgttactagatgatattattcttgttattagcatgtttgtgtttagtactatcacttgatcatcctcctgttattcacatgtcatgtttagtatcttgttttttattaaaatatgccgaatctatctatctattatattattaaaacagctttaaaagtagccactgcgttcactctgggagctagaaattctcacattaatcggaaaaaagaaaaagaaagaaaaggagagttcaagtagaaatacaatttaaaaatagctaaaattaggaattaaaataagcaatattgaaagaagttttcatataagaacccaatacgagattaatcaaaattcgaaataaaaataaaataaaatccaaaattagaaaaaaaaggagagtctaagtaaaaaatacaatttaaaaatagctgaaattcggaattaaaaataagcaatatttaaagaagtttccatgtaagaacccaatacgagattaatcaaaatttgaaaaaaataaaataaaatccaaaattagaaaagaaaggatagttcatgtaggaatacaattttaaaaaagttgaaattcggaattaaaaataaggaatattaaaaagaagagtccatataagaacccaatacgagattaattaaaattgggaataaaaataaaataaaaattcgaaattagcaaaaaaataaaagaagagtttcaagtaggaatacaatttaaaattagctggaattcagaattaaaaataagcaatattgaaagaagaatccatataagaacctaatacaagattaatgaaaattcagaataaaaaataaaataatatctgaaattagaaaaattaaaagagagttcaactaggaatacaattttgaaacaactgaaattgaaaataaaaaaataaaaaaattaaaagaacacaatatgatattaattaaaatttgaaaaaaaaataaattctaaaattggaaaaataaaaataagatttcaattaggaataaaatttataaataactaaaatttgtgataaaaataaagactattgaaagaaaagaccatctaaaacacatgacgagataaattaagtaacatacctataaaagagtagagtggtgacggttgatacaacatataaaaactgttgataaaacaccaaatagatcctaatgacgattaaaaggagggacgaccagcaggccatgaagaaaacgagcaaggcggttgccaggacttctagatagtaaaaaaaaataaaccccatttgattatcatattcgatttttaaaatctcaatgactataaaaaggagaagcaacgagcggggtttataggagtatagttgcagagcagccaacggttgacaggacttctagaaaataaaaataaattccaacgatagttatgtttgatttctagaatcacaatgacaataaagagtaggtggcggacgggccatagagaagcatagtggcatcattttacgggacttctaaaaattataaaaaatgaaaccctaatttttaaaggttcggaacttctaaaaagtaaaaaaaaaacaatgataatcatgttcgattttaaaatctcaatgacaataaaaaagtgaggcagcgagcgagctgtagagaagtacaatggcaaagccgctaacggtttggcaggacttctagaagtaaaaatgaacccaaacgataattatattcgatttttaaaatctcaatgataataaagagaagagatagtggacaggccatagaggagtataatggcaacgtttgacgggacatatagaaattaaaaaaacgaaacccaacgtgacaataaacttttaaaactataagatccaatttttaaaaattccaaagagaatgaatagaaatagtggtagatcgagcaagcaagtaaaggaggagatgacataagtggtagcaactggtgtgacttttaaaactatataattagaaacatggggattgtcggtgacatgggaccgggggtatcttgactagaggtttggggcagctgcagtcacccacgtggccagaccccctc

SEQ ID NO: 59831 - DNA, 2227 bp, Oryza sativa
cccatctcgtcggatggtcatttggaaagcagccatggcaaatctccgcccattaatgagggagtaacatggagatccccgatgtcaggcgagtgacggcgctgagcctcactcaaggacaagttgtgatttaacttccaggcgaaggtgcaagccaagttttggtcaagatagggtaggtccccacccaaaagaaaagtaggtagaagtggtgcatgtggtatccccttgagatataaaaggaggaccttgcccaccaaaaaggaggaggaaagaaaaaaagaagaaaaaaggaggctagaggggttctggagcctgaactctctggctctccggctctctgtaactccttcacacacagatccaccagaacacaggagtagggtattacgcttctcagcggcccgaacctgtctacatcgcccgtgtctcgtgcacttgctctctcacgaacattctccagatcgatcgagggcgaagaacctcacttagcgcccccggccgaaccggcaaaggggggcctgcgcggtctcccggtgaggagctccacgctccgtcatctggcgcgccaggtagggggcgcgtgtgtctttctaagccctcgtcctctttcgtgtgcgccaagcttctcctgctcagccccatggccgaacgggcagtggcgcacaatctctctccgagcgctagcggtgacgacggggagcagaacccgcgccgtcgagctcgtactccactgtccccctctcgccgaagtcttgggcgggaggaggcgctcgaggaggtcgaaagatccgcgacttcgccgcacgcgggcgatggagaaggacggcgagacggggagcgtcgtctcctcgtctacggagatggcagcacgccccagggcgcgctccaggctgcgggcgcactcctgcgtcacccacccgtcatccctgatccagagactccaacccgacgttggctagatgacgtggccaatttggtcatgacggcgcagcagcgcctaggcgccggctggcggtcctccgccaccaaggccactggcgttgctactgctggctccgtgtcgtcgaggcggagggcgcggcgagcggcggccgctacccgccgttcgtccgccattccctcgtcaacgcctccaacccaagaagatgtgcgtagggggccagatgcctgcttcaatatcgagcgccggcgcaatgatcgccgtgctgcccacgcatcggagggcgcttcctcgtccggagcgccacttcggtccgggcacgggggccagccccccatgtccccggttggcggtgccggctgtcgagcctttgtggcgagccttcggaacgtccgttggcccccaaggttccggcccaccatcaccgaaaaatacgacggaagcgtcaaccccgccgagtttctccagatctacacgattgggatcgaggccgccgggggtgacgacagggtcatggcgaatttcttccccatggccctgaaaggacaggcgcggggttggctaatgaacttgccacccgcgtcggtccactcttgggaggatttgtgccagcagttcaccatgaacttccagggcacatatccgcgcccaggtgaagaagcggacttgcacgcggtacagcgaggggacgatgagtctcttcgctcgtacattcagcggttttgtcaagtccgcaacaccataccgtgcatccctgcacacgcggtgatctacgcgttcagggggggtgtgcggcacaaccgcatgctcgagaagatcgcctccaaggagccccagaccaccgcggagctttttcagctcgcggaccgtgtggctcgcaaggaggaggcctggacctggaactcctccggttccggtgtggcagctccggccgcccccgggcccgctgctcggtcagggtggcgggacaggaggaggaagaagaggtcggcccattccgacgacgagggtcacgtcctcgccgtcgagggcgcttcgtgggccacccgaaaggggaggcctgcgagcgacaaaaagaaggaggccggcgctcccagtagggagcgcccgaccggcaggtggtgcaccgtgcacaatacctccctccacgacctcgtggactgccgcgcggtcaaaagtttggctgagcggacgaggaagtgggaggaggagaggaggcaggagcgccgtgagggcaataccccggcggctcccgccggcaaccggcgtggtgaggccaagcag

SEQ ID NO: 59832 - DNA, 1172 bp, Oryza sativa
ttcctgcagcccagtctccgcaccgcccgcataaagctgaaccccgacaagtgcgtgttcggcgtgcctgcgggcaagcttctcgggttcttgatctctgcccgaggcattgaggccaaccccgagaagatatgagctatagagcggatgcgcccccccagcaagcttagggatgtgcaatgcgtcactggctgtatggccgccctaagtcggttcatatcgaggctgggagagaaggcgctacccctatttaagctcctcaaacgcttcgggccgtttatctggacggaggaggctgaacgggccctcactcagttgaaggcgtacctcagttctcccccagtcctggtcgccccggagccagaggagccgttgctactctacctggcggcaactccgcagatggtcagcgcggcgttggtcgtggagcgcgacgaggacgaccctcgctccgcgcatccccaccttgtgtcgactcgacccgggagagagcagggaggagaggcccccgagccgaacggtggcccgaggcccccgacgatcggagctggccctctgcccgcttgtccgaaggtgccaggcgcccccgacccccaggatggccccggggccactgcgggaaggccgcgcctgtcgccttccgaccccgaggtcgtcgacacagaagccgagtgcgccccgcgcggcctctcggacgaaaagcgccctggagatgcggcccctggcgaagaggatcggccccgccaaaaggtgcaacggcccgtctactttgttagtgaggccctccgggacgccaagacccgataccctcaggcccagaagatgctttacgctattctgatggcttcgaggaagttgcgccattatttccaggcgcatcgggtcacggtggttacgtcctaccccctcggccaaatcttgcataaccgagagggtactggacgggtggtgaaatgggcaatcgaactctctgagttcgatttgcactttgaaccacgccacgcgatcaagagccaggccctcgccgactttgtggcagagtggacaccggctcccgagcccgtctccatccccgaggtcagctcgggcccttcgcagctgcctcacaccgcctattgggtgatgcaattcgacggctccctatctcttcagggcgccggtgcgggggttac

SEQ ID NO: 59833 - DNA, 1142 bp, Oryza sativa
tgaagaaagcaatccttcgacgagcttcaaggttctttgggacattgatcatagaatcccttgaggtcaggattgtgtgcatgcgccttacttgtttatagaaggtggggttcttctcttcatcaggcagaacaatagtgtccacgaagagaagcctcgtaggccttgactgtgctaaaccttcattcctcagttgttccatgctccttttctcagcctggaagtcacgaatcagaacatcatagagagtctgcagagcattgacaatcttggtaatgtccttctcaggcttcagaagtaagctcaatatagcaacaagctttgcatgcacatttggcagtacagacatcttgtactccacagtgaacttctccatgctcatggattcatcaaactcatggaacaattgtgtcacaatcccatgatcctcagtatcatccttgattatcttaagcagtaagtactttgcactatcatatacctcaatcactgcacatctacgataatcgttcttgcagatcttcctccaaagcttgcgatcaggtccttttacctcctttgcctgaccaagtgcaagtgatagctcattacagagcaagaaacatggccagcggattacacgcacattccacagctcaggtgggagctcaagaagctcaacttcgcgatcaccaacaatgtcctcctcccggaacttagtaattatctcattccaaacaagagcgaatctccgtgcctccacctgatttgactcgattttccggaatgatcgactgaagccataacgtagctgtagcctctgccagaaatttcgaagccggttgggcaagaaactgcgttcattcacctgctgttcctctggcataatgttgaatgacattgcacttgcaaagaactggaaccgaagacgcagctgtttcatgtccctgatctcccccagatgtgcaaatagccccacaaatgcacccgtcagtgaagagaagatagcataccaaatttggatatccatgagatagatcaacaccacaggaagccacaatacaaacacagcaaatcggttgctcttgccaaagaactcatgccaagcgtaatcaatctttttaacttatatattccctgtgtaggctcacgagaggcctgat

SEQ ID NO: 59834 - DNA, 767 bp, Oryza sativa
gaatggcgccttggcagacgtcgaagttcaagcagctttctgtagccatatgtatgatttattatttatttgtttgtctaaggttattcggtcctttgtaacgccgatgaaaccgatatattcagttatattatcatcgtatgaactgcaatttcgccaacttgtctatggcaaagtttcagactattaaaaattatctttggctggaacgtgaattcataattcataacaagacgtcacttcggtgacatccgataaaaataattcataacaagacgccttgaaaggtttaagttttattaaacgaaagaggaacataatttagattgtcgcagctaccaatcacactaaatacatgattggaagttaaataaaatcaagcttatagtcgaatgaaataaaaaggttccaccttcttttcccagtttagaactgaacaagtaaacagctttgtttaccgttaccacaacgacactgcaagcttaatacagctagctaccgtcttttactcgtctttcttctgtgcgaatcctgggggaaaggactccagccttttctattccgctcaaaagaataaggaaatataacgagaattgtatatgaggaatacaggataatcagctatcaagcactttgtgttcaaatatcaagcctcttatacctctgctctattttcctttcgagagctgctcctatgttttttccatagtataacggaaaaaaaaggtcaatcaacaatatgacaggttaaataaacattgaaagta

SEQ ID NO: 59835 - DNA, 1658 bp, Oryza sativa
cccgctgcggccgcggcggcggcggcggctgtgtcagcgggtagcacgggcgcgtctggttccggggagaagacggtgaagcgcatgatgaagagcccctaccagcttgaggtactcgagaagacgtatgcaggtgcgtggattctgatggttttgcgaggctttggaagtttggagaatttttttggaggatttttgggtggggaattgaggttttggtgtttggggatgtgattttggtttggtgcagtggagcagtacccgtcggagaccttgcgggcggagctgtccgcgaagataggcttgtcagacaggcagctgcaaatgtggttctgtcaccggcggctgaaggatcggaagccccccacaaagcggcaacggagggaggaagaagctgcagcggtgccattgatggcacctccgccagtgttgccgccaccagcactgccgctgtcaagtggcgagctactgatcggtgctagtagcccgtatgatgagccgccgctgcccccagttcactcgcgaaggggtgcagggcggtcctcagcagtgcccaggttatctgcgccagatattgggcggaggtattatgaacctctaccagtaatgctgccgccaccaccggtggcatcgatgcagctcatgccatctgagctccgggtgattcattctgtggagtcgcagcttggggagccactgagggatgacgggccggtgctcggaattgactttgatccacttccccctggctccttcggtgcaccaataggtatgcatcccaaaaccctgcacttcgtaggattaagctaaaacttcaaacttgaatgctagtgatatatattttgcaggctgtcacctttttatagtactgttaagccaactgtgttttgctctgcagttgttgaaatcaaataattttgtttacttaattgcttgttgttcctgcaagtagggaaatcgcaataggatgttatgggatggacactgtttagttaaataaagaaaatcaactggacttgttacgaagatgcacaaaaatgattgattgataaataatgtttcaaaagcaaaggtgaattttgagtatttggccagttgccaagtttctatgttagcaagaccatgttataaagtgttaatattcccaatgactaatttagcaaaaaggacatattgcaggaatttttaaataaactgaaaagctaccatgctgtttaacaaaactagctgaaactttgtgtgaaattttggagagctagacagttcatgcatctgcagcgatcaatgtacactgttattaatgaacccaccatgatcaatggtataaatctttctctttgcctatgattaacatggttaattctgtacctctaaagtgagcctgatggctccttttagcctttattgaatagtatatactagtaaatatacattagttctatccctgattataacactatccaccctaactcattgtcatcaattgtctcttaccttttattttatcatcttccctgtgcattgctacacttctctattgccatcgttgcacagcctcctaataactacttactttgcacattgtagtacatgaaaatagacattttgtgcatttgcttttctactgctcattcttgtagtagttagtcatgaaaaat

SEQ ID NO: 59836 - DNA, 2342 bp, Oryza sativa
gtttaagacggcagccagcgaaaatgtttttttttctgacggttacactataccagccgccagagaaaatactgaccaagtttataagaaaaaacgacgaacggagcgaacgctccgtccgcctccacctccatcaaagctccatccacccaagcatgagcatcacaaaaatttgaatcattagcacgtggctacagtatggcatcaaccatcccaatccattcacacatcacaaattcaccccaaatctcataatacattcaacagattaattcacaaatcacaaaatcaccacaaattaacacatccattcacaaatcacaataaaataccaaaaaaattcatccgttgttcttaaaaaaaatccaccgcctccacctcgccaccgccgctacagagccgtgccgcagcctccatcgtggcccgtgcgccagatctgagagagagagtgtgtggtggtggcagagagagacctgggaggtgcgccgcctcgatccgtgtgctcctccgctccggatctggtcccgtcgccggatccgccgcgagccgcctcgggcaccgccgccgtgagctgcacgagcgccgccgcatcgcgacgcacgggcgccgcctcgatccgcgtgctgctgctgctgggctcgtcgccgctgctagtggggagtgaagggggaggagagggagaggtgggtggagagaagaggatgagggagaggtgggtggagaggactgtagcgcccgttccgtcgtggcgcctagcgggaaaattatctcttaaaaaccctaattgcgaaatttgtttctttgcttgttgtctagtgtccgtgccatctcaagatctcaatccccgatctatcgtcgagttcaattccgaatccaatccctccaaatcaaattcctccgcaaaagtccattttgcctcccccagggtcgatgggccgattttccctcggcccatcttcccctctctctcccggctctctctctcgctttccccggcgcgcccccgctctctccctctctccctccgctccgccccgcgccgcgcgcgcgagcgcgtgtcgccgcgccgagcgcccctccctcgcgcgccgcgcgcgagcgcgagagccgcgccctgcgcccctccgctcggccccgcgagccagcacgcgtaagccgcccgcgccgagccaagtcctccctcaccgctccctcgctgccgcttcccgcgcgccgtgttcgcgtgcgcgcgcccgcgcggacgccgcccgttgcaagccgcgcgcgcgtgccgaatggtcgaccgcccggtcgccgccgccgtcagcctctgcacgcgcctgtcgccaatgtcgccgctccgctccaagccgtccccccgtcatcgtcgtcgtcatcgcccggcccccgccactccgcgcgcaagccgccaagggacggagccgcgcccctcctccctctgccgcgacgctcccgctccccttcccctttttcccgaatcggcaaaggggcaagcccctttctccccctcctttttccctttttcctcctcgccggcgtcatcctcctgccgccgctttggctgcaagcgccgagcgccagctcgcgccttgaccgttcaatgtcggtttccctcgcccaaaccgacattgccgcccatttaagcccaagccctccccctccaaactctctcattttcgcctccgcgccattgccgccctctgtttcgccgtcgccgatcgtcgttgcgcgtgtcggaggagccggcacgagcaaggacgcggaagaggactccggccgcgccctctccttcctcttccccggcccgaggccggagagattactcccgcgccgtcggcctctcgtcacagcgccccgtcccgcacggtagtgcctccctccgttcttcctcctcgctccatctcctccccttagatttcggtagtagctcgagtagcctccccgtagttagccggcgccgccccgactgttgccgtcgctcgccgtgtgctcgccgccgtcgccgcccgagctccgtagcacccgctcgtcgccggcctcgctcggcgtagttccgcccaatccgacgctagcgtcgagttcccgacgccgcgtagatgctctcaccgccgggaatcgacctctcgtgacctcgtcgccgtttccctcttctcccgccgccggttgccgccgccgcaatccgccgccgtcgagcaacctccgacgaatccgagccgttggctcgtctccccttgtcacgtgcagccgcccggtgtgctcgcttttgcctgtatcaccgtggttcgctccgctgctcgccgccgccacccgccgtccattcgcggccgggtcgtcgtctacct

SEQ ID NO: 59837 - DNA, 3643 bp, Oryza sativa
cctcccgcgcgcgcgcgctgggccgtcttgggccggccggtccgttaagctcggccgagctgccccaaatctctgggccgcaccctagccacccgagaaaagtctatattccctccctcctttcttttctttttcttttccaaaaaggatttaattaaatcctttttccgttagaccaaaaatccaataatcttagaaattcaatatcttcccacccgtaaatccgtttgactccgttcaacttccaaaattcctcaaatctcgagatctatctaatggcacgcttagaggtcattaatagggctttattttcgccgtttgttgagttgttccgtttcgcgtgtagttccggagcccgaagacccgcagtgcgaggatttcgaggatcaagctccagatctcgagcaaggcaagccacctttgaacatcttgagcctatatttgaaatctaattatattgcttgcaaaatattatgcattgataggatcgcacttaatctattgttccgtctgcaaggcagattggcggacctacctaaattgttgcatttgatcctttccttgttaattgttacagcatgtccccttgtaaccacctagttgcgtcttgatattcgtgcatcctgtgcgagtatcgacggacgccttcaaacttataatctgaataacaacttgggtaaaacttgggttttacgaaagatttggaaaacccgacacctgggtcggtgcttgcgaactaaatgaatttccagaaccgcggaccggggaacgtaccgggtgtacggtttcccgctctcgcacttaaggaccgatttccttggaatttcatccaaacataagataagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgttggcatatggtaaacctgtatcggctttcaaaatgccttgtcatgaaagcttggaggtctcccgacgtggctgatccccacgggctgggtgatccgggttagtaatgtcgtgtgggtaaagtgtaccccctctgcagaggttaacaaactgttcgaacagccgtgcccacggtcatgggcggatgtgaggtgattcctagcgtagttttgtttgactactgcttgtgaaattgctgttgtgaaaaggggttcgatgtttgaaaaatcagcagctgacgggatcagctaggcccgggtggccgtttgaaaagttgttggcccgggtggccgtttgaaaagttgttggcccgggtggccgtttgaaaagctgttggccgggtgccaaccttgttgcaatcctaaagagtgacacattgcacatactccgaccggacgagacgcactgtctcatccgagtcgtttgagaagcactcacctaatcattttagaaaagagttcaaataaaataaattgcaaaaataacagcctttccttgaagcctgcattaaacacttatttcccctggcttgctgagtactcccgtactcacccttgctctatataaataatccccccccagttgctgaagaagatgaagtggatcctgctgacgaggagttcttccaggagcaagtcggctacgatgagttttagggtttcggcctagttcccaagtcgtgcctgtgatgattggtccaagtcctggcttccgctttccttttgtaatgcagttgtgagctcgggatctgtccgcagcccaacatgactatacttctactctttaataaagagacctctgttgctgtgatactctgtctccctgtgataccagcactgtttcctgggactggtatcgattaacaggttaatttggagcgtcacgggctagttccggtcgggactagttcggggcgtgacaaggacagaggagacgcagtgggtggagataagacacgatttttctggcggaggtgttagtagccgctagtgaaaacacgatttttcttggcggacgcttaagtgctccgcctcgaaaaatagagtttttttatggcggatctcttagcgtggccgccagggaaaatatacttttgctggcggtccgtagccccccatcactcgttacatttttgctggcggttttcgcgtacggccaccagcgaaaattatagggcgacgccatgaaaaatcgtttttctagtagtatacgtttggttttcaagtttttgcacctaatcgtacccacctgccaagtttttgtaccgccaacgcaatttactcttttgatatatttggtggtccacttgtcatcgaaggctggatcaagtttagcgccgtgttcaagacgtgggagcgagaggcagatacggcaggggatgttgtgtcaatggcctgcaaacgtgtctagcccatgtgccggcctcacttcaagcctattaggcccacaacgggttacaagagtgcgtacgcagagttctgagctcatttgacatttagcccagctaaaaattaaaaaacttggtacatgaaacttcttaatagcaacattcagtatacaataggaactttatacataaaagttggcatagaaattttatacataaaaacctttttcatagaaactagtgttgcttgaggaggatgcaaaataaatgcttgaggatgcaaatgcaatataagtacaaagtaataatgatttactggggagggttctacatggtcaccataaaatctactccctccattctaaaatataacaacttttagccctcttctccaccatcattctattcccaaccaatcacaacactcttctatattcacttttctcacctacctccactactcaaccaatcacaaccctccaccattcaattctatatatttttttaataaccgtgtctaactctaaaatgcttattatattctaatatggagggaacagaacacgacgatggcacgatacctcatttattccaagaaactttgctcccacagcttacggaacaagaggaagataacctggtcctctagctaagtcaggggacggaaactagcgatcgaaacgatgactctgacagtgagggcgatgttgttggtacaaacgagaaagacgatgagaccgattgcaacacactcccacagtgactactctgatcatgagcctagctcacctgggctcacttggctggtgggaaatgttggttttaactgtcaggtggaagaatgtggatctttttatcgtcttgaatttgtgggttaatttgtttcttaataaactagatactaaaatattacttcctatacctatacatagattgtcaaactaagaaaaaaattcaatagagaattattgtttgggctgggatattcttactagttgtctagctaaataataagaaaaatgatactttacacatgcataacattttttttatatttatgaaaaagcaagtccttatatttaagcgatcaatgtacaatattgaattccaacattatttttgtatagaacaacatatatatatatatatatatatatatatatatatatatatatatatatatatatatatatatatatat

SEQ ID NO: 59838 - DNA, 2173 bp, Oryza sativa
acgcttcaacatctgtgcagcaactcactcgacacactccttattgtccagtaatacgtacgtagacggtttagtaaactccttttttttcactcgatgcaaattacaccatgctagcatgcatgatgcacatttgccatcatatacctgccctgccctctccatctaacctatatatatcatcagtcaaatatgtttaatttgctttgttttcttccatccatcaggggccaaagcctgcacctcctgtgtgcacctcaaagttaggcatcgtcaaatgagcagaagcagccgccctgttgttaggagccgcctggctgtagccgattagcgccgccgctgggttgtagaaatctacaatgcctgcagcttccttcagcatgctgctgttgttgccaccgtggccgccgccgccgacgccgtcgttatggtggtgttcagcagcagcattgctagccttgatgttgttaccggcgacgaggtcgacggagaggtccttggccgtcgctgccgagccgccgccgcactgcctcggctgcgtctggtagaacaccttggacacgacgagctcgccgtccttctcctcctcgtcggagcccaggtggtactggtgcatcacccagttggtcttctccggcttgcgctgcttgccgtagttggtgtagagcaccaggatcttcttgtaccccttcagcttgccgccggtgaacaccggccgcgtcttgccggtcttgtgccaccgcgtctcgccgccctgctcgtcggtgtgcaccttccgccgcttccgcgtccccgtcgtgtacgccttcgacgggcggtggaagaagtgccggatcaggccgtccttgccgactcctgaaattaacagcggcagaaagagaacagtacggttaatatggtagagtgccacactgccactgctctcacgaatgagttaagagatgcaaatgtaatcaattatattacgtgcatgcatgcaacagcaggtcagcaacacaacaagagtggcttcgtaatcgtagtatccagttgaccagttccaatgtcctgacggctgacggctgacgcagcataagaccattcagtcaaactatatgacgaatgggcccagttaatgatggttttgggccgactccagcaattctctgattctatctctctccccctgaactgttattgtttagttattttttgcgtcctttccatcataagaaaaatacttgctcggtgtttcaatacatattctctctgttccaaaaataaatttattttacactcatcccatatgtaccaatataaaacaaaaagacataccctcactttatcaaatcttaatgcaattattcctcattttacctacattccagtgcatctattatttactttcacaaactctagtgcaatgagtgttcaaaaataaatttattttaaaataaatgggagagacaaaaataaacttattctgaggtagggagtattacactaccaactttattcgttcgtatagctttgactattttttttctattagtataacaataatgtgtaacaaaaatttagtattgtaaaagtacttaaaaaaactgctcttttgatttttattttcaaattaaatacatatttgagagatgttgatggttaaactttaaagtttcaccgaataaaattatatttaaagaggaggtgggggcgtatttgtgttttgcatctcttaacatagaaatgaaatttcccaggttgtaaaaaaaggaaaagattatgcatgttaactacaaccttaaacttttataaaagtgtgatagacaatcctagaatcttcatacattatttaaccataaactatcaaaaatagattactttttatacaacggactgaatttaaagtggtttagtggagatatggcgctgaagggtgaaactatctttgaatttaaagaattactcaccgataaacttcagaaaatccttatccacattatggagtacttataatataatgtagatagtagtggagccatgctgtgaccctgtaaggtcaattaaccccgatagaatttttgcaatcaagtactattagtaaaaaaaatatttgcatttcgcgcgaggtggatcttgatcttggctcagccactgaatctaggtaaatttggtgtaatataaataaaatgtatat

SEQ ID NO: 59839 - DNA, 3799 bp, Oryza sativa
gaactaaataacacatttttatttgtcggcttaattattttcttacagatagaattaatttaggtcagctgtaatctatgaaatgtaaagaaaattactttgtaccatggaaggagcatcccctgcatgcacattgttttccagctcaacacgcatatgtctaacagactaccacaccaatattcccatgagaataccccacgaacggccgctagctccagcaccaacaaagaaaaaaaatgtttgcgttgtaaacgacataaagagccacttgcattggttttttaatcataattaattcttgctagataaaagtatttgtaatatatcattttctactggattaatatatagtacaatggtgacacgtggtttattattgataactgcttatatgaaaatagagttccatgaaaataatatgatcagtgcactataatgtctcttggtgcaatatttctatcactatggtagaaaatagtacaagttatcctgtggaatggaatgcaacccccctgaagaatataatattatatttccaaaagcaggaaaggcactcataataatttaaagtatctgtcagttattcttaggccatgtttagattcaaaaatttttctttaaacttccaacttttccgtcacatcaaatgtttagacacatccatgtagcattaaatgtggatgaaaaaaaaccaattcacagtttgcatgtaaataacgagacgaatcttttgagcctaattatgccatgatttaacaatgtgatgctacagtaaacatttgctaataatgaattaattaggcttaataaaattgtctcgcagtttatagacggaatctgtaatttgttttgttattagtcttcgttaatacttcaaatgtaatttgttttgttattagtcttcgttaatactttaaatgtgtgtccgtatagttcaaaaaaaatttggcacacaaactaaacatagccttattgcacaaatatacaatgactatcctacccatgcaaatacaccattatatataggcaaattaaatactaggaatataaaaggataagggaaaaaccagttcatattgcaacaagtcttttcaaagtttattctccctttgatctgatgttgcgtgtatcctgcatgacgtggacctttgatgcactgtgctgtcacaatcactcgttttcaatgtgaaataaacttttatgcaagtaggagaagcaattacttcaaaggcaaactttagcaatatttatacggtatcgtgctcaaatgcaacaacacacgatcggacatacacgaaattaatgaaaaacgcaaggacgatcgacatgtatataccctagtgtggatgttacaaatactaagcggctacgcatgattgacatatatgaagcaaggtcatcaaattggaaacgaccagtaaaactttatatcaaaatagggaattttaaactgagaatcaaccaagcaagaaaatgttttgtcaggagtacttccgtgacggacagcacctatagtttccacgtcccgtccagatctgatcatctttgcaattgctatagctgatggcacaatgtaattaagcatgcaagctagctgatcgagacaaatgcacttatgtagatcatgaactgatgaaactaaaactgattcgatatatgtcgatgagtcgtaggaaaagcatgcatgtaagtatattatacgtgcctggaagcctctcgggatgggtgtagcagatgccgttctcgccctcgatggtggggatgaactcgtcgatgagggggtggagcttccgcgcgtcaggcctcgccttcccttccaggtgctccagcagctcctggtccgtcgggtcgaacttcaccccggccggcagccccggcaggtcctggatcgtcgccgccgccgctgcctgcaactgactctacaccatgctcaatgccatccaacatgtacacaggagaccgatcgatcgatcgagcagggaggaagctctagctagctacctgctcatactgcgcgcggtggccgcaggaggggcaggtcttgatgaggttgacgtgctgggagacctgctgctgctgctgctgcttcttggccgcggccacggcggcggcggtggccaggttgttctccacggcgcgcacgtcgttgaagctgttgcaccatgtcatggctgtatatccaacaagacgagagatcgtgcagagagagcgagccagaaagcctctctctctctctctccctgtccctccctccggcctacgctttgctcgtcgcccccatatgcggcaaacgttaaggcgagaccccgcgcgcgggaggagggagagagaaaggaggagaggagggaacaaagcggcctgatcgacgagagggagaacaaagagaaaagagaggggagctataggaagcttgtccctgttaaaagctactcctactagctgctaatcgcctaatcctccctgcctgccttcccggcccagctgctgcgcgcggctactgattttctatctccatctggtacagaccaaggaggagaatgaaggtggattctaaacactaatcagagtttgatttgttatttttgttacaacttatagaagttgaatttgaacttgcatatttgtggggtgatatattacatatgaatctatcttgtcaaatttttttgaatttttttcatacacatttagttgacatacaacaaatgggtgtatctacctaggtgattaaaagtgtttccggaggagaatacatcaattctcacaccaacttttcggttggcgcttcccaggaagatcgccacgagctgatctctctctctctctctctctctctctctctctctctctctctctctctctctctggcgaggcaggcagaggcagaaccggcagtgcatcagctgtgtagtgcaggcaacaactacagaaagaacactccacaaaaggagcaagagactaggattagagagagatcgagctagctataggggacgtacgtgcaacagctagctaggagatcaaaatgaaaggctaaagcgatcgattaacaggctgaacaatgagcgtttgacagctatgggcatggacggatatgtgtcatgtgtgtcgtcgtcgcgaggtgtgcggcaacacgcgcggatgataaactgacaataaatcaatcaatcaaactccatagctaattaagctaggcgaacagcgagagcgaatcatagaacgcaggggatcgatccgggcgaatgatgcggtgttgcttggccctcaagtctgggcttgctaatgcaaaccgtatacgtgagccgcaaaccaggcgccggattctctgcgcgcgagttgctgcgtgtacatctcccgatcgagatatggacgtccggccaccacacgtacacaccacaccaatttgacggttaacatttacacgtcagaaatgacaccggccggtgttaatatagcttagctgctgctatagcgctggtcgtacgtactactactatagtatagtccatggccaaaggcttgcgttgcaagaaagcacctacacttgcgattaaccggaagacccgtacaccaaacgcatatgaaatgcatgacgaagcgattggtcgaggagaaggttgcgcgaaatgcgtgtactttggctggggtttaaattaaaggcggcaggatgacctacattctcctccgcgcgcgcgagaccccggctggtacggtgcgcgcagggtgtgcgtgcgtgcatgtacgtgcaggtagccgctgcgaaatacgtatacgcacacatatactaaccactgtt

SEQ ID NO: 59840 - DNA, 1839 bp, Oryza sativa
gggtgcactcatggtgcaaaagtagccacgtaaaagaaattgccaccttactattccaccttagcaaaattgccacatcagctttgacatgaaagaactatctcatttcatagaaaacccctaatagcttttttttttccaatcacattcctttttaactcaataaacaaaacaaacgtatgcatatcttcttccatctttcttgacgtgatcctaattgagaggtagctgcggtggtggcggtggcggtggccgcgacagcaacgacaacgagcgaaaccattacatcgcggtggcgatgagggctccgtgtgtcacattagttcaatccctaaaccaataaccaaaccaattcaagtcgataaattgctgctgtcgacgtgatcgccgcaagctttgggatagctccgactcgacgagtttttggagcatatgctcctagcttgttatggtaaatcacttgctgatggttgtagacttctattttttgttcatttgatggatgatgcaaagtaaaggtttcattgatctatacaatggctgtattttttttgggttttcacttgaatatcatattatttgttattacaattcaatgaagtgatctaatggtactagccacgagattggttgcactaaaattattggtgtttcctgtagctgtatacgatataagagtaacattggcaatgagaaattcttgctagatgtgttgtaccattatcagcagcatatagttagttggataatctgcaaataatcttagtgtattattttccttatgcggtatatcacatcaaccaattattttgtagtgcaggccatgagaaagaagaattcacaattgaactgcatcatggtgggtttttctttttttggagttggcagtagtagaatttatttggatgagaagatggactggtttgatcattgcgacacgaggaaaacagatacatctaaaaaagaagtaattgaaatataaaagttactagggacttttctgtaaaatgataaggtcaatgctcatgtgtcactttcgctgaggtggaacaatggcgtggcaacttttgcaccatgagcgcacccacctagccaagttattgtactgctatactcggcttttaagtttttgcacctaattgtatccacctgccaagttcttatacagccaacgcaaattactcatatcaaaatgtgcgtgggaagtgtccgactccggtccaatccatgatgcatgaggtagatgagtgcgtatgtcacacaaattaggggctagttggccacataatcacatatccgaagcgcgaaatgcacacgctttatccgatatcaaaccaactgtaacagatggcagaggatttgcttcctagttcccaactcccaagtggccaacacgaaacatctttgaaggagaacttcagaaaaactccccgcgtcgctctcgcgcgggcggctcggggggccaaaaaccctagccgcccacgcctccactccttccccctcacctcgccgctgccggagctcgccggcggcgtgtaaggaaggcggcggcgaggcttctctccttcgtggtgttcccctcctcggcgcgacgtggacggggcaccatccctcaccagcgcggtcagaggcggtggcgcggctcgggcgaggcggccacggcggcgaggcgtggggaggcggcggatccggcgcccccaaggccgaatccggccacccctcgcctagatctggcgcgccggcggcgcgacgcggcttgaggcggcgcggcggcgtgcggctacagctcggtcggcctggctcgagcgcggaggcggagggcagctgcggctcaccggc

SEQ ID NO: 59841 - DNA, 3712 bp, Oryza sativa
ggcttcggcgaggccgccgttgggcttggcggcggtgtggagcgcgctggcggcggggtcgtctttcccgtggttggccaggcggtcgctgtgttcgaagagctcctccccttctttgtggggagcttctaggcacggtgaaggcgttggccggtctaccagaaagactcaggttgccaaggcgaggttgttcccggtccggtcccataggtcggattcgacgtggaggctgaagggcggcgtggcggaggtggcctgggtcagcgtgctagggcgtggcggcggggtcgtcttccttgttgtcgaccaggctaaccctgtttggcgagctcctcccctctctgcggggagcttcttgacaggctggtggcggtggtcagttgacaaggaaaactcaggttgccgaggcaatgttgttccatgtccggactcccttaagttggattcaacggggaagccggcgggcggcgtggcagaggcggcttgggtcagctacctggcggaggtggttggtgctgtggcagtcttgtcgttggcaagactggaagccggccggcggtggggcgtcggttgggtgtggtggaagccatgtgccgccgatgtttagatggtggtttcggattgggcaacggaccatggcggtagggggtaccgagcgaaagcttagcccaacctttgggccaacagtgactacgctttcgggtcgctttcgggtgtggtaaccctcctgagggcatggttgaggtacccctcctcccttggcaaggagctctgggtgaaaaccttgttccgtttttgggacggatgacgacggcgtcttttggcgtcgcgaccttcctgagggcgtcgttttagagtcttcgcgtcgtggtggtgttgttggcccggtggcgatcggtctcgcatagcgacggccggttcggtgctcggctcccctctctgtagcgtgtgtttgcggttggcacttggttcggggcgtgtgctctagtgcacatccttcctcgacaaccagctatcgatgtaaaaccttttcttgtaaccttttcttccaatcttaattgaatgacctccttcggtctttccggcgaaaaaaaagtggccaacacgacaagttagcaacacccagcacctgaccgccgagagtttccgcactccgctcgcctgcgcggtgcaccggtgacactgtaccgaaccctgcgcaacccaatcacgtaagctcaactaaatttggcccaaccaaatgctcgctgctagtactagtacaagcgataggggggtctagaatgctcgctgtccatatattagatagataaactggtgagattttacagtcgacggcttgctgctcagcacttgcgctatatagaaagagaagtaatcaacattacagagaaaaaaacgtgcagattggtggcaggacacatattagttcatccagcaaaactttagactgtcacagacaacaaacgctatgtcacacaatgtatgtatagctccctctttgggatgtggacagcggacgtacagggttactatcagatactgcccaatgcaaaaactacaccagtacagaaaaattacagtggaacgcatacatctgcatatgaaaaaaatcgtcacactgaaaagaatcgaatccgacagatttatatagcaggaaaggtggtgctggtgatggctgtgttgaagatggcttatctgctgattcggtagaaggtgcaccattgtaacggtgatattagaatcaagatcacttgtcgcgtccgtcatcaccggtgctgctattttctcggcattgtctgctgcttctagctataccctctaagtgtttcagcaggagcaccttcaaatgtaggagctccagaggttccttgagtcagggagtgccctgcattatcgggtgccttgaatcataggagtgccatgggccattggagaaccttagcttctacctatccatcattgacccatcgatcagtcctcagcttcaggggtactatattgctaggcaggccaagttttcgcaccagatcttttaattgcaacaggaggtgcagatagaggaggccgaaaaacactgcagcagcatcagttccttaacagttggtgcgtgatccagctccttctgtagcatcttattccgcgttatgactaaattcctcaatgatagacgaccatgggctgaaaagtgaaagatcctttgtaagtgcttgataatacatatatttgagcacatttagtcaaataacaaatgaattctttagggcaacaacaacaacgaacagattgaataaaaaacacttaatggtttggctaaactcatgagagaggattggaaaatatgcaaatccttctctctctctctctctctctctctctctctctctctctctctctctctcttaaagaaatcaatgcacatcctctgtatttctaacaggttcatggttcattggtctgctcaagccatacgccctaaaataagtctaagcacatattcctattgacattttactgatcatgctatagcttgcttaaacatacataatcgaaatatgaataaagacagtgtatagcacataacttatgagatgcaaacaaggaaacataaggttttatcatgtgcatgcatgaacaatttgccactccatattccacaaaatgtgatcaaactggagaaggaaattacagacacttgtgtgtggtacaactctctaataatgacacttttgcagacgagatcatgtgggtgagaacttaatttctttatcacaaaaacagtcattgacaagaaccaaaattcttaatggaaacatccaaatcttttgaggaagtagcaacgctaattaaggaagacctagacttacggacttttgccttcaagcctccctaatttcctttctttctttccctccgatgtatccttaagttgtattctccccctgatctaagcccctttaaaacgttgtaacaactcttttttgccctttttccttctaatataaccggcagccctcctgtcctctaccgtttcaaaaaataatagaaacttactactgataaattttggtcaaagtaacataccgacagcctagtaagttcatggtttccaacatggagtgccagacctcgtagaatttctccatgtaaaagcacgctttatagaagtcgcagcagccaatctcagcaatgctagcctgtctggtggactctgtggcatcgataaagtctgaaaattcgttgacaaacttcaagatcgatcccttgcatgccatctgccatactttcttgcttagctactggtaaattaagggtgtgtttagttgggaaaaaggaaatttttaggtgtcacatcggacgtttgaccggatgtccgaaggggttttcggacacgaatgaaaaaactaatttcaaaacttgcctggaaaccgcgagacgaatcttttgagactaattaagccgttattagcacatgtgggttactgtagtatttatggctaatcacggactaattaggcttaaaagattcgtctcacgatttcccctatgactgtgcaattagtttttctttttatctatatttaatgcttcatgtatatgtccaaagattcgatgtgatgtttttggaaaaaaaatttagggaactaaacgggcccttaagaaagtgtgtaacatcggtagcagtagtttcttgtcccacatcctggcaatg

SEQ ID NO: 59842 - DNA, 2967 bp, Oryza sativa
tattcgttttcatattttttttaccggatacaaaaacgaatacggataactcgaatacggatagctcgaatacggaaacaaatacggattatctcgaatacaaataagaatcgaatatgatcggacacgaatacggaaacaaatttttctcggaacacgaaaaccaactcaacttctaatagaaacaaatatcaacatatataattagctcattttatataaaataaggtataatttataaatattttttaaaatttaaataatattaatagtatggactagtgttaagagataaactactattaaaatctataaaggtatattgaaggttatagagttagaaagaaatggggtatatctcatgggtcctgcggatattcgaatagcactgttcaccggatatccgaattattatccgtatccgacggaaaccctgataccatattcgtattcgtatccgagagaaaatatccatattcgtatccgtatccgaaatatccgagaattatccgatccgaaaggtatccgtatccgtttttgtccggagcggacggaaactatccgctccgttttcatccctatatgcacctcttggatattccaggtaaatgatgaaatgcttcaacagcatatccattcccagcataaacttagttaggtcatcggtgctcacgaccaagtctagtggccctgcataattagttttgggagtattacatatttacgtctcgcactaaaaaatgtcaacaagatgcaatgttctaagaataaacatataccattcgcgacactaactggattgacatatcctgcaaggcaccgacatcctataccaggatggctgaggataaggcatgtgcgcacatatacctacaaaaagggagtgtcaacagttacaacccgatgtaattcaagataaccataagaaaaaggtaacacccctttttcttctttgcaaactttattccataagaattcgttcatgaaatgagataattaaaagttacacacttacctgtcaacaagtcagagaactccatctctgacactgacaccaatcacaacaagggatacaattggtcatttcagctcaaggggaggtggcttactgtaacagatacccctcctccagcagcagcaactctagcatatcttctatcatccatttattttctgaaacacgcccggcgattcttttttttcttgaaacactggatctccgcaatctgaaacattgccaatgaggtggtctaagatgaaagtttggtaaaaataacttacccaatgtgcaatttaatataccaaagagagaatgggttaaccagcttgattttgactaataagtaaataatgacataaaagctataatagaatttttgcaaatgggcgatatgagactacaggtcacataagtaatattgcacaacaagaccacatcgatcacattgcatcaaccaacaaaaaaatcaaagatattcaggaagcacgaagcccttacatggatatctcaaaggcaacaaacacacctatacatgtataactggaaattctaagatgacctttatttggaggaaaatggatcatctgaagcaaatgatgacccacttcccccaaaacctgataaaggatatagctgttgtgaactgattctacaagatttagggtgtgtgctaagcaaagcacgtccaatgcaatctaattatctgcacgatcacaaccataaataccattttattgaagcaaagcagtactgagtaccgacaatagcatgcttaactagttaactggagaagataatattctactgctgaacaagctgaaaaattaggtctccaacacactgatcaaccaactaaatgctcaaaggtgaaagcaaagaacaacttatccgtacctgttggagccgtcgcaagaatccgtgcgccacttcagtgatctccgatttctgccgccgcgttcttgatccagccgtattcgccaagaaccccgcttctatctccgacttcggcggggtgattcttcatctccgatcttcggaaccgccttcttggcctctggtcgcgttcttgaggttgccccgccaggacctcgtgcgctccgaaacttctcgccgttcttgttgtactcgtgcattcttggattccggccgccttcttgccgccgatatgaacccttggacgccttctttgtcgtcgtggtcccgtcgatgctggggccgccgccgtcgaagaagccgtcgccgtggacgttgggggcgccgccgtcaccgtggacgctggggccgccgccgccgtggacgctggggccgccaccgtcgccaagaagcagtcgccgtggacgctggggccgccgccgtcgccaagaagccctcgccgtggacgctgcggccgccgccgtcgccaagaagccatcgccgtggacgctggggccgccgtcgtcgccaagaagccgtcgcggtggctgcctctccccgaaccggctggtcaccatcttcgcctcttgggtcggcagttcgacccgcgttgttgacgcatatgctatctcacggcctcaacacgtaaaaggaagtacagaattgggttcacatagtccgacccatcaaacgacacaatgttcaagcgtccaaccacgaaccaagaaacacaagaaaattccacggcaccgacgatcggcgctcagcgctgacactcattgagcgaaatgtgaacatgtaggtcctcgctgagcagggaacctgttaccgcaattgcggcaaacgaatggcaagatcagacgatggtgctctaaacgatagtggcgccacatgtcatccctcgtgaggcgtggtactgtcaccgtctcatcgtcgtcagaaagaacacacaccctgcacaagaatcggtgaccacgagcccacagagaaagcaccggtggtgctggtgccccagcctggatttttcacattttggtccttttaaaaaacttatt

SEQ ID NO: 59843 - DNA, 8329 bp, Oryza sativa
ccgagtccgtatgagaaagttacgcctattttattagatgacatattttgtccgtttcggtagagttttggaaaattctacaagtcacatattttgtccgtttaagtttattttttatacggttggttcctatgttctcctaagtgtgaaaaaaatatcaaaaaaatgaaataaaaataaaaaaaattacatctctatgtactgtttaacttatatatgtcatttcatgtggttatattttgaattagattaagtaatttcatatagtggtagagtgcattatgtttaacatgctgatcaaagggttttactaaaggaattatggtctaattttagtgaaggtgcaaagtagactgagtggtatgctagctattttcagacttagttaagtggtagttcgagtttaaattttttttgtggttggttgtatcgtgatcctaagtgtgaaaaaacatccgaaaaaataaaataaaaatgacaccgttgcaacttcatacagagaaacaggaatggaggcggcggcgccagcatggctggcgccctcctcctgccacgtcggttcgcgtgcgccactgtggcaggaggacggcgccagcctctctggcgccgtcccgttggatgacggcgccagccactctggcgcccaaaaaaggaccatttctaggataagttttttcaggggtctatttgcgaaataagtttttcaaaaggaccaaaatgtgaaaaatccagctgccccagccccctgcccgttctccatgtcttcgatgtgatcacacgtgggggagaggaggcgttgacgtgggatgaccagtgggagagagaggaggggttaatgtggggatgacaagtgggggagaggagaggatcgtgttgcctaattccccttttataataggtgagcagataactatgtgcgtcaagccgtcgattaatgtaccgttgatgtacagttgcttcccgtgtactttaacgtgacagaaaaaactacaacaccagttagctcgattggatccaaacaaaatatttataataacaaaaataacttacatatttggactccatctttagcacatgacaaataattttagtaccgaaagataaaaagatacgggggctgttcagattgatgtcattttcagccatactattttttttaaagttgtcaaaaaaatatctacgtttagtttgttgccaaatttggtaaatatataaaaaatcttaccaaaattttgacaatattaccattttggctacaatctgaacaggcccataaaatatcgagagagcgaggtcaagtaactcaattgattagtttctgtctacttaagtcatacatttggtctacttaagtcatacatttggtacatatatgcttgtatttacgattcatttatgtgattttttcggtccgatttttatccggcgtacgtcgccacctccgtcactccgattttgctgcgcaatgcggcccacaaagtctggagtctgtgcgccaccagcctgcagatcgctcctatcgctacaaatcagacgggggagttgggactcctctctgtctcgcgtcggcgagccgttgacacagtggttccagggcgcaccgtacagcatggatggagcaatggagagtagtatcaggcgcagcagattcttttttcacctgaagatgtacttcagcacttaagtctttacggatgtgtataaggcaagcgattaaataaacaatggtcacagctgatcataatagtgattattttttaaaagtatacatatatatggttatcaaattcatatactctgtatttatatgtttttcaataatgaaattttattttggcctttatttcaaacataaatctatatccatatatctttatctatacctaattagaaaataggtaaggcttccgggtcgcttggttccggcgtacgattacgaggatgacggcctggatctcgggaatcctgtcgtcgtcttccgctgttgtctcggcgccgatctccatcgtcgtcgtcgatacggcggcggccatgaccagtattgtctggcacccgtcgttcgcgatcgttgtgatcgtgatggttgtcgtggtcccggtcctcgtttgagcggtctcctcgatttatgttatcatggcaccgtgaagagacatgacgccgagagcgattcacgttgtctcgtgtgcgtcgtgcttctcggcggccgttgatttgatctcggagatcgccagtgccgcgaggtggaggggtagctcgttgaggtgattccctccgttccggatcttcaccattggcctcgccagttggtggctgctcctggtgtgctgcggtagtggcttcttcaaacgcgttgctgaggttagtcaccgattcccgtagtcgttctgtccaacgctcgaggtcaacgttcagaacgggatcgtaaggagttttcctcagtatcgcttgaacagccctgatatgctgggctagagtagttgattgattccccacttctgcgttggcgtgcgctgacgtgccaacgtcatcgatagccaatacctcccacggcgcgctcgttgtcgatgacccatagtcctcaaggagatgtaagaccgatggttcatgaggatcgatatcgattaccccaacgaatcgatctgaagttagagtcgctccttgttccttgctgttatccctgatggggacatatgacttaggagacggagctttcatggcgccgagaaagactttgcagctcgagaggtcatgattctttgtcttgtgaataggacaatagacatcctgagttggagaagtacgttgaattccatgttctttgcaggcgcgaatttcaacacggacgttgaggaaaacccagcaatcttgcagagtgtgtttcttggttttgtggataggacaccaagaccttgtggcttcggaagtcatctttgtcgactcgtggttcatgtcggaaggacaaggtttgaccgtatcagaatccttctcgagcttagatgtcatcgatattccgttcttcgtctcgatgggaggatttttcgacatggaatcgccttggttcgtagccactgcgttctcgtctccagtcattggaggactggttgagatcggcgtcgtggtgtaaaccgggaagacgatttcgccgacttgagtccataccagcattgttgaagcagggagtactgaggctagtgctgacgttgttgtcgacgaagctggatgacatagtagtagaaccttgagtaccaaggccccctacctggcgcgccactgtcgacgggtgatacccgtagaccagatatagagggtattggggtacgttggtacaaggacctacgtagtacgacatcaagcaaacaaaagacaagaattatactggttcaggccccttgataggtaataaccctaatccagttgatgtgggattatatggtagaaaacacagattacaaagggaacaagggaacttgtcggatccggcgagattgtagtcgagttgtttcgactagccctcgacgatttggctcctcgtaggctccggcttcataggctgtgtaggttgtgttggctctgagattcgatatcttaaaccctccctagggggtcccttttatatcgcagatctagaggtctccacgtagaactcggacgtatcagaccctatacgatacgccaacgacccagttctgcccgagtaggattcttcccgtctataaattccgtgaaaggtttccttacaatatacaggaaatattcgcatgcgcgtggatatgacatatcgatatgtaacgtatatcgaagggcaaagggtatgcctaacccgtaaccctgacaagcatcattttaattgcttatgactgtttattaatttaattctagataaactaaaccaactagaaatttgcctacatatttctcatgatgtgtatttattttatgaccaacgttgattataaattcatataggttttatttatattcatgtttataaattatttatgcctgacagtgacgtaattcatgaattatttctgtttaactttgtaattaattgagccaacacaaattaattattttcatttatccacgtgtttcgtgttttacgtgtcgcataaaagatttttaaacacttgattaacaacactaacccacacgccctccgtccccatactcactaggtgttcatcgcgtacgcaggtcaaaggaaaaaaaaaatcagggatcagagatcgaatcaaatcctaatcacatacagcgggcaaaccacaaaatcgaatgtcgattaaaaacccaagcgacaaatatcattcaaagtctatatcaaataacacaaaaaaattaaaccaaagtaaggaaaaagtataatatatagcgatccaaaacgtttttacccgttgcaacgcacgggccattttttttagtaatgataaaattataatcggatagtagcgcacacaggtgcatcaataactttttccacattattaatttgatttagagaaaagaaatcatagcatcgaaggagtaacccaaatttgtgggggccaacttttcatgtgtactcctggtaaaggcatcggcttcatcaccttagccttcaagtcaaaaactccaatatcacgtggcatttgtttacggtcccaaaaaaaacttaaattgtcttcagtgaagtagatgcaatctgcacctaatccggggatcctatcactcaaaaagaatgttgccgagttgctaccaatgaagattgacgcgccaccaaaatcatgcacctctctccactcgcttcctctaggacgctcgtcaagaataaatgcttggaattttactgttggatcgggtttaagctcaggctccggctccggatcatagcggtagttgtggacttgtgggctgcattgtaattgtccttgtcattttcctcctcaatagcagtgacatcgtcatcgctttcagagtcacatcgatcggtactatgctccctcaaaatgagcatcaggtttccgttcggtgactcggctaggtacttcctaatgtagaggggcaggccgtcttcgtctcgggacataaactgtggagcaacgtttcttgggttaaatggtgttgtgacgtcatcatgttcccaggtttggactacgccatctaaggcccctcacagtgctcctagctgtagcgtggcttagtactgccacgtaggtttttttcacccgtgtcgctcggccacgcttctctgcttggacgctcgtgagtaaactaggatgcgcaaaaccaagcctggaaaagggaccgcgcagaggaatcgaggggaggcgctagcgctgtgggcgtcattccctcgccgcccggtgctctcgcgcgggattcggccggcgaaatcccctattcaccctcccaaaatcccctcccgccacaacattatttctcccgccacagataggattggaagagaaaaagcaagaaaatcttgaagattggaagagaaaaacagatcggattcacggcaaaatcatcacagaaaaatcatcacagaaggcggtgccggcgaattccaccacaaaccaccactcaagtcaactcaaatcaccccaaaccacgctgaaatcaactcaaatcaccccaaaccaacagatctggacagtgcaagaaaagaacagcagcgacggctcatgctcctcttcctcgcggcggcggcggctgccgggctcgccgcggcggcctgtgccgcgcggctccgccgctccccggggtccggcggcgctgctcgaggtcccccttcggcaaggtcgttgcggtggaggcttgccccgctcgagcctttcccctcctcctctgccgccacacgaggccagcgccgcgcttttgcccgccatcagccgcttgtctgctcccgtctccggccgcccgtcggcgacgcatcgtccactcccgccgctcccaccgctcccgagtccgcgcgggaggagaagcgagcggcgcggtcgacggcgaggcgcacggcggcggcgtcctcggcgcggtcgccggattcgcctcggccaccggagggaggggaaggaggcgcaggggagaagcggagcggcggcacgggaggagaagcgaagcggcgcgggaggagaagaaggcgatggcgatggagtggaggaggagaaagtcgctaggggtaggtggggaataaatttcgtcccgtaccccgtgtctacacgcttgggtaacgctgcactgtgggttcggttttcttcacttgtggctccatccaattaagccacacatagtatgggtgcttgcactgtggggtgggtgtctttgggccaacttttttggcgagagctacgggccccatagctcgcactgtgagaggcctaaggtgaccatgtagaattgtcctcggtaaacgatcacatcttcatacatgtgtcgcgtttgcaagggcatccattttgcatcacgcccacgagcaagcacaaccctgttccttggacaatgcatcatcatgataagtattcaccagaactagggtcccacaacgggacggctttaaggagacgagatgaccggatttcctccgcagaaatctcaatgtcggagcaccatccgacaaacctggtgtggccctccggccagtaggtttccacgaatgaggctactttaaacaagaacctagcttcatcaccgtcagttcttggaagggcatcaaagtaaccggtagtggtgatggatggcagcgagtgttgagtgccggagatggggttaaggaggtgcagcccgcacttgtcatctgttgtcacaagccaacccttcgccgagccaatccacatacggctttggatggcaggggaaggcagggtgattgagcgacgccgtccatccgagaaagagtagaagtccgcgacggctagatgttggggggaatcaccggcggccggtagcatgagccaaggcggttcaggcttcggatgaaggcggaggttcatgccgtatccgccgcccgcttccacgtcttgcagacggcgccaaacttgatccagtctgcgaggactaggcgggttacaaatgttagagtttgtgtcgaatatgtgtacgtagtcggttacagtttaggacttggagttgtaataggtattaggactagagtatgagtcggactctatcctaggatccctcataaatagaggggcgtgcctgttgtaaccgcatggcgacttagcatagcgagagggagcggctgccggcgtcgaccggccgtgagtcgttgtaactctgatacgctatatatgatggatcggggaggagcgcccgtaatcagtgccccggagatgtaggctacggctgaactccgttaccaaatatcgtgtctcggtgtcgtcatcgttttggatctcctatggagttttcttccgtatttagctatcgatgtcgatttcggggctggttttataacaagtggtatcagagcctgcgggaggtccatggtagaggcgcgatggaggtgctccacaccgcgtagcctgctataatgcccagggaggggcattggcgcaaggtggagcacggcggcgatcaacggagtcttgatcggtggatcgaacacttctggcggcggccggaaccgtcgatggctgccttcaacagggagatgactagacatggtgctcgggttgatggcggcggaagcgattggcgatccaatcggtgggtcggacacttcgggcgggtggcttggactttccggtgagctactctcgatagggagacgtgcggccgcacgctcgggttgattgaagctggaggcaatcggcgttctcgatcggtggattcgaacactctgggcggggtggcccgggcctttcgatgtgttgagttcgacagggagatggctagacgtagtgctcaggtcgttcggcggctgggaagacggcatgcgacttgtcggcttcggctcgcgactagattgatggcgttcaatcgaaagtcggagcgggtggatcctataggttgttttggaggtgttgacgaggtatttgcgtgacaaactgctacggagaaggcgcacatacgaaaagcaacggaatcaggcagaagggcagtcaatttcagaccgtcaatgcgctgatcaatcatgttagcacagcaataagcattggttgcaactgaccggcggtattcgtcaccagcgaggttcagcgggaggctaggtggctgcgctagaggtcgtacgggtgcgtggaggctgaggaggtcacggagatggcggtgtgcacgtgttggtgttgaagccgggaccatggaacgtggccagagcccgagtagcaggaagtcggattgcgcaggactc

SEQ ID NO: 59844 - DNA, 1808 bp, Oryza sativa
caagctattgctgtgtctgtctgtccgacatcctcttattatatggttgattatttgactggttggaaaagtacagtatgtgcaatattatgtgcatctgtgacttgtacttatttttatgatggttacttgtgcaaataacatctacaggtacaggtatttaaatattcaaaaaatcaggaaagtactttattacctgggattgtagtagatgtgaaaaatacttttcacggccacagcatgtgcaacttcactaagactactagtatttgagatctggttatgaagtgcaggaaaaggagatgcattttttagctgagcagctcggcgcactcccaatcgaagctctccatcttcacctctggagatcattacaaaagagaagctttagtacatttcgagttagtggttcatgagcacatgagctataggcctacctgaggaatagcactgcatccccagatactagcttcttcttgttgataaacccgctccatccagtggttaaaaggtgcctccgtggttggcctgtaacaattagaggcagacctatgagatattcatggaccataattttctcaagactcctccaaattgcaattagcttaactattagagattatgtcgcaatagctgtagaaataggtagtctatgcataaattaaaataatttattgaaaacactcccagagtaagtgagcagagcctaatgagaaaaaatagcatagtttgctcatttttatctcatccagccagccaagttacagtttggtttgcttgtttcgtctaaactggacagccatctcgcttccaatacctagacatgatagatgtatctaaaaaggagacctggataatcttactaaaagaaaaaacatatatatactaatgcgttattcggtgaacaaagtacagtagttcaacctaaacagcctgtgatgtactataggaagatgtaggactgtacagcccgtaggttactaggttctctcacgcattaagaaaattaatcccatgttcccagggagaagcctaacaaccaagctgtatgacatatatatggtagttagtgatagtacggctgatatcccagtcaccaagataggctaaaccggcgaatcacctcgatagatatgtctgaacctccattccgtgccgtgcagatcctttgccacgagctcctggaatggcctctgcaggctgtagtcctgcaggcgccaagctgaacagagtcaccacacaagcaatcaaacagatcacggtgaggtagcttgtcccaatcgatatcgtcccgtaccagcggcgggaagcagtcctcggcggcgcggcgaggcacggagaagccgccgtgcgtgctggtgtcggaggccgtgagcgtcttgcagaacatgtggggaatccgggccggccgcttcacggcgtcctcgccctcgccgtcgcaggccgcgccgtcctctccctcccgcatccgcctctccacttcctgaaaaaaccacccagaaataatgttcgtttgagctactagcactgaccgaatgtcaaagatattcatcccatttttggatcagcacgcacgcaaacgcacctcgttgtcggcgaccaacgagacctgcgcgtacacctcgtccgtcgcggcgtccgcctgcaaacagcacaacgggaggagcagaccctctctctcaatcaatacctcgaacacattgcgctcgcgcgagagcagcaagcggcgagcgcactcacgtggaggctgacgtcgacgacgcggcagaacacgtgcggcggcaccgcggcgccggggccggagccgg

SEQ ID NO: 59845 - DNA, 5904 bp, Oryza sativa
ccctactatagatgtgtagtacaacacagtactcgccagtaaatagctagcccgggggtccggccttcttctgcatctcgggcacgattcgttgagctgtttccgaaagatcctcctcttcttgtgtgtgttaacaacctttggttgccatgttaccttcccccctgttggcccggctcgtggtccatggctagcttagatgtgtgtgatattatgacttttcggatgtattttggggccaataatttggtttgctttgtgaatctgagatggttgtatcctgcattattggagctacctagtgtgctgataaattatttgtgaaaattgctctttgtcgatcgatcttctggtgaaaacttctatttgtccctctctaggtcttgtcgtcattttagaacatgtgagttcatgcatacctttaaaaaacttcgatcacaacatatacataacaaaaatatttgtgttgtcactttgaaatgatatcgatagctttgccataagaaaatacagtggaatatttacttatttaactacttttatttgtaatccctccgtacttgtaaaggaagtcgtttaagacaatatttaagtcaaaccttgagaatataaatcatgaatagctctcaagttgttgagtttgaaaatgtaaaaattatatgaatagatttgtcttgaaaaatactttcataaaagtatgcatatatcattttcaataaatatttttatagaaacaagaagtcaaagttgagttttggagaccatatcgctgtccaaaacgacttcctttggcacatggtacttgcattcaaatatatcaaaaatctcttatccaccaaatctgactttatactggccatgcatgtaaggcaccagtatacagttagatgtgggaaggtatatatattatataaaaaaaattccattaaccatccgctccatcatagttatattgttgatgacttatcatggttaaatattgcgattttaaggatcaaccttgctcatttcaaaacagagcattgtatctgtaccataaaaatttgaattaacaccacaaacaaattgtgtctaaaaaataaaaatatatatactttttatggaaagaactattctcatcacatttatcttttcttgctttcccctgaagggcatcaagcatggatgatagtgcttgttgcgttaccatgagtatagcatggggcatatatatggttgagttgaggcagtcctagtggagggtaccattgacaatagtgctcaacttcctacttagcgatacaatcgtctttgaagatattgacagtgaactaagtcttaaaagtgtgctccatgctggccttgagaggcacgagtatatcgatacggaacctatgtatgaaggcaaaagagaaataaagccttggtagcttcacccgttagagggggcattcatatctaattgttaacggtgctatccattaaccaatagaagcaatattttcagattacttatttatagattaaaaattaagtgttgacataaacatttaggtatgcagcgaagatgaatgtttttatgtattaatgatgcattagacttattttggtggtacatatgcagttccatttattcaaaaggcatttagcgataatgctaataagtaacggcgacaatagatgagtttaaatgtatcctgatcaacagtgattttttaatacaagaaacatttttattgtttatattaaagtctactatctattttacaacatattttttttcttatgagacgaaatctataattttttttatatttatatgatgagatatgacttaactcttctaatattatttatataaataataaataagatatccacgcatctttccatccttcctagttgtaataaagtaaacaacgataaagtaaaagatgtgtatcgatgccagtagaaaacaataatggaggtagtcaatatatgctattactcttttgtccacggtgtcttactgcctttcttcccagctagccctgcttttaatttccttactgcacggccagcccgatcaatgcaccgtcattgaacaccaattcaaccggttggttcaggccttatttagatgagaaaaatttttaggtttggttgtcacatcatatatacgtatatacatttgaaatattaaatgtagtctagtaataaactaaattacagatcttgtcagaaaattacaagaaggatttattaaacctaattaatccgttattagtaaatatttactgtaacaccacgttatcaaatcatggtataattaagcttaaaagatttgtctcataatttacacgtaatctatataaccgtgaaaattctttgttttaggactaagcaaggccttgctcatgtctttatacctgcctggcagcagcatgacatcacataacattatgtggcatgtaagggcagtcccaacttatagtgtccataagcagtgtctatggtaccatgtcaataagacatcacaatagaaactacactctacaactcattgtttcttaaagtggaccgttaataaatacatcatctcttttctctaccaatcatatttattattcatctattatgaagacagtattatctctcaatgtaaaacttgatagtgtctagtgcataggttctcgtgttgaagttgtgtcttgcatgagacccaatttcttcctctcttcactctctctcttaattaatatagtgccacataagttaatagtcctacataacaatgtagttaatactatagacaccatcctatatagagggttgggactgccctaaataaactactcctggttttgaccatagctaaaccgtttaagacaggtccgaatcgtgcagggggagacgatgctgaatttgctgagatgcgcgcggcgtgacattggcacatcgctcatcgcatccaatcatccttccttccccggaatataacacatcatcatggatccacgctacgacgacgcgcccatgtcatctctgtactcggccgtgtatacgattgttgacgcatgcacgcagctgccaaaattttgatgccccccctgcggccctgcgccaggctgccactcgctcgctgctgcggcgctgccactgttgactactgatgaatgatgcgccacgccaaccatacgcgagcgcgacggatgatgcgcgcgcgcgcgctagctcgccgtcggcccgtggggagagaggctgcggcactggcagccgtgcatgagtacgtactactgttaactatacgagcaaggaacagggagtaaaagaggaaagacctccccggccggccggctggctggcagctggctcgtcgtagcgatgcgcgcgggagggaggcaggcagtgtgcaggtgtgtgcagcggtagtagagggggggtgttacgtccacctcgcccgctcgctttcgcgctcgcttttatcgggtgtgtgtgggtctctcaagcacagcagtgacagcactgcgcggctgctgctgctgccctcctcgccatggccttgcctgcctgcctgcctggcgacgcccctgccgctgcgctgcgccatcctgttccattccctggaccgcgtccatgcctctgcccccccttctcacgactttccaatctctgcttatcatattctttacaaatttgcagcagcgtcgcgttagtaaattgcggatttcgcaccacctatagacacctagattgacatgagtacactactccatatatatagagcttttgacagaaacacagagtcagtccaatgcaatttagtatactgtcgacttctatcgcccgtaagaatcgaccataccgggaccgtgagcctgagaacggcaccactccgctagtctggctgagtggcagtgaatactgtagatatgtactgctcaaatttactgtagagcttcatccaagccattgcctcgttgggagatcgatgagcctggctggcctaacgagtaacgacattactgtagctctttccctgccatatgtaatgaaaatttaggcaatgtgttaattaaagattctgctaggagcctaggaggtgtcaggtagcaaaaatgatcactactccagttcttttatgaccgtagtgccgaaagtcaaattgcatgcaattcttggagagcttatttccttttctttctttcacgaagaactctctttgaccataaatattgatacggttgactttaaccataaatattttataaccgttcattttatttaaaaatttcgtgcaaataaataaataaataaataaatacatatatatatatagacacacaagtaataacataataaataatatttatataaatttttttaataagatgaatgaaagtcaaccacgtcaaatgtttataaccggagagaatgtttggaaaaatctttgcatagaatagctactccactttgccagctctggcattttgtgtcactgttgagtattgaattaataggtggttatcggcaaaaaagaaaaaaaatgctcaggaatctaaaaacactagacatgaaaaacgtaagaatcaaaatggcatgtttagttgatcttaggaattttaaataattcctaaaatgcaggaattgtgtgaaatatgttatttagatgcttcataggaaaaatacaggatttttcgagagagataacacaaggaaagtttcccatgaggcccaacctcatgatagaaatccttaaaataaattatgattcaagccaattccataggaatttcgtaggaatctcaagtgctcatttctttcttccaaatgagcacctatgaaaattttccattggatttcaatcctaaaaggtcttatgttttttctttgttccatgaaagccctaaattaatttttttgactctcctgtctcgaacataagttctcgactctttccaagttgtaagctgtttttttttactttaagacatttttgcaacttttttccttgtatgtccttgcagataaatgttagagtaaatttcactttgagctacttttatcaaccaaagtttcccaatagactacgctagatttatcttttcacgtaacatcacagcatatagttacaatcgttcacgctttggacaaggttgaacaacatgcgttgatatcttaattttcaagcagtgaaatatgatctttgaatgttcatacatagtaatgaaatatatattatctttgaatgttcatatgcagtaatataatgcaattccatttattttataggatgttgtatacctgttacatttgatgttcttgtgctaacttgtaaaccctagtttaaagtgtaaagagtggtggtaactgtgctaagtgaaaatataagcttggcggtccatgatgaaacttcggttcactggtggagaaatgctttttagtcccggttcgtaaccccctgtagtcccggttttccaaccgggactacgaatccgggactaaagatcgctatctttagtcccggttcaaataaccgggactaaaaatcaatctttagtcccggttaatgttaccaaccgggactaaagatgggagaatctttagtcccggttcaaataaccgggactaaaaatcaatctttagtcccggttaatgttaccaaccgggactaaagatgggagaatctttagtcccggttgataacaccaaccgggactaaagatattttttcttttttttctgcttttaatattgaatattgatttcacaccatcccctcccatatccaaatcatcacatattacagaacatctccaaatcctcaaacaaatcatatccaaatacatcacaaactcttaaaaaaattacatcacagggttctaaaaaattcatcacatattcacatctcacacaaaaatacatcacagattcacatttcaa

SEQ ID NO: 59846 - DNA, 5830 bp, Oryza sativa
ttactaaccgggactaaagatcatagggccctgacacagcctgacatggaatcaaccgggagtaaagatgatttttagtcccggttggtaacaacaaccgggactaaagatcttcctcttattaaccgggactaaaaatcatttttagtcccggtttttaatggaaccgggactattgtggatataggtcgaccgaccaaagatggtttctctaccagtggttattaaaagtggttcaaaatgaaatatactctaaatgttactatgttagtatccccctcgtaaatctcagaaatgtaaaaacaaggagtaagcaagttgttttctcaattcatatacacaacacaagtctaaacaacttacatggtatatttaaaatcagcacgagtacatttatatttttcgagaaagatgcacacacatacacctcattgcctgtgcagcaaacacccgtaggtataactactcttaatacacgtttaaagagatgagatgaagatcgatgacaaaattttctcacagaattcatgtttaagccggcctggcgctgtgctgaaccctcctgtactccactccactccagccggcctttcggagagccggacgccgttgtccgatcagctcgcgtcggagcctcttatctaatccactgttccacggaccgagtgcacgcagtgaacgaagcccccacatcagcagcaaagctgcgtgaccgtgtccgtctcggcgtctcgctcgatctctcctgggaactccacacgttgtccgctctgcttcgccggagaagaccccacgcgcgcgccagctgctcccaaagcgcccccaacagtcaaggcattgtttgctagctagcttccgacgaccgcgcataaagctcacttacacaagcggttaatgtgcggacggcccccgccgtcgggcgaacgcagcgggggacatcaagcctgcaacggtgacaagtcggggaatccagcgacgtacacgggcgctcagtcgccaactcgccaccaccgggctttcgttcgtgtttagctctgccccgctgcacgctcgcctcctctcctccgcgcggttgcatgcgtacgttggtcctttttatctttttcagatcagcgaacgcatcgcgtctcctgtgcctgatacttttcggggccccgctcgattgggcgggcgatatatgtggggcccggtgccaggctctggcgagaggatcatggggggcttttggatcgactatgacgcgcgggaccggggtgtcacgttctgctgatgctgatactgctcccccccggtttaagcgcatctttcatcagcgcagcccccggcggggtcggtcgtaccgtatgatgccgtgcatccacacggtactggggccggtgcttcttcgccgtattgccggcatgcagtacggttccccgcggccgccacgccagaattttgcgtgtttctttgtgatttcgacgatcaacaaggcagtttgtggattatgccccactgctaactctgatgagccgtataacccgggaaagtaaaccgtagcccaagggctacgaaaggaaagcaacaagaacgacatgctgcgcgctagtggcgaaaggtttgaagtagctcgctagagcttagatcgagatggttctaattatggtatttttggttatgtttgccgtacaaagtaagtctatgagtagctagccatctcattgttggctagcaaacttagaccccttttgattgaaaggaaattcataaaaattttagggaatttcattcctatatgatttttttttcctatatagccttttgaatcaaaagaataaatcctatggaatcctatgaaatgcctcttcccatgtgaatattagaggaaatttaacatgaggtagaacctcatggaaagaatactttgagtctttatctctcctcaagatggccatgcagcaatgtggttgccattccaaagtataaactttcaaacccaccccgtacttttcagattattttgcagcttattgcgatgggttttaaggggtaaccaaaatatttttaaaaataaattaaaaagagtttaaaagttaaaacgagtgatctaagcaatatagtagaaaaagtttgtagaaaacatattctttttaaaagtatataccaaataatccgttttgataatccaatgaataatctgaaaaaaaaagtaagacattgttgtggcactctctcttctaaagaaaatctcaacacctttgctttctactccctccatcgcaaaataaatacagagagtactctagaactctagtaccatatgcatgttgtagtatgatttgattaaggtatccaagtactcctatctaaacaaccaatccaatcatgcaagcaacagttcagatcagtcagttcagtcttcagtgtgcatgcctaccactattgacttgtatgttcctctcctaatatatgagcccacttccaacgcttccaggcatccatctgccagcccaatcgcgagcgcgcggacctcgttccgtggcggccacgagagctatccgcggcggcaatagcaaacctacgcgcggtcgggcacttgggcaccagttgggccgaaataaaactgggttactcgtacgtgtgcgtgggcagccgttggatcggttaggacgcacaaaggagatcggtccaatgttcagcacttcagcggaataagtgcacttttggtccctcattttaacttcgagtttgcatcgtgtaattgaatggtaataccagatataacatatcccacaacttacaaccagagtacccgaggtcgcaggacagtattttgaccgattttcactcacatggtgagttgactgtagtcaaaatggccgtgagaccacatgaaacctatgtcagggcccttacattcttccccatttcttcaccatctctccagggcagtggctatagggaaggctcagggacaacggcgccaaaaaaaggaaaggatatcataaaggaggaggtaggggaaggggatgaaaagggaggacatggactgttgcggcgatagagcgtaacgaactagccatggtggccttctcgttgtctgggtgttcatcggatgttatgccgtcacgcggggttgggagtcacatcgcagctcgtgagcaacctcatctagccgcgcgtgaggaggttgcatgctgacaacgataaggggaatcaatggggatggtcagtcgtcatctgcatgcgcttcgtctgctaagatccgcttgaaagactgttggcgccactaacggctatgagtgagatggcgacgagctcgagagggcgcaaaggaggatcagggcagagggacttgggaaatcaaagttcgcagtggcggcaacggcgatggggagcgcaacggatgtactttgccgccggctgctcgttgtttcctcctcttttttttaccctctagttgctgaagagggcttactctgagtcatctctcaccagacgtgataagaggtccaagttgagctccctccacatcgcccctctccgagatgccatcgaggcccaccgccattgcctagctcctctaccgttggccgtcgtccttctctatgtctaccgccgtcgtcctagggagatagggaagagaggaaaaccaggagaccgtaatgactggtgccctgtcaaatgggtttcagtggttcccaagctgattacgtggccctaaccaattaagttggccatgcagcgaatgtggctatcattttggcctttcaggctttttgcgctgtgccactctctcttcaaattaatttcagcaccttttctgtttgttctagaactccaagtagcataagatttagctaaggctgggtacgcccttcgaatatagcggtatcagagccactaccagatttgggacctaccctgtaggagcgaaaccgtcagaaaaatagttttcccgtcagaaattattttcctgtgggtgaatcgacagaaattgccgacagaaaaatcaccacggaaaaattccattttcctgacggtttccctacagaaaaacaatttctgtgggtatttttctgatggaggaacacagaaaaaatccactgccgtcacgtttttgtccccataattttgacgtggaaccgtcagaaaaacaaaggtagaaccgtcagaaaaattaacttcaaggcagaaaaaaaaaaccaacaatgcagttcatatgtcaatatggattactgaacaatactttctcaacacattatagcaatggagttgtttcctatatatatatacacagcaattcacatgcacacaaattcatccatcaaaatacaagcaaactttcagccctgtaacttataagtttataaccaatttacattcaacaagaatcttttatcaccactgtaagttacgagttatgggagttacaacttccagtaccaataatacaagtagatgaaacagcaaatgcagataacttatccctcttccaagcatttaagctctagctattttatcatcttttgtatgtctttgaaatgctacatattgaggagggggcttttaagcaacaggctttgcacaaactatatatccttcactgacatattcagaggaacaagaaaaataaggcattaagtattttaggatgtgtcaattgagaaattctgaagacaattctgacatgcataaattttcccgagtcacaaaaacattgaagtacactgtgctacctctagaaacaagcagtacattaatatatggtgcatcaacagcttcagttcagtgcatactatagatagcagtgacgttagtaaattggcaaaaaatagcatggcaagagaaaaaaaatctgttgcagtagttaaataagtccacaagataaggccaagcatatgtgtcaccacttcaccagtacatagaacaacccttgaaccccaacattggacttcagactccatctcaacatttcacaaaaaatcagttcatgagcaaattaactagtttaatgccatatttcacaacagcttcagtaactgcattgtcattaggatcaaccacttctgttctttttcctaattgattagcaatgatgcagtatacaagtagaatgtaccatgaattaatttgtgatttacctcagtttgtgattctgtcagaagaggaataaaggcttaggccacgccaagcctgctcacgctaaggaccttcaaggacagcaatggcgttagcaaattggcaaaaaagagcatgccaagtgaaaaaaaaatagtttgcagtagttaaataagtccacaagacaaagtcaagcatatgtatcacctacgttgtactcccctcaaaccccaaatcacttcagattccatctcaaaattgcacaacaaatcggttatgagcaaactaactagtttaatgcaacattcgactcaagtagatgcttcaaccaatcgagaaaaatgagcaacttgtgctggacactaaccagacttaaacgaggagatatttgtgcaactagctacagacaataaattagccacgaaaaataagatgagaaataaggagatataggaactaatgcataattttaatgacaaagctttgactactaaaatctatgatattattaaaacaactttgaaaggagacaccacataagaagtttcaacataagaacccaatacgagattaatcaaaattcaaaataaaaataaaataaaatctaaaatttaaaaaagaaaaggatagtccaaataggaatacaatttttaaataggtgaaattcggaattaaaaataaggaatattaaaagaagagtccatataagaacccaatacgagattaatta

SEQ ID NO: 59847 - DNA, 750 bp, Oryza sativa
aagaagatagagatgagcagtgggctacagatttgtagccagttgcagcacgggctccaagacgaaatatatgtatgacatgtgggaccataaactaatagtgtggtatacgtttatatattactattgtgtatatgtttatatattactattgtataaattgactattaaattgactacagttgatttggagccagtatttggctatactattaaacaacttgctctcatgcattttgtaacctggttcgatgagatatccgaattactactcggcatctaaatagtcaatccaatcatgcaagcaacagtgatcagtcacttcagtgtagtgcatgactaccacgattgactactgtagtagtagtgttatcctcttctaacaattctttcaacgcaatataatcgcgatcagcacacacaagtacacagcaccgctcctcctcgcgcacatctgagaaacaggccctgtgcggcggtgcgcacgcgcgtgcctcgggacacgcgacgcgagctatcaggcggggaataagttcactccatgaccctcaaatataattgaaatctaaaccatgattctaaactacaaaaccagatatctcaacccccaaacttctaaaaccggtgcaatttgactccctgagcggttttgggagatggttttgctgacgtggcgccacgtggcgcctacgtggtaatattgaccgagtctttgttacacgtggcgttgacgtggcatctacgtgacgg

SEQ ID NO: 59848 - DNA, 1356 bp, Oryza sativa
tagtgagaagagcatatgaaccaattccacccgtatagacctaccaaaaagagtgaaatggtaattggaaatctagaaatgccataattacaaacaatctattattagaatggaacgactaatagttttaagtaattgtacctcattaagctctctttggtgtaaaaaaactttcagaatcatacacagatgtcttaaagcaggaaacttcttcacataatcctgcagtacagagtaaaaatgatgttcaaaatatatgcaatcatttgccccacgaattagcttcacgaacacacgctgccagtgaagtaattagccaatttgtctgcacaaagtaccttgatgaagtctgctgcttgtggtccaccatccatgtcaaaactggaaaaagaaaaagggaaattattcgataagcattcccgcaaaaaactagaaacaaaggaatatttgatgagaaacacaatttaaccttatgtcaaaagctatttcactttttctctccacgaacttcacaattggcacacgggcctttgctattacctgccatgaaagaaaaaaaaaatggtccaccagaaaaataagtaagctggaatctacttgattgacaataacaactgacaactgcagcacagagtgaaagtttaaacagtgggatttggtctctttcaaggtagctatttatccgtcatgcatatttcagttggacagaaaattgacttttccttcattggaaaaaaaatgcatttttgtctctttggctttgttttgagtaattctttaacaaaataaaagaaaaagtcttgcaaataccaagtgttgcaaactagagttaaatagagtgaaaaatggacctgtatctttttagcaacccctttctgagacaatgcttttgcaagagcatacaggccaacttgtggagtcttaaccctggagtcaaatattacaacctgcatcacaaaaccatgtataaactcacagataaaggagagagtttcccaaaatagggtacattttccatgtattcgtatttcattgttcccaggtgaaaagtaggggttaacacttaacacgtctgtaacaggctatgcatcacggttttcttctaatcataatcatagaatagcagaagaagggtatccctttgatatgaaagtggaagtagctaacaatgcaattaagggtgaaaatcactctggagaaacatatttcatactttactccaggaaaactgagtaaacattgctaattatatacatcccattttttcctccctgttctgcaaaacaggaaaacagaaagtgcatgctgagctacaccttccttctgtgtttactctttttctcctgtattgctatt

SEQ ID NO: 59849 - DNA, 11021 bp, Oryza sativa
ctgcagctaatgctgatcaaatgcgtgcgcacatggcaagagagggacaatgtgtgttactatgccttgcattgaggccatatatgtttgataacattggagacagctttcacagcagctgttcgtgaagattgttcttcagcagaaggtgatataaagtcacagaagtcaagaatctctgtaagaaatagacaatatgtcagtattgcgtcagtcaaaatgtccagcctgaaaccatataaactgactcaagcttattaacaccatgtggacactcccaagtttataacaccatagtttccaggcaacacttcaagagtgtcatgaaagagcatatcgcgagtagcttgatatcaaaatacaattaaaaaaatatcaatctccacctaggctgaactgagaagatttcagaaccaaactaaaatcagttccaaactattcgcataatctgtgcccattgaaacaagtccattgcctacccaagctaaaattcgaattgaactatctctaagctgatcaaatcaatttacaaatcgtgttcttttccaacattcaaactaacaaatggcaaagccaaaattatccccacctttgtgaagctgcagcatagggctcctgaaccgcctccctccccgaaaccacgcgcgctccgacccctgcgctggctgctcagcgggagctagagaacccgatagcgtcgcctccggagcaggctgcggcgacaacgcacgcggggtggccggctcgtcttcaactgccgccgacacgtcgagggagaagaaatccgccgcggggatatcgacgagcgcgtccccagccgccgtgatctcgttgcggaacacggagtaggccgcggtggcgtcctccacctcctccaccaccgcagccgaggcggaggtcgacgcgccgcctaggtcggcagtcgcaccctctaggtgctcctcctcctccggcgagaacgccagtgtcagccccgggagcgcgtcgtacacgatggccacgccgcccgcttcggcctccatggcgtctgcggctggagaggcggtggctgcggctggagaggcggcggcggtggcggcggcggcggcggcttcggtcggcggcgcgtgggaggggagaggtttcctgcccttccgccccggtgtaggaggctccgcgggtcgcgctttgcgagccatagggtttgggccggcggctgcgcggtgcggctcgagcggaggaggcggcggcgggccgagacgaaggggtacatcgattagtgcgggactcgtgggcaggccggaacatgtcgttcacggtttcgtggcccgcaaggcgcgctcgcccacacactggcccatttctatttcccatttgattttttttcctaaactcaacagtttgggttgttaaatctccgccatagctgaggatatatagatggttgcatctgcctccaaaaagacaaggaaaagaatatatataataaacagatttgattctttatttcaatccagtattgtgcactccaaattaatgcaagttttgagaaaagctggcatcttacaatgacaacgctcgagacagctcatgctatgctttcatcattgttgtggacatgttgcttacgtacatcaatacatgagcatttgcttttctttgcgaagtaacaccgtgtatcttacggacaactgcaacccttatatgcatgtgatcacaactactagagaaactatcttttataggttggccaaaatctacaatagtcctggttcaactaaaaacttggactagaaactatttttagtcccgatttaaaagtacacggggactatatgatctttagtcccggttgatatcactaaccgagactaaatatctccctcccatgtgttaaatagatcgaaccagagactacatacttagatttcctcatccttatctcttagcgctagacagatcgagacgtcctcatccacatatcttctctcgccatttctctcgctgactctgtactctctctttcctcatccacatatcttctacagcggagtcgacgggagaaggggcagcagccgccgggcggggtcgacggcggccgtcgggctggggaggcgacgacggcttgcggcaagtggaggactcgatttgggggtttctttgttttttaaaaaagaatttgtgattcattggatctgtgttatttgatatgtgatgtaattttttttagaatttgtgatgtatttttttgataatttttgacatgaatcttatgatttgtgatgttgttactttgatttggagatgtagggagcaactcgatttggaatttatgatgattttgtgattttgatgagtttggtgagtttggcgtgaaatcaatattcaaataacaattgaaaaaaaaactggcgttacccataaagattctcctctttagttccgtgcaaccgggaataaagatgaatctttagtgccgattattttaaccgaaattaaagatgggcattttagtctcggattcatgatataggggggttgcgaaccgtgggtaaaaaccctttctccagcaatggatgcggcacgacactgtttgcggtttgcccttgacaatggtatttttttacaacattgtcaacgacatatactggcactggatatataactaagctagctaacgggaccatgtaacatatttttctcactctagaatcataaactgggcgctggaatctcctccgatgtatttatactgccatttgcgtagcataaaactctccgttgactgcatctacatacacggtactcgtctgctcgacccggcaaagattagatcgactgagagcaagtttaataaaatatcccactactggctccaattcatttatagttaatctaatagtcaattaatacaatagttgcttactatactactaatatatggtctcacctatcatacacacattgtgtcgtagagtccgtgctgcagctggctacagatctgtagcctgctgctcttatctatcatcttttatcttattaaaatatgtttacagctggttaatagtgctattgtagccgctctgatcgcgtcagaaaagaagggcgaaaaccgcgataccccgccccccggcgatcgaggctgctgtgttgtttatcccatccgcgccgtgctcgatccggcattcccgcgcgctttgctttgaagcccatttacgcattcgcaacttgtggcgtggcatcaaaagcgtcctccagctccaagccctctcccggtaaaggccgaccggctcgatctccatctcctttaatttgcccccaccctgacatgtcccagaagaaaaaagagcactcacccatgggtgcatatgcatgcatgtcccgttgtccggattggatctcacacaccagagctggtcaagtcaaattgagcagcaaatctatgggggtaagaaagccttacatacaaacaccgcatgatcgatggatcgaaggtgacaaatagcaatataacaatgagccatgcatatcggggttgtcgtctatagttgttaatgtgcttggatccccaattgcgtgataaatatcacggtagcagtcagcgatcagctagcgtcacccaaatctcaggctggatgcttacatatatataaatgacaggacaaaaccgatcccccacttgcactggcttgttggtagctcagccagacagccaccccgctacagctacgtacgcgttgggttgggcacgagtgcgacgggtagggaaaaacgaggaaattcggtgctgtgtgtgttcgctcggctcggctccttcccccctgcggagatctgagacttcatgtgcggctatggttaacttgtcgcttacccggttaacccccaagagagttcagctaaatttacgcgctaacttgtattgatcgaatgcgatgttctgacttttcagggcaagtggatatgacccgtacctgaggctttagctagaactggaacttaaggctgtgtttatgctctatttagattccaacttttttctttaaatttttaacttttctatgatgtgacgaaaaagttaaaaatttatatgtgtaggaaagttcgatgtgatggaaaagttgaaagtttgtgtgtgtagaaaagttcgatgtgacgaaaaagttagaaacttgaagaaaaaaattgaaattggcctttatgtatcttcatgtcatgaaccttatttgtccttgttgcgaattcttcagtctgaacttgattaatttggtctcagctgcccggcctatagcctgagttcttcaaacttgaacttgtctcttctgtcgacacgtactcccactatactcataaaaaaaagtcgtttaaaacaatgtttaagtcaaaactgaggaatataaatcatgaaaaactcttaagttgttgagtttgaaaatataaattatatgtatagatttatcttgaaaaatactttcataaaagtatacatatatcacttttcaataaatatttttatagaaacaataagtcaaagttgtgttttggagaccgtgtcgctgttataaactactttctttactagtatggagggagtaattaagaaaggatctattattgttgctgtgcataccaggccttccatctgttctcctagcgaatcagatcgggcaagctcacatgtagtatagatcagtagatgagcatggccctttcctctccccctttctcagcgattcagccccacatgctgacatgcatgcatgtctcctcttctttcccgcagaatccaagaccgaaagctaccgtgatttgtgcttttgttaaaagtaccgccacacatccaagatacttaaccatttggtcctatctcctgtgcacacatcatttgcttgtttcaggcgttctttcggacagatggggttgttcagctaattttagacgacgagatgaccctgactgtaacagtctaacaaactctggttttcttcagctgcttgttgtggataggaggagctacatgactcttattgatcggtctatcctgttgcgccgaccaaagacaggagtacggcatctcctcattgtcgacaaagttattttaatccgttttctcatcatctcagaattatgtcggaaacccgtagcaccagtgaattaatagccagatcaattgcaacatttttatagtgagggtcgtcgctcttatgtggcacataaacaaatgataaacgtcaaaacgatgaacacagtcggcaaagagaatcaaggtattctagctctctggagtattttactgagaaacgaatgtgtggcaatcccaatgttgctgaattacatcaggttacatgtattaaacctcggaggccgtgtgcttcccgaacaacttatgaatctggcataggagtatgggttactgcatgattcccttcatttttcgctgaaactattttatttgtgtacttaatgtttgcatgggagatggagagaggggttcatcccgatagggttgaaaacggtccgaaaacgtttcaaccatttccataatcacatttttctcgaaaaatagagttgaaaaccgtacagctagaaatacaaacgaaattcaaaatatcggaaagccggaaacggaattatacagacagaaacatgtcgatatcgattaaaaacatgtaataaatataaaaaatattaaactctaaaatcacacatttaactttgtacaagtatataatatgatgaaataaattgaatgttacactatgtaaactatagattatctttttttaaccttgtaggagtattccatatagggatttggttgaagagttcatgggcttctaactatatgtcaaagaaagaaatgtaccatagattttggcatacttaaaaatgtggtaattaacataatataaaagaatagtagtttctgtaaatatatggtaaaatttggaaaatggtctgtatacaagaaaattgtttccatttccattttccatatttaaaggtgtggaataaatctctctaattcttcttcttaggggagtgattaatctggtattaggatttgagagacaggttttgccattattattcggatattttagtaatcaagaatcaagatggacttttttttttaactttgaaagcaacaaagataccatgttttcttactgttgacgtagtagtaatagattcatctagagtttgaatcagtttcttgagttggctactacattgtttttggtaattacacttaccgaactgctataataactttttttttaaaaaaaatatttttaagtttttattatttaatattaaattaattatgtgctaataactcttctcgttttagcctaatcaaaagcaccctaataatattacataactactccatatctcatgctacatctatcttttttaataactattagtagtgactgaattatacgagttttgaccacaatttttttcacgatgaatttacaaatctttagaactcgatgttattattgcaaaagttcgatgcaaaataaatcaagttatatgatttttatagcattaaaaaataacaacataagaaaatactgatcaccataataacaacataagggtcccgttattatggttcgctggctgccatgccacaagcatacccttcgtagtcttaggccatttacaacgtgtggctcttgctcatggtctcacggctctatatcggacgcgtgtacccgtggcagcggggaccatggctccgcattaccgattccgcgcttgcggaggaaccgctcgaagcgccgcgtctgagcccaggaagaacgaagccacggcccgaggccacgcggtggcagagctggagccccgtgcgtcgcctcgtccggttgtcagatccgccgccaccgctacttcccgacgctgacgctcgcgaagaagggagggggagaggaaccgccgccagatccggtgagcccgccaccgccaagctcgccatgccgtcggcgagctcgtccgcgccgtcgtgggaggaggaggacggcggcgtcgagcccgcgtccggatccgccgccgacgctcgcgaagaagggagggggagaggaactatcgcgttgtggccccgccgccagaaccagcgagcccgccaccgccaagctcgccatgccgtcggcgagctcgtccgcaccgtcgtgggggaggaggacggcagcgtcgagcccgcgtccggatccgccgtcgagaacccggatccgccaccgagatggggagctcgccggcaaatatggcaaatgagagagggagagagatggctcaagagagagagggggaaagagggagagagaattaaaaagagagggggaagaggctgacaatgggtccgcatagtgtttaagggtgcatagtatgtacttattttggttgttatagagtctaaaatataaagttttaataggtttgataataacatacaacataagggctgatatataaataaacagagactgaaatacaagatacgttttggagtggttttcaccgggcagtatgatctttgtatggttctatcctacgtgatgtacgtcttaaaaccacttatgcttgtggccttcattgtacatgccctttacatgtaagggggtgtttgggaattaggaactaaatttagtccatctcacaaaagtacaagtccctatgtaggaacttatgtttttatgagagaactaaagtttagccccactttagtccctccaaccaaacaccgcctaagtactacacaacggacaagtacacgcaggagcatacggcaagcgaggagagtgctatacgaggcaaaccgtggagggccccgcggccgggtcacatggaagtgcccaggccggtcgtgccggatctggacctcagagcaggcagatgcttctccgcgcagacgagtcacgagtccaactgtcaggtactcacccccaggtcatggcgaaattcggtaataccacgtccacgttagttactactactagcacgcaagtagtactagaaattcggtatgccacgttaacggtcgtctcctttgacgttcaacggctttttccggctttccagcctttttccgctgccgacgtgcgggcggacgggcacatgggcgtttatcggcttcgccctccaggttttgaagtttcgctgctgcggtacgcgcacgccgtgcccgttcgatggcgaatcccaccgcggcaccgtcccaagcacaggtgatgatagggccacgccgatgggacagagaatccagccaaggcggttgagtgggctgaccgagcaagccttcttcttcttttctttttcttttctctataaaggcaacatgcatggacagggaaaaacaacctagaatatttctgcgtccaaacggatctagaactcatgttctcctttcggaaatatacaaccttatcgtgcctacttatggtgactttgaggccccgtttataacggatgaaaataaggattaaggacacgtaaaacgaaaaaaaattagcatattattaattgagttttaattattatacaatttaaaatggctttattgatgttttagagtaacatttatatgaaaagtttttgcacgaaacgtatcgtttcatagtttaaaacacatgctaacagaattgttgtaaattttgcgtcttaatcagaaaaatgttcaagaatatatgtatatagtactgtaaaataattttctttttgtctagaatatatattgaatcggttactttgcatggaccatatttttttcatagtgtgaagtgaaaaggaaggcattgaaatcactattgcgtccggtgtatgtgaaattttgtgttgctttcaaccgaagtagattttatactagtttccaattgttttcaacaagtcatgtccgtaattaatattttctcgtcaggttttcacgaagccgtgacttttggatatatgaaagctacgaagaaaccaattccgtactcgttaaagaaaaaacatttttctcattctctctctacaagcaaagatttcatcctacttgtatatatgtccattctagcctttagggatgacaatgcccacatccctttcctatggaaattctcctattaggaaagagggatggtagccatgtggtatctatacatgttttagcgtgctatgattagtgaatgtggacaataatgtattcttgtcatatggattaatagatatctactaatatattgacataatatatatcaaagtataaatatgtttttaagcgggtaaggagctatgggaggatgttcccattgcagttggtggggacgggaataaagatggggatgcattccctggtgggaaatatccccttgtcatctctaatccattttgattcgtcatttcgaccgctcatagtcgggtataagatacttttacattatacatgatgatggagtcgggatattagagcttcgatactagtgattttaatatgaatttagtgagctcacagatttgtcgccgatttccaccctttaagcatgtgttagtggtgcactcaggaatgtgtgatgcttttatgcaaaatcaaaaactcatatatacaagacattacatcactttatgcaagttgttttttttatgaattgactatttaatgtacgctttcaaaacaacttcattttttaccaatccgacatataccaataaaaaagagtaaatattatcatttttttcaaatcctgatgtagttatttatcaacttttctactttaatgtatacgtgtttcccaccttcacatacaccaatgcaatagtaagttggaggggagtaatatttctttttgttagcagtctcgaatattgaaggatctatgatccgtcgtaaccaggacaaggcatcaatttggcatactaccttcgtcccgaaataaacttaactcctaaagtttaaaatttattctaaaataaaccaacttatactcttttatctaccattggtttccaaatttagaaattttatttcttcaatatcttttcatctacccattcaccaatataacttcataattagaggtattttggtcatttgtatctcttcttaaacccaccttgaaaatttagggtttgagtatttgtgggacatagggagtacatgaaacgtactgtgctgtgtggaaacggacatgcgtggaggaagtgtcgatccgtattacaggcttgtggactggaagttgtatatgctcacgcgggttcgctcatggactttgggagtttggatgcggccgcacacggtgtttgttaatgcgaaaagaaccagccagccgccggcactcaagatgaagttcagagcaagtttaacagtatatagctaactattggttcatattatttataatttatagtcaattaatagtcaattcatataatagttacctataaaattactatataattaatgtctgatcctatctgttatacacacacatgcattttaaagtccgtactacagctggttacaaatctgtagccacattacttttctatcttctttttttatctccttaaaatatgtttataactggtttatagtctgctaatgtactgttcctatgatactagtataagacgggaagaacaagtggtttaattaaccctttatgtttacgtaccgtgagagagtacgcgttcggcaggaattcacgtgaaaaaataaaggcgactaggcgaggaattcactggaaaggcgattgcagcaggaacctttcgatttcttttctgataaataatggacctttcaaattcgtatgaattgtacattcacgtctgtgtgaccgttgcatcatcagggttgaaagggacgacgaatcacaagttttcccaacctctagggtgtaaacacggtcttgttggttggttgtttcggtgtcgcactattggatatggatacggtactaggacgggattatgtcagcgatattttttttcacattatgtttggtatgatgtactacatgatacactggtggagaaatcatctttgaccggtcgactaa

SEQ ID NO: 59850 - DNA, 1939 bp, Oryza sativa
cactcccttagatctttagtccggttggttaccaaccgggactaaaattcaacatagtatataatccctaattctcatcctctcctccacaatcacaaccacttcctcacacacagatcgatcctcctatcttctccccctcctcccctctcctatcttacacagatcctcccctttctcattccttcccccttcccttcctcctccctcccctggagacggatgaggccgctcctccttccttccccttcctttcctcctccctcccctggagacgtatgaggccgcgccgcacgacgcggtggatggacggacacgcggcgtgcggcgcagacgtgcgttgcaggggagcacatgcgcacaaacgtcctccctcccctaaagttacttgttctctctttttttttgatattttgtgattcactgagatgtaattttgtgattcattgtatggatttgagatgtataatatgtgatgtatttgatttgtatgtaaattttttaggatttgtgatgttttagatttgtgtgtataataactttaagatttgtgatgtggatttgggatgttactttatttggggatttgaggtttgatttgggatgtgcatgccatccgattcgtgagaaaataaaaaagtaacaaaaaaaaagaaaaggggaccatccggtattgtccctatcctctctttatttaccaaccgggacatctttactcccggttatttcacccgggactaaagatagcgatctttagtcccggattcgtagtcccggttgggaaaccgggactatggggggttacaaaccgggagtgaagacaatttctccaccggtgataattatcttgggtagattttgtctagaaatctgcttttgaaatactttatagagtaatatatatcattttcactctaacctcaaaaccgcttatattctactccgtttattcacactataagatgtttcggcatatccatttctcatctaaattcactaatatatatatataaattggacacttatatggaacatatacatacgtccttgcattaatctatttacagtccaacacattatgtaacatgaaatcgaggaattattcaatattttatataatcatatgatcagaaaaaacaaatacatatcctctgacgcgtaagagtatatttcagtgtgtaactgatggttactgattaccttgtttttttttaaaaaaatccctccatctagaaaagacgacattttaaaacaggtagtaatagatggaaagtaaaatgttaggatttgaaaatgcaaaaaaacattaatagaacttttatgaaaaacttttatatagttgtattttaatactttttgtaaaaataagtttgaaagtagtgacaaaataccaaaaaacaccaccatttagagagatggaggtagcaaacaggctagtgcaccaacaattatagctaatggttgtgcgaatgaccgtcttaatttaaagccatacttttccttaatgaaccactatattgaccgcaaaacgtgttttaatggcgcattcactgatgatagccatcttaatcgaccacgatgatgtccagagaggcgtactaatccttctgatattttttttctcagaaaataattatcgtcacctataaactgtaacaaataaaacgtgggatctctatacatacacgcttatcgcagagaagaaagatacttacgcgccacgcgcacaagaaaaatttaccccggataaaaggggcaacagctagtagctagtactacttcagaagatcttttttttacacgagtggcagttctcgccatcctgcgccatattttgcattttccaccccgtcaggcaagcgcacgcgtccggcatgctcgtcctctgtttctcacgcgaccctccgtttgggctcctccgctccgcctccgtcttccg

SEQ ID NO: 59851 - DNA, 923 bp, Oryza sativa
agcttcaccgcatcctcgagggctacatcgacacctccacgggccgccccgccaaccccgccgtgcacggcgagaacgccttccttacccgcgtcgtcacgcccatctacggcgtcatccgcgccgaggtcgagtccagccggaacggcaccgcgccccacagcgcctggcgaaactatgacgacatcaacgagtacttctggcgccgcgacgtgttcgaccgcctcggctggcccatggagcagtcgcggcagttcttccgcacgcctcctgaccgcagccgcgtgcggaaaacgggcttcgtcgaggtccgctcgttctggaacatttaccggagcttcgacaggctgtgggtgatgctggtgctctacatgcaggccgcagccatcgtggcgtgggagagtgaggggctgccgtggaggagtctgggtaatcggaacacgcaggtgcgggttctcaccatttttatcacctgggccgctctccgcttccttcaggcgctactggatattggtacacagctccggcgtgctttcagggatggccgcatgcttgctgtgcgcatggtgctcaaggccattgtggcagctggctgggttgtggcgtttgcgatcttgtacaaggaagcctggaacaacaggaacagcaattcacagattatgagattcctgtatgcagcagcagtgtttatgatcccagaggtccttgccattgtgctatttattgtgccgtgggtgcggaatgcattggagaagacaaactggaagatatgttatgctcttacatggtggtttcagagccgaagttttgttggccgcggtttgcgtgagggcacctttgataatgtcaagtattctgtcttctgggtgcttctgcttgctgtaaagtttgcgttcagctattttctccagatcaggcctctc

SEQ ID NO: 59852 - DNA, 775 bp, Oryza sativa
tgattgatctattgtcaatgtttttttttgcataatgagcagcattttgtgccagaactgtacataaatcgcatgctctctaaactttggacattgtatctaatgaaaatgcaggcatttgattcattagtagcttcccttgatacacgtggcagcagggaagcacaattgcattcaatgctacaaaggatcgaaccaacctttaaggaggctattaagaggaaaaagagtgcagttgtagaacaatccgctggaaggtatctaaagaatggagctacggaaatgattagggcaagttatcgtagtgattttggaagcccaagcagtaatctttctggtgtcacttctgatagtgctatagcatattcagattctttcaaaatagagcttgggcgtaatgatgttgagaagactgctatttcaaaaagggcagatgtctttataagatggatgtggagggaatgcaatgattgcaaattgacatgtgccatggagtatggcaagaaaagatgctctgagttgatgcattcttgtaattactgctatcagatttacttggctgaagaaaggcactgctcttcttgccacaagaattttaaatctattcacaatttttctgaccacgcatcacaatgcaaggataagctaagaactgatcataactggaagatgcaaactgcagatcattctgttcctataggagtgagattgctcaaattgcagttatcaaccattgaggtcaagtaacatgttttatgtttgtcacctgcttcta

SEQ ID NO: 59853 - DNA, 1332 bp, Oryza sativa
cagtgtgtttttgcaagatgggcctagagccccaaagagggttttacactcgattctcagcctagggttatactaggaaacaatagatgagcctggcttaaaggcagtctaatttttgtattgctgagcttatctattggtgaatagaagtattatgtagactctgttcatagcatttacatagtaaccggtttattcatataattttaattgctgacattcctttccttatgtattatgaacagttccagagcaacaaaagcagcatgtgcgatcttatgatacaaagatatattctaggcatgattcaaagctgttaaaggtatatttttaggaaatttccaaaagtaagtttgtgacttgaagtgtgttgtgttttttccattgaataaacccgctctggttttatgtgcttaccttttggagtagcattgcttcagtttaaaatgtcatggcagtgaattgacaatgtaatcttacccagaatgttttggcagttttaatatgtcatggcagtgaaatgacatgtgtcttacccagaatgttttgccatgacaatgtaatcttacccaaaacttttaaaatgtcttggcagttttaaaatgataagaatgttttggagatttggccatatgatgaaccgctttacccagtttgtatgtaaaccccctttcatggcttcacccccatccagggccagtcctaacattttagaggtcctgagcgagacaagaatggatgccctttattcaaagaaaaaacacatacaattactttccatttagctgcaaaataaaattgcatacatgcatagaaacaggctcataatcaatactcttttgggactataactgtaacatgcttgtcgagaactcatcccccacccaggacctgcagcgagccatgactatggaatggagaatacaggaagcaattgctacattgaaaatagcaataataacacatgatcctaaacactttctgaaaattagcggaaggtcgcttagtacttaaattttagtaaagtaggggaaaatgtgccataattgggcagtcctaaaaaaatagcagtgctaatccatacccttttcaaccctatcgcagatgtttgaaaccaaaaaccaaatccacaacaaaaatgagatattcccttatagtgctgatgtcgtgttccagacttccagtggaagtgtggaacagtagtatataataggtaaccgaagaagaagaattgggaaaagataccatgtatcggattctggtagtgtcattgcaaatgaaaagaattgtactatcgtagacaagttggttggaaatcgttaacatgccacc

SEQ ID NO: 59854 - DNA, 3308 bp, Oryza sativa
ctggttccgtgttcctggggtatttaattggtaatcaaggaagaagaatcgagagaggtaccgtatatgcaatgactgtgtgggactccggtagtgtcattgcgaattgaaagaatcgtactatcatagacaacttggttgaaaatccttaaaatctggctctcatcctttagtcatctgttttgggataaagagggtagaacgagaaggctcttatcagcacataggctagcctactaggttggcatcttgctttggggcttggccgactgggtcttccttgcttgtcaatatgagcatgtaggctatgccgtagtccttgtgagttgcggcggcatcccacatgaactagacactggttttagtgcatgggtaggcccaaattttggggggccctgcacggttgccgtgggcctgtggctgccctgccctgctgcgagactagactgcacggaacacgtgttttaaggccattaggtgtgagttggtgccaaactgccaacacattggcatggcacaattatcttgtagtgtttcatgtcctgttaacgccatatattcgccttataaaaagggaaataacaccacgtttgtgtgcatgcattagttctgctcatctggcattacctggattctcctttcgtggttccagtggccttttataacggaaatgctagctgtctattccattcacacttgcctattgattttttgccttatttatatttggcccttttatatcgtcttcttggtgagcccccgtgctactatcttcataattagcttgtcgctgcagagatctgtatttgagaattgagattgagcgtactcttggtatcgttgttttcttataagttttgagtttcgcctcttgatttcttcatacctcgtttaatattttgttgttcctctttttcccttaggcctcggctttcttccccagcgtggaacacccttttgttccaaattcgatcgctgggaaaaaaaagtcaatggttggtaatctgcccccagttcaccctcatgctggatcacgggcagtccatgagtatcaatttcttcctgaacagccaagtgataggtatgagggtgcaagcagatctcatgagggagcaagcagatctcattattatgacactccagttgaagcatcgaattcgaggatgtcatcgcataccccgggatcacatcttctccgtggatctgatgaggcagcacctggttatgctttccaaggtcaaatgtctggttctggccatttgcctcaatcaggcaggcgtgaggtgcttccagcagtaccaacagattacgagatgattcagtccaatagcgaccttaattctgttccagtcgaaggccagtatggtatttctcaggttgctggaattgaaaactcacttctaccgtctgaaagaagagcctatcatgatgaagacggctctcgagtggatagaaagcgaaaagtatgttttcctctgaccccatatagtcatatttgcatctttcttcatatccttaaatcttagttatagacatattgaatttgtttaccatctgccatagcacaatgaggaagcaaaaattgcaaaggaagttgaagctcatgaaagacgaattaggaaggagcttgaaaaacaagacatgatgaagagaaaggtatggcttattattagtgcagatcattagatcttaatgtatttcgattagaagtcatttacagtttatgcttgcagagagaggaacagatgcgcaaggagatggagagacatgatcgtgagagaagaaaagaagaggagagattgctgcgtgagaggcagagagaacaagagaggttcctaagagagcaaaggcgtgaacatgagcgtatggagaagtttatgcagaagcaatctagacgagttagttttcaaattcatattatgtaaactgcaatgcagtgtagtatctatgccagtaccactgtttagtaatataatgttatgcctatatttgtgcaggcagagaagcaaaggcaaaaggaggagctccgaaaggagaaagaggctgcaaggcaaaaggctgccaatgaaagagccacagcacgcagaattgcacgggaatacatggaacttgtggaagatgagtgcttagaactaatggaattggctgcacagagcaaagggttgccatccatgcttagtcttgatagtgacacattgcagcagcttgattcctttagaggtattctgaccaaatttagactttcttagtactacaatgtgccaaaagtaaaagttcactgctagtggctttgtgagaattgtttcagtttcttgtgcatccctaatagagtaaatataaccagactgaaatgaaaaacaatgtattagtatttatatggaacagatctgtagaaatacatgcacaatcaaaatagaatactgtgttatgtaataggtgacactattaggccatgcttggatcttgatgttttgggtaaagtaatctaaaatttgttgccttaacagctgcttcaaattaaatgatgcctagctagtagtgattggaggaatagctcagccatttctacttttgcctaacatttgcttggtagtgaaaattctgttgtaaacagtttcgaatatctgaagtttaaccaaataatgtggtactttgtgattattgattgattattcccttcatccaggcatgttgactccattcccccctgaaccggtgagactgaaggagccattttcgataaagccttggacagtatctgaggataatgttgggaaccttctgatggtaaacctgtgatatattcctttcttgtagtattttgtgatattcagtgaaagagatctgagttcttaaaagttgtgtgagttgacagtgtaaccacaagaagccataacgttgatttgcacattttattttccactagatgctaaattacaaaaaaaattgaccttactgcttttatttgcttggaatcataaatgtaactatcttgcttgtagactcatattctgtccatgcagatggataaacaaatagacctttttgatacattagcatcacttcatcaggtctataggagaggtgttgcttcactttatacagatgcacattgcagcaatccatcttcttaaaaaatttcaaactagtcttttatggccttattagttctttcttgttgagaagacatttgctctgatgacacttgagagtagagacgtttccttatggttttctagtgctaattgaaaatttagtttcatttcatgcactaaatctggtaacagatttacatgatctgttctatt

SEQ ID NO: 59855 - DNA, 763 bp, Oryza sativa
ttaaaaggagggacgacaggcaggccgtgaagcaaacgagtaaggcggttgacgggacttccaaaaagtaaaaaaaataaaccccatcgataatcatatttaatttttaaaatctcaatgacaataaaaaggagaagcagcgggtggggtatataggagtatagttacaaagccgccgatggttgatgagacttctagaaaataaaaaatgaatcccaacgatagttatgttcgatttttagaatcacaatgacaataaagagtagacggcggacatgccatagaggagcatagtggcatcgtttgacgagacttctaaaaattataaaaaataaaacccaacaagacaataaactctaaaaactataatgttcaatttttaaaggttcagaacttctaaaaagtaaaaaaaataatgataatcatgttcgattttaaaatctcaatgacaataaaaaagggaggcaacgggcgagccgtagagaagtacaatggcaaagccgctgacggtttggcgggacttctagaaagtaaaaatgaatctaaacgataattatattcgattttaaaaatctcaatgacaataaatagaagagacagtggacgagccatagaggagtataatggcaatgtttaactggatgtctagaaattataaaaacgaaacccaacgtgataataaactctaaaaactataagatccaatttttaaaggttccaaggagaatgaatagaaatagtggtagatcgagcaagcaaataa

SEQ ID NO: 59856 - DNA, 3438 bp, Oryza sativa
gcagcacaaggcccctgcagtgacaatgttacattcatcaaatggtaacatgatggttctttgtgcgttgccctgctttgttctcagtttcacagatagcttcagggataaggaagggaatgcgcgctataggtttgtcgcattcaagggattgtggggtcatcgacaatcaagcacctcttgatccacacgttgtagttgaatgaatacaatttctagactttgtccattgaactgtttcagcaatgacttttgtttctatagcgctgttagaccaaaatgtggtgtcttgcttcaatccaataccgtaagagtaagcaaagaaagttctcataatattgctgactattatagtggttattggcagaatgcagtttgtcagcttcccagccacccaccatgacattggctttccactctccacaacagtctggtaatcaaagatcttgctcgctcaaattcatgttgattgatcaaacaggtgtaatcccctcaacatagacagaaaaacatacagtagcatgtatctcaatacttgatattttggctgttgactttttctcatggttatactcctagccaatagaatgaagatccataattccatattttgcgatgctgtttagcctgttccattaagtgaattcatagattaagcatgttagacatgtcataagcagaggattcactatgacaattaagcagcataaactctaaagaaagctatcagaacaaaagtacagtgaatttcttttggaaaacaaggttattatatgcaagtggaaagtaataaacatatttgatttaatctttatggagggaaccgatggaaaacatcactagaaactgtgcatttccagggaggttcacattgtagagattttcttttgccgtgcaataaacctgaacaattgatatgctactcagcagtccataagaaaatgaaagaaaaatgaatagaataaaatcgacatatgaaaatatgaaacagtgcaataacctagctaacatttcactttcccaataaatctacctaacattggttgtacaatatgtcaataattacatttgacttaactgcctagcttgctatgcaatagtttgagctacaggttttgatcatttatcaccaaactccacatatatgaacaattaaagttaatgcttagtatatttacgtatgtactccctccggtttcattttaattgacgctttggacaatgacacgctctacaagatatacctttgaccttatttttctattataatatatacaataaataaatgcatgtttacttttattatagtgttttgaaagacaaatctatatatgtttttctagtttctttaaactaaatatttttaaagttattgatggtcaaagttataaaaatttaacctcaaccatgtccaaaacatcaattaatatagaaccggagggagtaatgaacaagatgtatgggactatggaaaacaacatcgcaccatacctgaacactgccaactgctcgtaacttcaaaaaaaaacagatatcattacataacctggaaaagtgaacaccaaaatgtaagatctatcgacaacaaatctcccacttgtgtaacagcatagaaagagtaagaagtatatgacctctgagcacaatgtttgcttggcaacagctcgcgcatacgatgtatcagtggagtgtagtctgtacctttatttcaatttgaaacggttaactggctccacatttcctcagcttcttgtcttacctttttcttactccaatatgcacgtacaatcgtatcccatgtttccctctcagggatgcatctctctgataacatgtcacgcacaacatgagcagctttctctaaattgttctttttcgataagcactcgacaaggagatggaaagttgttggcttggtagaaattccacgggtacgcatgctctggtacacctgaaaagcccttacaacttcacccttagaacacagtgctgtcaccactgcatcatttatcctgccatgcaggctccaagtcaagcggtttggtcggatgccagcaaaattcatctcatcgaggtaatttgaagcctccaaagcccttcctgcatcacatagcccaacaattagcttaccgaacaacccagcatcaggcttcctcccctggagacgcatccggtctaaaatctccatggcctgacccagacagccctccttacagagcccatcaataacagaactgtatgtgattgtatttggaagcttcctctccttaaccatcctgtccagcagctccactgctgaggcggcacgcccacccttgcacaatccatcgatcagtgaactgtatgttaccacattcggcatgatccctctcctagccatttcatcgaacagtttcagagcatcatcaaagcaagcctcccgcgcgagccagtggataagagtggtgtaagtaaccaccgttggtgcagtgccattcgcaatcatctccgcgaacaggtcgcgggcctccggcagccggccgcggcggcagagcccatcgatcacagtattgtaggagcacgcgtcgggtttggggatgttccgaaaaacgcgaacggcgtcgtcgatggggacggcggcgtcggagcagtgggccttgacgaggacattgtaggtggcggtggtgggggcaaagccggcggcgcgcatgtcggcgaggagggagcgggccagggagaggtgggagtgagcgacgagggcggcgaggaccgcggtgtaggagcgggcggagtgcgggaggccgagggcggagggcgcggagcggaagaggtggagcgcggcgaggggctggtgggcgcgggagtaggcgcggaggagggagaggaacgggggctcgagctcgccgggcgaggggaagagctcgcgcgagcgggagaggagggaggatgcgagcgggaggaggctggcggaggcgaggcgggacgtgaggagggagacggtgtcgcgcgacgggaggacgggcgcggcggcggcggccgtggaatcgtcgggcggggacgcggacgagggcctggcggtggccgcgtcgaagagcgccagggcccggcgcgggtcacgctccgcgcggaccaggcggtggaggtggtcggcggtgagggtcttgggccatctggtcgccgagggggtggccggcggcattgggctgcggcggcggcggcgggatgggcaaagcctgcgtgtacgaggcgggacagaggtgttcggcggaatgctgccctgccctggcaacacgaggacctctagcaagtgcgcgcagttgcgtgaccgaacatttgtcgggccggccaaatgtcaaagaaaaggatgggcctatttcggccatagctgaaaattaattagggcctgcttgggaattaaggacctttctcgaccggaataagttcaccagaggtccctca

SEQ ID NO: 59857 - DNA, 2595 bp, Oryza sativa
catggcgttgtgcgcactcgcgttgttccccttcgtcgcctctgcgtcccgtgacctccgccaccatcccgcgggcttcgtcatcggcgggagagggtagagagggggtcgagccacccgagcttcactcatcggcgacaatggcgtccctctagccaactgttgttggtgttgctgatgctaatgcggcttcctccgccgcctccccgcctgcaccaccatctcgggcagctccacgccgtggtcccgcacccacagcgacgtcgtccgcagcgccctcgctgcgcactgccccagctcctctcccttcccttccccgtctttcccgccgtcaaagcagcacaagaggcacccaaggcggcgacgtcgcctccctccgagcggcagcggcgaccttgtctccctccgttcttgcccgtcgccaccctgcccgccggcctctcaggctcgggggaagaagagaagaggagaagagagaacaaagaaaagagaagaagaaaaaaaaagaaaaagaaaagaggagaaaagggcgctgatatgtgggttccaccatatgccacgtcagctaaacgggggaaaattagatcagtactgtttagggacttttttttgcacggttttgtatagtttaggaatggagatttctgattttgtggttaagggatctcaaaaatctcgctgttaagttgataaaccttcggtgaacttattccttctcgacctggtaaaagaaataaaagcccgtaactttcggccacctaaagtaccggagaatatattcaatacccttcctgttcgggagaaaaaattggtagaaataacttatcggagcaatttgggacttcgaagtagacaaatagatagataaaaaaactatgatgaataatcaaaaataacatcaaactcaccaacagatgttcatgtaatgttccacatgttttcacgtaaatcttcattgtagttcgtaaagcaatgtctcggtgcttcttcgtttgtacttatatttcaccggtaattaggaatgcagtttttataggcgatatataccgagaacaaaatggatatccttaaaaaaacaaatggaactgatagatctcgatataaaaagtcacctaataaatctatctattatattattaaaacagctttaaaaggagacatcacgttcgctgtgggagctagaaattctcatattaatcggagaaaaagaaaaaaagaaaagaagagtccaagtagaaatacaatctaaaaatagctgaaattcggaattaaaaataagcaatattgaaagaagtttctatataacaacccaatacgagattaatacaaattcgaaataaaaataaaataaaatccaaaattataaaataaaaggaagtccaagtaggaatacaatttaaaaatagctgaaattcagaattaaaaataaggaatattgagagaagagtccatataataacccaatacgagattagttaatattcggaataaaaataaaaaaaattcgaaattagcaaaaagaaaaaaagttaaaataggaatacgatttaaaatcagctgaaatacgaaattaaaaataagtaatagtgaaagaagaatcaatataagaaaccaatatgagattaattaaaattcagaataaaaaataaaaaatatccaaaattaataaaaaaataaaagagagttcaactgaaattcaaaaaataaaaaaaaataaaagtattaaaaacactatacggtattaattaaaaaaatttaaattagaaaaagaaaaaaagatttcaattaggaatagtggtggcagttgatacaatatataaaaactgttagtaaaacaccaaatagaatcctaatgatgattaaaaggagggacgagcaagacggttgccgggacttctagaaagtaaaaaaaaaacccaattgataaacatattcgatttttaaaatctcaatgagaataaaggagaagcagcatgcggggtgtataggagtatagttgcagagccgccaacggttagcgggacttttagaaaagaaaaaataaattccaacgatagttatgttcgattttagaatcctgatgaaaataaagaataggcggcggatgggccgtagaggtgtatagtggcatcgtttgacgggacttctgaaactataaaaaatgaaacccaacaagacaataaactctaaaaactacaaggtccaatttttaaaggttcggaacttctaaaaagtaaaaataaaacaatgataatcatgatgcattttaaaatctcaagggaggcagcgggcgagccataaaggagtacaatggcaaacccgctgacggtttggcgggacttatagaaagtaaaaaaaataaacccgaacgataattatgttcgatttgtaaaatcccaatgataataaagagaaaagagagtggacgggccttagaggagtataatggcagcgtttgacgggacttctagaaattataaaaacgaaacccaacgagataataaactcaaaaagctataagatccaattttaagaggtttcaaggagaatgaatagaaatagtggtagaccgaggaaacaaaagaaggatatgac

SEQ ID NO: 59858 - DNA, 2258 bp, Oryza sativa
ttttgtctgcttctcttgttggataatgtcttgatgtcagttcctgcctttaataagttgtactcacaggttaagtcagtctgagttcattataccatattggaagtttatgagaagcttcagtcaacccttttctgttggaatgcgattcaaattgagatatgagagtgaggatgcttctgaaagaaggtattatccaacagttatatttcatgttttgcgaaatggcattacaatggtaaagatatttctagctcgtgcttggtttttcataaagaatttgtttttcaggcgtactggaataataattggaagcagagaggcagatccaatgtggcatggttcgaagtggaaatgtttagtggtatgcgctcttatatataatactgctttgcacagatggatgccagtagttctcttatttgatgttttactgcctagtgggtccgtgtctttcaaatagcagagtgcttctctgtattcagcattcaacattttgtgttccatgtcttagctttttatctgttgggaagttatagtttgtacaatccaaaattttgaatagatttaatggctcatacaagggtaaattacggaaacaaaggcatttaacctttttatgtgaaataaactagcttaaagtttatttttgtgaacttatgaaagtattggtcaagatttcagtgtttgcagcgcatatgtaaattcgtgtttgcagcgcatatgtaaattcgtggtgtacttcaggttctatatctatgtttttctgaacacacaagtttagaagcatttgatatgatgaaccctgaaaaatagcgccctgcacttctgcttatcagcttataggatagaatatagaggttgaagggcatactttacatgccatagtgggcagggcatcgtctttactttgttaaaattttctccatttatattccaaatctttatcatgttcctgatttctagtattgtattgtgatggtgacaggtgaaatgggatgatgatgtggagtgccgtcggcctaatggggtatctccttgggagattgagcttagtggatcagtttcaggatctcatctgtccactccccattcaaaacggctgaaatcatgcttcccccaagttaatccagatattgtgcttccaagtaggttccatttacaagtcaaaggaatcattttctgtgctgcatgttccctgttgaactcacttttccttttcccattttggcagatggaagtgtttcttcagattttgcggagtctgccagattccacaaggtcttgcaaggtcaagaattgttgggtttaaaaactcgtgatggtactgttaatacagcttctcaggcgactgaggcaagaaattttcagtacactgatgaacgaagttgctctatcaacatgagtaacaatatcttaggggttccgagacttggggtgaaaactccaagtggaaaccctgggttttcctaccattgctcaggctttggggaatctcaaagattccaagaggtcttgcaaggtcaagaagtgtttcgtccttaccgaggagggactttgtccgatgcctgtataagaggttctggcttccgtcaacctgatggcaaccatgcacctggtgcagcatttaaatggcttgcaccacaaggatgtgatcatcatgggataaccacatcagttctgccgcaagcatcctctccatcatctgtcttaatgtttccacaaactagttcaaagatgcctggccttgaatacatatacggatgcctggatagaaatgagaatagccgacattttaagattggacctacacaagatatgacaagaactgatcaaacattacgactctggcctcatcttatttcaggcaaagtgctagatgagtgtacgagaaatgagaagctgcactctccagtcagtggtgctgagcatgaatcaaataacaagtgtcttaatacaaatggctgcaaaatctttggtatatcattgactgaaaaggcccaagcaggcgatgaagtggattgtggcaatgccagttatcattctcggctccagtctttaaaaccacagatgccaaaatcattgggcagcagttgtgccacggtaagtgctcaatgaaatgttcttttggcatcttcttcctgaaattgcttgctaaccgaattatttacaggtccatgaacaaaggcctgttgttggcagggtcgttgatatttcagcagtgaatacgatgatctgatacatttactgtatccagg

SEQ ID NO: 59859 - DNA, 1349 bp, Oryza sativa
cttctgtagttgactgctctagcttgtagttgtgtgttctatttcaaggcctacttctgtaaacaaggtagctaatttcctttttatttgattgccactatagtacttatgtcactgcgccgactgtgcaccctactcttggtggacagctgctcagttgtcataaactaaatgttcatgaataccatgacttaaaaacgtaatcctctgttattcatctaacttcagcaacaggagttgattttgcaatggcacaaaataacctagaaaagttaatgatggtaatgtgatttagatttaaaagactcgaactgttgtgtggggtccatttttaagatttggattcattttattctagtgaaacagaggtgtttgagaatgccatatatatacttttaatgttataatctcgtctgaagttcgagatgttaactgcagaaatcctagaatctgaaataaccattgtgcttatttgaatctttcgctaagtttagtatcaaataagcacattgggttcaaagtatattaaatcagcaccttatgttcatatattgtgcatataaaatgtgcattgtgttcttctcctgatttatttgctttgctttgctttcagccctgtcccatctgcttcgaaaagattacaagagatatgttaaatcatatcaccatgcaacatggttacttgttcaaggttaatctccttccatacctattctgttgcacaagcatatgctaattctttgataaattttcttaattatttaggaatgttctgattcctttttcaaaattatttgtgatgtacagagtggtcgcaggatgcgcagattcgatattcccgagagccaggcactttctttactgagccgagatctgcgggatgctcagttacaggcacttctaggaggtggtcatcgtcagcgaagaagcaacactactgccacaaacatttctgctgatcctctgctttcttcgtttggcctgggcttctcaacattggattcagaggaacgatcaaaagcaccagttcctattcctgatgatacatcaattcataaggatactcctgctcagccatgggaatcaaggtatatatatttacactgctcagccgaatcacattagtggcctgatattcttccacctaaaaccccactactaacagcattacttcaagaatcatcctagtttgtctggaaagcatagcaaacactattgagtattagccaattagttcccatgtcctgccatgctctatgatttatttttcagctagcactttcacaaactgttcacagttaccttcttgtctgagacaggtactgtcattttgttacatatgtcagaaa

SEQ ID NO: 59860 - DNA, 1016 bp, Oryza sativa
ttttaaattccgaattttcgttattactaaattgtattttttatatggactctaaattcatctttcaatattccttatttttttaattcctaattttagttatttctaaattatggccgagtttagttccaaacttttttcttcaaacttccaacttttctatcacatcaaaacttcctacacacacacacttccaacttttccgtcacattgttccaatttgaatcaaacttccaattttgacgtgaactaaatacactctatatttctatatgaaatctagacttgttttccaatattttttaaaaattttgaaattttgttatttctaaattgtatttctatatggactctaacctttacttttactttttttatttttaattctaaatttcacttggttctaaattgaataccaatgtggactctagtttcctcttccaatattacttatttttaatttcaaatttcagctatttttaaattgtactttattatggactccctttttttcttattcttgattaatatgagaatttctttatcgtgagagaaagtgtggagccttttttctattatttaataagttagtagatagaggattgaacacccctagagcaatgtcactctcatgtaacgagtcaagggcaataatgtaattttccgttgtcaatgaatagatagggccctccagagacaagggggatcccaatccatcccatgaatatatggttactctaactctcatccctcctctcctcctatttgactatctcctatatccaaccttaggctctctccaatgaggggtgggagcccttgccatgattgttcggccaatttgttccaacaattgcatgttttatcaggaaactcttttaacccatagagggatgttccatcgtatcgtgcttatcaaataaatagttttgaagaattaagataattatatttggcaagatatattaatatatcactccataaatatacaagtttaaatttgacttctataagtt

SEQ ID NO: 59861 - DNA, 1539 bp, Oryza sativa
acgttcgatagaaaacaaaatgcgggacggctgcgtatggtgggacccagtcatttaactattcaaccaatccatttcccattcgccattccccatccttatctcttatgtcttatcttcttctccccattttcttctcgccatcccggtgaccggagggcaccgcaggggttcgtcgcggccgcgtggctcgggggacggcgtgtactccgccgcggcgaccacgctgccctacgaggacgcggatgggctcatcaagtacttcgccgtcgacgactcccgcggccgcgtgttcgtgttctctgtcgccgtggacgcgctgctcgagctggagcctagggtgtgcaacgagccgccgatcactgccctgcttgtgtacctctctccgcgccacacctcttcttcctcttcaccggccatgccgacggctccatcgctgcccaccgcctcgtcgagtcgtctcattatttgttttcgttgcacctttgtcgtgaaatgatgtttcattgtatttttattggatgttgcatatattattgtctttttgttgcaatcagtagttttcaactgttgcattcacccaccgcctgatcgagtcgtcccattatttgctttttgttgcatcttgtcgtggaatgatgtttcattgtgtttttaatcgatgttgcacatattgttgtctttatgttgcaggtagtagttttcaagtgttgcatctagttacaactttttaacccggtgataaaatattttctcaagactgatgaaacatttctctccaaaatacaaacaactgaaacatttatattaaaacaattttttattgtcaatgacacatttctctgcggcactgaaacattcctcttgaaacaatttttattggtcagtgaaacatttctccgtatgcgctgcaacaccgtccgatattttaaaaaatatcagactttcgatttgtagcactctccgtaaactctataggtcccgaccacatcgcacatgaccttaggaatgacaccttggcatgcatattgattcagttcaatatatatagcgacacatacagtgaccgagatatgtgggatctctcttagcctcctcctctagttgcaagttgcaaccaccagtggctagagaaaaacagaagcaaagatttgacaacgcttgacgacagtaataccacagcgaactaggcgccaccacacgcccacccctcaaccggcgtgatgacgcccgtgcgtgcgtgtgatatatgatccgatcgatggcaaccggccgatgatgtatcgtcacactaccctgcatgccatcagtggaagagagcccacgttgagctgtaaagcacagcggccactgtgaagaaccctggacgtcaatccgcgcactgttaactgttccctgaaaccggcgagagccagccggcggcaggcggcagcccgaaacaacggctttccgatcgatcgatcgatcgctgctgcgcaaacccgcgaaaatgacaaatgcatgcacgagataagggagtgtggcaactggtggcgcatt

SEQ ID NO: 59862 - DNA, 7902 bp, Oryza sativa
  unsure (1)..(7902): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggtgttagaaatggtgagtgggaggaggaacacagaaccaaccgttgagaaccaaaatgagttctactttcctgagtggatatatgagagagttatgaatgggcaggacctggtgcttaccatggagacaacacaaggcgagaaagaaatggtgagacagctagctattgtagcgttatggtgcattcagtggaacccaaaaaaccggccctcaatgacaaaggtggtaaacatgttgacggggaggttgcagaatctgcaggtgccccctaagccctttacatcgtctcaaaatcaacttgtgatttagatcatgagaccgcatcgccatggtttggactttggagaccagcaaagcaatggagcttggccagcatttcctataaaaaggcatcaccatggtttggtgcctgagtgagagatatgcttaatccacatatcagaaaatagttcttagtgagctgaagcatgcacatatagtgtttgattattaaactaaactgggcaaccagatatatgatatatcaccatgtactcttgtaatttgcaacatatctcaatggatttaatttgcaatataataatagttggaagatgacaactaaattaccttattccatcgttgatgctagtccactaatcatccttgctgaacaccaacaataaggtcatatttactcccagtgctgcattttcttttcaagataaaaaaagaagtgctgcatcatccagaagaggaaaaaaaataaaaataacaaaggaaggaagctaagcaaagggattattaccaaggcagcgaggctctggatggacatggactaataatgtgggagacggaggtggtgtgagcgacttgagaagacgaaacatgtggcatcaggcttggtggattcgaccggatctttgccggccgtcagcgccaccattgaagacacggtagcaacaacagatggcgccatggcggtacgggcgacggcgaggcttggtcacgcactctcgcatatgccgggaggaaacggcagcttacccatctgtctacggaggcgagaagcggcggcggaggcggctcgcggaacggcataccgccgcattaaccggagctctcgccgggaatagtggtgagggacggaggaagaagaaggggatttttttttttttgttggagagagggagaaggggatgattgctcggccacaggccggttaggatggcccacctaatcccccgcggcccatgaacggtggattgatctgacggttcacatgtagcccaattcacgagcaaatataatgcggaataagttcaccagaggtccctcaacttaacagcgtgatttttttgaggtcccttaaccacaaaaccagaaatgtctacccctaaacttactcaaaccgttcaccagaggtccctcggcggtatttttgcccggttttgctgacgtggcatcctagtcagcaaaaaaatttaaaaaaagtacgtagagcccacatgtcagctgcacatctttttttcttctcttttcttctccttctcttctcttttcttctctcccctctcttctccttcaggctggcggcggacgcagctgcgatggccgtgctcggccgccaccaccgccgtacccccgcgggtggccgacgatgctaggagaggcaccaccggcgggagaaggggaagaggcagaggaagagattgtttcttggtcgccggccgcctccccctccctcccaaactcgctggccgccgcgctcgctcgccgctgctctgccgcgcgctcgcgctccgctactctgtccgcggcctgctcgcgctccactgctcgacccgccgctgcgctcgcaccttccgctgctccgttgccacgctcgccctcgttgcgccgcccgcatccgtgctcccgctccgccgccgcgatccgatgcttccgctcaacagccggaggaccgcaccgcgtagcctcgcccatggcgacgacgacggtagagagccgatgacgacggcggccacggcgcgcggctcctccgtccgcagcctgaaggagaagagaagagagagaaaagaaaagaaaagagaagaggagagaagaagaaaaaaagatgtgcagctgacatgtgggccccacgtgttttttaaaattttttttgctgactaagatgccacgtcagcaaaaccgggcaaaaatattgccaagggacctccggtgaacggtttgagtgagtttaggggtacacatttctggttttgtggttaagggacctcaaaaaatctcgctgttaagttgagggaactccggtgaacttattccaatataatgctccaacttatattcactggagccagcagccagtactccctccgtttcatattagagatttgcttcagtccagcaaaaaaaaccttgagataccggtgtctcgcagtactaaatcgtttttatcttagatatagttggcaggatgggcattgttacctcctttcacttttttccgaattttttttgaaaataatattattttaatggaaaatcgcaaaattataggtcggctagacgaaatcgcaagtttagcgccctgtcgaactggggcagttcgataggtacccctgtcgaactggggcagttcgacagggtactgtcgaactggggcagttcgacagggtactgtcgaactggggcagttcgacagggtactgtcgaactggggcatgctagttgtccaagaaaaaaaataaaaaagtacttgctacagtgcccgatagggacgtatcgaacagggggagttcgatagggcgcgtggcatggacgtatcgaacagcggaagttcgataggcagtgtcgctacagtgccgctacagtgtgcgctacagtgtgctacagtgtttttccttttttttaagttattttattacctgtcgaactggggcagttcgacaggtaccctttcgaactggggcagttcgacaggtaccctttcgaactggggcagttcgacaggtaccctttcgaactgcctccgttcgacagggtgctaaacttgcgatttcgtctaactgacctataattttgcgattttccattaaaataatattatttccaaaaaaaactccttttttcctagtcaagtttgactaagattataaaaacaattaggaacatctaaaataccaaactagtttcataaaatttaacattgaatatattttgataatatgtttgttttgtgttgaaaatagtactccctccgtcccaaaatataagcatttttagcatagtgtcaagtcaaacatttttaactttaactattaataggaaaaaataaaaaaaaagatctatcaagtaaaattgatgttactagatttattattaaacaaactatcgtaatatgcaactctttttatttaaaacattttacttttatagatattgttggtcaaaatagtatctcgaagaccgtgtcgaaatccaaaaatgcttatattttgggacggagggagtaatatatttttctataaacttggtcaaacttgattaagaaaaaaaaatcaaacgacttataatataaaacgaagggagtacaaaacacttgcttatttatagtagtatttcatacaaaaaaaataaatttatgcattagtatctatcaattgttggatccatgaatatggaataataacaaccattatttatgaacgctaattgctagctagatacatcattttcatcacagcctaactactggctaattcagctattccatcgtcctcttctgaaattgcagaaagatcggaggagtgaaagtaagaatccatgacttgtggaggtggcatgccatccccatcgcagaaaaatggtctcagaggcacttgcagcgcatccacacccccttcgagcatctctattgcctcactcatcgtcggccgatcgtgtgatttcatctgaatgcaccacagcccaacaaggcacaacttcctctctagctcatgcatgttggcaaagttggatatctcatcaacttgttgatctgctattagcttatcataaacccatgatgggtagtatgccttacttgcactggaatctgcatttggatctgcattccttcgtcctccgaccatctcaagcagcaacattccaaaactgtaaacatcagacttgccagatatgatgccaaagctccgggaaaccatctcaggagccatataacccactgttcctcgtaaagccctatctgacacaaagctcttgtcccttgggtacagtttagcgaggccgaaatcagcaacttttggaacaaagttatcatcaagaaggatgttgtgtggcttgatgtcaaagtgtagaatctgcatatcacacccttggtgcaggtagttgatccccctagcaatgcctagagcaatctcattgagcttgtcccatgagaatcttctctcagatgagaagatgtgtttgtctagagatcccctaggcatgtactcgtaaaccaaggcccttctcatttcctcggagcagaaccccaccaaacgcacaacattaacatggtgaatcctaccaatggtggcaacttcactgatgaattcttcgccgttgcaattagagtagccattcagtatcttgatagccacatggagatcacccgggagcagcacacccttgtatacagaaccgtagcctccttggcccaacttttctctgaaatgccctgtgattgcgataatgtcggtgtaggcataccttgtcggaccgagcatttgttgcattcggagaaatttctcgactgcatcaattgttatcattcttttcaagtacttttgtgcaaggaaaatcaatacaaccaagggtgccaacagatacctgcatggtgctgcgtacacaagttcgatcggttggaatcaagaaattgtaacatgcgtatataactagatgaaacactagaaacaattgagatgatgtgggtttataagaaaagatagaaataacattaactattaatgggataaattatatagggtagggacgtagggtcctggtcgatgacttacgtacgtgcaagcatcgtccagaacatcaaggcatacaatattatgcccaagagtatattgtatggcgatggaattttagcagttgcgcaatccatgaaattttcagtcaccgaaagactaaaccaatctgaaagtttgcctataccagtcgatttgctgcatgcaagaacaaagacggatagattcaggcatatataaatggaggggaggtcggaggaatgtgcaatcagatattatgtcaagatcaggaactcacggaatcgactccattaggcaatccttgaagcttcgatttctatggtgtctgaaaggaaattggacgcggaatcctttcctcatgaattttactacgtcttcataacttaagctatcaactgctggtgctacacgacccataccatccaaaggagtcatggctaggtaaccacaggaaggctcgaggttttcaatgtaacaggacaatctgccagtcaagacataaacgaaggagctgctggtgcccatgcaagcaacaggactgtacataacattgttgtttatttccttggaacagttgacaaagaaagaccaccaacgtgaagcagggtccaattcgacttggatgttgtatggcgatgattcttcgtcgtcactactaacatcatcatagtaataaggaatgcgtttccagcgaggaagagggcaattgttacgtgaatccgagatgttggcgtcgacaacccagaaggtggaatcactgtagtcgatgcctgtcacaaagtatgttccgttgtcgatctgaattgtagccttgtcatcggtgcaagtcagctcatacgatgcaacaccgcactcgtagcctcgccggtggaaaggagacgcgactttgctaaaatggccgcaggtgaacggagggcatgcaggtattccatgaattaaaggccattctatatccggatctgggacgacaaatcgaagcacacacaggacagagaaaacttgcagggcagtcgagcgacggaagagcggaccaggaatcaccatggtgtggggtagcagctagcttagctagttcgcccaagcaaagcatgcaggagctaggtagtgacacggatgatattacaagtgtctatctccgcgcggtgcgtgcactgtatgtaagcagtgtaactagagttttccaagcaaataaatttagctaaaaagcaacacttcatgtccttgactgtgatgctgttgacttggaagtctttgatgacacgaagcagattagtctaaggcgtagcattcagttccacaagagtctaccgtgctgcatcggtcaccgtttattgatgttgccgaaaaagattggtcaaagtgcacacattaccagtcgcccgctatcacgagccttatcattaggggaacagtgcttcacgggttaatttcaaaagcccccaaagctaacatagtgtattcttctaaaactatcttaacaggacgcgactacaccgagagtgctagctatatggtgctaaagagagacacctttctttccaaaaaaaaaaagctacttatacactcaatatctatgtatttttttccttcttagagaagtttctcttaaattacttatctgatttataatccgattacgccgttgtgtttattgcaattaaatctttacaacaagatctcacatgattatattttgatgaaaaatcacaaattacttttatgatatgtctaaattacgtttacatttcactaagttacttcttaaactataaaagtaaattcagtaagtctaaaagtaatttatatatattatagaagtaacttagaacaaacgaagataactttggcatgttatttgaagtaaatccgttgtatagataaaaacatgactctatctaaaaattaaattaatcagcacaaattatggaatttactaaaaagtcatattttatccctacaacgaatttacttctaatgtcgtgacaaagttacttacgttttgttttaagttacttttagaatatatgtaaattacttttagactttattgaatttacttttatgtctaagaagtaatttagtccaatcttgtcacgtcctgataaattcatcccgaaataaaaatcatcttctaaaaggaataatagaattaattaaaattcgaaaagaaattggcaaaccttaaaatacgtacaagaaaaattcaaatgtgacccggagaatttttgttaaattctccttggtctaaaaggagccctcaaattttagtggaattttcagagcacaaataataattgagaagaaataaacaaagttgaaaaggtttataaaaagaaaaaccctaaaagaagtcttctttccccccctttcccttcttgggccggctcggcccacttctctccctccctctttctcctctcccccgcggcccatcggcctcccccgcgcgagcgccgctgacaggcgggcccgcccgccaccctcgctgacgggtgggacccacctgtcatcgcctacctcccgccgcgccgccgccgcgcccgtgccctagcgccgccgccgccgcggattccg

SEQ ID NO: 59863 - DNA, 1698 bp, Oryza sativa
taataatactgtgtagctctaggatcgtctttacaaaatggctttgggcaactaagtgacttttaaatgctgtttactgcaaaacctaacccctattattatccccttgtaccccccccttgcattaatcatgcatctgccggtgtggcttgctgagtactgtggttgtactcattcttgctcaatccttcccctcttcagtaagagaagctttggagaagatgtcttaggtggagtcctggcttataccccagttgagcgcctgtgaagatggagccgtaggcccgctagtccgctgctgtttatttttgattgtcaggccttaagtgcctttgtaataatgtaaatattatcgatataataaagatgtgtcttttatatcatgtttgtgtggtgtaccccggcttttcctgggacggggattaatacactagcgttcgggaaaaggcaattttcccggtcgcgacaaatctaaaagtaacttatatatatatatgataaaagtaacttatgtatataataaaagtaatttacaaatataatttttttttcatcgtaagtgaagatttaattgtaacgaacataatagcgtaatcggattgtagatcagataagtaatttgagaggaaactttatttgaacaagaaaaaggcacccacgtgaactttatttgaaaggaaaaagacatccccgtggatggacatcatgacgacgtgcacagttagacggctctcagatgcgtcgtgctatagagctaaaccgagaacgctctcgaaatagatttcgcgatcttaatagtatacttcctccgtttcataatataagccattttaacattgtccatattcatatagatattaataaatctaaatatatatatgaatgtaaacaatgctagaaagttttacattattaaatggaaggaataataaatgatgtatactgcttatgcacgttcctataaaaaggcatcgccatgcatggtttggtgcctgagcgagagaaatggttaatccacatatagtaaattagttgtcagtgagctgaagcatgcacatatagtgtttgattattaaactaaactgggcaactgggtttgtgatatatcaacatgtactcatgtaattctggtagctagcaacatatctcaaattctcaatgtatttaatttgcaatataataatagctggaagatgacaactaaattaccttattccatcgttgctgctactccactaatcatccttgctgaagaccacgataaggtgtggtattagctctcctatcccttcagctcaagagatcaatcccagtactgcattttcttttagaaaaaaaaaacgtgctgcatcatccagaagagaaaaaaaacaaaggttattagagcaagtttaatactatagtcaactaatagctctaaatcatttatagccaatgtaatagccaattcatacaatagttacatactatactattaattcttggtcctacctgtctgtcggtgatatgggaccgggagtattgcgcccggaggcttgaggcagatggaatcgcccacgtggcctggcaccttcggggacgtcgggcccgagggtgaggtgtccgccctcctcctgatttccccgagggggggtcgggttgctcctgccccggccccgaaggccgaggtgccccgaccccttgtggggtttgcactat

SEQ ID NO: 59864 - DNA, 3647 bp, Oryza sativa
cggtcgtgttcacgcagatggcgtcgctgttcgtcgtgcagggcgccgcgatgcgccgcaccacccggttcccgggcttctccgtcccgccctccagcatgtcggccttcgacatcctcaccgtcgccaccaccatcttcctgtaccgccgggccgtctgcccgctcgtgtcgcggctcacgggccgccacaccggcccaaccgagctgcagaggatgggcctcggcctggtgctcggcgcgatggccatggccaccgccggcacggtcgagcacttcaggaaggccggcgccaccacggcgatgagcagcgacctgcacatcatgtggcaggtgccgcagtacgcgctgatcggcgtgtcggaggtgatgatgtacgtcggccagctcgagttcttcaacggggagatgcccgacgcgctcaagagcttcgggagcgcgctctgcatgatgtccatgtcgctcggcaactacttcagcgacgtcatcgtgagcgcggtgaccaaggccaccgccgtgcgcggccgccccggctggatccccgccgaccttaacgagggccacctcgacaagttcttcttcctgctcgccgtgctggccgtcgcggacttcgccgtgtacctcgtgtgcgcgagccggtacaggagtggcacggtggacgtcgaccggagcgacggggaggaggaggatggcgtggccggcaggcagatggcggcaacggtgtaagcgtcaggatgaatcggccgtctgctcgcgctcgatagatgcatggcaggctgtcgtggttcttgagacggagactgcagactcttcgaggggatgagttgcattgggacgagttggtttagcacgacaagtctccgttgatgataggacatgcacggggggatagtgacacgatactaaagaataagaggtcgcctacagatgcagtattgttctatcatgtacgcctgtgtttcatcgtttcacatttttctggccaatgtaacaagagaacgcgactgttactgaccactcatgttttttcttctgcaagagtgactgatcaatgcttctgtgcattgccgactgttgattgatacgcatactagtgctaataatacttcattttccctgcctagtactgttttgtttctactatttacaattcactgctgttccttcacggtggcactgttactttgggcctgtttggcacagctccagctctaactccacccctcctagagctggagttcagccaaacagtttcagctccaccaaaattgagagtggagttgggtgaagctctctcacaaaatgtactagagttgtggagctgggtttaggccccgtttggcatagctctagctcccactccaacttatcaggagccggagttgtgccaaacgatccagatccacctttttttggagtggagttggcagagctactcctaaaaaatgaactacggggtggagctgggtttttgctgctccacagctccactctatcccaaaagacccactaccctctaattttttagagtatctacacgaaaatgccactcaactacccctacaatcctcctttcctcccgttctctctcctcccctcccaatcccgagcgggcgccggcggcggtggcgggctgcggcagcggcgggatgacgacaggcggcgacaggcggcgcagcgtgacgatgacgagcgggtggaggccggcggcggcgggctacggtagcgtcggcggtagggggccacggcgacggggcgtgacgacgacgcgcgggcggaggccggcggcggcgaagggctgcggcggccgggggctgcgggacgaggacgggcggcgcgcgtggccggcggccggcggcgcggctggggccgattggtttcgttttttttcattttttcattttttttttcagatctagaactgaaagtatagccaaacacttttaacgagttttcaacttcaaccggagctagctctcactggagttggagtttagagttaggagttggagtttggagccctaccaaacggggccttagacagctacacaactccactctagactcaactcctggagttatatttaggagttggaactgtacgaaataggccctttgttagcagcaaggcggtgaacagctgaaataaagttaagtggtagaaaaataaggtgtgtgcgcccacttgggtttgtgggggcgtaaatgtggtatgtggattcacatccaacttgtagccgaaaaccatgaaatcgttatttttcagtagcagacgagttatctatttggctgcctagcactcaccatatttggattgctgggccaaatttgagttgaagtttattatttctgtgaagagtacactttaagggtgtgttcagcacccctttttcccaacccatctctctcgttttctgcgcgcacgcttttcaaactattaaatggtgtattttttgcaaaaagtttctatacaaaagttgcttaaaaagtcatattaatccattttttaaaaaaaacaaatacttaattaatcacgtgctaattgactgctcagttttccgtgttactgttccgggttggaaaccagcctatgcaaacacaccctaattatcttggctatgcattgagcttcattcgtgtccattagcgcaaaaccggctatagagcgttaccgattatcaaaactaatgtaaatcaagtccctcggtagtttacacggcgctttcatcctacggctacatgacagattaacttagtccttatccgacgtaatgcttacatgtaattacagccaaggaaaaaatatataataggactcgtatccacatgtaagtggtaattgtatagatgttttttttattttgagtaaattatcacagtactgcaggtttaacatgatatatcacaaaactatagatttagcactaaatttatcacataactacatgtttaagactaagtatcacaaaactatagatttgatatcaatttaataacagaagttggacttatataactcaaacatagcattagtgctgaggatttaaaccccaaaatctgtagtttacgataatttcatcagcaaatctatatcttttttatacttagccttaaaccagtaggtttgtcataaatttattgttagatctgtagttttgtgatacatcactttaaatatgtagttttatgataatttaatcaaagtatttatagctttgtgaaatttactcttatattttttttccatgtgaaacatatgagtcctacatctttcattagaaaaattatggcacaactacgactcacattgggtctccttatttttaaaattttttaaatttttttctagtttcgtgattaccacaagtgccatgttagattaagactatgccaacgtgccaagtagaggttacataggtcaaaaaccactttcaaattagtcgagggactcgatttgcagtgattttaaaagttagaggatactcttacctaattttatagttgagtgatgcaaactcaaattagggatgcgaaatggaccgtttccttcattagttgggtttgatgattgaaggtccgatctaatttgtatctcttaactactatatcagatatcttgacccataactattaaaaccaatgcaaggg

SEQ ID NO: 59865 - DNA, 884 bp, Oryza sativa
gcggcgagagggacgcagcgacggcgagggcgatggtcgccagcttcgcgaactcggcgtcctccggggccagcggcgacgcgtcgtcggctcgccgaacgcgtcctcgcacgtccctggcgcgtccagcgccgcgctgagctgcgtcaccgcgtcctgggtggcctcgtccccgcccctggcgatgtcctcggcggtctccccgagctggtccacggcgtccgagtacacctccgcgcacacgccgaggcggtccttcctcctcgcgtccttctccgcggctctcagcgcggcgatgcgcgcggacgtggcgttggcggccttctccgcgatcctggccgcgatggcggcgaggccgcgcgcgtcggccgcggtggcgctggcgctgtcggcctggaaggccttgatgcagtcgttgtaggtgacgtacttgtggccggcggcgacggacttgcatgtgtcctgcaacacggaggactcgcaggtagacaatccgagcatgaggaggagcaccgggacgagcagacgcctcatggtcgctgggattgggtcgacggccggcgatggtgagcttgcgtaggttgggagcttgggattgtgttgtggcggcggcgtacgttctcgcggcttgtcgcgtagacgtcgactgcgtgtagacggtttcgatcagaagctagcgtgcgagacctgggcattttaatacgcgggcaagatttgataataccataatagttgtcttaataatttataagtttgctaaaataaaataatgttgtaccagaccctacttgtcatcgtcaagacattatggtattttgagaagtttgattcgatcttgtctacctttttatgatctgtgcttcctttttttgggacacaaatgt

SEQ ID NO: 59866 - DNA, 781 bp, Oryza sativa
gcaattcctctctgtctcaaaatgcaacggaggaagagcacgtgaagatgacaacgattgtgccattgccgcggattggtgaaaggaggcgaagagggatcatcagcgcacggtgcgggatgaggaatctcgcgaatcgtgactgccgctgccacaggagagaggggagcgatcgggaaagtagccactggatcaaccactgttgttgaccatgaaccctaggccgcctaatcgccggcgtccaccgatccggaaatgaagaggatggagaggagagggagagaggggcggtaccgggcgtagagggcggctgtcggcttcccctcgccttagagtggccagatctgccagcgaagaggccgaagtcaccggatccggcggtcccggcctcctcgttggcggatgcggcggcggaagcgagaggatggtgacggcaatggcccgcgtgctgggcggcggcaggcacggcagcagagagtgcgcgggggaggtcatcacttgcgggaagaagagaatgagggaggcggcacgcggtggcggccattgcttgggcaggagatagagcggagcgagagaaggagaggaggcaaatgaatggtggcggctagggttcgaggaagggggttagggttgtttttgttttgcaaaaacactcttaatcttctagttttcagagcacggttcgattttccaatttttcgcttcttcgtatataatattgttttctacagaggacctgtaagtaagcacgcaaaagttagaactaaggacctataacaaa

SEQ ID NO: 59867 - DNA, 1093 bp, Oryza sativa
tagacttaaaagattcgtctcgcgagttagtccaagctcatgaaatgaattttgtaattagtgtatatttaatactctaaattaatgttcaaatatccgatatgacagggatttaaaataagtctccggaaaccaaacagccctaaagttacgaattttctgaagtctcatcaccgaaccacccgaaacgcaacccctctctggagatcaccagatctactcgtccccaatggcggccgccgccgccacctccccggcgcgggcggcggcctggaccttcgccgccgccacatgcgtcaagctcctgctcgtccccacctaccgctccaccgacttcgacgtgcaccgctactggctcgccctcacccacgccctccccgcgcggcggtggtacaccgacgcctcgtcgcagtggacgctcgactacccgcccttcttcgcctacttctcccgcctcctcgccctcccggcgcccctcgtcgacgcctccctcgtctccctccccgtccccgacgcgccgccctccttcgcctacctcctctacctccgcctcaccgtcgccttctccgacctcctcctcctcctctcctccgtcctcctgctggccacggacgcgctcacgcggcggcggcggcggccgttcctctccctcgcgctcgtcctctggtcgccggcgctgctcgccgtggaccacgtacacttccagtacaacgggttcctgatggggctgctgctgctgtcgctgcacttccttgagcaggggagggatctcgccggcggagtcgtttttgctgctctgctgtgctcgaagcacctgttcctagtggcggcgccggtctacttcgtgtatcttttccggcattattgctgtggccggggtgtggtgaggggattgggaaggttggtgctgatgggggctggtgtggctgctgtgtttgctgctgcatttgtcccttcctgtactatgggcaggtgagttttgctcggttaatttacctttggaatggacgaattggtatgttttttttttgtttagatactgtaatccatctgtaatcatcagttcacttaaaagtaggaaattatttcttga

SEQ ID NO: 59868 - DNA, 3905 bp, Oryza sativa
tggtgaggaagaaaaaaaaatcacagtacacacatatgctgaaaaaaaattgttcccacaacctttattttaccaaaataatatgttatggagagatttttgaaagttacatacaagttatattataagttatattatagttatagtgtaattacatataagttatagtgttaaatttttaagagaaaatttgtcgacaaatatatagcaaaattggtcatcataggttgcccgtttgggcgtccgtcaccgtcgtggccgtcccgttccgagttttgttcacaaattagacgcgagaaaaaaaatcaaggagatgcggtgaagctgttggttggcgagctaactcctggtggcgttacagtatggcggcgtctttggctgattcttgtcccattgctttcgcctgctcaatttcaattctcctaatatttttatgagccggccagagctatcagcagatcgagcgtcgtcgccctcttatgattggatttcatcaccaagtaagtcattgtgataaccatccaatctggatgtttgacatacacatagacactgataacatatatttgaacctgcattcgactgtatacacttgaatcaaacccaataatggcacagtatcaacttgccaagcgtgccaaaaatcacaaccacaatatcgacttgactactccacaggacaaggaaaattgggggtgacataaaatttattctcttgcttgatacatccttacatcagagtaatcaagacaatatgtatagttatataccaaatggtgcaaaaatggaatttctttgatgaggttcctaataactacagtaccttactcagaaccaacaacttaaattggtaagagcggcattctaggcaacattgtgatgattaggaagtttcctctacactgactgtagtctttctacctttcttgccatcaacatataattggtggccatatgacataaatccccaaatggccatcagcatagctataatctttactccatccatcttgtcatgaaagaaaatcacagcaaaaacaggaatgatgggtagagctagggtgcttatcacatttgaaaacagcgatgacaccacaaagatcaatcccaccactccaactgatgctacctgccaagatatagccgtccacagcagagtcattacatatgacagtttcccagactggaatgcatgcatctctccttgtaaagtcatccattcaccacttgcaaataacccaacaagagaagccaatgttgccaccatagctgtttatatatgcatgttcaacacaactgagaacgtctccctcttaataaccttctcaaatgtgacttgcatcagggagagaatgagcgagtatgtagctgatgcccctagtgtcaacaggaaacccaaaatgtacttcccatgtgatatactagtagttccctgagaatcttcatcaactccaaggagtgaagcagaaaacgtaaggaggactacggaattgaaaatcagaggggtgaatttttgagcattgaggaaatatgagaagacagcattgaaggcaagctgactagcacagatgagcgaatatgttgagaccggaagatatagtaggccataggaatacatcaagtcgtctgcagcaatgatgaggcccaggacaacatatatcagagtaattttggggatagaaattgtaggggcaggactactagtgactgtttgtgtagaagatgtctttgaatggaaaagaaatagggcaatgaacaaaatcggaaagccagcagtttggacgaatgtggacatccacttgctattgccgccttgattgtagtagaacctcccaagaagtgtagatgcggtctgaccggcaatgaggaagaacatgttaactcccaccatcagccaccattgccaactcttgacaggagagttctgtataggtacttcatgagttgacgaagttgcagctttggatgaatctgcaagttacagaaggtaggcagtatcaacaggttagcccaaacttcatgtgttaagcatagcacggccaactgaaactttcttttcctattcaaaatagactaccaaagttcccatagtgaagtgaaaccctcctctcctttttttccccccaacaattggccatataaaccccaaaagctctaaatttattgagagaaagtcgagcaacacaagactatagctccatccttacagtattgtccattggtgaaactatcaaatgaaagcgagttacttggaatctcagggaaatcctgcactaatataaaaaaactaatataaagattttacttttgttaaatgcagtgcattactatagctggtgctatcatcaaccacttatccagctcatgtacgcgaacaacaggggtttgccaattaaactcacatgcctactctgccactcgatgatgtcacgatagtctgaaaagttaatatggtctataaacaaaaaacaaatcccatatgggcatatggccatatccaacacgccacgcacgagaaggcaattcatcgaacacctcgcgggcttacttccccacaccatcgaacaccaaataagcccgagagaacgaacgagttcatttcatctgcgtttaccgccgcccatcgcaagacgactctaacctcctcacccccactccctcaacgaagaaaatcggacatagctaaacagtgaggctttcgacagaggaagggggggaaagatttgattgacctgcgatctgtatctggacctcctcatcccggttgctaccgccgtcgctgttgccgctgtcaccggccatgcccgtcgttgggggcgctgctccgcgcgagcgcgagcgcgatccgaggcaagcggagcggtggagagagagggagttgataggaggagaagatgagaagaggtgtggcgccgcacgggggaagacaagtggggaaataaaaagagtaggaaagggtggggcgctgcagtcgtgtgaaaattgaaaactgcctcctccttctttcgcttcgcgagccgccgaccgatcccttgttttactatcgtcaggggctaaaacgagccgatctcgaccaagcccacataggggtggatatgagccggctcggctcggtctggcttgctaggataacaagccaagccagctcgttattctaacgagctagaagactggatcagctcggctagcttgagctagctcgttcagctcgcgagccaatacaccaaacccaaaaagtttgcaataaaaattcagattatcaaaccagcgttcaaatccaagtatgcaactgtatctaagtatcaaagtaatgaggcaacgaatcacagagtcaagtgttcaacaaatgaatcatcagttgaacaaatcacaggaggatgttagtacgttacacctacacggctgcacctcgtcttcctcctccgtgatgcacagggacactcggcatgggttgctcatcgagaggccgacagcgaccagtgagcatcacggcgtgggtagctccgcagttggggaccggccatctggttcctgggcatgaaccggcaagcagcgagcgtcggccactggacgctggacgggcgacggcgaagcaggatggagggagtgcgcaggcggctcaggatggagggagcggcgtgggatgtgcggaggcggcgcagacggctcagcggcgcacgggcggctgttgccgatgccgaatctggatctatcgagaatgaggggaaggggactgattgaccaagtctactagggttttggacattcctattgcacattttctttgggcctagcacgggatggactgatttttctctttctgggccagcaagttgagttatacttatgggccatgttttgttaatgtctctcctatctagctcattaagctcatgagcagctcg

SEQ ID NO: 59869 - DNA, 2224 bp, Oryza sativa
atactccgcgtgtcgaggtccgccgtgctcagcttcggcttcttcatgggggtcctcgtcgtggactcgtggtgctcaacatcgccgtggtgctcatccctcctcttcttcctcctcccctctcccctctcttcatctctctcccctctcctctccccatctcccctctcttcacctcccgccggcggagcttgcatgagcagcaccagcagtcgtaggagcaagacgggatcctcaagtacatgctcaagatgatggaggtgtgcaacgcgcaggggttcgtgtacggcatcatcccggagaagggcaagccggtgagcagcgcctccgacaacctccgctcctggtggaaggagaaggtccgcttcgaccgcaacggcccggccgccatcgtcaagtaccaggctgacaatttgttggcgacaatgccgtgccggggtgcgacggcaacgtcggcggcgccgcgccggcagggccgcacttcctgcacgagctgcaggacaccacgctgggttcgttgctctcggcgctcatgcagcactgcgacccgccgcagcgccgctttctgcttgagaagggcgtgccgccgccgtggtggccggaggggacaggcgtggtggcccgaatccgtcgtgccctcaccatcgcggcccccgcccccgtttccaccgtcctccacgccgccctccgacctcgacggcatcctcgccatgggcggcgacggcatcctctcccgtcggcgccggcgcgcgccgctccctctccgtcacgcctgagagagagagaggagagacaggaagagaggggagatagggaaagaggaggaagaagaggatgggtgagaatgacacctggggcccacatgggccccaccatttttattaatttatgtgtgaaactgacatgtgggtcccacgaggtttattgtttttcttagatcaaattgccacgtaaacgccacgtcagtgtcacatcaaatggagaccgagtcagattagccacgtaggcgtcacgtcagctaaaaccgctgaggaaccttatctgcactggttttgacagttgagggactgttgtatctgatttttcggttggaggacgaaaatcggattcgttgacaagttaagagacttcagatgaacttattccttcataattccacgtctctcggaagaagaatgttaggcctgcttcattcgtgcaaacggcagacaccgatcgcaaacggcagaacgtgtacgtcctgaggacgggccggcccagatgtaggaaaagattttttttgaaaataaaaaggagaaaagattagagcgcacacagacacactgagacgagtatcctcaggttcatcagaattttcagattagttggaattgcctttcatttgggggtttgcgttttcataaaactgctaattacgggctctctttgcactctgcaatgctgcaagcctgtcgatccctcaccttctctgagccccctctaagcttatggtcccctgtcccaaatctttttttttcgaggggacagacagggagctcctgcaattcactatagaagaagagagttgatccagtttataagggaaaccggacccaaaaaccttacaacaacacggttattaaaggaaaaccagcaaaaaccccgacattgacaaaccgaacctaagtacagccgtccaacaagagataaactcctaaaacgaagcctttaagaaggttacgccgacaacgacgacatcgtccgatcctaacgaatctaggttttcacccggagaaaactcttgaagtggagttgaacgagggctccagtagcaacgccttcaagaaggtgaacggcgtccaagggtgtcgccgttgctagcaccgagagcggagcaagactttcgccttggagcacccatcaaccatagcatccacgacaggagccaccaaatgtcacctgcacaccgaggatacctgcgatattcacaccacctgcacgacgaccggactccaaccaccccgttcccacccgaggacgcgccggatctgggcaaggagccagatccggctgtcttcctctccaccaacgccggccgacgcctagaggggcgccggaggacgccagtggcagccgcggggtgcctgcgtgctctggccaccaccggccggcgccggatccgggtgcgccaccgccggatccgcgggctgcaccattgccaccccaacgccgtcaccatccccgc

SEQ ID NO: 59870 - DNA, 760 bp, Oryza sativa
tctgtatgatacgattataaaaatctttcgaaagatgtataggtactcccgaattgcagatgatttgggccatccaaccggtgctggctgctgaagcccaactcaattacgcaaaggcgacatccatgacgacttggcgtagaaggcccaatcgccaggccgcggctccggttacagccgtgacgacgaagcggtggctgtgcgcagatcggagttgcggcagcggcggcggcgatggcgatccggaacttctggtcgatggccgcggcggccgtcgggttccggctcgttctcgtgctcttcggcggggacctccacctcgcctcccgccccgaggtctccacccccctcacctccatccgccgccgtaagcgctcccttgctcccctgcctcctcgtcccagacttgagctgtgctgtgttgtcgccgtaattggactaatagcttgttttcctgtgtgttttgcagtggcggaagggtactggctgaagcaggcttccatgtcgccctactccggttcgttccacacatcttaatcttgcttgattacttttttttgggggggacaactgaagtcgtgaattgttgagctcagtatagggatggaattactagctacatgagagcacttttaaaagtaaagtaaattgattgggtgctacttcttctagtaagctccattaagcatgaactgctgcaagcccgcactaatggggtgtgttaaaaaaaataagcgcaaaattgccatacctttactta

SEQ ID NO: 59871 - DNA, 1585 bp, Oryza sativa
cgcccatgcgaaggtggtggggtaaaggtccgcggctccggcgacgggcaggcgccagatccggtcgccccgcttggccgaggcgaccggcgacgggctcggtcgatgccggcgccgctccacggacctggcaggggggtggctggcggcggcgatggtggcggatgtagcggcgacgaagttggcgacgaaggcggcggactacggcgcgtgccgcgacgccggccctcgtcaagaaccttgccgccatgagggaggcgcggcgcccgtcaattgtacgccgtgcccgtgacgccttcctccatggcgccggcgacccgcactgtgcgctgcaccttcaggtccgcgccacccaggccggtctggacggttggcggctggcgatggtggaggctgacggtggcgactggacggtggtggctgatggtggcggctggacgggggtggcggtggcggtggtggtggcggtggcgatggtggctggcgatggcggctggcgacggtggtggctgtggcgctggcagtggcggctgtcgacggtggtgcaaggccatcatccgaggctgacggtgcgtcatcgtcggcagcggcatgtggagacggggaaggaggagtccgggtgcgggcgcgctgtcaagaactgtgggcggtggccttggccgaatttctaaagggacaatgttgttgatcgatgaagatccttcttgtgcggattagtggtgtgggtttggacagggaatcgcgggcgaaagccttgccgagccgtttggccggctgacgacggcgacgccgtttggcatcgttcccctccttggaggcgtcattttagattacccctctccttttctaaccatattctccgggtgaaaaccttgcttccttccgaacgagcggtggcggcgatccacgtcgcgtcctccttgggggcaccgctttggagaaacctcttcgtgcaaggattgtcaatggtctatgcattggcttcgaacttcagtcctaggctttgacgaggccttctagctccactttttgttttgcttttcttagtttgtgtcctctcttttcctgtttggtgtgttcaacttgtcttgaactacactctcttctggagtggaattttgtaataattggctgtagctctttttgagcaaaggccgagatattatattccattatctaaaaagctacgccgaataagaaacccaccagaagttttgataggggtcgacgccaaagcagataatccaaagaagccagccccatccataccaccggcaaggatagcaagagtaacaccactaactgcaaaagaaactgaggggcatccccgattagggcctccacgcatgggaggttgagaccatctcagcaaaacttgaaaccttcagccgtgtaattgatcttcactggaggtcaagaagaagaccacctcctttgtatagaactcgtcggagaaatcgagaaaggttggcgcaacctttttttcccagatctaaaagtatctcatccaacggctgggagaagaaacccggcaaagaggtgaccaatcactggctaaaaaaccggtgatgctcaccacaccacc

SEQ ID NO: 59872 - DNA, 1223 bp, Oryza sativa
cgacacgcaggtcgtcgatggcgctggccacgagatcgtccatgtcctggtagtacttgatgcagagcttgagctcctctaccagctcggtgaggacgcgtaccgtggacgtcacgttgcgcatcgtgatgttggccgcggcgatggcgaggccacgcttgtccgtggcggaggcgcctgccggatcagccgagagcacgcccaagcagtagccatagttggaagttgcggtgcatgtctcgttgatgagagatggggaacccaccgtgagaccgggggctattgcggcggcgaggaggagtgtagcgatgatgggatgcatcgggaattctcaggccggggagaagctaatgatgcttttttgtggtttggctcctccaggtacactgagatttatagaagagaaaggaccttcaaaaggaaactgatcaatgtaataaattctaaattcaatgcgattgatcatgaaaatcgactctttaatgtacttccggctatattccaattctttcctcaataaattgccacctcctttaaatgggtgtacattgtgaataatcacaaatgtgtttgtgccgcgtgcaaacgtccgcacgtgaaacagaacatcccctcgtgcgacccttcgctctagtacgtgcctacgtgctctcctgcctgctccccacgcatcgtgcaagagtgacatttataagttcagggggagaaaacccatatagcattattgaaaaatcagacttagtactcatttacagcaaacatgaaattatagatttgaatcatatttaacgcaggagtatagtattttactaatttccttgtgaagcagatttcataaaaaaaaactcatgaaggccacttgaaccgggggaggctaatgggcgatcgatcgccagggcgattgcccagtgatcggtttcccccctccccctatactcctccctcttgttcccttcctcctccccttcttctctttccactgcagtgcaccacacaatttttttaaaaaaacaaaagttagaaaaatttatatatagaaatactatataaaaaaatttgaattcaaattcaaatttgaatcgggtatgtaaacttttaacttataaactttgggtctataaactttaggtgtataaactttagatgtatagaaatactatatatagaaaatatttgaattcaaattcaaatttgaatcggatataattcaaattcaaatttga

SEQ ID NO: 59873 - DNA, 778 bp, Oryza sativa
gtaaaagtgtttctatgaaggcaaagagtgaaatcttccactcggtatcagatgctacacggagtgaaaaatgcaagcaccggttaccaggcaacgccacgtcctgggagatgatccaacgggaaagaactcatcaaggttaaaggtgtaaaggaatacgttgagtgctaactgatgacaacatgaagagaatagcggaaagtaaactgaacataaagaaagtgaatctgagttgcttgttcgtgggagctattcccagttatgaaccaagtgatatgttcgaagatagtctgcagaggtcagtttaaaatcacatgtaacagtgaagcctcagatttggcgggataatgattagacaataacaaatccagcagtaaagctatttgggaagacgtcaaagtatgtcaagtgggataaattggttctcttgggaagcataacttatagttagagtggttgacccttgcatcaaatagcagaagtagctatcacccggagaccaggaaagctaatatgagacagttgatggcaagttagaagtgaatgacaagcatgatattcttatgatgacaaacatagtatcctagtaatgacaagcaggttacgacgcatgacacgaagttgataacttgtccgaggttgactccgaagatatgaatcatgagaagttctggaacggaagcatcactgcactaccgcaacctagtctgagtcagccaaaaggtgcaccctggtccaagtcaggtgaagagaagattccatccgcaacaggaggtca

SEQ ID NO: 59874 - DNA, 716 bp, Oryza sativa
ttcctgcagcccgaatctctgacacattcttgggtgggttccaagcaagtacagcttcaaccttgctgggatctacttggacaccgttggaggagatcacgtgtccaagaaatgctactcggtctaaccagaattcgcatttcgagaatttagcgaatagttgatgatccctgagcttttccattatcagcctcaggtgttcagcatgttcttccttattcttggagtatatcaggatatcgtcgatgaacaccacgacaaactggtccaggtattccatgaagattttgttcattaagttcatgaagaatgctggagcattggtgagtccgaaggacatcactgtgaactcatatagaccataacgcgttgagaaagcggtcttcgggatatcttcagatctgattttcagttggtggtaacctgatctcaagtcaatttttgagaaaactcttgctcctttaagttgatcgaacaaatcgtcaatctgtggcaacgggtacttgttctttatagttacttcattcagggctctatagtcgattaccattctctcagagccatcctttttcttaaccagaagcactagggctccccaaggggatgagctaggtcgcacataactcttactctccaattcttcgatttgtcttttaacttctgctaactcattagctgccattcggtagggtctttttgcaattggtgcggtgcct

SEQ ID NO: 59875 - DNA, 1257 bp, Oryza sativa
agtgctttcaggcacatgagctacacggaaagccgtagcaaactcatcccaagcaatgttagtgggttcagggtgtgcattgcagtaattctcccaccaatctgcagcaggtcctcttagctggtgagaggcgtagagcgtcttctcaacaggagtacactgcactaagttgagttttctatcaacatctttcagccaatcgtcagcctcgacgggctcgacggtctgagagaactctggcggacgagacctcagaaaatctgtcagcttggatctattgttgctcatgtgagggtggccatttccatgcgcattatgctgaaaaccggctacggctgcggctaacccttgcaagatttgtgtctaaactgccattaagtgctgcatgttgttttccacatgaggtggggaagggaggcgttcttctccagaattgtgactagcagtgcggtgagagcggtgagactgttccatttctgcattacgggaagctgtgtgatgcgagcggttactgcgacggggttgctcaacttctgcgttgcgggaagcagtacggtgcgaacggttgctgtggtgagactgctcattagctgactcatgatttgcttctggctcaactctaccatcctcaaaaccaaagcgggctggtgcacgagcagcacggcgggggcggctaaccatctaaactcccagaagagggcggggtaagagtcagataagcacttaggagggcaaggagcaaagtaaatagcaactcagatagcacacactaggcataaactggatttttcatatcataaaaacacctagtacaacgggtgtagacaagtcacagagctacgccgagcttgactgtgcgcacaccacctaggagaaccagactaccaaacaatacccacaacaaacacacgcacgcactacctcgccacgactccaaaagagttggcggcggaacaaaagggcctaacacacggacggctgctgaagactgcctcctctactcctcgtctgcctggctgcttcctgtagtcggctcctcagtcgaagaaacgtcgatcggctgacgcgaagggaccggcggaacctgtcgagggccggcagcagcacgggccgctggcggtgggggagctgggtagtcgaaacggaacacggtggaagaaccaacaacacgcttccgcgcagtgcggataaagcgtgggcctcggcgggaggaagcaactggggtgtgtccgggggtgtaggaagggctaactgggt

SEQ ID NO: 59876 - DNA, 706 bp, Oryza sativa
acaaccttcctccgccgcctccattactcggtgccgctccaggaagctcgccgacggcggacgcttccggtgatcttttcacgttttctttttcacctttttcatcttctcttcaccgcttatcaccacctaatcccaattaccatcctttttagatttttcttctcctttcttactcgcattttgtccatccatgaaaagtctctataagattttatactcccaactccaaaccacttcgttgacatataggttactactgctcgtcagccgaccattactgtaagagctgcttgtttgtttgtacagctagttgtctaatcttgatttgcaaaattgttaattaaccttagtttcttttttttttctttgatgcttgggtttaagaatgagtggacttgttgatgtgcatggactgcacggtacaggtcgtttgtacacaggattaaatgctggatttatgagtgagagggatctgagtagagggggataggagtgtatgtggctttgtgcacagggattaaaagaaggttcttgattgttttgtgtctgaaatgaattctgaatctgatccaatggtctatgaatactccatgaaatagcatcaattcaattcatttggtcagagctttcacatggaggcaggcagcgtatttatgggcgatggctgcctctgcctccattactcccttttctggtgcaccaa

SEQ ID NO: 59877 - DNA, 1578 bp, Oryza sativa
acattggctttgaaccaaaatcaattattaggcacatcgataacaaattcaagtacaccataagctatgcaaaggcctggagagccaaacaaaagattattgagatgaggtatggcacatttgaagcttcttatgataatttgcctcgtttgttagccaccattgcccagaggaataataatacttactatgacctacatacatttacatcggttgatgatcgaacaaagagtgtgctgcaaagagcctttttctcattgggtgcttgcatcaatgcttttgtgcattgtcgacctgttctatgcatagatggaacttttatgacaggtaaataccgaggtcagatattgacagcaattgggtgtgatgggaacaaccaggttgtacctatggcttttgcatttgtagagagtaagaacattgaaagctggtactggttcctagagagagtgcacattgcagtggtgcgtatgaggcccaacgtttgccttatacatgatcgtcatgcgggtatgttgcgggctattgactacttgcagaacggttgggatgagaagggacttccagctaagtggcctgatgttcggagtcggtggtgcatgcgtcacatgggtgcaaatttctacaagtaattcaagaacaagcatcttatggagctctttaagaggttctgtgcacagaaccaagagaagaaatttaatgagttgtgggacaagttggatgagttgacaacgaagcaaacagatgagcaatctcgcagaccacaagttgaaggtgacgagcctcccatacctcttggcgcattacatgatgacccaccaacaatgagaaggaggtcagggtcgtccatcagaaatttcactcagtggattgagaatgagcctaaggagaagtggtctctattgttcgacaccgatggatctcggtatggcataatgacaaccaatttggcagaggtgtacaactgggtaatgcgaggagttcggatacttccattggttgctattgttgaattcattcttcacggcacgcaagcgtactttagggatcgatacaagaaaattggtccgtccatggccgataacaacatagtgtttggcaacgtagtgacaaagtacatggaagataaaatcaaaaaggcacggagacatagagttgttgctcaaggcacacaagtgcatcggtatgaaataatgtgtgttgataggagcaggcgtggtatctatcgcaagcaagccgtgcaggaatgtgtcttgaaggcggatggtggatgtacctgcagttgtatgaagccgaagcttcatcaccttccttgctcacacgttcttgctgctgccggtgattgtggcatatctcccaatgtgtacgtctcaaattatttcaggaaagaagcaatctttcatacatgagtgaggagatatatgggttcgggatctcaggatcttacacaacactgagtgcccaagttttttacattccagatccatctaagttaagggtgaaaaagggtcgacgccaaactagacgcatcagaaatgatatggatgagtcagaagcaggtgggaggactttacgctg

SEQ ID NO: 59878 - DNA, 1140 bp, Oryza sativa
ttttgctggttggtttccaccatggtgtgaccgtcctttgtgcgattgtggggatggatgcatactcaagtcttccctcatgatacaaactcggggcaggagattcttccaatgcgcgaactttgatcaggtatgcttcatctattcgaagttcaaatggataaaaaaactaacttcttcgtacacaattgtaacatcttacgcagacatatcgtccaatgtgcaacttcatcgagtgggtagacatggagaacccacaaaacgacggaacccgtgcttacccacgtagtgaaacaagatcggactacctaaggtggaaggatgagcatgaacgtcgaattgctgctgaggctttagaatggcacgtaaatcccctaggactccccacgtggcgtgagcgtccggagtgtcgttgtggtgaccgttgtcaggtcataaggtccgtaaggcaccgaactcgaggacaaaggtgtttcgtgtgtccaaatattgtcgacgatgatttcgtggtaattacaactattcttttcatcactcctcagtactatcattaacttaactatcccaaaatggatgtacatagaggatgtaaggaaatgtcaattcgtacaatggattgacacagtcagagttacttcaagtggcgggccgataacgcaacctgaaccgaccatacagttcattcatgcttggatggagtacgatcgggtggaaattgcaagcttagactggaggaacaatccattagggttacctaaatggtccgagcgtccaaagtgtgggtgcagagatcgctggcaggtggctacatcctttgctgaacaaacatttcgaaggagatattttgtctgccccaatgtagacaacgatttcgttgtatgtctaaccatttacaaaatccgctatgatttgcacaaaattactacccaaactgaataacattactatttttacagggcaatccaaggatgggtggatttactcgatggatcgacaatgtcactctatcatatcatggccagaagataacagagtcagaaacacaagtagagtatcaacgattgaaggaccacgagaatgcaatgcattctgaccgacctagaagatgccgataggttaccgcatgcttgattcgtcggg

SEQ ID NO: 59879 - DNA, 2718 bp, Oryza sativa
cgctgcactcgggaacaccaccggccgccggcgtcgttgccttccggccactggagctctggcgcccctcctctccctcctgtcagtttgctcggcagtagaaggaagaggaggaagacgacgggaggaagaagaaaaggaaaaagaaaagaaggcagacactgacaggtgggcccctgcacagtaactcttcgtattttctctatttaattcaaatcctaatctttagaagcccatatctcctaaaccgtagatccgattccattcaaacttggacctaaattcatataaattcaaaatctatattttgataccaaatttgctattttaagattctgtttgaatttccttaatttattcaaatactattagaataaatatttgattaaatcttacaattgaatttacaacttaaatttatatttgcttttcaaatattttattttattccaaattacccctttagccactaaaaagccgccggttggaactttacgccttccatggggatgttcgcggtttactatcctcgacgtcggaccgttggttgtaaagcccgacaaaaaccaaacctaaggtcgaagtgctgctcctagcaccccacgccttgatgcgtatagcggtcggagcttcactattccctcgacctccacagcacgccgcacagttagctctcgggctcttttgatcttagccgctccgccgccactcacggttgtcggagtaacacttccgccccaccaaacctacaccaacctcatattcctctagccgatatactgtcggtcgacaccggctagagaagacactaaatctagtcattatgctgccaactctagcaacgactagcaaacaaccaaaccctagccgataccttgctagtcaaatcccagttgtcatccaaattccatactgtcacgccccgaactagtaccgaccggaactagcccgcgacgctccaaattaacctgttaattgataccagtcccaggaaacagtgctggtatcacaggaagacagattatcacagcaacagaggtctctttattatagagtagaggtacagtcatgttgggccgcggacagatcccgagctcacaactgcattacaaaagggaagcggaagccaggacttggaccaaacaacacaggcgcgacttgggaactaggccgaaaccctaaaactcatcgtagccggcttgctcctggaagaactcctcatcagcaggatccgcttcatcttcttcagcaactgggggggattatttatatagagcaagggtgagtacgggagtactcagcaagccatgggaaataagtgtttaatgcaggctacaaagaaagggctgctgtttttgcaattgattttatttgaactcttttctgaaaacaactaagtgagtgcttctcaaacgacacggatgagacagtgcgtctcgtccggtcggagtatgtgcaatgtatcagtctttagaattggccaagattggtacccggccaacatctttcaaacggccaaccgggccaacaactttcaaacggccacccgggcctagctgatcccatcagctgtagatttctcaaacatcgatcccctttttcacaacggcaatttcacaaggcagtagtcaaacaaaactacgctaggaatcacctcacatccgcccatgaccgtgggcacggctgttcgaacagtttgttaacctctgcagagggggtacactttacccacacgacattactaacccggatcacccagcccgtggggatcagccacgtcgggagacctccaagctttcatgacaaggcatttcgaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgttcggatgaaaatccaaggaaacggtccttaagtgcaagagcggaaaaccgtacacccggtacgttccccggtccgcggttttggaaattcatttagttcgcaagcaccgacccaggtgtcgggttttccaagtcttttgtaaaacccaagttttacccaagttgtttttcaaattttaagtttgaaggcgaccgtcgatactcgcacagagtgcacgaatatcgaggcgcaactagatggttacaagggaacatggtataacaattaacaaaggaaggatcaaatgcaacaaactaggtaggtccgccaatctgccttgtagacgggacaaacagattaagtgcgatcctatcaatgcataatatttttcaagcaacataattaacttcaaatataggctcaagatgttcaaaggtggcttgccttgctcgagatcttgggcttgatcctcgaaatcctcgcactgcgggtcttcgggctccgaaactacacgcgaaacgggacaactcaacaaacggcgaaaataaagccctattaatgacctctaagcgtgccattagatagatctcgagatttgaggaattttggaagttgaacggagtcaaacggatttacggttgggaagatattgaatttctaagattattggatttttggtctaaaggaaaagaatttaattggctgcaggaa

SEQ ID NO: 59880 - DNA, 1760 bp, Oryza sativa
acccggccttggccgagttggcgccgacgcggcgcctacgtggctgccacgcgggccggcgggaggtagacgacgacgccgaccggaacggacggcggacgacagcggcgagcggcggagcgaaccacggcgatacaggcgaaagcgagcacaccgggtggttgcacgagacgaggggagacgagccaacggctcggattcgccggagggagcttgacggcggcgaatcgcggcggcggcaaccggcggcgggagaaggggaaaacggcgacgaggtcatgaggggccgattcccggcggcgagagcacctacgcggctacgggaatccgatgctagcgttggattaggaggaaacgcatcgggggaggccggcgacgagaggcgcttccgagctcgggcggcgacggcggcgagcacatggcgagcggcggcaacggtcggggcggcgccggctagctacggggaggctactcatgctactacccgagtctaaggggaggagatggagcgaggagggagaacggggagatgcactaccgtgcgggcgaggcgcagtgacgagaggctgacggcgcgggagtaatctctccggcctcgggccggggaagaggaaggagagggcgcgcccggagtccccttccgcgtccttgctcgtgccggctcctccgacacgcgcaacgacgaacggcgacggcgaacagagcacgggaggcggcggcaatggcgtggaggcgaatgggagaggaaaggaaagggggaggcttgggtttataggatggcaatgtcggtttgggaaccgacttagggcgggcaaaggagagggctagcgctcggcggtcgcggccaaagcggcgacagggaggagggaggaggatgacgccggcgggaggaaaaaggggaaaagagggagaggaaagagggcttgtcccttgcctcttcgggaaaaggacgagggagcggaggcgacgcggcagagggaggaggagctctgcctctgtcctttggcagcttgcgcgcggagtggcggggccgaggcgatgacgacggcgatgacggcgggacggtgtggagcggagcggcgacacgggcgacaggcgcgggcaggcgcggcagaggctgacggcggcggcgaccaggcggtcggccaccacggcacgcgcgcgcgggaagcaacgggcggcgctgcggtttgagcggcgtggcttgggcacgcgcgctggcttgcggggccgagcggctgcgcggctgcagacgcggcagggcagcggggccgggtgacgcggacggtgcaggcgcggcacgggcggctaccacgcgggcgcgcgcgctgaacaacggcgcgcgggggccgacttcgcgggcggggagctcgccagggatggagacggggagagggagagcgagggggaggcgctcggcgcggcgcagctcacgcgcacgcgcgcgcggcgcgcgggcggaccggaagagggagggacagagagagagagatagccggggagggagggggagatgggccgagagagattcggcccatcgaacccgggggaggcaaaatagacttttgcggaggaattgatttgggaagggtttggattcgggattgaactcgacgatagatcggggatttgagatctgagatggcacggacactagacaacaagcaaagaaacaaatttcgcaattagggtttttaagagataattttcctgctaggcgccccgacggaacgggcgctacagaccaacccccctaacaa

SEQ ID NO: 59881 - DNA, 894 bp, Oryza sativa
atgaacaggacaattatatcaaaggcccgttgtatgttgtctaatgcaggtttgcctaaacagttttgggcggaagctgtttccactgcttgttatcttatcaatcgatcacccagttatgccattgataagaagactccaattgaggtatggtctggttccccagtaaattattcagacttaagagtatttggttgtactgcttatgctcctgttgataatggtaaattggagcctagagctattaagtgcatttttcttggttatccgtctagtgtgaaaggctataagttatggtgtcctgaaaccaaaaaggttgtgattagtagaaatgttgtcttccatgaataagttatgttacatgacaaaccttctactaatgttcctgttgagagtcaggagaaagcaagtgtgcaggtggagcacttgatcagtttagggcatgcaccagaaaaagaagatgttgctattaaccaagatgcacctgttattgaatattcagattcttctactgttcagcagtctccaaaatgttctattgcaaaagataagcccaaaagaaatattaaacctcctcgaagatatattgaagaagcgaacatagttgcttatgctttgagtgtgacagaagaaattgaaggtaatgccgaaccttctacatattctgaggctattgtttctgatgattgcaatagatggataactgctatgcatgatgagatggagtcacttgaaaagaatcatacttgggaattggtgaagttgccaaaggagaagaaacctatccgttgcaagtagatcttcaaaagaaaggaaggtatgtctccaagtgatgaggcaaggtacaaagccaggtcagttgctaaaggttatagccagattccaggtattgat

SEQ ID NO: 59882 - DNA, 6118 bp, Oryza sativa
  unsure (1)..(6118): unsure at all n locations
cctgggtaaatgcatgctgatgtgagcgttttctggttatctgaatcgcaatcaaatggcatagatagatactgaacatggttacatggaaaaatgatgcttacattgcctccagatagcttcactcagatcaagcagaaacgctttgcattctctgcaacgatgctatcaagtaatgactcgcatgcgttttccagcagatccagcaccagaaaaacattgtgcaacgatagctgtcccctccctccccgccgcctgccttctctttccccaccgccgccgctgccctctcgcgcgccggccgccgcctgccttctctttccccgtcgccgcctgcactatgacgcccgggcgacggactggttggtggggatggcggcgagggacggcacggcgctgaagccggtgctgagcgggttgtcgatgaagccggtgccgagcggtgagcgactccgagaggcgcgcgccaccgccgagcgcgccctcgccgccgccgagcgcggagggcgacgaccccgcggcggtcgacgtcaacctcgtccttgccttcctcgccgcccgagacggggacttaaacgacgtgagacggcctcgcctccgcctccgcgcccaacaccacggcgcccgcccgcgcggggccgcttcgccaatggcggcgacgcagcgtcaccgacgccattcgcgaccggctgccgccgccgcctcgcccggtggcttgctcctcagccgcccgccggcttgcccaaagaagtgaagagaaaagaagagagagagagagagggagaagggaaaggaggggaaagagggggaggcttacgtggccaggctggcatgtggagcccgtgtgggtcccacgctgactcagccgccacgtaggccaaaaccggggtcaaaaccaccgaaggatccattatgaccggttttgattagttaagggactccgaatatctggttttgtgattaggggacgttttttaactcggtgacaagttgagggaccttcggtgtactttttccgcaaatataatgctccaacttgatgactaataacacactagcaccagcagctagttgcttatttatagtagtatttcatacacggaaaaaattttaagcattagtaaatatcaattgttggatcgatgaatatggaataataacaaccattatttatgaacgctaattgctagctagattcatcattgtcatcacagcctagctactggctaattcagatattccatcgtcctcttctgaaattgcagtaagctcggaggagtgaaagtaagaatccatgacttgtggaggtggcatgccattgccaatgccatccccatcgcagaaaaatggtctcggaggcacttgcagcgcatccacacccccttcgagcatctctattgcctcgctcatcgtcaggcgatcgtgtgatttcatctgaatgcaccacagcccaacaaggcatagcttcctctccagctcatgcatgtcagcaacattggatatctcatcaacttgttgatctgctatcagctggtcatacacccatgctgggtagtatgccctgcttgcatttgagtttgcatttggatctgcattccttctacctccagccatctcaagcaacaacattccaaagctataaacatcggatttgtcagatataacgccaaagctccgggataccatctcaggagccatataacctactgttccccgtaaagccctatctgacacaaagctcttctcccttgggtacagttttgcgaggccgaaatcagcaacctttggaacaaagttatcatcaagaaggatgttgtctggcttgatatcaaagtgtagaatctgcatctcgcacccctgatgcaggtagttgatccctctagcaatgcccagagcaatctcattgagcttgtcccaagagaagcttctctcggatgagaagatatacttgtttagagatcctctaggcatgtattcgtaaaccaaggcccttctcatttcttcggagcagaaccccacaagacgcaccacgttgatgtgatggatcctgcctatggtggcaacttcactaatgaagtcttctccattgcaattggagttgccatccaacatcttgatggcgacatgaacatcacccgggagaaacacacccttgtacacagacccatatcctccttggcccagcttgtctctgaaatggcttgtgattgctatgatgtccgtgtaggcgtacctcttggggcctagcatatcttgcatccgaaggaacttttcgactgcatcaattgcaatccttgttttccagtacttgcgagtaagaaaaatcatcacgaccaacggtgcgaacacaaacctgcatagcactgaatacgaaaaggctaatgaattttgcaatgcaatatgtggtgtgaccagctctgatactgtatactgtagaattgagtggaacaaaaatgcaaaagttaattaccagcaatccacttgacaagacacaaggtgtatattatgaagagcttatggtaaagagaatgatcaacgccgcggatcatgtcgctgatggaaagacgcatgtcgaggtaataccgtctggatatgcctatcatgcatccccagaaacggaggtcaatagaaaggatgtcaatgatccggtctttgatgcctactctgggtaatggattgtcatggctatcagctaagctgcaagatcatttattggaaagagttaattaaacgggattggaggagaagagctaaacaaaatcggcccttttcagatgataaagtaaaggtttcgagattataaggaattaaggcgctcacctaacagactcgttgaggcaatctttgatgagaccataccaagtagtccaaggtcctccatatgtaggaaatttgacggcaaatccacccctcatggattttacaacatcttcatattcggacagattaatgctgttaccgttactgccaccgccgataggagtcatggccaagtatccacaagaaggttcgatgtcttggatagatggtgctccaaacgatgggagcatataataaacgtaggacgaagtcgtggtcaggcaattcatgggctggtatttgctactactgttcgtaattagttcctgcgaacaattgacaaagccgacccaagtaatcatatcatcaaggcccaagtcccagctgtcgtgtgatcctgggatacccagaccaacgtaaggcagctggtccgagcgaggaagagggcagctgctgtttgcatcatcctgcaggttggcgtcgacgacccaaaagatggaagcagtgtagtcgatgctactcacatagtatttccctgtgttgatccgaatggtggccttgccatcatcgctgctgcagtctagctcgtacgacgagacgccgcacctgcgagggtcgcctcgccggcgaaaaggatgagttatgtttgagagatggccgcaggagaaaggttggcactgacgatgccgtcgtccttggacatggacgacgtgatgatctgcatccgctaccacaagtgcgagcacacacaggacggtcgacaaagcagctgcttccattctagtgtaggctaccaagctagctacttgttgctcgctcggccggctcctacttataagtagtacgacgtacgcgctaccaagaaggggaaaacagaaaattgagtatacgtcttagccattaacgcataattaattagatattaattattttaaattaaaaaaatagattaacgtggcttttaaataacaatattgtatatatattgttttcaaaaaaattacaacggttaatagtgcggaaaacatgcgcatgaaaaacaagtaattttttcaatctttcagctcggccgaacctttaaagttcgaatttatattaggtcgatcttatgctataggttgtgtccattacatatttcttatttatattaagtcgaccttatgcgaccatcgaactcgttcgtcgatcaaagaaaaggcagtgaaagccaaagccaaagtacagatcaagtgccaaagccaaaactctcggctcacagtgctaaaagcagtaactaaacaggctactcggtagtagaatatactaccctttttatttttttaatgatattgttgattttttataatgtttgattatttgttttattaaaaaatttattacaaatatgtaaaagtataagttaagattataatttcttcgataataaaagcaagtcataaaaaatatatttatatttttagtaaaatggatggacgagcggcgtctgctgtcttaaaaaatgaacatacttgcgtgttgcgaacttttgactgtagtactgtacgacaacaaagctcgcgcgcgtgaattagcatttctgcgtgcgccaggcctaatttccacacgggaattaaactttactggccggtttcttcaattcttcatatgttaatctctcatgagattggacatgagtggactggagcaagtctacgatgttcaaggtcagtcctaggccggcatgattttccaaagcaccccctccgtttcatagcttttaactttttttacctgtcaagctctttcatagctttaccttttttttttactagtcaaactctaatcaaatttatagaaaaatacgacaatatttttaatacaaaacaaacatattatcaaaatgtattaaatattagttgtaatgaaactatttggtcttttagaatttatatgttgctaaatttttttataaatttaatcaaacttaaaaatgtttaattaggaaaaagtcaaagtgacttgtaatatgaaaaaccacttatatagcacgaaacaggaagaacatacagcgcattgttgcttacaatgaagcacacagttacactatcntgagcccacatatatatatccgccttcactttatgtacatatatggagtacctacagactacagttatcaaaccaattgcttttgcacctatagagtcagagatcaggatgagtagcaaatttctcgccatgtatctcctgcttgctctcctcagccatggcacctacagctacagtgccaccacagcttcaggctgggaagaccaagacttcttcaggcattgcccagtgtcccggtgcagcgacggtggaccagagatccggttccctcacggcctgcaatccagcaacacatcatcagcatgcggcgcttcatgcgccaagctagcatgctccggccaagacaccatcctacatcacccatttctggggccttgcaaggtcacctccatagattacaaggaggccatcatgagcatcatcccgcttgtgtactcctcgtctccatgcccgcttcagaagctcatctttgacaatctacagccttacgactaccatagatgtaaattatacagctgggctcctgcaaaaatagtacgctgttcaaaagagttcacaccaaatggtacttctccagtcgatggctacgctttcatgaacaacgccgattatatcaccggcccaatctcctgccccagtgaggcaagtcacttctcatatttggtggatgctcggctatgcatgtatgtgcttcccttggactgcaggatcgtctccagaggctccattccaatacccggtccagcctactctgatatcggtggcccaacattcaaggaaagagcagaaaaattcatcaactttgctgagacgactgtcagttggtattctgatgacgaagttaccattaactgcacagagtgcgaacgtcaaaagcaccgctgcgcattcagctcacaaaggaatcgaacattctgcatgagccgcgagcatcacggtaccattgctaacttctcaaaatccaatcctatcaccctagttttatttcctgaactacttttctattttccactccctccgtcccataatatagcaatctagtaccggacgagacacttcatagtacaacaaatccgaacctgcttactgtttagattcattgtactatgaagtgtcacatctggtcctaggttgctatattatgaaatggagggagtagctattatgatttaaccatacagtactagagtgctgctctcgcatcattaatcttacatgagatatactgcaa

SEQ ID NO: 59883 - DNA, 5024 bp, Oryza sativa
aaagtcatttcaggtactgctataattcaaacctaccttatattcattattcaaaagagagaagaagcactgttataacttatcagcaataaaaagttcttattgctggcgcttctgactcaatattttgctaaaaaggacactaccttgccttacccatcaggcaactacaatcagttgatcactagtccatagctttctatcctattgcaatgcgctgatttcccattctctgtttattcagctacatcatcggcagctgcatttgttgttctttcattgatcatagccactgtgctctatatttcgctgaagtcaaggtatgacgaggaggtacatttgaaggttgaaatgttcctcaggacatacggcacatcgaaacccacaaggtacaatttctctgatgttaagaagatagcaagacgcttcaaggaacaattaggtcagggtggatttggaagtgtctacaaaggagaactaccaaacggagtgcccgtggcagttaaaatgatagaacacactacaggaaatggagaagaattcatcaatgaagtagcaaccattggacaaattcatcatataaacattgtccgccttctgggcttctgctctgatggaacaagacacattcttatctacgaattcatgcctaatgaatcattggagaaatatatattcttgcatgacccaaatacttctcaagaactcctagcagcaaacaagatgttagatattgccttaggcattgcccgaggaatggagtacctgcatcaaggatgcaaccagcgcatcctccattttgatatcaagcctcataatatcttgctggactataacttcaatccgaagatttcagactttggtcttgcaaagctgtgtgcaagggaccaaagcattgttaccttgaccaaagcaagaggcacaatgggctacattgcaccagagttatattctaggaactttggggagatatcttacaagtcagatgtatacagttttggcatgctcgtgttagaaatggttagtggaaggaggaactcagacccgagtattcagaaccaaaatgaggtctactttccagaatggatctatgagaaagtaattactgggcaggactttgtacttagtagggaaatgactgaagaagatagactgaaggttagacagatggccctagtggcattgtggtgcattcagtggaacccaagaaaccgtccctcgatgacgaaggttgtaaacatgctaactggaaggttgcagaatatagaggtgccccctaagccatttgtttcatatgaaagccatgctgtgccataaatcatagtaatgttatgggagttatacacttatacttagttgacgtgttgcatagtaatgtctagaaattgcataatatgcaccttgactgcacattgataactgtatgaattatgaatcgtggctctttaccatgtaatgtaatacaagtaataagaaacacatcagttgatgtgattaccgtgttcagttgttgctatgatatatctccatcaaaccatggtgtgcagagtactcctggctgcactatttcagtaattcatgggtccgtagctagtggcttgcaagaaaatcctgaaaggaaattgaattatggcaatttttcccaggcagcacaaatataaaatatcgaagcaaagagtattatttttgtctgtttgtccgtgcgaacggccgactagggtaacattcataccctgaattcgtcactgaataaagaagtagattcatatcctaaattcctcactgaactaagaagtataataagtaaagttggcttggtcacattcctatccatcccattcaaaaagtcagggcccgcctatctatctgatggaaatctcaagcaaacaggatgctgctgggcaagcaatcgaggagctacgaatttgcaatgtgaagagatgaatgggcatggactcgactagtgaataagtacactttaataaaacttagcaaaaataatcaaaagcagaggaaacgggctacctttatcaatgcaaggagggggcagcgaactgaacaaccaccggatcaggagatctccccgagttctgtcaatcctgcggctcggcatggcatctcgcttggggcctggatttgcggctcgggtctcacaaggactcagggagaactgaacgcgacgcatagaccgggcaacgcgcgttgacggcgcagtgctaaaaacagacatcgccggggaagcagaggcggccgggagtccgagggatcgccggctaccgcaaatggttcgtggcaagagagggaggaaaggggatttcatacggtggagcaccacatactaagctgtgcctatggctactgatggggcctgccctaaagctcctgccgctaatgggcctttatttgcatttggaccaaaaaagacctgcgggaggcctgtcttctttctgctcgtggaaatttttataactgtaaatcgaccatttttataacttatagattttgtggttttttcacggaattttatttatagcatttacttttgaattactaagaacccgtatttaaaatttttatctacaatttttttaattgctaataagtcgtacaaataagcatatagataagcaaaatatgaatcggaaccgggaattgctagatttcagtcacgtaggaaagaacatagcaacagtgccgaccaacacagaacactagcttagctcgatttttgcatgcattcatacagatgaagcacaagataataaatcgtacaagcccacatatacgcattctacaggaatataggaataggagcatagaaactgcatctgtgtgactgtctacaatcatcacaggcttgagcacaacctgctcacgaaaagacatcaacacaccatacttgctagtactagctaattcaactcagtgatactctcgtcttcctcctcggagatggcagccagctccacctcggaggacagatacagcgactccattgccgggatgtagtcatcgtcacagaagaatggcctaggaggaatttgcaaacaatcaacaccaccttcaagcatctctatcacctcgctcatcatcggtcggtcacaagacctcatctggatgcaccacaatccaacgatgcagagcttcttctccaactcatgcatgtcggcggcagcggtgatctcacctgtttcttgtcgggtcagctgacggtacactcgtgatggatagtatgcctggcttgaattctccgcattcggatcagcattccttcttcctccggccatctccaatagtagcatcccgaagctgtaaacatcggacttgcttgatatggcaccaaaaccccgagagatcatctcaggagctatgtatcccactgttcctcgtgctgcgctcactgggacaaaactcttgtcccttgggtacagctttgcaaggccaaaatcggcaacttttgggacaaagttgttgtcaagaaggatgttgtgcggtttgatgtcaaagtgtagaatttgcatatcacacccatgatgcaggtagttgatccctctggcaatgcccaatgcaatttcatttagcttatcccaggagaaactcttttcagacgagaagatgtacttgtcaagagaaccctgaggcatatactcgtacacaagcgctcttcttatttcttcagagcagaacccgacgagtcgcaccacattgacatggtggatcctaccaatggtggagacctcgctgatgaactcttcccctttgcaatttgcgtcacccttcagcatcttaatggcaactcggacatcaccagggagtagcacacctttgtagacggagccatatcctccttggccaagcttgtctctgtaatgacttgtgatggcaataatgtcggtgtaggagtatctcgttggggtcagcatttgttgcaattgcagaaacttctctacttcatcaactctcatctttattttccagtacatgtaggcaacggaggtccacatcagcagcatcaccaggacgaacctgcatgctacaccataaacatgttcatccctgctgtagagaccaagtgtatgaacaaatagagcatgacgagactacaatacagcgaaaaaggaaaatgtaactgaaatttgatatgtgtgattgtcacgtaccagaaatgacccttaaaatccagaaagtttgtggcactaacatcaggagcacaacaaaagggtgtggaagttgagttgcatggcggccgcatatcgagaagtaagaattgatattagtaacaatgacgaagatccgatatactgtcggttctccattactgtcgctgcaagaccacgatgtcatgcatgagccattgtacagcaaagcaaatttccaagataatgttatttggcattggtaaatttcactatcaagaatgtacaaggaagacgggccaaagtgttcagttttaagtcccaaataaattgactcacctgatcaagccccttaggcagtcgatgaatcccccagacctgaaaggaaaacgaacagcgaatccttcactcatggatctgacaacatcttcataatttacatcctccagtgtcgcagccgcagtagcagttcgccaattctctagaccacccagagctaaaggagtcattgccaggtatccacaggaaggctcaaggttctcagctaaataagatcccagaccagttagcacatagacgaaagaagagttgccgctccggcaagccacaggcctgtacatgacattgctgctattcatttcctgcgagcatttcacaaaggtagcgaaccaatccacatcaggggacaactggacttggacacggcggtgtgaatcttctccaagcctgtagttttcattataaggagtctgactccaccgaggaagagggcagttgttagctgaatccaagcttgcatcgaccacccagaagtactgatcactgtagttgatgtcagttaccaagtatgttgccttgtcgatctgaattgtagcattgctgtctgca

SEQ ID NO: 59884 - DNA, 2981 bp, Oryza sativa
taattaggaagatcagtgtgcagaataaggctttcggagaactcttttacaattggatatggattggagtaaactatctatgaagaacttcacaatatctttactacacagggctgtgctgcagagggtcatttacaatagcttctagccactgccagcaaattcacagtttaagtttaacactaacaacagttcaccgttgcatggaagtgcggcttcattttctgatgacgccaggaatgcagtcacactaaaaaggactgcaacatgggaccacagaagtttcattgtactttgggattgctccaaaagtacgctgctatcatgagttcatgacaagcacagcataaactcccagtaaatttcattatagttacattcatggccttctccttgtgccttcaatcttcaacagcactacagaaacatggctaaacttcttgttgttgtgctgctactatctcttctcatctatgcggccacagcatgggatgccgagagcttcttcaacttcaagagttgtccaccaaatcagtgcagcaaacatggaccaaaagtccggttcccactccgccttgcatcacaatctccgtcgtgcggcacacctctcatggagttatcatgttctggacaggacaccatcctgtatcacccagttctaggctcctgcaaggtgactgcaatatcttacaagcatgctgccatgtccatcatcctgcttgtagattccacacctcactgcccacttcagaagctcatctcgacaaatttatcaactgatgtgtacaaacctcaaaaattggaagctgcaagcttagtaagttgttcaagagatttaccaagagatcagcacggtgtagttggcccaataacttgcctcagtaacaacgcaagccagtggtatttgatacatccttatgcatattgtctgttcttcagccagactgcaaagttgttagtaatggcatccaggcaccctcaacttttaaggaaacagaaaatggagtaatcggtgttgatgagttggtattcacttggtactccagtgacataaccagagattgtcaaaaatgtgaaaatgaaggcaaacactgtggtttcagctcacaaaggggccgagcattctgcaattatggtattttctctttctgaagcagaaatcttacatcaatattatgacttgctttgccttggtaggaaactctatggtctttaccttttcattctcttagtttaaagtttgccaattaaattgttcaaaagatttccatagttgaattagttgtaaacactgcagatcagagcagctgctagccaatggaagcataccaaagctctaggttcacatgcatggttattctaatttaaaacgcgcgcacacaagagaaggttataaccgattaagagtaacggaatttttttgaaattcttaaaattaaaaaaaaaaccattcatctacaaggtaacctagatcaaaatgaatttttctttaggattggagcataggcatcccttggtaactagagagggtgctatgaatgaacacactctccaaaataccattgttagtatcaacgtatagtttatttgattgtaaccatttggactggaccgcctatacatgttccaagttaaagaaaaaaaaagaaagaagaaaacataatttacttagcaacaactgctaagcctcacgttggttccatgtattccagccatagaaaccacacccacattccttaatgtcaatactatactctctactctagcttatcactagaaccaaggatggacatgctctcagatttgatgtggtgttctggttatctttaatttctcactttttcacaataagcatgacctgaactttggcttgtcagcaccttcttggatacatattcttgaaaaaaacaccatactgggtacttgcaaaaggaaaaaagaagaaaaagtgaactccatgtagggtcatattgatattttaattctgaactcttgcatacctatgttagatacacagaaagcaacaggatcttcagcatgaacatgtttgcacgagttctaggtcactggtgatccatcatgaaacacagcttggtgcccaaagaaaccagcatcccatctgtctattgataatatatatttttttagagtaaatttcacttagagccatcttttattactgatatttcgctttggccctttaatcaatgttctcactttcgaccagttctttgtttttaacctttgtggcactttggaccaccctcaactattttatccatctacatccaacttatcatatgccaaataaatggtctttcatatagctgagagagttaattgacgagtacaagccgacatactcgagatcgttcatatgcttgagaagagagttgtgatggtccaaaatgaagcgaaggtaagattacccggaatgcatgaacctaacaggaatgcatatctattttccagacaagttaggatccttattggaaaaggaataatttttgaggagtttatacatatatagccctttgttccatgttgtccttcacctgttatgcttcctagtgatagatcagagatgccctctctcagtgacatgttgcgctagaatatatatatgggcgctggttgtcacatggcaggatgcttctcattccttctttggcccatctcctcctatacatgcgcaggcatgatgcatgcatacggttgcatgcacaaaccagttaagatcagagaatcccagcagtgtagtacatgcatacttgcgacgtcatatgctatatacctatactccactcggtgctagctaggttgaattgagatcgatcgatcagatatggggataaaaactgatagagctaagctagggcctggatgcagagagatgcagccatggccttctgttttgttttgttctcaagtgagatacgacgaacctgcatgctacaccataaacaggttcatccctgctg

SEQ ID NO: 59885 - DNA, 765 bp, Oryza sativa
cgtattgggtttttatatggattcttctttcaatattgcttatttttaatttcgaatttcagctaattttaaattgtatttctacttgaactcttcttttattttcttttgctaatttcggatttatttatttttattccaaatttttattaatctcatattgagctcttatatgcactcttcttttaatattccttattaatctcatattttttattaatctcatactgtgtctatatgaattattcttctaatatttcttatttttttattcctaatttcagttgttcgtaaaatgtatttttacttgaactcttatatttgatttttctagtttctaaatctattttattttttattacggatttcaattaatctttaattgtgttctacatgaactcttctttcattttttattgtgttattatttcaaaatcaaataaaaatccgtgcacatgccatcatgcttttctggttgctgacgtgtgcatcacccaaatacggctcactgtgcagccgcacggcttgacccgctgcttcggatttccgtcgctcgccgctagcatctatcttcatatcaacaaaaacgcatccaaattacggttctacagtggttcgttgcccgctgctttatttatatatgtgtattatagcctaattcatctctaactctagttaattggtttaggaaatcggacaaaactcttttgagtctgtttgcatgtaaaggccctagctagagattgattctaattctacacgcgt

SEQ ID NO: 59886 - DNA, 2791 bp, Oryza sativa
atccttatttttttcgctcacaggttttctcttaattaccttttttttctcttttttttcgatggtgcatgaaaatactagtactatcttatactgtcgcttttcctctttctacgagtgtcagatatggtggagttcgagttcccaatgcttcagttggcccgccaaagccatccaatttgccgagacggacaccccgcgcgcgacgccacgccaccgcgcgcgaatttacgcggttgcccctcggtggagtccccttcgccgtaattagcccctacaaggaggggcagtctcggcgcgaaacgttgactcccctgcactcccccaatcccctccacgtcaacacggccctgccacgtcactggcgaactcttcccctgctccccggcgtgagcggagcaggtgcggacaaaacggcccctccaccatactaccagcaccacctgacaatttgcgttctcaccccaagttaaactcgtaattacgtgtagccccctcctaggctcaccatttataggagattttttttttcaatccggtacttgagaagggttggaattaggatttggggttcttccttggtgcctggtaatggctaaaataatccggcctagcgcacggtgcactcacgaacgaacgactgcctcggccagtgggggcgtactggtaagaaaagcccactcgttactcgttagtgctgcctccgcatcatctgcttgctacgctttcctttctcctaagagcattcccaatagaaaccacggtagcagtggtcttatatgaaccatatagcctaagagcatgtacaacagcgggctaaaagtcagctgtaaatatattttaaagagataaatgagaagaaagagggcagtgggctatagatttgtagccagctgtagcatggatttcaagacatagtgtgtgtatgacaggtgggactagatattaatagtgtagtatgtaactattgtatgaatgagctattagattggctatagataaattggagctagtagttggctatactattgaacttgctctaaaatcatgctatataagagtaggacacactacttctattgaaggttacttcttaatccccccgtttcataatataagcatttttagagttggacacggttattaagaaagttggtaggattaaatgtgtgagtatagtattggaggataagtagagataggtggaaaattaaatagtgtagggttataattggttgaaaagagaatattagtggagaagttatattttatgataaattttaaaagctataagttgttatattttaggacggagtaagtaaatattacgaaatctgaggatactttgcgaagataagcccatcccagcccacaaacacaagcgctgttttcctctcctacccttttctttattttattcggcccactccccctcctttttctcgtctcctccgccccagcgcccggcgcctccccttctcttcaccgccggtcgtcggcgctgccgactgcgccccacgcgccacgacgactcagccccaccgcgccgcctccgactccaccccatcgcgccaccgccgactccgcaccaccgcgccgccgactccgccccaccacccgtcgcctccgctcttcgccgcgccagatccggtgggccgcgccgtcgactcctccccacggcgccgccgacgactccgcccctctccctccgcccttcgccgcctctctctccctccgcacggcgagaggtgcgcgcgagccgagccggagggggaggggagggggggagggagcggcggatgccatgggcagcggcgcgtcacggctgctgaccgcgtgcacgtgctcgcggccggcgccggcgtccgtggacgcggagccgtgcctggacgacgctctcggccactccttttgctacgccgccgccgccacggccaccgcccactcctcgtcgttccgccacggcatctccggcgccgcgctctccgccaactcgtcggtgcccgtcccgctctacaacgcgtccgccgccgccggcggcgtggcgccggggtactcctcggcattccacacctcgtcgtccttttcctccgcgccgctgcagctgtccaacctctcctcgggcccgctgttcctctcgggtcccatcgaccgcgccggccagctctccggcccgctcgaccccgccgtgcccttctctggcccgctccccgcaaagcctcccaagcccgcgtcctcctcatcgagggggttctcgaggaggttccggaagccgtccttcggcagcctgcggcggagcgtgtcggagaagaaccgcccgtgcgccgtgccgctccgccgcgacgacggcgtgcagtgggcgcacggccgcgccggggaggaccgcgtccacgtggtggtctccgaggatcagcggtggctcttcgtcggcatctacgacggcttcaacggccccgaggcccccgacttcctcgtcaccaacctctaccgcttcctcctccgcgagctccgcgggatcttctacaaggaggccgacgcggacaacaagaagctctggcagtttctcgtggacggcgacgacgacgacagcgagctcgacttctcgggctctggccggttcgcgctgtcactcgacagctcaaggagagtcggtttcacatgtgggcgcacgccgcggtcgacgagagcaggagggaatggggttccaggaggttggcaccggcgcctgcggtgagggaccatgcggcggtgctagccgctctcacccgggccctggcctcgacggaagcgg

SEQ ID NO: 59887 - DNA, 726 bp, Oryza sativa
cttgggccggccggcccatttagctcggctgagccgccccttttctctcgggccgcgccctagccgcccgaggaaaagtctaatttccctccccctcttcttttctttttcaaaaaggatttaattaaattcttttcctttagaccaaaaatccaataatcttagaaattcaatatcttcccaaccgtaaatccgtttgactccgttcaacttccaaaattcctcaaatctcgagatctatctaatggcacgcttagaggtcattaatagggctttattttcgccgtttgttgagttgtcccgtttcgagtgtagtttcggagcccgaagacccgcagtgcgaggatttcgaggatcaagcccaagatctcgagcaaggcaagccacctttgaacttaattatgttgcttgaaaaatattatgcattgataggatcgcacttaatctgtttgtcccgtctgcaaggcagattggcagacctacctagtttgttgcatttgatccttcctttgttaattgttataccatgttcccttgtaaccatctagttgcgcctcgatattcgtgcactctgtgcgagtatcgacggtcgccttcaaacttaaaatttgaaaaacaacttgggtaaaacttgggttttacaaaagacttggaaaacccgacacctgggtcggtgcttgcgaactaaatgaatttccaaaaccgcggaccggggaacgtaccggg

SEQ ID NO: 59888 - DNA, 1192 bp, Oryza sativa
gacatggacttgcccctgtgggctgtggcctgctgctggtcaagtgcctcgtcgccaacgcgcaacaaacttcaggtcccgagcgagcgtgattacgcaattgattgaatgacggatcaagcgtttgttgggagccagggaaaaatcgtaggacgtcacgcaactctcttttaatttgggacattgtctacaccgtggctcgatcgatcgttgctctcctggagaatgaaaaacacgttttgctcttctgtttttgtttttgtacttccaggacaacatgaaaccgcctactcagaatgatttttttcttgcgacctggtaattgagatcctaagcatggcagcatcgtgggctaattttgcgtgctcaattgctcatggaaccgtgaaagctagcctggttgcatgcacggcaaggctactgatccagcactgtgtgaggccgattgaagcttccgtggagtagaagaatcttctggcgtttgatgtacggagtacttcatctccagggacaggtacggtgatggtcgccattccaccaacctcgaggataaatgcgtctggtacagttgttaagttgatgatgtacgtatgaacgcaatagatgagcaaagtatttcaagcacatgcgtcgctaattgatgcgttcacaacaaaacaagcccttaaatggagaactgtattaggaccatccatgataagtaccacaaatggagttgcacttaaccttcttgctgacgcgccagcgcatggcgatgacccaagcacgatctacgaaactggctgttgagagtatttatgtcatagattctccattttcggtggcagcggtccagttggtttctccgtttctgcaaactatgtagtcttgtactgcaaaatggacggacagttcggtgagacagaatccttacgctgtgcttggtgatttctgcagtactgcaacatttcttcttcttcttcttcttcttcttcttcttcttcttattcttaacggaaagactgcaatatttcttggacgggccggaaaagcttgtgagttgtgatcgatatctgttcttgacgggtcgtgcaaactcatcagggaataccaacttcatggttaactgctctacacgcacatatattcgtcagaaattcagaattttctctagttttgtacaagggcctaactattgcgtagaacacacgag

SEQ ID NO: 59889 - DNA, 1110 bp, Oryza sativa
atttttaattaaaatttaaatgaagaaattcgcaaatatccatttaaagagcatataaacttcaaatggccataacttggccatttgaactcggaattggaccgttcaagtctctaatttttccttaagaagtcaagaacccatttttgtgctttgttcctgcttgttgtatggagtttattagagtaaaagccttttcttttccgttggtcgtgtagacgctgcagcttcggaagatccgctcttcgtggaagttgaagccgacgtttgggaaagcgagcaaggcaagtcacatcacccttgagcatattgaatcccagtttataaaattattttgatttaaattattgtattatcgctttgtttaaattcccgcgttaccactgttttatttagccatgcctatttacctttgttatgacattattattgctattgttattattaccttgttcaccctaggaaaataaaaaccccaactagtgggtactctattcatggttccactagtataaatttaggtagatgcttcgctgaataattaggcaacattaggtggttttataactttagactttgggaattctcatatcatttggacactatggaattgttggattatggtggaattggacatacacctctcttcctctttcaaaacccctaaaacctgttttcggtggggtttgggtgcatgccagttgtgggaagtagcaccccggccactataaggattaagctcgggcctctgttgcaaagcactaccgtactaaccacatgtctaatgggtaaggcttaactcggtgctcagtctagtcctgaacaaaaggacacggatagagatggatgaagtcgttgcgacgatggatatctctgaggcaaatgaaggctacgcgagctgcggctcggtaatcgagatgtctaggcaaatgaagactacacgggtcggtgcccgttagtcgagatgccatggcactggactagtacgcgggtggtctcacccctatgtgtgtggcgcacccggtctagatcttgttgctaggggctcaaccctggcctgcctgtccccggataccggccgtaggcagggttgggtcggtacttttgttc

SEQ ID NO: 59890 - DNA, 1225 bp, Oryza sativa
caccaacatcagtcggacttgatgcatttatgttctcttgtgctagttcctgctgggatctttgattagtctgtaaagagtcattttcttgattttgaaggcgcacatcaacaagattttctgccagcattgttgaatatctagaaaaagtttgcacaaaacaacagagagtgagcatgcagcgatgaacttactaaaaagtaagatagttccaaaacaaaaccaactgataatagatggtagtacctttcagtctgtcctaagaggaaatcaagttgcttgtctagggccttttttttcctttcctcaagctccagttggttcttataaaaaacctgcatcaaacccaaatataaatagcataaggtttagtatattggaaaatgtggtgttctaaatatacactgagccacaatgaacttgccagcttctctattttggtccagaacttcttcacgtccttagaaatatttagggcaacttttctcaggcgaacttcttcctcctatgaaaatcgcagccaacattaagataaaacccatgaatactgatttgctatccacataatctacggtcattgagtatgtcgctcaatgtgctggttatatatttacttgcagttgaaagaacaaattaggggaaggaacactgcttggttctcaacttatcttcatcaaagttcaattcaatgtgctgttataaataatgtcttatgtactaatgaaatatatttcctagactgaccatagtttatgccaaaacatgcagtacttgtgaatttaacctattctaggctttatttgtcaacctgatcttattgatcaaagtctccaccaaatttaggtttagcaagcagttaagcaatcagttagctatggttcttcattctttattctcggcaggttaaagtcagatcatggtaataaataaagggtactcagttaaggtccctgtgtactgcagtgaggataaactaagatgcacatcactcagttcagcaaacggcaagcatgcagatgtggccatgtgggtcattgccagcaataaattacagtccagcttccttgtcgccttcccagcctccaacctttcccattactacagtttattattctatgtatataaatgataaagctgctgatagccttcaatatgggacagaattgtaataagacaactctcatggagtcatgttaatctgcctaattaataaaaaaaagacaag

SEQ ID NO: 59891 - DNA, 1434 bp, Oryza sativa
  unsure (1)..(1434): unsure at all n locations
tcatcctaactctcaagacttgaaacatcaacagtaaggaaatagataatatgtactgaacatagtaatgaatgagataaccaagaaacacgagcaagttttgactagtgattctcccagagctctagtgccaagctaacacatcaattgctgatttggcagatcaaagaatgaagatgcacagtgcacctttatcaaacattttaagtctttgatgaaattatcagtacgcatttacttaatacagcaccaacaaccaagagatcagtcccaaggcatcatattcatacattgtgtctttttttagataatggaattcatacatagtgactgatcgcgtaaatagaacttaagaagacccacaggtagttgtcagattctcagtgagatcatgcatatgacttgatagaatttgaccttctgattttatttcatacatatatgacccagttgctccaacttttgttgccatctatggtcaattgaggtaaatataggtttcgggaataacaaagattcctttagaaatcaagttttgagagaactgagcctgccacaatagcccaaactgtagtcatgcatgcatcngcccagcatggttcgttcttgcgccgctttttgaaaacacataaaagctttgcacattactgtaccaaggagaaaatgctttgtttttgtactgtgttaaggagaacatacagaaactctgcattatgatgcaagaatacgtaggcaacacaacaaagctttttaaactgctgttgaagaatgaacacatgaaactttctagctctatatttcatttcacctctaccactgaaaaggactgtagaagcgagaatggtgaaaacatctaaatatgcattagttgtgctgattattttagcagtaagcacaaaattaaattaatacgccttgacaactgatattagctttactgagcaaatctctgtctaagctatatattcagaatcaaatgttcctttattgaggatttgaggtccgtcaaacaaaccaccttcttaacactggacattagtaaaagaacttacctggaaagcggtccaaactgtagaaacgactgtgatggaaggacaagaatgaacaaaggattctatattttactagtaccaacctatcaccttacaagaaacaacctctagcctcattagagttagctccttgaaggaactctaacgaaggtaggggctggctcttccaccaacctccaatgtaaggaagtcagtttagctttatagatgccagcaaatgatcaaaacttggtttgataacctattcgcaaaaaaagattgtacaattctgcgtttcaacgctaaccattcgcagaaacagcggtaggaaagcctaagaatagtacccgtgaccaaacttagaccaacagtaaagctatgactatgaatagccttctacagc

SEQ ID NO: 59892 - DNA, 2078 bp, Oryza sativa
tcaattctacatgaccccaaatcaaagttgaattggtggcaaggtacagtgaattcgagacaagtggtggggggaaaaaacgagctgctacagttgtttctccacgacgcatgaacgcatttttaaccgtcaaaatccttcagatgttcactgctcatgctcagtatacataacaacaaacgaccatgtcattttccgggcacaggaggaagccattaattagatcagggggagaaaaataaagtagcaagcagacctaccacagcacatatacatgagtcactctcaactccctacttatctcgagaaggcttatctcactctctctgcatcgcatggaagccactaaagccaggcttcatccaaagatcatggccataggccggggaggcagtgttagttggctgtagccatcagaatttcagaggtttatgcatgccagtgtggcactttagccccggctgcaaccttcaagacgtgcatttctcagccagcaagcaagctgcccgccggacagcagcggtggtcagttcacggccgtgctggctgaaaattcggtggcttcgtagcatcgcatctcttcttcgtcggactcgctgcagcgacagctcggggagctgccacacagtcccctgcagtcgtttcgccgtcgtcgactcttcgtcgtcatccccgcgcgaacgcgtggtggacaaaggcgacggggatcgagagggtagctagctgcgctagtgggggcgcaatcggagcgcgacgtcctgctaaaggaggccctctgcaaatgcaatgataggaacgtcacgttggtttttcagagcatatatgagaatgagaccgagaggtaaactctgtaatatagccaaccacgtaaagtggcgggagtatgagaagaattaggtatgtcggtgtcataccgtttacatcaagaatcaggtatgcctagctgagctagccgtgtagctgatgataattagaagatcgaaggcgaattctatggttagtttcagtgacagactggagtaggtctagaagatttttttagcgttgtttatttcattaatcacgaaagtatggtaaagcgaaagtcgatttgaaataaatcagtcgtcgtttcgaattataaagtaggctgcagccgctgtcaggcgatccatctagaatgcacttaaccagcgtgagcttggttacctgaaaaacgtagctgcgtgtcacgcatgcctttatgctaaaatatggaggcgtgcagtgattgcagttcatcaacgaaagggaaatcggaaggaaagcaatgattggaaagtcctaatccccattagttaaaccgatctgtaatcactgtcgagcaattttattcacccactgcttgctactcatctggtcgcaacgcacaggaaagattgattggattagcttacctgaaaaatttgcacgcctagagtcctggacgtatgcctggtaaggcttctacgtccagccctcctagtgcacgcatctatgtctttttaaaaagacaaaaaaaaagagagagataacatttctgcatttttcttaaaaggaaaaaagtgcgcaaatgcattggaaagcacaatgcaattgctttctttagcaaatatcatagtcactcgtactactacgttttaatctggatacacagtatatggacctgtcgacacactttcatggtagtcatgcaaaatgcagctcatgtagcgctgcagacacgtaggagtaaatcactagtacagtgcagacaaaagtgataacgactcacaatatacacacacctgacaatatgtcgtcgtatggatggcctatattcccccgatcatcatatctggcttaccgacaagaacatttgggtacattcaactgtaaacccccccccccccccccacacacacacacaagaaaagctcggccatatgacagggaacacactgtcacacactaaactctgctaaaaggtagctagcctaaagggacgacctgtgcagaggaaacggtaggtcaggatcgcttgaactatgcgagcgtctacccgtgcaggaccagaaaggggatgcgccgatagatcgatc

SEQ ID NO: 59893 - DNA, 2157 bp, Oryza sativa
gctgtcgacgtacgtgggccgcgcgcgggccagtgctcgcgagccgcgcgttgctgtgcatgtatgcgcgcgtgtcgtttcgcgcacggtttcggagagggaggatcgattggatcaggggttgtctcttttggcctaaccacatgtcacgaagggttagttgatgtattatcatcggcacggcagtgaatatagtgattctggcatgcatgcagcatgcatgtggttagtagcagtaagctagcgtgcgtgcacttacgttgcattggttgatcgttcatagtatagctataagaacaggcacgttttggtttttatatttttttaagcgtgataaaggcagtgacgggtaggattgttcagctagtaacctttggttatcttgagccgtcgaccatgcatgccctttaggattccaaacggtcgctgggtttaatcgatctgccgtactgccaatgcgctgcaaagcttggaccatagctatctcagctcagatgttagtagtatcgatctatcaggacgtacgtggaattcgtcagaggcgtctgcctgattcagcctgaagacatatatatgtagctttctggggggaaataattagcggaggtttatttttctcgaaatatcattacaaaggacggtttgtgtaattgtattcattccagaaccagtgaaccaggacactagaaaatacagagtccaaacgtatggcgcccatctgattgacagcatgtccaatgtgatatctctccatgttttttgcatttagtttaacggtcaaagacgggcaatctgaattaagcagcatgcaatgatattttgagagcaggactgtcaggaaaatgttattatcagcatgaaggtacacgagttcattgcctcaccccgcacagcggcgtgccgtcaggttaatcaccacgcgaacggcgcccatcagctgcctgagagtcattatcagcagcgataattagtcccatctacaatgatcgatcgattggtcatctcaccgaaccctgcaaccgtggatgtgatcaattcttacttctcaggcacagacctaagttaggactggccttggacaatgatcgcatgacattagttaccagtagtccgaatcgagcaccagctagcacatcttgcatctactgttacgagtgtacagtagaaccgattaggtcatgtgcaatgcgagggcggaagacctcttttctttctcacactacagtctacccattgcatgcgtcaaatttactctgtaccaggtccaggtttggaccttgaaacaaatgaaaatcattactattgttttccaagcgttggctcaagactagtgaggatgacatgattttttaagtatatatattgttccacattcagtgttaaccactgtgttagggataaaccccactcttagggttagagcaagtttaataggatagccaacttctagctacgaatcatctataaccaatgtaataggcaattcatacaatagttgcttactatactattaatacctagtcctacacctagctatagctggctacaaatctgtagcccgctgctcttctctctcttcctttatctcattaaaatatgtttatacctggcttatagtctactattgtacctgctcttatcgtgttaactaataacataactacactattgatggcccatgcaaattgcgcgaaaagtatcttttttttcttatataatagtgtgtgtgtgtgtgtgtgtgtgtgtgtgtgtgtgtgtgtgtgtatatatatatatatatatatatatatatatatatatatatatatttcacattttattattaaaatagcaacatagttttaaattatttactaaattgatcatacgtgatagttattaattactttcaattttgatcttagttatttctaaattgtattactacatgtactctaacctctacttccacttgtcgacgtttgatgtcacgactacggtatttggacagtatggggatcgttggtgctaggatatatgtgagactgaggtaaagagatggagacatggatttttatacaggttcgggcccctgagtagttaggtaataaccttacatcctgttggccgaagccggtattgctcttattcacataatcacaccagtagggctgcagg

SEQ ID NO: 59894 - DNA, 3420 bp, Oryza sativa
caggtggtattctttaatgtggattgcggacgcttctggggacgatgaggtcctttggcttgctgcctttcggtgaaaccttgatgtggttcgtcaaaaagctgtactgactaccttcagggaaatacattgcctgctatttgtatctataccactagggtttaattggcgatgatcatccttagtgcttcctcgagatggggagcatccaaattgttcttctgccacatcacctttgacccttttctgatacctgatcgactaattaccaaccatcgactactatgttctcaaacattgatgtctcctggatctttgtaactgtttgcaggtatatccgaacttatcaatgtagaggcatggcaggtacccttatgggtttcatccaacaatccttatcttgatctgtaaaaggcgtatcccaactcctatcctcaactactgtctcgttggctttttgacccaacacagtttaattggttttcttttccatcaacaggttggttattaactcgaggttggaacatagttcctctgaaatgagaccctaggtctcctatgtcagtaaacaattatacacatgatcacatatccgcatctttcaaacgaatcctcatggaacttgtctgtattacacatttctccctcattacatgaatacgaggcactaccttaaacaaaaagggacggtgcttaacatcggtacattgtattctcaatatgaatcatccataagcatagcaagctcactgtttatagacatgaatatatttatgtattacatggttgctgcaaactttcgattacaccatgataagtagcggactgaaaaccacaaacatggctgctcattttgattctggagagatatagctggcattgttccagtgactgcatccttgattggttctgtgatgatgtgataggactgcataatgctatcattcacaggagaaagcggatgacggtcttctgcttggtatcgccctccggaggttgattgctcttggctcggcctggagtaggtcggggagagacacaacttcttccatctacgacaattcttcgctgaggctgtcgatgcagagagtggttgctatggtttattgccgagtcaggtgcagcaggaggagcattggtgcattgtttctgctatgggttctgattaacacgaggccttacgggtacggcgtttgctccagtgaccacaatacgattggaatgtctgcttcgtgtaaattggcggtaatgtggaggtcgattttgccttggttggggacagtttttggaataatgcccttcttcactgcagttgtaacaaacaataactttcttacactcgggttcttcatcttgtacttgatttctcagctgctgtattggaacttccaaaggtacaacgcagatactggcccctgtcttgtcagctggtggctggggctgaaattgagcattgacaccttgtggtagtgcattcattggaattggagctgttgcaacgcgggctataggactgcttcgggatgcatggatgacaattcgttgaggagcaagcttctgattgcagggagttgcgtggactgacgtgccggcagctatgtttctcggttttgggcacttgtcggcgaaatgacccattccttgacaattgaagcaacagatgtcttcccggactcggcattttcttttctcatttcgattcctctgtcctggcactggagttaggctgaaacggtgatcttggcggggatttgtgttgccttgatgcttctctccgttggaactggcgggttggttggccatcttctttgtcagcagaaaactgaattgacaatcttttggtacatgatcagttccttcacaaaagaaacaagtgatcctgctcgttggacacctgtcgggtagatggtcttcctcacaatgaacgcatgtagaggcacacgagctggcaacatgaccgatttctccacaacgagggcatgccttaagttctacttcatcttcatcatctgaggagacttgatctgaatcttcactatcagacactctacctccattagctaaaagatgctctgtcaactgttgtgcacctcggaaggaatttcttctctgatgttttgtcattcctggtggaggccattccgtgctggtaatgatcatcttacggacttcatcttcggttcgcattggtgcttttcttttctgctgaggacagttccttgcgtagtgcccttgctcatcacacataaaacagatgatacttgcttcttttgggtcaacatgtggcatggcatgaggggccttctgggatgttggcggtgcgctgacttgtggtgtgagtgcttggactgcctccaactgtacttgaggttgcatctgactcgggttcaaaattggcatccgatgctgctgtagtatctctataagcaatttgttctggttaatcaggtgttggaccactgccacacaactggtgtctggtgcttcattcactcgggagcttgaggtaccaatgtcctgacttctgaccttattgcctttctcattgtcagccatctgttgcaaaggtttggagagggagagagggaaaacaaaggggagagacagattagaactaaggataggaccttaacagatctaagtcttttgctgttatgatgtatgttaggcttattctgcaagttgattaagcaaacaacctagcatggttacatcacaacccactgatgcaaaccacgcgctacacacacaagcaaggaacacacgactaacaacactaccctatagggtggcttaggttctacgacgggttctccaagatcttcactcctgcttcacagctggcttcactgcttcctttgcttcgctagcggatcctgcagtcttccggagcttcggcaaacaactgacgacatcttcttcttcgcaaagctgaccatctagtacttagttgaaatccgaagaaagaaaagagtaaaccttttgcaaatagcattaggggaaggagaaaaaggaactttcgcaaataatttttttatttataaaatatgtccttgggttttatccacttggcttatcctacagtcgagatggctctgataccagcttgtcgcgaccgggaaaattgccttttcccgaacgctagtgtattaatccccgtcccaggaaaagccggggtataccacacaaacatgatataaaagacacatctttattatatcgataatatttacattattacaaaggcacttaaggcctgacaatcaaaaataaacagcagcggactagcgggcctacggctccatcttcacaggcgctcaactggggtataagccaggactccacctaagacatcttctccaaagcttctcttactgaagaggggaaggattgagcaagaatgagtacaaccacagtact

SEQ ID NO: 59895 - DNA, 18214 bp, Oryza sativa
tgacacgcggtggacaagaatgaccgattggtgaccggtctgacactgctcatgtcgtcagcgcacagccacgttcccacgacgcgcctgcccccggcagaagtggaggtaggtatgtgccgtcccatcagaaggacgttcggagggcaaccgtgcaaatctccgtccatttattgtcgcgaccgggaaaattgccttttcccgaacgctagtgtattaatccccgtcccaggaaaagccggggtacaccacacaaacatgatataaaagacacatctttattatatcgataatatttacattattacaaaggcacttaaggcctgacaatcaaaaataaacagcagcggactagcgggcctacggctccatcttcacaggcgctcaactggggtataagccaggactccacctaagacatcttctccaaagcttctcttactgaagaggggaaggattgagcaagaatgagtacaaccacagtactcagcaagccacaccggcagatgcatgattaatgcaagggggggtacaagggaataataataggggttaggttttgcagtaaacagcatttaaaagtcacttagttgcccaaagccattttgtaaagacgatcctagagctacacagtattattaaacaaggccgtgaaccctcacgagcctgccttaacccaaggcctacgatgatttggaccgaactggcaacccgacctgggtcccagctcgtcccaagccaacccaggccaaccattccatattttagttgttgagcaaattttaagaattaaaacactgacttgggtacattgctaggcttgcccatatccgagggctcggctattcgaatagatttactctgatcagaggtgtacatctttacccacaagacacatctttactccgcattccatggccttggaacccgtcgtaaagatgtgacatagtttccaacccatcctagccttagacaagagtaccgacccaatcctgcctacggccgggatacccgggacaggcaggcagaactgagcccctagcattgggcaccaaccctccgccgtatgacatctcgactaccgggccgcagctcgtgtagccttcatttgccctggagaatgtccatcgacgcccgacttcatccatctccaatccgtgtacttttgtttatgactagactgagccacaaactaagccttacccattagacatgtggaagtacggtagtgctttgcaatagaggcccgagctttagtccttatagtggccggggtgctacttcccacatctggcatgcacccaaaccccaccgaaaacaggttttaggggttttgaaagaggaagagaggtgtgtgtccaattccaacataagccaacaattccatagtgtccaaatgatatgagaattcccaaagtctaaagttataaaaccacctaaggttgcctaattattcagcgaagcatctacctaaatttatactagtggaaccatgaatagagtacccactagttggggtttttattttcctagggtgaacaaggtaataataacaatagcaataataatgtcataacaaaggtaaataggcatggctaaataaaacagtggtaacgcgggaatttaaacaaagcgataatgcaataatttaaatcaaaataattttataaactgggattcaatatgctcaagggtgatgtgacttgccttgctcgctttcccaaacgacggcttcaacttccacgaagagcggatcttccgaagctgcagcgtctacacgaccgacggaaaagaaaaggcttttactctactaaactccacataacagcagaaacaaagcacaaaaatgggttctttacttcttaaggaaaaattagagacttgaacggtccaattccgagttcaaatggccaagatatggccatttgaagtttatatgctctttaaatggatatttgcgaatttcttcatttaaattttaattaaaaactcatttattgcgtcagccgagggagcgggcgcgcggaccgggtccacgggaagtggggcccacgcgtcagccccacggtccacggtggaccgggcgcacgcggctggcggcggtcggcgccgtgggtcccgcgcgtcagccgcacccgcgggcgcgggcggatgacggccgggcccacctggcagccgcgagggcgcgcccgaaggcggcctcgccggcacggccgacgggagcggcgcgcccgcgccccgatggtcaccgccggcgaccaccggcgcggcggagcggcgcccgagagagcggagagaaggggggaaagcgaacggcggtcttcggctcaccccgggacaacgacgacgacgagaacggcggccggagtggaggaaagcggcggcgcggctcgggatgacgatgacgacggcgctccgacggtcggcgagcgaaacggaggcgcggacgaggtcgacggcgatgcggcgatgccgagggaggtggcgccgagccgggaggaagaccggagcgacgacggcggcgaaccagagcggaggaaggcgacggcgcggttcgggatgccgagggcgacggtgctccggcagtcggcggacgaagcggagcggcggacggggtcggcggcaacacggcgaagcggatggaggtgtcgccgagtcgggagggagaccggagcgacgtcggcggcgagccgaaggtcgacggcgacggcggagagagaggagcacggcgcgagcacgaatccgacggcgagagcgagcggcgagcggcggaaacggaagagcgaagcacggggagcaaatatatagcaacgggagggggagagcgcggccggggagagaggaaaccgcgcgcggagatctcgggcgccattgaagacgccggcgaacttcgcggggtgaatccggacgaatccgagggagagagagagggaaaagggggggaaacgggagagggaatcacgggggtgattttccccctctttaatgcgcgcggggacggcgggaaacggcgagattcgcggcggcggcggctctagggcacgggctggcggcggcgcggcgggaggaaggcgatgacaggtgggtcccacccgtcagcgagagtggcgggcgggcccgcctgtcagcggcgcgcgcgcgcgggggagctgatgggccgcggggagaggagagagagggagggagagttgggccgagccggcccaagagaggaaggggggggagaagacttttagggtttttcttttttataaaccttttcaactttgtttatttcttctcaattattatttgtgctctgaaaattccactaaaatttgagggctccttttagaccaaggagaatttaacaaaaattctccgggtcacatttgaatttttcttgtacgtattttaatgtttgccaatttcttttcgaattttaattaattctattattccttttagaagatgatttttattttgggatgaatttatcaggacgtgacatttatgtaaagaagaaaagtccagtttaaaaagggaagggtacatgtggtatccccttaagagataaaaggaccatgcccacgaagagaaggggggattttgattttcccgggagaggagagggctggttgatattttgtaacttgctcttacacagatccaccaaaaacacaggagtagggtattacgcttcccagcggcccgaacctgtatacatcgtctgtgtctcgcgtttcttccgggcacgcgatctttccacatacagagagagcttgagatctcaccctaagcccccggccgaactggcaaaggggggcctgcgcggtctcccggtgaggagccacgagctccgtcatctggcgcgccaggtagggggctcagcgtgtgttttctgagctctcatactcttccgtgtgcgccaagtttttcttgttcagcctaatggccgagcaagcaaaggtgcacgacctctctccgagtgtgagcggcgacgacggggagccaaacccacgccgtcgagctcgtactcccccacctcctccacaccaaaatcctaagcagggggaggcactcgagagagtcgaaaaatccgcagcatcgccagtcgcgggtggtgcaggagaacggcgagatggggagcgtcgcctcctcgtctacggtgacggcagcacgcctcagggcgcgcttcaggctgttggcgcgctcctacgtcacccgcctgtcgtccctgacccggagtctccagcccagcgatggctggacgacgtggccaacttggtcatgacggcacagcagcgcctgggtgctggtggacggtccgccaccaccaagacctccggcgccgccactaccggttccgcgtcgtcgagacggagggcgcggcgagcggcggctgttgcacgccattcggctgccactccctcgtcggcacctccgactcgggaggatcggcatggagagccggatgcccgcctcgacatcgagcgtcggcgtaatagccggcgtactccccgcgcaacggagggcgcctcttcgtccagagtgtcacctcgacagggacgtgaggaccagccctccatgcccccggctggtggtgtcggctgtagagcctttgtggcgagtcttcggaatgtccgttggcccccaaggttccggcccaccatcaccgagaagtatgacgggagtgtcaaccccaccgagtttctccaggtctatacgaccgggattgagccgctgggggtgacgacagagtcatggcgaatttctttcccatggccctgaagggacaggcgcggggttggctaatgaacctgccgcccgcgtcggtccactcctgggaggatttgtgccagcagttcaccatgaactttcaaggcacttatccacgcccaggtgaagaagcggacttgcacgcagtacagcgaggggatgatgaatcacttcgctcgtacattcagcgtttctgccaagtccgcaatactataccttgcatccctgcacacgcggtgatctacgcgttcagggggggtgtgcggcacaaccgcatgctcgaaaagattgcctccaaagagccccagactaccgcagagctttttcagctcgcggaccgagtggctcgtaaggaggaggcctggacctggaacccctccggttccggtgtggcagcttcggccgcccccggatccgccgctcagacagggcggcgtgacaggaggaggaagaaaaggtcggtccattccggcgacgagggtcacgtcctcgccgtcgagggcgttccgcgggccacccgaaaggggaggcctgcgagcgacaaaaagaaagaggctggtactcccagcagggagcgcccagccagcaagtggtgctccgtccacaacacctccctccacgatctcgcggattgtcgcgcagtcaaaaacttggctgagcgaacgaggaagtgggaggaggacaggaggcaggaacgccgtgagggcaagtccgcggcagttccctccggtaaacggcgaagtgaggccaaacagaaggcccccgccgttgacatcgatgacggtgatgatgacctaggtttccaagaacctggggccaccattgccactgtcgatgggggagcgtgtgctcacgtttctcaccggagtttcaaggccatgaggcgagagcttctcgccgcggcccctactcatgaggcgacacgtcgggcgcggtggtcggaggtggccctcacctttgaccagaccgaccacccaccgtgcgttgcccggggagggcagattgcgatggtggtttcccccaccatctgcaatgtgaagttggggcgtgtcctcatagatggaggagcggctctcaacatcctttcccccgcggcctttgatgctatcaaggccccggggatggtgctccagccgtctcaaccgatcatcggtgtgacgccggggcacacatggccgttaggtcacatcgacctaccggtcacctttggtggatcagccaacttccgcacggagcgggtgaacttcgatgtggcggacctcagtctgccctacaacgcggtcctggggaggcccgcgttggtgaagtttatggcggcggtccactacgcctacctccagatgaagatgccgggccccggtggccccatctctatccgtggcgaccttaaagtcgcgctcgcttgcatggagcagcgcgcggaccacctcgctgctgcgaccaagcccgagggtggtgacgagaggcttggcacctccgcccccaccgccccgaggcagcggattgccacatgcgacgaggtcccggtcaaggaggttgccttgggcgacggcccatccaagaccacacggatcggtggtcttctggatggcaaataggaagacgcgctcgtctccttcctgcgggcaaacactgacgtcttcgcatggagaccagcggacatgcccggggtccccagggaggtgattgagcaccgtctcgccgtgcggccgggcgcaaggccggtccggcagaaagtgcggcggcaggccccggaacgtcaagccttcatccgcgaggaggtggcgagacttctggaggccggattcatccgtgaagtcatccatccggagtggctggcgaacccggtggtcgttcccaaggcgaacggcaagcttcggatgtgcatcgactacaccgaccttaacaaggcatgtcctaaggatccttaccccctgcctcgcatagatcagatcgtcgactccactgcggggtgcgaccttttgtgttttctagatgcatactctggttaccatcagattcgcatggctagggaggatgaggaaaaaactgcgttcattacccccgtaggaacctattgttatacatcaatgcccttcgggttaaagaatgcaggtcctacttttcaacgtactactcgaatttctttgggtagccaaataggacgtaatgttgaggcttatgtcgatgacttggttgtaaaaacgcgcaaccaagaaactttactttcagatctagcggaaacttttgagaacctccgctccgcccgcataaagctgaaccccgataagtgtgtgtttggtgtacctgcgggcaagcttctcgggttcttggtctctgcccgaggcattgaggccaaccccgagaagattcgagctatcgagcggatgcgcccccccagcaaacttagggatgtgcaatgcgtcaccggttgcatggccgccctaagtcgtttcatatcaaggctgggagagaaggcgctacccttgtttaagctcctcaagcgctcggggccgtttacttggacggaggaagctgaacatgccctcactcagttaaaggcatatctcagctctcccccggttctagtcgccccggagccaaatgagcccctgctactttacttagcggcgaccccccaagtagttagtgcagcgttggttgtggagcgcgatgaaaacaatcctcatttcgtgcacccccattctgtgctaacttggcccgggagcgagcggggaggagaggcccccgagtcggacggtggcctacggcccctgacgaccggagtcggccctctgcccgcttgtcagacggtgctaggtgcccccgaccctcaggagggccccaaggccactgcgggaaggccgcacttaacgccctttgaccccgaggctaaccctgtgctgactcgacccgggaaagagcagggagaagaggcccccgagccgaacggaggccagaggcccctgacgaccggagttggccctttgcctgcttgtccgacgatgccaggagcccccgacccccaggacggccccgaggccactgagggaaggccgcccctttcatcctccgaccccgaggtcatcggcacagaagacaagtgcgcccgaaaggccacttgaatgaagaacgccccggggatacggcccctagcaaagaggatcggccccaccgaagggtgcagcggcctgtctactttgttagtgaggccctccgggacgctaagacccgataccctcaggcccagaagatgctttacgctattctgatggcctcgaggaaactgcgccattattttcaggcacatagggtcactgtggttacgtcttatcccctcggtcaaatcttgtataatcgagagggtacaggacgggtggtaaaatgggcaatcgagctttctgagttcgatctgcactttgaaccacgccacgctatcaagagccagaccctcgccgattttgtggcagagtggaccccggctccagagaccgtctcaatccccgaggccagcacgaactcctcgcagctgcctcacaccacccactgggtgatgcagttcgatggttctctgtccctccagggtgccggtgcgggggtcactttgacctccccgaccggagacgtccttagatatctagtccgcctcgactttcgagcgaccaataatatggcagagtacgagggactccttgccggactcagggtggcagccggactggggatccgccgtctcctggtgttaggcgattcccagctggtcgttaaccaggtctgtaaggagtaccggtgctctgacccgcaaatggacgcctatgtacaccaagtgcggcgtatggagcgccattttgacgggatagagcttcggcatgtgcccagacgggataacatgatagccgacgaactctcacggctcgcgtcctcgcgagcccagaccccaccgggcgcctttgaagaaaggcttacccagccgtcggcgcgacccgaccccttaggggagacggatgcgcctgaccggcccccgaggcccgtcggagtcctggcctcgggacccgaagggagcgctccaagctcccttagattgattgcttggatctctgagatccaaacatacctcacagataagactctacctgaggaccgcgaagggagtgaacgcgtacaacgcatttccaaacgctacgtgctggtagaagggaccctctatcggcgcgcggctaacggaatcctcctgaagtgcattcctcaggaacaaggcgttgagcttcttgctgacatccatgagggcgagtgcggagcccattccgcctcgcgcaccctggttggcaaggcctttcgtcaaggattttattggccgacagctctcaatgatgcagtcgatctggtccggcgatgcagagcgtgtcagttccacgccaagcaaatccatcagccggcccaggccctgcagatcataccactgtcatggccatttgctgtctggggacttgatatcctgggaccgttcaaacgggccccgggcgggtttgagtatctgtatgttgcgatcgacaagttcactaagtggcccgaggcttatccggttgtcaagatcgataagcactctgctcttaaattcattaagggcatcacggcccgttttggagtgcctaaccgtattattacggataatggcacccaattcactagtgaactcttcggcgactactgcgaagacatgggcatcaagctctgcttcgcctcacctgcccaccccagaagcaatggccaagtggagcgcgccaatgcagaaatcctcaaaggccttaaaaccaagaccttcaatattctcaagaagcacggcgattcatggatcgaggagttaccagcggtgctctgggcaaaccgaaccacaccaagccgagcgaccggggaaacgcctttcttcctcgtctacggcgcagaagcggttctcccatccgagctcaccctgaggtctcctcgggccaccatgtactgtgaggctgatcaagatcagcttcgtagagatgacctcgactacttggaagagcgaaggcggcgcgcggccctccgagccgcgcgctaccagcagagcctgcggcgctaccatcagcgccacgtccgggcccgatcactctgcgtcgacgacctcgtcctacgccgcgtccaaacgcgtgctggactgagcaagctctcaccaatgtgggagggtccgtatcgagtgatcggtgtcccccggccgggctccgtacggctggccacgggcgacggcactgagctgccaaacccgtggaacatcgaacaccttcgtcgcttctacccctgaggggggggtcgggtgtcaggtttcgggctcgggctaaccccgcacccccctcgggtgtgcagggttagccgggggctaccacacatgcacagccttacttttcttatttcagcatttcaataaaagcagtttcaatttcctaaaggttgtgtctgtgccgtttttccttctgaagaatcttaacttgaaataaggtcactcgtgctcaaccttgccctcgggggctcggttcggtcagctaaaatcgccaagcggggcccagaaccgagccatgccccggggcgtggtgaactccgggggggaatcggcaaaaacccacaatcgggtcacccataaccctcggtcaccatgttcccggcctggccagtctcgacatgtggatctccccaggcactagccccgacccgagccatttgaggatcgggacttgagcacgagcccttaaatcaagctaaaatgcaaaaggaccacggcacaaatcatcctcaactcatatgcatagcaaaataaagttaacatagaaatttttcatcatttttgattgcagattaagttgatctatacaaaaagaagaaagaaaatgaaaaagttggagattggcgggggcctgggggctcattccaatgcgcccgggtcgccggcctcgtcgccaccgtcgtcctcaccgctggcgtcgccctcctcgtcggagctgagggcgaacgcgagccgaggggccgacccctcgaagctttggacgatatggttggcggcatcccggacccgcgcgcgcgcatcgtcctcggtcccgggagggaactcctccagcgccatccatggggagaagccggggtccctggcctggtaactcgctaacacgagttccaccgctccttgggcgaggtccctcgaggatgacttgatggtcttctcgagctcctcggggagttgttggacagcccaggccatcctcctaaggtgcggggcgaggccttccagattggtagagcgcgaaattgtctggcctttccagaggcccgcttcccgaccggcgcgatccagccgggagactgcatcccaaagcatgccgggccctatctcacccgacaagcggagggcctcggcttccccggtggatgagtccagggcgcgctgcatgtccgcgacggtgtgttcggcagctgcgaggcgggcgactaagtcgctttcgcccgtagccgccccgccgctgcgctccctcgcgtccagctccttttctcgcgcctcgaggttagcagcccgctgctccagcgcggctctctcggcgcggatgcattccagattgcggcgcgcctgctcctcctgcgctgccttgcggagggacaggctgtccgccagccgttgtgtcgcggcctcggactcctcaagagctcgctcccgctcagcaagcgcgtcctcgcggagccggagcgcggactcctcttcggcgcaggcggcctcgtgcgccgccagcgtcgcctcccggatagcggcggcggcctcgcggtccgccaagctgatctccacggcgccggcatgatcttccagcgccatggcacgggcttcaagggcctcttcgcgccgtcgggatgccgcttcagcctccgttgctcgctgctctcgggcagcggcggcgtcaaggaccccctgggcggcgtcgagctttttctttagctcccgtgttgaaggcggagggagtcctgcgcctcaatcatcgcggtggtggcgatgagggcggcctctcgctcctcctccacctctcgggcgatctccgccagcgccgccttgcgggcttcaagctccgagatgtggcggcggtgagccttacggcccacctccaccatggcgtccaccgagcgccgcccctcctcgacgcgcgcccatgcggcctcgagctccgctcgttccgctcgcaaggcctccacctgggcgctgaatccatctagcaccgcggtgtttgcggcggccaaggcttgcagaaggggctcggcactcagcggggcggcagaagacgaggagaagagccgccttggagaaaatgcgacgcggctcggcccgccagaagacgcactgagctcggggatgtcccccggacccgtttggtcctgggcgtcgcccgagggagcgggcccaggcgatgcgcccgcggccttgtcgcgagccgccccggaggttgtcgcctgagcgtcacccgagggagtgggcccgagcgacgcgccggcggtcttgtcgtgaaccgcctcggaagacgccatcgcctcagcctggcgagcccgggcggtttcctcccgagtggcttcttcagcctgacgagcccgggcggcctcctcccgagcagcttcttcggcttggcgagcccgggcggcctcctcctgagcggtatcctccgcctgccgaacccgagcggcctcccgggcggcctcttcagcttcccgaaggcgatctgcggcctctcgccggtcagattctcgcctccgttcctctgcggccgccggatcttcggcctcggattggccggacttgggatggcgggaggaacgcgacgggacatcgctgaagcagaagaaaaaaccggaagacaaacaaggtggataagagaaaacttgctgattgggataaagggaagatggttgtgaaaggcgtgaaacgaacctgcgagggggtcggttgaacgaccaccttggaggggaaatcaggtttccccgggatggttccgtctcccccgtcttgcggagccgcttcttcttgcgctccgtctcgggctgtgatgtcggcgcggccccctccgggcgcctgcggctggcacgcaccgccccgtcccctcggggaggagatgggggaggtgttcctccctgtttcctcttcccccgggcgtcggcagggcggttgctccccgagcccccgtcgcggggcccagaagcacggccccctcctggggttgattcttcctggcggctcccgccggcgccgtcgtggcccttaggagccacctcctctgaggccccgacccccatcatgatggtcagaatggaggcgcggtctggatcgcagcagagggggaggagtccttgaggaataagagacgcctccatggagctgagattcagcaccctttggaccacgatcttgaagtcatcgggagcccaatcccatctgactccccggtgggtcctcatgtagtcctcggacccggtgtactcccatgcgctccgggcgcgccgctgaagcggcgcaatccggcgacggaggtagtcgccgtacaccatggcccctgtgagcccctgagatcgcaggcccgccaggcggtcgaggacggcgtcatagtcatcccccagatccactggcgcccgccagctggagaccggcgccgggggctggcttgggagtcggaggcgcgcttcgttggcaaggggggtgtagaaccagtcgctcttccaatcgtcccacttcttgcggagggcgcaggggatgtagcggttcaacactggcccccgcggctggaagtagcaaccaccgaccaccgacggcggcgacaccgactgcacggtgaagaaccaccggaacagccgaagagatgggcgcaccccaatgaacatctcgcacaggtgcgcgaagatggccaaagtcatcactgcgttgggggtgaggtgcgccatctggagatcgtagaactccagaacatccataaagaaagaagaaaaaggaggaaccaacccggccattgcgaaggggaggaagaagatggaccgccccgggtaatctggtgctgggcgcgcctcgcccagcatcactatctcccggccggtggcggattccggcatgaagcgacgcggcagcccagcctgcctctcgcccacaatgcgggaaggcggtagtacgctaccgtcgagcagagcggagccccgtgccatgtcgtcggagaaagagagggttgagaacgagcgtgtgtggcgaaggtgaggcgcagcaaagagagagtttagggcgcaaacggcgaaggaaaggggaatagtggcgaaaggaagggagcaagtcctttcctcgatggctttatacccttcccatcgctgagcccggctcctcgtttctcgtgcccactatctcgctccctcgttactcgctatctcgctccctcgtttctcgcgcccacgcttccactaattccattcgcccgcttgcggcgcatgaggtggatatgcggttgtggcagtcgagatagatcgtatcgtgtgcgcgttaattacgatcgccgaccgaagcgacgttaccatatctccagacgaaacgaatctgcacgcccagattcgagcgctgctcaagtgatgtggcagtcttgaagagaccgcccatgactgacggccaagacaccattaccgatatgcgtggtttgagaccgttgggtttctgcccaatcacggagaccggtcccacctgtcaccaggctttatgagtggcgtcatgcccgaccgcttcccttgagaaggatgatcgccctgacataacgccgggggctactgtcggtgatatgggaccgggagtattgcgcccggaggcttgaggcagatggaatcgcccacgtggcctggcaccttcggggacgtcgggcccgagggtgaggtgtccgccctcctcctgatttccccgagggggggtcgggttgctcctgccccggccccgagggccgaggtgccccgaccccttgtggggtttgcactatgtacataggttgggtgaacacggtagggctcacctaaccgcatttattgcggtctggtcaagcgtgtcacgctgcatgcagcgcaatgcagcgcgctcttttatccggtctgtgaccagtcacagaccggtcagatcaacggttaggtggcgactggcggtctgacgcacgcctcgccccgtcccgtcaagacgagagcctctaggcactcgtccccagctggagctagcgtgatacatcccagagatggcacgttagccccgatcgatatatgccaggcttcatcctaaccattacaggcaagatgttgtgtgaagaagggcaaacatgcacgttgctaagctgacacgcggtggacaagaatgaccgattggtgaccggtctgacactgctcatgtcgtcagcgcacagccacgttcccacgacgcgcctgcccccggcagaagtggaggtaggtatgtgccgtcccatcagaaggacgttcggagggcaaccgtgcaaatctccgtccatttatgtaaagaagaaaagtccagtttaaaaagggaagggtacatgtggtatccccttaagagataaaaggaggaccatgcccacgaagagaaggggggattttgattttcccgggagaggagagggctggttgatattttgtaacttgctcttacacagatccaccaaaaacacaggagtagggtattacgcttcccagcggcccgaacctgtatacatcgtctgtgtctcgcgtttcttccgggcacgcgatctttccacatacagagagagcttgagatctcaccctaagcccccggccgaactggcaaaggggggtctgcgcggtctcccggtgaggagccacgagctccgtgactgtcatacacacattacgtctcggagtccgtgctgcagctgctcttttctctcttccttttatctctttaaaatatatttatagttggcttatagtctgctattgtatccgctcttactgctcttagtaccagtactaataatgtgagagacggaggtgggagagacggaggtggtgtgaggaacttgagaagacgatacatgtggcatcgggcttggtagattcgaccggatctttgccgaccgtcagcgccaccattgaagacacagtagcaataagagcaagtttaatagtatagcccactactaactttaaatcatttataaccaatacaatagccaattcatacaatagttacttattatactattaatatctggtctcacatgtcatacacacgttacgtcttgaagtttgtgctgcccgctgctcttctctctttttttatctttttaaaatatgtttatagctgactagtttgctaacctgctctaacagatgcgccatggcggtacgggcgacggcgaggcttggtcacgcactctcgcatatgtcaggaggaaacgacagcttacccatctgtagacggaggcgaaaagcggcggcggacgcaaaccgccgcattaaccggagctctcgccgggaagagtggtgggggacaaggatcggaggaaggagaaagggatgtttttcttttcttttcttttgttttttttgagagagagagagagagggagaaggggatgatgattgctgggccacaggttaggatggcccatctaaggccttgcttcgatggcccacctaatcccccgcggcacatgaacgatagattgatcggacggttcacatgtggcccaattcacgagcaaatataaggaaaaagtacacccaaggtccttcactttgtcgtcgagatacaaaatcgtcctcaaaccgcaaaaccagataccggacgtccctcaactaataaaaccattcgctttagatccctcggtggttttgaccccgattttagcctacgtggcggctgagtcagcgtggaacctacgtggaccccacatgtcagcgtgtcacgtcaactctctcttttattgcagtagcagcaacagcaagcagcagctaatctcgccggaagaaaaaccaaagccagaggcgacacgggagtcgtcgtgcttcggcgacagctcggtcggcatcgccgccgccgccgccggtgactctgggcgcggcggcgcgctggatcgcaagctgcaggcggtgaccacggcggtgtacggtgcctcgttgcactccgggaaggagctcctcatccgggtcacgtggacgccgaacgctgccggagccaccggcctcgccgtcgccttcgacgacgcgctctctccgtcgtcgaggtgcgcccaccatgtgctgcacaagaagcgcgggagcaggtcctcgctaccaccaccggcacggctgtgggcgtccactagaacaccgccgaggccacgtacgcgttggattcgtcgtcccctgagcccaccggcgaggcggcgactactacctcatcgtcgttgctgacaccgaggtcacgctgctcctcggcaaggggtggcttctgttaaatatgtgatccgaattttgggcccacaatatattcggattagtttcctaataagagtcctattaggtgtctttctattatcccttatatatactcttgtaagccgtacgggaatgggtgacgttcccaatgtgattcccctacgtttgtaatcatctcctctatagtgatcattgccggtcggcgcccgtggtttttttccgcaagggatttccacgtaaaattcgtgtctccgttgtgcatctattttcataacaagtggtatcagagcattggagatcgatctactgcagtcccggccaccggcgattttttccgatcgaagaaatcgatctaatcggcggtacgcgtcgtcgtattcgttgttccgtcgaaattctgttcggcgaaatccaatccaaagcggagtcgccatcaactccgagtcgacgtcgtccttcctgccgtgcgcgtgtcagaggagcagcgcaggcgcagcagaagccatcggcagcaagcagccgagcggcacaggaaaatccatccatcacaaagcgcacgcataccgagggaaattagggcagcagccgcctgttggccctgttcacatgaagtccaaactcacgttgaatttctacgcgcacacagccaatctaccaggagatttacagtacttcgcttggtgcacacaggaggtgtaccatagttcgtgtttttttctagtttaccctaatttcttactagcaaatttcaggattaattcccatggcgagtttgaagtatgatctaccgctcctggaccgagacacaagattctcactttggcaagtgaagatgcgagccgttcttgcacaacaagacctcgatgatgcgctttctggatttgataagaggacacaggattggtctgttgatgagaagaaaaaggatcataaggttatgtcatatattcatcttcat

SEQ ID NO: 59896 - DNA, 1366 bp, Oryza sativa
gcaagatgatgagtctgtgatggaccatctctccgctttcaaggaaattgttgctgaccttgagtctatggaggtaaagcatgatgaagaggatttaggccttattttattgtgttcattgcctagctcatatgcaaacttcagggatactattctttatagtcgtgatactctaactttgaaagaagtttatgatgctttgcatgccaaagaaaagatgaagaagatggtaccctctgaaggttcaaattcacaagcagaaagcttggttgtcggggtaggcaacaggagaagaacacaaacaacaaatcaagagataaaagctcaagtagctaccgtgggagatcaaagtccagaggcaggtataagtcatgcaaatactgcaagagagatggacatgatatcttcgagtgttggaagctacaggacaaagacaagagaaccggaaaatatataccaaaaggtaagaaagaagaggaaggtaaagccgcagttgttactgatgagaagtctgatgcagaattgcttgttgcttatgttggttgtgcacaaactagtgaccagtggattcttgatactgcatgcacctatcacatgtgcccgaatagggattggtttgccacctatgaaactgtgcaaggtggtactgttttgatgggtgatgatacaccatgcgaggttgcaggtattggaacagttcagatcaagatgtttgatggttgtatcagaacattgtcagatgtgcggcatattccaaatttgaagagaagtctcatctctttttgtactcttgatcgcaaagggtacaaatattccggtggagacggaattttgaaggtaactaaaggctctcttgttgtgatgaaagctgatattaaatctgccaacctgtaccatctgcgaggtacaactatattaggtaatgttgctgcagtttctgattcattatctaattccgatgctactaatctttggcatatgcgtcttgggcatatgagtgaaattggtttggcagaattgagcaagcgaggattgctatatggacaaagcatcgggaagctcaaattttgtgagcattgcatctttggcaagcataagagggtgaagttcaacacatctacacataccactgaaggtattcttgattatgtgcattctgatttatgggggcctgctcgtaagacatcctttggaggtgctcgttacataatgactatcgttgatgattattcgcgaaaagtttggccttatttcttgaagccaaatatcaagcttttgatgtgtttaaagagtggaaaacttatggttgaaagacaaactgaaagaaaggtgaaaatccttcgtactgacaatgggatggagttct

SEQ ID NO: 59897 - DNA, 1076 bp, Oryza sativa
tttttttaagtggaccaacaaccctgtcgaacaacctgtcgaactgtggttgttcgacagggtataaaacttgcgattttagccaatcaatttatatttttgcaattttttattaaaccaccgggcagcggcacagttcgattgaatcttcattgatttcaattgaatcttcagttacaacattaagctattccagtgagtatgggcgctctggatcctttatatctctaatatgatgtaagaaggttaaggagtgcaaacaaaagaaaaattttgagggcagcagaactccagatagaggtaagtataacaggaaagaaaaggtacacagcatgtagataagttaacgaagaaagcacatcaaatatttctagctggtcaatagcctctgccgcattttcatctgtggtttctggtgcctgccgagcacgcctctcttttttctcataaactacaggattagcatttattaatcccacaaccatttttctgatgcaatgcactaatttatatcagaatggcgaaattcctgcaagttgaaaacatggaaattataccaatatcagtcttgaataattttgttaatcactataaacgttcaatggagatattccccgcccaatctatcactagtagtctactagtaatattattgtggactgttaataatcaagactaaattgcgttcgttaaactatgaaatgtaatttgatccctcaacaccccgatgaaagaacagattgctaaacagaaatgcaaaatagaggtgtgataagaaatttgctaaaggatatttagcaggctaaactctgaagcggtcgcgggccatatggttaatcactaaagactgcaaggactgatgtaacatggggcatgggggggttcagctgaaccccaatttctttcggaaacaaattgcttagtataattaggttaaggcaaaggcaaggagtaccgtattgcaagagaagctaagcgcatctgtagtatcgccccaaattaaacagaacccgcagcgatagtaaggagtatagcaaccgtacgtcgcgcaggaggcggcgcaaggcataggccac

SEQ ID NO: 59898 - DNA, 3306 bp, Oryza sativa
ccgggagacgctgctcgcggggtggagatcggcgccgccggccggcaagcccgcgagttgatggcgacggggagatcggctagggcagggcaggaagggggagatgagaaaacgcacccctccaactccaaccacaggaaacgggcaggaagggggagctcggaactcggaactcggaagagaagaaaagctcaccggcggcgggcggcgggcggcgtaggcggccgtacaccaccgcgggggcgtttgagcccatctagtggtgctggtggtgttccattctgacttcgcttgtaacatctgggccgggctgtgaatcctcctccgtcatgggccgacatgccagagtccaacatgaatcacccccgaacccctttccttccttgggtatttcatttactggccgttcgatgcgatctagattgcgcggattaagggtcggtgtttaaaactcctaaccccttttttaggttgtgagcgcgttagattgagcggataataaataagccattcgtcgcaaaacgcaaagtgagccgagcgctaatcatgctatgcttgcttagatctagggatgtagctatatttatggcgccatattttttataaaaaatagtcggtatatatttacattgtaagtatctaaattacatatgtaattttagtgtatttacaatgtaagtctcaaaattacatatgtaagtactaaaattacatatgtaaattcgaaaattacatactaattatatatgtaagtggggtgtaaataagatataactactgtgtaagtggctaaaaaaatcaactgtagcatatagcgccatatttctagcaactccgtagatgtagatctagtgccatcagatcattaaatcaccaacggattaatggccatgtcgtaatttcctccctatcaccaacagtcaaatgtagtattcattggtcaggtcggatgcgattttatatgcagtacgttgcactgtcttcttttcttgtgcccctgtctaaataaaaatgaaatcctgaaaccccctttttcattaggcataagaaaattacaaataactaaaagagtgacggattaaattctgaaatggcgacgaacacacagtgaaaaatgccgtcgccaaacttcttctcatcggcaataccgttttgagtcaactacaatattatggaccccaaagcagggcacggctgcagatacgttcaaattttcagatgttgggcggaggtctttcagttctgatcttgcccgagtacccgcgttacgactccaacagcgattgtgcttccaccagaccttaagaatgccctgccaagagctcggcatttggagaattcttcaacacagaccggagcgtctaaggtaacctgacaaatatcaagaaaatcacaacatcgcaaatgatgacttcggaagcaatggctcctcacaaggatctgtgatcagttgttacctgcacaactgcattctgctttgacttaagaaatcgaggtgcagttttgcttggtttgccagccttgtcaagcaatgccacgattttcgtaaccctcgcagcctccttcacatgatgtatgtgaaactcgacctaggcccatatttttatcagattgcatcagggaagaaaataatcaaaaggagagcttttggtcatatctttacctgatagccaataaggataggaatggtgacgtccaacactagaacccttagctccaagaagttagagacaggcactgggaaaccagggttgcaaagaatcccacctgctattagcttactcccatcgatgccctgtaaactaaccgctacattatcaccagctcttgctatgtcacatgaatttgaatcccgctcgatggatttcactgtcgccacttccccacaaggtgaaattaaaacctgcaacagcaagttccaagctgtcaaaacagataggaatgtcaagacatttgcgtacaaaagcaagtataaatatatatattttttaaaaagaccaaattccgacatcatgctgttactgaaagattggcatgcaaatatgcaactagcaaatgtcacaatgtaaacgctcttgatcaatctttcctctatcctcatatttggagctcatctcaatgaaatatacaagtatcaatagtccctgctgatttgtgaggaatgtacctttgaaccaattcgaatagctccagtctctaattttccaaatgctgccaactgccctgttgactgagacttgataacatcacagataggaagaatgaggggctttgaaacatcccgagatggaagctgcaaggaatctatagcatccaagagacaaaatccttgatacctgaaaggacatcagttcaagattcctattcttcagataaacaaatgattttttttctaataagacagtatggtcccaaatatttcaaaatatcagtaatgctattctcacgagtgcttactacaatatgtcgatattaccatgtgaaaggttagaaattgcaagatgcatgaaacagccatctctgttgaaaaattctacacaatgtagtgtttcgaatggcatggaagtagtgtgtcaaaacataacttaccaggaagttaaacggacatcagaaggatttgtgatcaaattctgattttcaacagcactaagaggaatccaggtaacagatgagtctgggaagttgcatgcccgcagaaaactaccaagttgaaccttgatgaactcgaatctttctttggagtacccgatggcatccatcttgttgaccgcacaataagctgttcaacgccgaagcttctaataagctgagcatgttcttttgtctggccaacacttttccctccttcaccgtccatgccagcttcaaatgaaccagtgcaagcatcaacaacaagaatagctgcatcagcttgcgttgcgccagatatcatatttggtacaaaatctttatggcctggagagtcaagcaaaactacacggtacttattggtctccaaataagccacagccacagtcattgtcacacctctgtctctttcttcactgctttcatccatagcccacgcataagcaaatgatccttttccctggaaaaaaataatttccataatacaagaatatgaatggaacatcaggatcaagtatagtacaataacaacaataataaacttactttttctttagcctccttctcattcttgtgcatatcttttttcgatatccttcctaacagatgtagcagtctcccagagagtgttgacttgccagaatcaacatgacctacctaaacaaattgttcgtagac

SEQ ID NO: 59899 - DNA, 1508 bp, Oryza sativa
gagggacggcagtccgcgcgcccgccggaggatgagggacggagggacggcaggcggcgctggcggtagcgcggcgagggcggtggcggcttaggtcgctggggggaggaggactggagccgactagtatacctggccaaatgggccgggccaaggcgtgccggcccgagcacggcagcactgtagccggcccaggaacggcacggcacgcccgctcgtgggccgtgccggcacgacccgttcagccgtgccgtgcttggcccgacgtctgagcccatgggccggtacggcaccgcacggttgccatcgggtcggcacgtcaacgccacatcagcaaaaccgccatccaaaaccgctgagggagtcaaattgcactagtttgaatagttcggggagtcatcctatccggttttacggttgagggtcacggattagattcgggtgacttttaagggagtcaaagtggacttttttccttttattaaatttaacattgaacatattttgataatatgtttattttatgttgaaaatgctagtatatttttttataaagttggtcaaacttggataaaaataaaagcaacttataaggacaagttcactgtacttctttgcttgataatactaagttcataaaactacatatacatgggcctccgcgtaatgacgctagcgtacacagaaaaatacaatcatcacatatataagcagcttcagcagtcagcatttcgcaacgtgcatactactagtactaagttactggtagctaaagctctgaaacaggctaatgctttcgtcgtcatcgtcctcttcagcttcagagattgcagtcagatcagatgacagatggtaaggctctactccaaggggttgctcatcatcacagaagaatggcttgggaggaacttggagatcatcgctgccaccttcaagcatctctatcacctcgctcatcgtcggtcgatcagatgacctcatctgaatgcaccgtaatccaacaacgcaaagctccttctccagctcatgcatgtcgacaatgtcagagatctcacatgtttctcgtcgagtcaactgcttgtacacccgggatggatagtatgcctgacttgagtttgctgcattcggatctgcatttcttcttcctccggccatttctagtagcagcatcccaaagctatacacatcagatttgcttgatatggtaccaaagctccgagagatcatctcaggagctatgtaacccactgttcctcgtgcagcgctcactgggacaaagctcttatctcttgggtacagcttggcaaggccaaaatcggcaacttttgggacaaagttatcatcaagaaagatgttgtgaggcttgatgtcaaagtgcagaatctgcatctcgcacccctgatgcaggtagttgatccctcttgcaatgcccaaagcgatctcattcagcttgtcccaggagaaacacttctctaatgagaagatgtatttatcaagagagccccgag

SEQ ID NO: 59900 - DNA, 1666 bp, Oryza sativa
aaactaattatataaatgaaagctaattcacgagacaaattttttaagcctaattaatccacaattagagaatgtttactgtagcatcacataggctaatcatggattagttaggctcaatagattcgtctcgcgaattagtccaagattatggatgagttttattaatagtctacgtttaatatttataattaatattcaaacatccgatgtgatagagacttaaaagttttagtcccatctaaacagggcctgagggaactatgatccattgggaatcgaacacgaaaccccttccctatgaatccaatgatatcagtataacttgcattttgtagctgtgagactgatatatgttgagtatcaaagggaatcatggacaagtatcgacaagaaggttgaagctctccaattgtacagccataaaactcgttgagataaacaaaagaattgttggtaggcaggcaagagacgggcctgtaccatggactagtagtatcttgtattggtctggaacaattcacaaagcatgcccaagcactgtctgaagaagtagccaaatcgagaaagccataagaatcagttgtagtacggtccaacagatcgtcagtactgtaaggagggtgatcggatggaggaagagggcagctgctatcatcatcctgcatggtggcgtcggtgaccaagaaggacagatcggtgtagttgatgctactcacgtagtatgttcttgtgttgatctgaatggtggccttgccagtgttgctgcaggacaggtcataccatggacggggagcagcaacgcaatcgcgcgaatcgccttgaagacggaaagggtaggatatgttgtgaagatcaccacaggaggaaggaggacagtagtggttgttgctttgccctcctccaacatctgctgcaacaagcaaagaagaagagatcactagagctgtctgcaaggtgtaggtaatactactgctactaatggagctcgccatggctgcaggggcctgcaggctgcagcttcaagacctggatgaatgacttatgacttatgaccgcgagtggacgaactgcagcagtagtactagtcaaagttggacggccacaccagtcgtccaggcacagatgagacacgctcctacacgaattattgggatattatatttgcgttaatggctcttcttcgcctccatgggtcagacagacagaaacgaatagtccagtcaagatgagctctgagcttgctcttgttgcaggaccctgcttgctgctgctgtcgtctctgcttctgcagctgcaggccacggcatgggaagacaaggatttctcagctactgcccgccgtcgcggtgcagcgagcatggccccgagatcaggttccctttccaacttgaatccaacaatactacaccatcctcatgtagcgtaccatgcatgaagctagcatgctccggccaagacaccatcttagatagcagatactcgtaccttggaagcccatacaaggtgaccgccatagattacaagcatactaccctcaccatcatccctatcggagacttggattcatgtccgcttctaaattctgtaccacttccttctcagccactccattatcattatcacggtgcaaactggagctcttgcgacatatacaattggggtt

SEQ ID NO: 59901 - DNA, 1627 bp, Oryza sativa
caaaacacacatgagcgtcacatacacttcatcttaattccaaacgtggttgctcaaaatgtagaggctaaataaaaagctttaccaacctcatcgtaagatcactggcatggcggcattcacttctgggagcccatcatcgagttacaacttacaacaagatttatggctgccatccttcttgtactggaggtgcaatatatagtagtgtcaagggcgtcaaggcccctggtagctggaccgcggctacgtaattcgtagccggaatccgtcttctccggcgaggttttacccctcagccgtaggttcaggtttgggagagagaagaggagattaggtgagtgattcttgattttttctccacagtgccgaatacaagactcaaaaatagtccacagactgaatcgaacatgcctacaattaaggaagaaacaaggaaactaatcccttctttctaatcttagccactcccggtggcttcctcagctgtgcgctgggcgcgctctgtagcgcggcgcacgtcacgcgcgcgacggcgtctcgcgtacgtgcggccccacatgacatctcccccctcatcgagagccagctcgtccccgagctggaagtcggggtacttggcgatgaaagcgtcggcgtcttcccacgtcgccgaagctggggactctcccttccattggatcagcagctggcgcacaccacgtgcgaggcgcgtcttgacggctcgttccggctccgggaccacggcaccatggtgaacagcaggcaggggcggtggagcatccggcggggagccatggaacttcttgaggaggccgatgtggaaaacgtcgtgcagacgagctcggggtggcagagcgaggcgaaccgcgacgtcgttgatgagctcggtgatgcggtagggcccgtagaagcggggcctcagcttgccggcgacggtctgtggcagtgaagatgccgcgcgctgcctgaggcgtagtagggcccagtcacccacctggtacgtgacatggcgatgtgccttgtcatagtggcgcttctgggtcgcctgtgcttgttcaaggcggctgcgaatgtcagcgaggaacttatcccgctcttccatggtcttggcgacggcggccaccctggtgtctccgggctcatatgaccggatggatgggggatcgcggccgtagacgacgcggaacggtgtgtcccgcagtgacgtttggtaggcggtgttgaagacgtactccgcccacggaagccactggagccactgccgcggtcgatcaccagtgaggcaccgcaggtacatgacaatgacgcggttggcggactctgactgcccatctgactgtgggtgaaaggccgtcgtcatgtgcaacttggtacccaccaaccacatcagctcgcgccagaagtgggaggtgaaaaccgtgtcccggtccgacacgatggactgtggcatgccatggaggcgaacgatgtcggcgaagaaggcctgggcgacggtctccgcggagtacgggtgagacagggggatgaagtggcagtacttgctgaacctgtccaccaccgtcagaatgactgacttgccccggacgcgtggtagcgcctcgacgaagtctaggacgatgtccgt

SEQ ID NO: 59902 - DNA, 7881 bp, Oryza sativa
gcagccggtgcagcgtgcgctggacgccttcgtgtccttcctcgggacagccgccatgagctccggcagcagaggcgaggccgggggaatgtacagccgcccgctgtactggatcatcccgtccacggccgcccacggcagagcttgggagcccgaggtgagctcttcatgcatggcgacgagggccgggtcagtggtttgcgcgtggcggagcctgtcgacgaagtcaaagcgtggggccgagagcgccaagatggtgccatcctccggtgtgtcccggcgcgacagcgcgtccgctacggcattggcatgtcccggcttgtactcgacggtgaagtcgaacccgagaagcttccccacccagtgatgctgaggaatcgtcgcgagcctctgatcgagcaggtacttgaggctgtagtggtcggtcttgacgacgaagcggcgcccccacaagtacggccgccagtgacgtacagcgtgcacgaagccgatcagctcacgctcgtatgctgcgagcgcgcgatggcggggtgccaccggcctactgaagaaggcaacagggtggctgtcctggacgagcaccgctccgaagccatgagacgaagcgtcgcattcgacgatgaagggcttggagaagtccggcatggcgagcaccggggcggtggtgactgctgccttgagcgcgtcgaacgccgttgcggcctcccctgaccaggagaaactatctttcttgaggagggcggtgaggggcgcggcgatggcgccgtagttgtgcacaaacttgcggtagtagcccgccaagccgaggaagctgcggactgcgcgcgccgagcgtggcgccggccaatcccgcacagcctgcaccttggccgggtccatggcgacgcccgcctcagagatgacgtggccgaggtacgcgacggacgcgctggcgaaggcgcacttggcgcgcttgaggaagagctggtgccgctgaagctcgctgaggacggcgcggatgtggcgcagatgatccgcccaggtcttgctgtaaattagtatatcatcaaaaaacacaagaacgaaacggcgaaggaacggccgaagtacgtcgttcatcagagcctggaacgtcaccggggcattgcacagcccgaacggcatgacgaggaactcgtagaggccgtcgtgggtatggaacgcggtcttgtgaacgtcggccggccgcatccgcacctggtggtacccggagcggagatctagcttggtgaagaagcgcgccccgtggagctcatcgagcagctcgtcgatgacggggatcggaaacgcatccttgaccgtgagcgcgttgagggcgcggtagtcgacgcaaaagcgccacgatccgtccggcttcttgacgaggaggaccggggacgagaacgcggagtcgctgcggcggacaatgccttgctcgattatggcggcacattgcagctccaattcatccttgtgagccgccaggtaacgataggggcggacggccactggcagcgcacccggctttaagacgatgctgtggtcccgagcgcgctgtggtggcagaccggatggctcgcgaagaccccttcgaaagaggccagcagcccatcgagaaggacctccgaggctgctatgacggcgacagtcggctccgggcgcgccgccacgtcggaccagcgaacctccatgccgtggcgcgagaacgacatggtgcgcgccgtgaagtcccatgttatcggccccagggtaaccatccattgggttcccagaacgagatcgtatcccgccaacggcatgacgaagaggtccacgtggaactcctctccatcgatggtgatcggcgcctgtcggagcacgcccgggcactggatcttctcgccattggccactgtggccgtgaggcgcggcttgggctggatggccaagttggtgcggcgcgccgcctcctcggcgatgaaattgtgggtggagctggtgtcgaggagggcggtgagggtgaccgcgcccagcatcacccggacttgcatcgtgtcgcagatcgggactcctgcgaccgcctgcaaagagaagacaggggcctccccatcttggtccgcgtccaacgcggcgtcctcggcgtcggtgagcgtcacgccgtcgatgtagaagatgcggcggcagacccggttatggccacgggagtacttttcgtcgcaattgtagcacagcccgaggcggcgacgttccgcctgctcctcctgggagaggcgtttcaccggtttggcctccatcttggccacgggtgcgctcgccggcggtgcagggagcgcgaggcgctggggcagtgccggcagcaggccgcggggcgctggccgggcgggaactggagccggcttgtcgagctccatcaactcaacttgacgggccaggctcatggcggccgcgagcgactgcgggttgtgaatccgcacagcgtgactcagcggcggaaggagtccccccgtgaatagctggaccaactgggcttcctgcagtggaccggcgcgtggtaggagcgcctggaagctgttctggtactccttgacggtacccgtgcgccggcactcggcgagctcgaacatcggcgctgagcgcaggggcggtccaaagcgcaggtggaggaggtccttgaagcgattccatctgggagtaccctcgtcctcctggagttggatataccacaattgggccacgtcctccaggttgtatgaagccatccatactttctcctcctccatgatgcgttgttgatggaaataagattcacatctgttgacgaagatcaggggatcggtcgtgccatcatagcggggaaagtccatcttctggaactgttggcaacttttttgacaagttgacaagcacgatcgcagcaccttaagctttgcggtgatcctagagtcgccaaccacctcgatctagcaaagagctaaacctagatgggttttgataactaaaccggctaatggagccgatttctagataactacccgtctcgtgggcaagacggaaggttttcaggacaaacctacaaagagatgttgcactctcgcagcggcggcggacggtttacggcgcaaaccgacaaagatggacaaactaagagaaaactaaaagcaatatgaaaagaacgattcgattgattgatagtagattgttttttacaatgaaccggccttgtcccttatataggggttggtcttgccctctacaggcccttctccacgtccaactcggggtagaaaccaaaggaaacccgaaacatgccttcccgagcaaggaaacctcgaaacccgacgcaacagaatcggacttgggcctgccggtcaaaccggccacataccgccggtctgaccggccttcaaccggcggtctgaccgcccaacacacggcagtcagactggcctacctcgaaggaaaccggtagacttccaaattttggcaatatttcctattttaagcctaggtgccaaatttgggtgtaaacacatgcccccctgcctttttgatgaacgacgtgaatctaaaagcatagaacatgtttttggtcttaggacgataatccaattaccggccatagtacctcctaagcgtcttgccaaacactcgggaagtatttctttaagtatttcccattgattgctcgctgaaaacgctccccttgtagtgtctccaaaaagtatgcgttccctcgaacaacgccgcaaactcgataaggaccctcccaactaggagaccacttaccgaactccttagatcgagtacctaaaggcaaaattgtcttccaaaccaagtctccaacttgaaacaattttgctttcactctcttgttgtacgctttggccaccctcttcttctctttctctatctcttccaatgccttcaagcgcttgtcggtgacttcatcaaggttgtctcccataaacgtctcgtaatcttcacttgacaaatcatcttgcttgatataacgaagagaaccaagatttacctccaccggtaaaacggcttcttgaccataaaccaactcaaaaggagtgactttagtggcaccatgtttatatatcctatgtgcccacaatgcttcagaaagcacctcatgccacctcttcgggtgttcctcaatcttcttttttactagctttaacaatgtcttattactcgactcggcttgtccattagcctgagcgtagtaaggagaagaactcaacaatttaatgccataagattcggtaaaactcttcacttccttagacataaaagaagcgccttggtccgtagttaatgtttgcggaataccgaatctatgaataatatgcttcaaaataaagtcaattacctccgtatgagtcatattcttcaaaggtacggcttcggcccacttggtgaagtaatccgtagcgactagcacgaacctatgcccctttgatgacgaaggataaatttgaccaatgaaatctaaagcccatcctcggaacggctatggtttgattataggattcaacacggcggcgggcaccaattgaacattgccgaaccgttgacaagcctcgcatcctctataatatttgaagcaatcatcaatcatcctcggccaataaaaccccgctcttctaagcaaccaattcatcttgtgggccgatttatgagttccacaaattccttcatgtacttctcccatagccactttagattgatctttatctaagcacttcaacaagacaccatctatgtttcggcgatacaaatctccttccacaaattccttcatgtatttctcccatagccactttagattgatctttatctaagtacttcaacaagacaccatctatgtttcgacatacaaatctccatcaagcaatggatatttaaatgcttgccgccgaatttttcgatcaaccttaaatgtgggatctttcaaatatgaaatcaaaggattcttcgaatccttttctgtatcctgaacacaaacgtccgaatccacaataaattgggttaaaaataactggaaacgggccccccacctttctgcctagaaccggtcagaccggccacacagggccggtcagaccgttcaggaatgccggtcagaccggcggcatgtggccggtcagaccgcccttggtcacggtcagaccggccgtgcaacgtcggtcagaccgcctctggtccccaactttgccaattttgcgcaaaaatttaaaatcaagcaccggctcttttaatatcagaaataaccccctttttacattataaccagatgtttgttgtgccaagtcatttgctctagaattatcacacctagcaatatgtctaatagcaaaattatcaaaattggcaataatatctaaacatgaatcgaggtacctatttagtgatccatccaagcacttgtagatcccggcgacttgttgcaccaccaattccgaatcaccaaaggcctccacatatttagctccaaccatctccatcacttgtaagccgaacaataaagcattgtattcggcttgattatttgtgcaataatattccaaacgaaccgatgcctcataacacatgccattaggtgaaatcaaaactacccctttgccttgaccttctttgcaagaagaaccatcaaaataaatcttccaaggtataacttcaactaagcaaacctctccctcataagcaacatctatatgatggtccactataaaatcacatacaatttggccttttatagttttcaatggttcataagccaaatcatattctatcaaagcatatgcccacttaccaattctcccacttagaattggcctttgcaacatgtgtttaataacatcggcttgacaagtaactatgcatgtactagataacaaataatgcctcaatttggtacaagcatagtataagcatagacaaagtatctctataaaaacatacctcgtttcagcatccaaaagacggcggctcaaatatgtaatgatatattccttgccatcttcctcttgcgtcaaaacggcaccaatgactttgtcctcggaggcaacatataaccgaaaaggctttccggctttaggcgctcgcacaacgggtggagtagataaatacctcttcaactcttcaaacgtctctttttgttttgccccccaagtaaaatcggcttcttttttcaagcgaagtataggaacaaaagcatcgattttacccgctaggttagaaataaacctcctcaaataattcaccttacctagcaacttttggacctctttcttgcatgtcggcgctttgaaatcatgaattttttctatcttcttaggatcaatctcaactcctctctcatgcaccatgaatcctaagaacttccccgccgacacaccaaaagcacatttaagtgggttcatcttcaaaccataccggcgcatcctctcaaaagctaatctcaaatcggctatatggccttccataccatccgatttgacaacaatatcatcaatatagatctctaagataatacctagcaaatcatgaaagatcaaattcattgccctttgatacgttgcaccggcattcttcaacccaaaggtcatgacaacccactcaaataaaccaacaaaccccgggcacctaaaagccgtcttgtacatatcctcttccgccataaagatttgattgtagccgacattaccatctaaaaagctaatcaccttatgacccaaggcatcattaatcatcaggtcagctataggcataggatactcatctttaggagtggctttatttaaatatctaaaatctatgcaaactctaattttaccactccccttcttctccactgggactatgctagaaacccactccgcataacgacatggcctaataaaccccgcctttaataaccgatcaatctcctctttgactcggtcatataataaaggattaaaacgacgaagtggttgcttataaggcctaaaacccggtttaactggaagccgatgctcaacaagctcacggctaagacccggcatctcatggtactcccatgcaaagcaatcaacatactctttaagtagctcgattaccttaaccttataatcggctttcatgtttttctgtacaaaagtcggccttggtttagttccatcacctatatctacttcttccaatggatcggccgatgtaaacccttgtccaagcttctcaacttcatcaaaatcttcaacagtttcaccaatatcgttctttgtagaccgatattcttgcaccctcttttgtaaccactctaaactagcctctttactcattatacaaatttatatggcttagccgtgctacactagccggctttacagagataggtacaaatttgccatcggagatactaataaaatcataactagaaagatccctccccgataagcattggatattcccatgacgccactcaaacgtagcatcggccattgcaacttcggccgatgtatccgcttgaacaatttcaacatcatcgccgtcccattgaattaaacattgatgcaaggtagaaggcacacaacaatttgcatgaatccaacaacgacccaaaataacattgtagttaccttgcacatcgacgatgaagaaagcggttggtagcgtcttatttcccacggtgagctccgccgaaaaaatacccctcgcctccgttggttcaccattgaatccattgagaatcatgttggtcttcttcaactcatcaccctcacgccccaacttcttgaatagcgaatacggcatcaagttcacggcggcacctccatccactagcatcctagagaccggcttcccatcaacatggcctttgagatagagaggcttcatgtgacggtttgattcatc

SEQ ID NO: 59903 - DNA, 1291 bp, Oryza sativa
tcggcaacataaatatcatgatcaccctcctcctcactatcactagcatcagagtaatcaactgcattaacattaggatttttgtctaatggtctagcaaattttttattatctttaacctggctttcttgagccagagccctttacataagttgactaacatcaagaaattgttggccatctagtttttctctaagaggagcaactaaaccattaaaagcaagaccggccaaatctctatcagttatattcaaagtataacatcggtttctaacatctctaaatctcttaatatagtcaacaacagattcattatacttttgcttaaccgatgttaaatcacataacctaagctcagtttctccagtatagaaataatcatgaaattgttcctctaattgagaccaagtatgaatagaatttgccggtaaagaagtaaaccatgtaaaagcattaccggataaagataaagaaaacaagcgcaatttaaaagtatcactattagcctcaccacattgcgctaaaaattgacctacatgttcccatgtggtcttaccatcttcaccactaaatttggaaaattcgggaactctataatttctaggaaacgacacattatcataataatcgggatatggctttttgtaagctctagcacgattcctagtttcgatcccgaatctattcctcataatatcactaatcatatcctccatgttattaggcccttgtggatttggtggtgggtttggtggcctaataggttgagtttgtgacgcaatatgattatattggccttgcctagtatcgggaggatatcccctagaaacatcattataaacgttagaaatatgtgggggaatttgaggattagtggtagcagtagatacaggaggatcaaatgttctaaagtgatacaaataactagcattagtcattggatcaattccctgtatcgggacgattgcgccggtctgaccggctcagggcccggtctgaccggcgtcatgttgcgcggtcggaccggcctgagggccggtctgaccggtgggataatacccggtctgaccggccatctggccggtcggaccaacggctgtgtcgctgtctgaccggccatcaggcccggtcggaccggccgtgaacgccgctccgtcggttttagaccctattggatctatgggagattgactaacagtggtataggctttatcttttaatgtgtaatcatccataagagaacctagcctattccttaaaaacccatcaaccttttccttaaacattacat

SEQ ID NO: 59904 - DNA, 3114 bp, Oryza sativa
  unsure (1)..(3114): unsure at all n locations
aggctctcgatcagcttggcgaggtcggcgttggagggttccaccattggtgcggtgacggaggtggctgatggtgaagatggtggagggctgagtggtggcgcggcggctgggaatggagcggcggcgttgggtgggtcggcggagcaggaggatgaggatcggcgtgaccgtgataccaggttgtcaagggcgtcaaggcccctggtagctggaccgcggctacgtaattcgtagccggaatccgtcttctccggcgaggttttacccctcagccgtaggttcaggtttgggagagagaagaggagattaggtgagtgattcttgattttttttctccacagtgccgaatacaagactcaaaaatagtccacagactgaatcgaacatgcctacaattaaggaagaaacaaggaaactaatcccttctttctaatcttagccattcccggtggcttcctcagctgtgcgctgggcgcgctctgtagcgcggcgcacgtcacgcgcgcgacggcgtctcgcgtacgtgcggccccacatgacaagtagatcctgctgaaagatgacctgctttagtgcattactgcgaaggtcatttttgttttggatcatagcaaaaatcaccgagttggataataccatagcatatgccattaacatggcccccgcatgtcattctcacatgtaatggtatttctaaccggtgcatctttatactactaatttttctgttaatatagtgatctcataaaaaagaagaattggaagcagaaatgaacacaagcatgatacactggcatggctgcacctgcaaaaaattactgaagaaacaaaacttacctgctatcacagatgcaatattccaattgtctgtagcagcagttcaaggttcgtacacagatactccctccatggctccatccataaatgtttgaggcgctttgacttttttaaacatatttgaccgttcgtcttattcaaaaatttaagtaattattaattcttttcctatcatttgattcattgttaaatatacttttatgtatacatatagttttacatatttcacaaaagtttttaaataagacgaacggtcaaacatgtttaaaatagtcaacagcgtcaaacatttagggaagaagggagtagtttagatagaagtaggtaatttggttgcttgtatggtacaattagagttgcaacgagatgctgcttgattgtttacttattttgatgggtgacaaggttaaatagatctgaggtgtgatagacagatgctttgcaacccctcatctgccttatcccaccctaataactcagtacttagcagttagcaccagcaagatgcttattgtatttgctgaacatgacgtagggagcatttctcatttacagatatattcatatagttaatacacataactggtcctcagaatctaaaacttaataagagcaaggtcaatagtatagctaactactggctccaaaacatctatagccaatctaatagcccattcatacaatagttaactataaaaatatactgtaccattaatacacggtcccacctctcatacacacataacatcttggagtccgtgttgcagccggctacaaatctgtagcccgctttcttctctctcttctcttttcttctcgatatatggttacagccggcttatagcctgctattgtacctgctcttaagcgcatcccgcctgggggtctggttccactaattgcactatagcaatcacttgtaaataaccataaatgttggggtttaccttttctttctaaaaaaaactacttttcctgcggtgtgcacacggaaagcttgtgtgcacaggatacgttcacttaatcaaaatatcaatcaaatctaaattctcttgtttggtatttgcaggttcacatgtcaaagtaattgcaggtactgctcaatccaaatcttcctttgttcaaatcaaagtaaaaagaaagaagaaaatctatctgttacatacagagtcttatttttatctactactgtcatacattctcttttacacattacaatcaccaagtctggtgtctttatattttctatcctaatcaacgtgtcgatagtatgctcctccttcgatttatgtggtagcatggttttcccagcatgttcctctattccattttcctgagttataagaccttagtatcaataaaagttaggctatgagactttgggcagaagatgcaatgcactaatttctctctgcataatcagctacatcatcggttaccgcatttgttgttcttttatcaatggtagccattgcactttatctttcactgaagacaagatataacgaagagatacacatgaaggtagaaatgtttctcaaaacgtatggcacatcaaaacccacaaggtacactttctccgaagtgaagaagatagcaagacggttcaaggttaaagtaggacaaggaggatttggaagtgtgtacagaggcgagctaccaaatggagtccctgtggcggtcaagatgctagaaaatccaaaaggagaaggagacgaattcatcaatgaggtcgcgactatcgggagaatccatcatgcaaacattgtccgcctccttggcttttgctcagaaggaacaaggcgggctctcatttacgaatacatacccaatgattcgctggagaaatatatattttcacatgattctaatacttctcaagaactcctagtaccaagcaagatgctagatattgctttaggcattgcccgaggaatggagtacctgcatcaaggatgtaaccagcgtatcctccactttgatatcaaacctaacaacatcttgctggactataacttcagcccgaagatttcagactttggccttgcaaagctgtgtgcaagggaccaaagcatcgttaccttgactgcagcaagaggcacgatgggctatattgcaccagagctatattctcggaactttggggagatatcttacaagtcagatgtttacagtttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 59905 - DNA, 1667 bp, Oryza sativa
gacaacgcctgcaggaccatcggccgcttcatcgccgagaggtccatgaacgccgacgtcttcgccatgtcctacgagcccaagaagaacgagaggatcgaggggaagcttggcatcgtcatcgacaccattaaggagcacggcattatatttgtttaggcaagttcagcttacaacgttgattaaaatgtaagtaggatttttttttgtgctattgccttcttaatgtcggtcttgtgatgttattctgcttgtagaattgcttgtttttcttacgattttgctcatgggttggtggtttacagcgaatgcaattgttttatctattgcttccactaaaaagtatagaaatcagacatacttatttcaaaaatatacttatgtttcaaataaatacagaaactcttcctttcaaaaataattcatgccttttttagttctgaagttggaaacacaccaaaattgtcctgtcaaatgtgtaaaaagactgctgtgatgttaatgctaatggaatatgtgagaatggcaggggtagggccttggaacccgttgatcatctcagttcaggtttactgagttgaattttgccagctagctgtgatcttaaaatatacataaatacgttgagatgataattcaggggatggatctcatcattcaaccaaacatcttagtaataaactgcattttggtggaataactattactaagttctattacattattattattatttatttggacaaaggaagtataacttccgggatctgcaccaactaaggatacacacaatcatatttgtggatggagtcatgtgttccaccaccacacaaatggtgcttcccataacatgatgttgatcattggtattgttcacgtaagaaatgtgtgggtttgtaaggaatgtagagcatgagtccctactgattgtcgaattttcgtacatcatgtatcagtaggatagccttgatctcttgttgattatcaggtatctgatgaatgacttccaagcgctgtattgttcatgttcttcaaataataactgtatgtttccaccagatgttgcgaggtttattgcatggtagctatgttcatctgttgggtagctgaagtctgttgtcccaccatgttcatcaaaaattatgtctggaagaaagtgggtgattaaacaattggataaatcaatttagcacagctacatattaaaagcaaaggtaagacctcagatttgcactgcctatggtgaatggtcctgcacttaagaaagaggatagtaaaatgaggctcacattctttactggttctcaaactatgctcctttcctaagttcaatattatcttgtcatgcttgcagtgcacagaaaccatcctgatatggatcttccctgcatgaatacacaaatgaaagtgttttttttttcgcattcatcttgtatccctggaaaatgaagtaatctaattgaatgtggcatgtcattgatgagttaattgggcattataccatcaggtgttcgaataggaagtcggacatctttctggttactcatgagattctcaaaggcataattgcttattgccctgttccgcatcttaaaggcattagctccttttaagcctgcagcaaaagaaccaagtttcatgcaagtaacttagtatacaatatatag

SEQ ID NO: 59906 - DNA, 712 bp, Oryza sativa
gaaacccaacaagccaataaactctaaaaactacaaggtccaatttttaaagtttcggaacttctaaaaagtaaaaataaaacaatgataatcatgatacattttaaaatctcaatgacaataaagaagggaggcagcgggcgaaccataaaggagtacaatggcaaagccactgacggtttggcgggacttatagaaagtaaaaaaatgaacccgaacgattattatgttcgatttgtaaaatcccaatgacaataaagagaaaagacaatggacgggtcgtagatgagtataatggcagcgtttgacgggacttctagaaattataaaaacgaaacccaacgagataataaactcaaaaaactataagatccaatttttagaggtttcaaggagaatgaatagaaatagtggtagaccgaggaaacaaaagaaggatatgacagaagtaaagggtagcagctggtgtgacttttaaaaactatataattagaaatacaagtatagctatttaataaatcttaagtaaaatcatactgaaaaatatatgattttgtttgggtgctagccgcgcaattgcgcaggccacccagctagttacttttgaaataaatgaaacgcacatgtttcagcaatatgtatttttaaaggtatgatacaaactgaaatgtgtacagtataatgcactcattagtactttaggggctgcagg

SEQ ID NO: 59907 - DNA, 749 bp, Oryza sativa
cgtttcaattttacaccttataagttgctagaatcacagtcatctttaaaaaaaaatcattccgaaatgatgtattaatctgaaaataagttgtttcatagcaattccgtgcatctctattatgaaagactagattggctctacaataaagaatgacaattcaatgagtcaatgaaatatttgaagctttgataatataattctgcaagaagctctgtatgctactccattggtaaaaacaagtagataactagtgtcaacaaactaagaacaactaggtcagtatccaataaagcatattctgcaaggagggacacaaaactgtaggtcctcaactatagtgctcacctgaattactcactgcctctgtgagctcaagtgacttcaagtttctgttgcgtgctatttggagtctacgaccagttgctcggataagcatggcagctataaaatctacggccacaaaaatcaaactgtcttgcattcatgagtgtaatataaattacaagatctccaacatagttcaaaaagataatggagtacattggaggcttcattttttttatttggtctgaatcattacatggtaacataaaaataataagaacataatttaaaaaatcatcatagaaaatccttttcatccatggaaatcaagtggctaatactgttagagaatagagacacagatcctaggtgtaatggaaaaaattacataacaacttatttacctgcaatatatatgatca

SEQ ID NO: 59908 - DNA, 706 bp, Oryza sativa
aaaatcgtggacaacaccactaatcgatcatgggaattaacaacaagtataataaataaaataatgtacttccacttagtaggtagctagagagcatgcgtagacccagaggttggtgcttaggatggtggcggccacctcggcgaccttcacctggttgccctcgaagaaggcagcgtaggggaggagatggtcatagcagaagctggagccgtcgcggtcggcctgcagggcggtgtcgcagcaggagcggacgaacgctgccgcgtccgcggagggcgcctcccctggcgccgccgcaggtggcagcaccaccactggcttctcctccttcgcagcggccgcacatggtggggataagccgccggcgctgacgaccatcaacaccacgaggacggtggccatgctcgagctcgacctgctcatttctgtatattatttatctctctccctctctctctctctctctctctctgcttgtttcgttactacaggatgaattacttcataacaacgaggtacaatttatactagtaggctcgattggtcgttaactaattaaccacaacctttctttctaatttattcaatggctgttctagcatcacggcatgtctttttggtgttgtgatgtagtgccatgcttgcaattataaactactatattaatgcaactaattgcccatatatagacagcctgctcgct

SEQ ID NO: 59909 - DNA, 6481 bp, Oryza sativa
aaaaataaatccatccatgctttatatttaggaaattttatttcccacatttaacttcacttgttaattaatgtacatttaatataaattttaataataatttattaaataatttataaatcctaatacgaaaatcaggatgtgacaaagaccgctggaagaaatcacaagaagaaagatagggacttgactcctacaaatgaagggatccatcttacacgcagagtggagattatgggtagttgggtaccacatacccacatggcacgtatatccgactggttataggggataggttgtacagatagaatatagaatatgtttaggaaaggactcgggaattatgttaacttgtatgtcaaggaaatatccagtagtcctagttagttacagttgtaatacatattcgttagcctagtacgtaagccatatgggctgtacattgtaatcttggctcctccccctatataaggtcgggtccaagtgtacctaggggcataacttttctcccagatcatcagatcaataatacactcggtggaataattcccccgctgtataaacctttgcctcctacgtcctaacctatccacttttccagcttgattgctaccccttttagtattgccagaatcttgttttgacagttggcgcgtcaggtaggggttgcaccatgtttttcgccgactagtgcgatgggattcgttccgggcatcaccgacttcgctttccctcccgggcagacgtgctggttcggcggcccatggacctcatcagccacccgtacatgcatgcaaagaagacatcgtacgacagatcaatccatgattataaatcaagctaataatattatatagattgtgaaagaagttcttctgtatatgtgcagaatgaaggatcccttaaagcaaattgtttttgattggttgcaagctttatagttttatttagttccttcgactgtaactttgtaaatattttttgagttatataaaattacactgctcggcaaagccctggcagtatttcaggtcaaaaaagatttcatatagattgaaacgacaaaccaatcgacgtcagagattagaatcatcgatctcattgagattgccctcgagcaaaaacaatgcctttgattcctgaagttgtttccatcgcacttcttgatggataattcgacgcttcccctacctgtcgcgccaactgtttaaactggaattcggcaacatgaaaaagagtatcgcacgagacataaaagtggatggatgcgaagacaagaatttagacaggttcaggccctctcgatgagaggtaaaaccctacacctgtttggggatttgtatccgccaggtggatattgatctgatgatctgattgtggttatccgtgctgatgcccttgtaggggctcattgcccgccttatataggttggggggcagggttacaaagtagaaaacaagccagacagcccactctagtacataatagatggatccggcccactcctatctctagtcgaatatggaggccgtgtcggtacccggtacgcatactctccacaagtttctctacaggaacaaggacgatcaataactaactatctgttttctcttttctattttggttcacacagctacacattgacatttatttttagcattaaatgcctagctctagccttgatgtttacttacatttttctattgtaattttatgtttttgttttagcattggtgtgaatcaggatactcctaataatatatcaacatattttggttgtcatctttttgtgtagtttgttttgaccagaaaaaggttgcttaaaataaaaagaaagattcatgcaagctgaaataattcacacgatagataaatttatttccgaaatttgataacaatgttacaaatgtggcgtgcatgcgatcaatgtgtgggaagcaagtatcacaattaattaattgaaatacaaaagtatgcacgatataatcgacggtggtgtgtatccaaaagaaatttagcgtaaggcctatatataagaaagaactgaggaattgtatgtatgaagttgaatgaaaaaatgatatataatgtagaattgagagttgggaatatatgaaatagaaaattgagaaaaacaatgttaccaaaaatcgtggacaacaccactaatcgatcatgggaattaacaacaagtataataaataaaataatgtacttccacttagtaggtagctagagagcatgcatggaaggctatatatatagctagattattaaagctttatgtgattgatgagggagctagctgtgtcgaaagtatatccaagggttttctgggcggggagatcatcgctataagtgaacaggtaacctatctcgcaaccggatgctttcccgatcccaccgttgtagggtttctccacccctttgatccacttttgcgcattctccagatcctccttgctgcgcttgccatttccggcggcggcgaggcggccgaggctctgcagcgcctccctggtgatgttctcgccggcggctacgctgaagtcatcgacgcaggcgttcaggttcgggtcccccttgccggcccctccctggaccttgcgcaattggtcgacgtagacccagaggttggtgctcaggatggtggcggccacctcggcgaccttcacctggttgccctcgaagaaggcagcgtaggggaggagatggtagtagcagaagctggagccgtcgcggtcggcctgcagggcggtgtcgcagcaggagcggacgaacgctgccgcgtccgcggagggcgcctcccctggcgccgccgctggtggcagcaccaccactggcttctcctccttcgcagcggccgcacatggtggggataagccgccggcgctgacgaccatcaacaccacgaggacggtggccatgctcgagctcgacctgctcatttctgtatattatttatctctccgcctctctctctctctgcttgtttcgttactacaggatgaattacttcataacaacgaggtacaatttatactagtaggctcgattggtcgttaactaattaaccacaacctttctttctaatttattcaatggctgttctagcatcacggcatgtcttttaggtgttgtgatgtagtgccatgcttgcaattataaactactatattaatgcaactaattgtccatatatagacagcctgctcgctttttgtttcatatccattcacttaggcgcctagcattggcttctatatttttgtcaaatccttgcatttttccttggttaatcattaggtctagaaatataatgatatatagtttaaaatttatttaatataatatacgaatatctacaacaatctatttatcttaaccaatcacaactactactgctcgtttaattttctcacataactactcatctcattcaatactaactctttattcagatactcattgttaatatccagaaaaaaagctccaaatatattgttagacggagagaattattattttggaagcaactgcaccacaggccagaagcaaaattcagctatataactactctctccgtcccataatataaatgattttgccctttaaatctgtcccaaatgtaagatatatattttgtgatccgcgacgatattttatacccaacctatcaacttagtgctacttttttcccatctactaatttttaccaatttattttccatctatcaattttttttattccctccgttctatattgtaaaactttctggccctgccaatataatatcaacccaattgatgagagagaaaccacataaaacaatagttttgtgcttgtgtttctcccttcttccggtcttcttccgacgctcctctcagttctcacacgccccctgttgtgcgtaaggtcatagaccacgcacgtgtgccccgctgccccgtcctcactgctacaccgctccgccgcgagggctccacggccaaagctgcgcaatcatgctgctgctcctcatgtgtgtacccctgcgtgtgaggtaaaaggctgccactacgccacggagtcctcatcgtttccgtggggaccatgtcatcgacccttccatccatgatgccccgccagaaggcctccgcaactgccttcttgtcgctctggaggagtagctccctcctgttcatcgtgtcggtgaacttctgtaggattagcttggcgaagacgtcgatgatgttgaggccggtgtcaacctcgcttatgtacaagaacaagcggtcgttgtcgaccagtttcgaccgtcaatattatccaatatatgaagactacctatggttgcaatgcataattcccaaataaaataattacttccactatatgctatgctactaacatgtatgcaggagaagcactcataaatgaagagaaggatgtggaaatatatcaatcaatcagtcgaaagtctgctggtgatctgcaattgcatgagaaggcccaaaagtccaatttaacaatcacaaatgggcctagaatgtatgtcactgatttaggggcccacatggaagtctcctggaggaagctggggccagaagagcccatatagggtatatactgtttttagtaaactgttttttattattagtagtaggtaacagtttatactcttttttcgtgcagtatatttcctagctatgtatatgctgccatttctgcatgaaagtatatactgtttttgtttttagtaagcaacggtatatactgtttttttttatttgtagtaggcagcagtttataggcagctgccatatacttcattttgatgtagagaaatatatacagataaatatcccacatacgtgttttttatgacagtatatacttattttttttaatagtatatacttcttttttttacttagtactgtgcttcaccaaagtagtttaagtactgtgcttcagttaagactagtatatatactgtttcctaggtggtagcaatatacatatatacttctttttaaggtggtagtaacatatacctttttaaggtgcaggtttatacttttgttaagataattgcagtatataccatttttagcagtagcagtatatgctattttttaagatagtagcagtatatatgctatttttattacttgcttttaccctgtcgcagaactcagtgttcgtgctgcatgcacgtattatgatccaaaagttttagtatattctcaaagatatatgtagttccaaaagaactagcctcacagacgagaaaacatgatcaagaacacaaattgaacatgctgaatcgcagattgaaaagtaataatgtacatccaaatcacagtttgtcaaacaaggatccttccccttgcgtgtatattctctccgctggtgccgttggattgtggcgttgagtcgacatgttctgcagacggccggcgcggccggacaccacctgcaagcaacaaaaagattaggggcttattcattcaaatttcaaggaactaaagaaatccatcacaaaccactatcctggaacaacattcacgcatgcaaaggacaattaatctaccatctgttgatgacatttttttcatccaaatcacagtatttttcattctgaactctaggattaatttttatctacgtgtacgtacagagattaaaaggaagaagaataagaaatagtgtatactcatctgagtgtggatctgtgattcagaatttcatatataaactaagaacagtacacaccaccatcctggagatctggtagtagcgataggccgccacggctgccttgactagacatatatgaaaacaaatcacaactaatggtgaaattaactaacaaaggtgcttaccggatctcatcgagatcgagacgatcaattggattagacaaaatacctggccaccgtgatctctgtgcgttttaatccttgcggcactctagcagctgacctataacccgttctgatctccgcttaataagcgagaaacaacggaaagaaaaacgaactggagaaaaggagtagatcagcgcatcgccaatacctagacctattctcgttctgtcgagcggagccagccaatgccattccgtggtcctccgacgccggtagggcagaagacaccaggccgatggatcacgccgtcgcttccgactcgtcgttgacgccaaatcaatgatgtagatatgctgcccttgtcggcaacgatgccaacccctccgaagatcgaggtctccactgataactgatttatcgatctaatgagctgggaaaagggatttatctatccggttttccgattaccgcgggttaattaagattatgttttttttcttgttaaaaatgaaaacgggtccgttctgtgaatccggtaacgggcttcttcggggtggctatgatggacggtagatgggagcgggagcactagtcaagaaatcgtttttagtcccggttcataacccc

SEQ ID NO: 59910 - DNA, 3098 bp, Oryza sativa
acaccatccaggactaaagatcacgtagtcccgttctacttataaaccgggactaaaaaccatctttagtcctggtttttactgcatccgagactattgtggtttttgttcgaccgggcaaagatgatttctccactagtggagtacgtactcctaggtgtatggaatcatttactcttctgtatacctaggtgtatgtgtatgtactccctcttccttgttggatatccattagttgataatgaatagttagattaaaaagaaataaataatattattttttcaaatttcttcatgtccatccgtaggtgttctattttttcaaatttttgcatgcatgcacactgccgaggaatgggcacgtttaaaatttgcatagcacttcatacagctttttctagatcatactatgtaccaccatacattggctattggtagtatatactttttttttctatatcggtactatatttcacttttttctggatcagtagtatataccactatttctagatcagtagtcactggtggagaaaccctttgtagtcccggttcgtaacccccctttagtcccggtttccaaaccgggagtaccaatccgggactaaagatcgctatctttagtcccgggtgaaataaccgggagtaaagatcgatctttagtcccggttggtgttaccaaccgggactaaagatcgagctgaccttttttttttgcatggccctgttgctgcatggtttatatatatatatatatatatatatatatatatatataaaccatgtatatatatgtttcaatacatatatatgcatacatatatatatatatgtatatatatatattatattatattatatgtatatacatgcataatatatatgtatttatacatatatatgttatgcaaatgcatatgtatatagatatatatatgaccaaaatatatttacattatagaaaatgtgtacacatgcatatagaaacatatgtagtcatgtattaattacaatccattatatgtcctagctagctacgatttcgacgtagtagtagtcgctgctagctcagaagctaaggaccggtgaattgtgtttccgtcgtagtagaattcacccttgggatcaaggatttcttcgttgatgaatcccatgagttgttattgaaccgctgcgataaattccttgtgtgtggtcaggttatccctcatgcgaataaactatatgaatgtatgaaattgattagtaattaaacaagaaatcgttacgtaatgaaattttgaatttatttgtacgtacatcgagctctcttgtggtgataatttggtctgcaaggcagtggcaatactcacacacgtagtagccgcacaagttagttccctgcttttgctttgcgcattacaaataaatgacaaattaacggcgtgagatctaattaatatacagttgtatgtattaatttgaatcggagaaatataaatgtagagcatgtgtactcacaggaaatttgaacctccgcctaagtctttctctccagttgccgcggaccaaatgacggaaccgataccaagccctacatggagtttaaagatatgattcgtagtagaaataattaacataacaagaatttcttaattaacagagaaacttatgccagtacctgtctataagttcgaaaaccttgtcaaacgtagactcttttttatccattgagtcatatacattgacggtgcaggccgacaggtcgaagagtaaaagcacccagtggaatctgcaatgtgcgtgggatgcattacatatgaaacacttagcaagttcgtacgggaatgaaatttggtatgtaggaagacagtaaaattaaactaactctgtgttgtacggtaacagtatgaacgtcttgtaatgctgcgccttcaggagatggacgagattgtcctctgtttcctgcggatattggtcgagcattccaacgtttactctccgagggtcgatgaatccagtatcgaaaaccctccgccgtcgggccctttgaatctccattctacaacgataaaagggagtattttattttatatagtctacttatatacaaggacctaattaattaaaggagacatagtaattaagaattataattgaacaatatacttacaaagtccagcaactcataatagagacatcgagggcgtccagctggtatacttcgtagattcccttgaaattgatccagagaatatcatctccttgcaagaagtccgggtccctgatcctcgctccgatcatctctctaccggtggcgctcatctccacgtacagctgatggaacttgtacatttgtgtgggtagggactgcaccagctcaggcttgacaagcggtttaccgagttcgtacatgtatttcaattccgccttttctattggttcaactcctagcaattgatccgtagttagaccggtgtcaataataaattcttctatcgtcatgtctttcccggtcaccaacggctcgatctcctggtttggttgctctccaagctgagggactggtttggactttccagaagatgctttcttcagcgttcgctcatagtccgatagcttgatggcctccttgacaagtgcagacatacccctgaagaagttcatgacactggggtctataggaatcttcttttctggacttcgaggcttgaattgtctcttgacttctgacgcaacgtaagcgtcaagctcctcttgcgtgcaatcgtaccccgggtccttgttcttggcggcgtcaacttttgccttcttcgttgcccttgtgtgggcaggcggtggagctgggggggcctttgactttgaaggtgccggaagaggagcttgcggaggagtaggtgtaggagcacgaggaggagtcggtgcaggatcctgaggaggagtcgatgctggagcctgaggtggagacggtgctggcggagcatgaggaggagacggtgcaggatcctgaggaggagatggcggagccggaggagatggtgcacgagacgccgcttgtcgcccagggaggatgatgtaccgcctgcgccatagaataatggcatggcttgtgtctcgta

SEQ ID NO: 59911 - DNA, 2283 bp, Oryza sativa
aacgggacaggtcgattcgtcctgtgtttgcatggcgtccatgctctgtgatcctacctgccccgttgaggcgcagctgctacggtttcctgacgggctcaccattgcaggaggaatggtcggctggggatcatgggaccgatgtgcggccatgcgttcatcaaccttccttgccacctcctcttgcatgttgagttcgtagctcgatacccggaactctgggtctgcaatcttcgcctcggtatctctcttgctcctcatccgactcctgtacgtgtggatgtcctccttgaaatcaatcttccaaggaatcacccctttccctcgtgttcgtcctggatgctctggagtctgcagggcgagtgtcagctcgtccctatctctgtctggtcggaacgtgccctgagaggaggcttccactgcatctgttagtcgtcgcgcagcctctcgtatctgatcgccgaagaccagtgagccatcagctgggttgagcgttccaccgtgagcatagtaccagaacttcgatcgttccggccaattggctgttgccggttcgatacccctctcaatcaagctagcctccatcttctcccacttcggcatcgcgacgctatagcctcctgaccccaagtggtgatggtacttcttcttggcggcattttctttgtttctttccatcatcgcctgcccttgttcacctgtcttatatgcaacgaactcgtcccagtgatcccttagctttgggaatgtgtcgaagttcggtgtctgccccttcagtatatacttctggtacagatctcccttgaagctctgaaactgttctgccattttcttcagagtccaccttttcactttgtcctctgtacccgcaggaagggtgaatgtctcgagcattctggtccacagcatctctttctccgaatctgggacaaagctctcatgatctccgcgtgcacttgttcttcgccagtacaccgtactgacaggcacgttatcccgcacaacccaaccgctgtgacgtacatagttcttggcggcttcggccggggcactaggacgtccatcttcttccacttccgttatgatgtgccgaccctcaagcttcttcgctgcacctcgttgcccgcgtgcctcttctgtccaacggagggttgactaccactagcctcctcctcctggttcccctccacatccctttccacgtgcccctgctggttcccctccgcatccctctccacgttcccttcctcgttcaagtactggtttggatcctcgttcccctcttcttcattccagtactggctgctttcctgcgcgattgtatcgtacaatatctgttcctcatcgcggtcagccatctgttgatacaagaaacatctgctaagtcacgagacatttatgttttaacaatctaagtcttgtatgctaagtgtaaatgtcgtacattagaaccctacacaaccttacgtgctaagtccaattacaaatcgtgatataagctaagtctaggtgacgtatattatacaaccctagctagtaaataattatatactaagtctaattacaaataaaataatcttatattaaaactcaaataatattacatgctaagactaaaatagtcatgtatatgctaagtgtttcgtgcgtatatgctaagtctaattaagactacaatagtcaattgctacttgtcggaccaattccgtagtcaataattacatactaagtctaattataaataaagtaatcttatattaaaactcaaataatattacatgctaagactaaaatagtcatgtatgctaagtgtttcgtgcgtatatgctaagtctaattaagactacaatagtcaattgctacttgtcgcaccacttccgtagtcaataattacatactaagtctaattacaaataaagtaatcttatattaaaactcaaataatattgcatgctaagactaaaatagtcatgtatgctaagtgtttcgtgtgtatatgctaagtctaattaagactacaatagtcaattgctaggagtcgcaccaattccgtagtcaataatgtcatactaagtctaatttgcaataaaataatcttatattaaaactcaaataatattagaacactacgcaatcttatatgataagtctaattacaggtctctaataatcttaattaattgcattacaaatataacaatcatttatattattacgtcacttgcctgctccaattccttctagggctagctgttccactcaggcttgacggacgactccgac

SEQ ID NO: 59912 - DNA, 5268 bp, Oryza sativa
agcatcatcggctacgggaacctgattctagacacgccactcctgtcttggtcttggtttcctcagccgatggttgatgtcctcttcaacctcctgaaaacgctccctgttcctcaatctctggaccctccttttctgattcttcgtgaaaataccagaaggacaccattgattctttctgatcacctcatcttcttggccacgatcttgactcatcggacccaatctttgatgaacagagagtcttgcctgtttcagccgattatccctattatgtggtcggcttgagctctcgatgatatcactgcatccagggcagttttcaatggatggcaacctcatcccctcattccagcagaatctgaagaactcgcaaccccaatgaggatcaaaaccatcgtcgtattcttcataactcctctcctgctgcttgtcatacttcttctgatacttgttgataatcttagccgaatttacttgaaaaccctttgcacgggctctatcggctgcttgaccagctgtatgcaccatattaataggaaaaggattccaatcgaccttcatcggcttcttggaatcatcaaacctaatctttcccccttcaatggcaacctggatttgctatctaaagaccttacaatcattagtagaatgagacccagaattatgccatttgcaatatctcttcttgcctaattcctcagccgatgggatcgtatgatcggtagggagctgaatctgcttttctcggagtagcaaatcaaaaattttgtcagctttggtgatatcaaagtcatacttctcctctttcccgggactctttacccattggcatggtataaccttttttgctccttacccattcggctgcagctatttcagaatcatcttcttcgtcatccgacccatacatatatggacaaacgtgattaactttctttgagcttttcctgacttccgccgacctatgctcaagcaaggttaccttctgtatcagatgcgataagctatcgaagtcttcggatgaaaatttctccctgattggaggaatcataccctggaaggccaaatcggctaactgagcatcagtcagactcaagctaaagcacttgttccgcatctctctgaacctctgaatatactcgtgcacaggctcatcatgccgctgcttgatcgctgtcaggtcggataacttcatctcatggaccccactgtagaaatagctgtggaattgcttctccaaatcggcccaactattgatcgacccatatggcaaagaggaaaaccaagtaaaagctgatccggacagagataaccggaacaacctaactctcaaggtgtctacagccgatgcttcaccgcactgagcaaggaatcggctgatgtgctcataagtcgacacgccctcttgtctcgaaaacttggagaaatctagaactttaaaccgattgggaagaggaactctttcaaaccactcagggtaaggctgccaatacaaacttccagtttcttttggtttaagtccgaattgctccctcattacatcggcgatgtcacgtcctgataaattcatcccgaaataaaaatcattttctaaaaggaataatagaattaattaaaatttgaaaagaaattggcaaacactaaaatacgtacaagaaaatttcgaatgtggcccggagaatttttgttaaattctccttggtctaaaatgagccctcaaattttacttgaattttcagagcactggaaatatttattaagcaacaacaactatgatcaaagtttattaaaaagaaaacttaaaaataatcctccttcctcctttgggccaagcccagcccaaagtctccctctcctccctctctttccctcctctcccgggcctctcctcctcctcccggcccacctcttccctccccctcccggcccagctccctcccctcccctctctctcccgggcctgcctctccctcctctcctcctgggccgcctccgggcccaagccgagcggcgccctcccacccgtgccgcgcacgtgcgtgcgctgaccgcgcgcctggccgcgtggggcccacgcgccggtcgtcttcctcctcccgcacggcctcttctctctcccgtgcaaacctagcgccgttcctcctccaaatccgccccaatcaagccggctctttccaaattaattggggggttttaatccccattgattcctcttcaattccccccaatttcccccttgaatcgtgcccccaatcgccgggaacggacgcgccaaccccggtcaccttgcaaggccgccgggcgcctattccgccgccgttccccgcctctcccatggccggctccctctcctcccctataaaatggaatccccatcctccgttctatcgttttagccccctcccgcgttctcccgtggcctcaccacccctccccgccgccgcccttctctttcccccgcgccggcctcctccagccgcctctccctcctcgcccgagcgccgtccggccatgccgtcgccttccccggcgtcgcagccgcctcctcttccccggcgctgcctccgattcgtggggaaatcatcggagacgcgcccccgccggcgtccagtggcgtcgccgccactacaccgtctctggccggctgctgttcgtcgccggtacgccgaccgacgtcgccgtctcctccgtcgacgtcgcagcgtcgtcctctcctccggctgctcctcagtttcgccggaacaccgccgccgccgcgccggcctctcgtttctcctcgtcgacgtcgccttcggtagccccttccgccgtgcccgtgcgccggccgacgtcgccatctccacctccggcatcacagcggcaaggtcgccctcggcctcgcctcccctccacccgaacaccgccggtgtctgtcgtcgttttcaccgttcatcctcgccggctcgtcgtctcgcggcgccgcctccgtcctcgtctccgtgcagccgctgccggctgccatcgtcgtctcctcgccgtccccggtcgtcgtcgtcgtcgtcctctcgtcgttcccggttttgctcgtcgtggcgttcgtccctccgtcaagccgatcgcgttcgccgcccgtggttcgtcaggcgagccgctgcagccccgtcgtcttcgtcctcgcctccgcgtcgccaagcgttgcaccggccgcgtctcgccttcgtccaaggatcgccgccgaagtcgctccctcgccgttcgcctccgtcgtctccgagccatcttcgccgcgcccgttcaccgtcgtcgttcccacgcctcgtcgcgtggtggtaaggatccatcctctcgctgccccgtcctagtcctttcggtgtcgcccgtgcccgttgtgcggttgtcgaccccggtacccgtgtactggtgtcggtagtcattcgcttgtgtgtgtagtgtccgtgttagtgtgcccgctcggtagccgcgtggtttccacgtgtgcagcccgtgtggtgtctagtggagtccgtttgtcgaccgcttgcctcggttgacacacgggatccgcttccgtcgacccgtggaccgtctctgtgtactcggtctactgtggtcctttaggttgacatgtggagtctgcatgtcaacagcgcagccttcctgtattttccaggctagcgcttacacatgttttataattggaaaacctaatcacaataatccgtcaatctccatgtaacagcattaaacttcggatgatcatatcttggtcatacgaaccccgaatcgacccgttcaagtctcctaatgtttgttataaactaaagaaccgtgtgctttctttttatgtattgttattgcttctttataggcttgtagctttgcttgtgtgcttcgcgtagcttctgtcgttccgaaggttctcgaagcgtggtttgcggtcgtcgccgaaggttcggaaggctgttctctctgagcaaggcaagtcacatcacccttgagcatattgaatcccactttacaaaattattttgatttaaattattgcattaccgctttatttaaattcccgcgtaatcactgttttatttagcacttcctattaatccttgttatagccttatcattgctattgtttattattaccttgttcaccctaggataaacaaaaccccaactagtgggtactctattaacagttccactagtatgaatctaggtagatgcttcgctgactaattaggcaacattaggtggttttataactttagactttgggaattctcatatcatttggacactgtggaatggttggcttgtgatggaattgaacacacacctcccccctctattcaaaaccccaaaatggttttaggttgggctcgaggtgcagggttttgctagtagcacctcggccactataaggaccggtcttcgggcctctgttgcaaagcactataaccacatgtctaatgggtaaggcttaactcggtgctcagtctagtcctgaacaaaaagacacggatagagatggatgaagtcgttgcgacgatggatatctctgaggcaaatgaaggctacacgagctgcggctcggtaatcgagatgtctaggcaaatgaagactacacgggtcggtgcccgttagtcgagatgccatggcactggactagtacacgggtggtctcacccctatgggtgtggcgcacccggtctagatcctgttgctaggggctcaatcctggcctgcctgtcccgggatatcggccgtaggcagggttgggtcggtacttttgtttacggctaggatgggtgaagggttatgtcacatgtttacgacgggttccaaggccatggaatgcggagtaaagatgtgtcttgtgggtaaagatgtacacctctgatcagagtaaatctattcgaatagccgtgccctcggatatgggcaagcctagcaatgtacccaagttagtggtttaattcttaaaaattgcttaacaactaaaaggtggaaaggttggcctgggttggcttgggacgagctgggacctaggtcgggttgccagtttggtctgaatcatcgtaggccttgggttaaggcaggttcgtgtgggtccacggccttgattaataatactgtgtagctctaggatcgtctttataaaatagctatgggcaactaagtgtcttttaaatgctgtttactgcaaaacctaatcccctatattattaccccttgtttcccttgcattaatcatgcatctcccggtgtgacttgctgagtactgtg

SEQ ID NO: 59913 - DNA, 2906 bp, Oryza sativa
tccactagcgtgagtgttcaccatctgttgcagattagaaaggatagaagaagaggggttacactaaagataagaccttaaccaggttaacactgatctgatgtgtgtagaccattatattgttcaagttgattaagcaagcaacctagtatagtcacacactcatcaatgaacttctccaatgatgggaatgcaaccatacctacacacaaagcaaacaacaaacgttctaccctactaactattcttcaaaattactttggcggtataggtgctaagacaggatccaaacttcattccatcttgaccacttggcacttcagttcttcctcgatccactttacttaacctccatcagtagacctcattggcgtcttcaggtttcaaccactagtttcagaactacttcaagttgaacgagagaggagagtagacaatgaaacaatttgcaaagaattctagataaggaagaaaggagaaattttcacaaattatgttttcggaaaattagtccttaaggtttgaccatttggcttatcctacagtcgagatggctctgataccaacttgtcacgcccggaaattcactagtaatttccgaactaatttgtgcatagaaccctcgtccaggaatcagccgaggtacacaaactgacaatttaatatactgaatcatcaataatagcgttacatacttacaaaagaaaagaaaactgcagcggaattacggtctagcgaagctccactcccacaggcagctcaactggggtataagccaaacgtcttctccttctggatcctttatcttcaactgaggtttgatgattattgcaagaatgagcatatgacatactcaacaagccacacagcaaatatgcaagtgcacaaggataccaaaggatggcataatataggctcatttgcgaaagcagcatttagcaaagagttaagagtagtaaaacagtagagtaattaatcagaaattttaatcaacactgaacagcacacccatgctgtacaggcccaaccatcctgaacaaccatacccggctgaacagatctaactccaaaccaggagctaagcaaattattaccagttaatcatcaataattattgtgagaggtgtgagactaatcacgaaaaacattgctcaactcgcccataaccgcgggcacggctattcgaatagttttactctggccagaggtgtaccactgtacccacaagacacgattccacacatgttgccatgccccgaaataccaccacggcattgcaaaggggaaaatcgtaacaataccctttgcacaacacaactcaaaacagtgcaccgttcctggatcataatcacccccttataaacaaggcatggactccccagcgacccccgtggacttctcgccacttctcagtctggcgcactataatgaaccatgctatacaaaggataaagccgttgcccacgctggcttgtggttggtacggttaatgtctcacaacagtagctcgcgaaccggtccttaattgtcatgagcacaaccatcaaaaccatatgctcacaacccaccttaaccaggttttaattatcaattaattaacatcacacgattaaccatcgtgagctaccattaaatataaccataaataataatgtagtatatatgattcatcccattagtgagctaatgtttctaagcattgctaagcaattatatatataacttttagctgaaccaaaccaatacataaggttcaagctaatcaatttattacccaaggtatcaaggaatagggcattcaatgcaaattggccataacaaaggaataggttcacaccacccggtgacattcgaaaataaatgcacagttgaaacaaatagagaatttaaatataggatcaacatgctcaaaggattgtgtttaggatctgtgtgacttgccttgcaataatcggtcttcaattaatcttcttgatcacttccgacgcactcacgaaccttcgcaacgacggaaacgacaagctaacacgcaaaacgaagaaaaagactaataaaaaccaaataaacagtatataaaaaataaacaaacatgtagatcataattttagatgaattatgagacttgaacggcctcattctgacttcaaatgaatttattatgaattttacaagattaaatctaattaaagcccatttaaaaagaattaaataaatttaattcaatttatggataattttaatatgtagatctttattttagaaaaatttagcaacttgaaccacctgaaacggatctatggttatttagttatgattttccgaagatttaatctacgggaaaaagataaaccgatgacgtcatgctgacatcacccatggccgaaccaagatggcgacctcgccggagatagagcggccggctgcggaaaaggagggcatgtacacgtagaggacgacgagacgaacccgatggtactcaccaacgcgacgaacgacgacggatgacggccggcgacgaagaagcgacggcggcggcggcttgcacggtggcgacggctctacgggtcacgggagaggacgggagagggggcaaacgaaagaggaggactagggggtcctatttatagccttggattgaagagatcggactcctcccgcaagaaatcgatccgggaaaatcaaaactcggttttggagataaactcgaaaacgagtttgattcggataaaatacccaacgatttgctccgattcttgggggaaaagatagaggaggatgagaggatcaaaacccctcaaaaatccggaagaaacggggtcggattggagcggacttggaggcggaaaggcgacgcggcgcgcggctcgggctcagctaggcagccggctggaggttagggacgacac

SEQ ID NO: 59914 - DNA, 6847 bp, Oryza sativa
cgtggactccttgcagattgttgccttgatcgctcggggagccgtcggtagcacctttagaactcggttgagccgagccgcctggagcttgtttcacttctccatctttagaagaaccggtcccaggattatcagcaaccacttttatcttatacttctgaacaagcgtgcccttgcgggtttgcatgaacgagctcaggaactgatcccgtgcttgctgcatcgatgcttcaaactcctgcttctactcaggcgtgaatttctctggatcgattggcatgacgttgtcatcaatgatgtcggtcaatcctggcttcggcgccttgcctttaacggaacctgggcttgatggtggcggtggctgtttctcggccatgaggagggactgacgtctgacttctaatcaggtcccaccgggtgtgccaaaagcgtgttgacagaaaacacgtggcttgggagatctgcttaactccagtgcaggtccaaaattcgccttcggatgtattagtgtgccagttgatttgatcctgtaatcaacaagaaatagaaacaaagaaaccgtagttaaatttataaacgatagccgatcggctagatgccgatgacatatcatttatctttgagccgatgtcatctgtgcgtcgatcggcagtcatgaataagtaaaaaaggactaaatctactcgatcggctgtagatattaacaatatatactccttatatcgatgtctacttaaatcaagtgattgggatagatcggtcatcatgccgagacagtataaatcacttagatcgaaatatatgtcaataacaagactatatatgtttatagcatagccgatcagatagatctagcatgtatcggctaatactccgatactactctatatcaagatattaaagcaagtataatatattgagcaaaagcctaacatacttagatacggcaatatcttaacataaagggcagatttaacatatcaataaggcatatagaacaaatgaagttaaatcagatacgatcggctgaaactccgatactattctaatcggcaactagaaggcaggctagagatcgatattctaagcacgacttaacagatcaaactcaactgatgcaacattaagtataaaaagaagaacaatatctagacaatcaagccactagaaatttcatagaatgatagatatcttatataatctagatcaacgtcaagatctaacctaatcggctgtcttctgcatacagatattggcggatagtagtctagatggcgatattgctagagattatgtaagatatatgataatttgatgaattaaataaacaagattagagtgtcatgaagatggaagcactaatcctaagaacgcaatccatcacgacgaattttacctcttgttgaagatcgaaatcgatgcagctcaacccgaaagcaagaactcgtcgaaacaaaactaaagcaaaaagggtggcgatgcgccgaaattatgttgaatgtgtgtgttcaaaattacatagggctcggggtctatttatacccgaggattacaagatatgcccataccggacacaaccattatctctaacaaactctaagataccacaagtctttgcggcagacttttgcccacacttatctataaggaattcacataaaatattctaattaatagatacaattgcctttccaggactctatccatgtgtggcaatcatcttgaagtacattaacttgaacccgatgtcgcgcacaagtcgtattgtcggaatcggctatatcggcttatttagctcgactcagactcagccgatcttgtcgtagccgatctggacttcagccgattcctaccctgttttcaaactcgatctccgcttccgactttgcttcgatctaatcttctctccgctgctaatgttaccaaatttggttgttaacaacttctaatattccttattttttaattccgaatttctattttttcttaattgtatttctatatggactctatactctacttctaatatttcttacttttaaatccgaatttctattatttcctaattgtatttctatatgaactatatactctacttctaatattccttatttttaattctgaaattcagttatttcctaattgtatttctatatggactctagtctcctcttctaatattccttatttttcaattccgaatttcaacaatttctaaattgtatttctatatggactcttctttttctttttctccgattaatgtgagaatttctaggccatgagagcgaacgtggaggcttctttttctattcctttgcatgatatgaggctaaaaaatctgtcacttgtcctataatatatcagacaaggtttttctacacctaggtgccatggcactcattatttgtatgtgactcaaatagttataaaaaaattgaaaaaatgtagtaacatcctttgtgatgatacaagtctatacacaaatatgcaggactaaatttgatctaccattagagaaacaaaaataataaaatcagacagtgaatagtactcgtaaagtgcaaataaaatttattatttttgtttcttcatatatcaatcgaatttagacttgcatgtttgtatagtgttttatattatcatgatctatcttaccaaattttataaaatttttatacaactatttaaattgcatgcatacacctagataccatggtgccatgatgtataggcagtcccgactttctttttacttctacgtgaacagtaccatgcaactgcatgttgcctgccgccgcctcacaaaggatggcttcgcggggggctacgcgtaggtgcgtgcgtcggagataggtgcgggagcactggcggcggaggcgacgcagccgcgcggggccatggaggtggcggagccctgcgcgaccggcggaagcgacggagccgcgtgcgccggcgtgggaccgtgcggagccacgaacgagcggtggaggcgcgtgcgccggcggggccgcgccgagctatgtgcgggcggcggagccccgcgcaaccggtggaggcgacagagtcggcggagccctacgcgaacggcggaagcgacagagccgcccgtggccgcggaggcgacggagccttgcgcggttgcgacgtcgactcagcggaggcgctcgtgggcgacggagccgcgacggccggagccccgcggcgctcgtggaggcgacgatgccggctggccgaggcggcgacagatgcacggagttcccttgccgcgccggggcgcggtgaccagcggccgaagcttggcgcgctagcggcagctccggagcgttccgagccacgcggggctagcggaggcggcggttcccgagtgtgctggcagagcaggaggcggagtaccccggcgcgcgcgttgcatggcgcgtggtcgtcaagtttgacgtggttgtgggttccatcctgaccatgctggcagtacgtattagctattctagctagcactgcaggacagcacacgatcgtgatggctgcacacgcatgtgcgatgcatgctgtgccgcgcaccacctctctgtttctttcttctttttcttgtgcttctgacggcctgagggcgctagtagccgcgccgttgttcagcggcggcgcacaaggacgaagcctccgcgaagcagtctaagcacgacacggaagcggcgtcgtggggcctgacgctgtttcgccatggccgaagcatggaacagcggcggcgcgacgaggccgagtccacgcggagcattgtcggcgcctcaaggcccaccacgcgaggccgaagcgcggcgcggcgctagctcccggcgccgttgggtggagccggcaaggagccacggcctatcgcgcatcagcggggtcacaaggtcgaagccggagctcgatgtggaggcatgccccgcgccggaggccagccgaagttgaacgcacgggttgatgtgcatgagcgtacgtagttttttttttttttgagtggctccgaattcagcctaccacgggctccgaacgcagagcctaccgtagagaggctcggaatttggagcaacttgcggagccttagccgaggcttagaattgcaaacctacacagcttaagactgcaatatatatatatatatatatatatatatatatatatatatatatctcaattgctaacctatcttttttaaagtcgcggagaactactccgtccggccggaaccaggacggtctcgacgctgacttcgccacggagggtacttcactgggtctcttggacgcggaggtctcacattacttggccaagaaaattgcttcgcagaccggagaccgtatgaatctcatcatgacatttttcctttttgttttgaagagtcgcagagaactactccgtccggccggagccaggatggtctcaacactaactccgccatggagattgcttcaccggtctcttggacgcggaggtctcgcatgacttggccaaggaaattgcttcgcgggcaaaggctgcgtgaatctcatcatgaccttttttccttttgctttgaagagttgcggagaactactccgtccggccagagcctagacggtctcgacgctaactctgccacggagattgcttcactggtctcttggacgcggaggtctcgcatgacttagccaaggaaattgcttcgcggggcaaaggctgcgtgaatctcatcataacctttttttctttttgttttgaagagtcgtggagaactactccgtccggctggagccaagatggtctcaacgctgactccggcacggagattgcttcacaggtctcttggacgcggaggtctcacatgacttggccaaggaaattggttcgcggaccagaggccacgtgaatctcatcatgacctttttttccttttgttttcaagagtcatggtgaactactccatccggccggagctaggacggtctcaacactgactccgccgcggagattgcttcatcagtctcttggacgtggaggtctcacatgtgatttgaaatgtaattgcatgatattgtacctactattgcccgaggcagggcaacagcggtggtgcgagccgatcttgagcgcgtaggtggtgcttgaacgcgcaaagatgtagcctagaggggggggggtaaataggttttcctgaaattcacaaacaaatcacagcggtaaaattcagcaggttcggaacctccgggtgtggaacaccggaacttccgatctgctcagactgtccggaacttccggtgttctaaccaccggaacttccgggcaacagaaaaaattgaagatctagcagagacttaaactaatttgcacgaattaaactacaggaagaaagagcaaatacacaatcacagcaacatgcatagaatcatcacagagaagacaaaggcgattttttcccgaagttcgaatcttgcaatcctactctccgttgaggtgctccaaagagctgggtctcgattaacctcttgcctcacccgtgcaaagaacctcgaagaagtccgaggccttcaactcaacatttctaggtcattttctagaatttgagtgaccaccaagatctaactcacaaatccttctagaaaagaccacaagtgcaagttgctctacctaggagaacctctgaaatctcagcacaagaatctttactcacttacctcgtttccttgcggaggtaaggaaaaccttcacaaactttctcgagacatccacatgatctttggaagctctcaggtggcacctaaccgtttaggagaagatctccaagagtaataagcccaagtaacagcccacaagatatccaagtgctcaaacacacctagtcttcaaaccttctccaaatcactcctacactctcatctattctctcaatctcacaagaatggctctagatttgagtggaggaagcaaagggatcttgggagagtctagaacaacctagggcatgaaagaactgaagtgaaaatggccaaaaggtgcgatctggatatatataacggctaggtgacgacatctagccgttactcacatttttgaactggaagaggtccggaagttcctgacattcggaacttccagacaacacttaggaaaatttcacatgtcgcaaggttcggaagttccgggtccagggaccggaacttccggccagccttctctatccggtctggacccatttgcaaaaatggctcccaaaaatattctaccacaaggaacccactaagagcactttttatatctcagaacaacacttggaacccctcttaatagtacggtttttcctaaaactcgatttcaaaaattaaactatcctattgaccttggagcttcaaatccgctttgaatgaatgttgtaggggtctccaagcatcttttgatgtcctaagttcaccttgggagggactaattacctgaatatctcaataaacacattagtcccttaaccttatttatcattaatcaccaaaatccactagggagataaatgcaactttagtgctgacccttggccgtgtcggcggtcgctgtgccgagccctgcgcagagtggctgggacagcgccatcaccaggccgtgcatggcgtgtgcccatgctcaggtctgccggaaggctcgggatgcgtggccttcggcccaaccgccgcgtcggcgaggccgcaggggggaggtctcacatgacgcggccccgcggcggggccgtacaaggccgtgcttgtccgggcggaagctcggcggaaccgcacggggcccgtggcaagcgccgcccctggaaccttgctgcgagtgggagcacctctttataatttactat

SEQ ID NO: 59915 - DNA, 2257 bp, Oryza sativa
cggtgaccggaggcggcgaagccacgcgcgaccggcggcgcacgcggccggcggaggcggcgaagccggccgcgcggggccgctgacgcgacgaagccgcatacggccggcggaagcgcaaagtggccgcggctcgagccgctcgtggccggtggaggcggcggatgcgcacgcggcatcgctatacgttagccggcggaggagtccgagccgtgcgtcaggtgcggagctgcgcgtggccgcggaggcgacggaccgcacgcggtcgcgacgtcgactcggcggggtcgcgggcagccagtggagggtgtcggagactcggagccgcacgcgaccggcggagtcgcgcgtggcctcggaggtgatggagcctcgcgacgctccacgcattgccggaggaggcggcggagccgcggctcggcactgaggcggactgccgcgtcggccggagcttcgcagcgctcgcggagtagcgcgtggaggctgccgctcgctgcttgctacgggtttatgttagtgatatgtcctagaggcaatcataaagatgattgtatcacatactatgtttacatatttatccgacattattcctggaaatagataactcattattggttaatctatatgtgattctttcatgggactctttatgttgtttgttactatttctaaaggattctgatcaaatatcatatgtggaacaaatatgtttatatgatcagcatatatattaattgatgatcatgtctcatggatcatggtatagagataccaaattaataatatggacacatgttggtgaacatgttgttggatagacccaacatgagacactgcaagagccatatgtattgtgtcatcagtgatctcatttagtgttgctgttgaatccttagacctgagattatcatggttcacaacatgtgtagtacactggtggagaagtgctttttagtcccggtttgtaaccccccttagtcccggttttaaaaccggaactaccaatccgggactaaaaatcgctatctttagtcctggttcaaccgcgtaatctatctatctaatctctttctttttcgttcacgtccggttggtgttatcaaccgggactaaagaaagggaactttagtcccggttggtgagggaagcggcagtaagatggtccccttttctttttttttcttttttattttctcccgaattgagtgggatatatcccaaatcaaacccaaatccccaaatcaaagtaacatcccaaatcttaaagttacttatacatacaattcaaatatatcacaaatcctacaaaaattacaaacatatcaaatacatcacagatccatacaaacgtgcaatgaatcacaaaattatccacacaaatgtgcaaatgggatgccgttgccgccggccgccggccacctgccagccgccatcgggtgcggccccaccggccgccgccgcccgtccgccgcccgacaggcggcctcgctccgccgccgctgcctgaccgcgcggcggcctcgctccgccgctgccgcatggccatcgccaccgtctgccgcacggccgccacgcggccggctcgcttcgtcaccgcctgtcacgaccggaaataacccaacgggcgttccttacgtgggtgcattattccttttcccaggaggcaaggtacactaaaagttgatacaattcagagtttaacaagcggaagcgtaaataattaatttattacatgggcggcgaaggcccagcacacaaagacaaacgggaaacagcgaaagactagggcgacgaccacaggcgcttgacggcaggcacgagctagacaccaaagccttcatcttccagaaactcctcttctgggtttgggaaaaattgagcaagactgagtacaaccaccgtactcaacaagacacacccacaagtgcagaataaatgtaagggagtacaagggggttatcatataaggggttagggtttgtagtaaacagcactaaaagacacttagttgctcaaagctatattgtaaatatgatcctagagctatacaagattattaatcaaggccgtgaacccacacgaacctgccttaacccaaggcctacgatgattcagaccaaactggcaacccgaccctgggtcccagctcgtcccaagccaacccaggccaaccattccacattttaattgttaagcaggttttaaggattaaaacactaacttgggtacattgctcggcttgcccataaccgagggc

SEQ ID NO: 59916 - DNA, 751 bp, Oryza sativa
ggccgagccggcccaagagggggagagggggaaaattttaaggtttttctttttataaaatcattttaattttgtttatttcttcttaattattatttgtgctctgaaaattccactaaaatttatttacacattttaggaaatatacaaaaatcctctaagccttgtttaacttttactttgcacattttaatttttggaggctttcacacggattttaattattctaggcataatttaaaggttatattttagggtcgttttgggacgtgacaaacctacccccttaaacggaatctcgacaccgagatttggaagaactggcgaagagatcgggatgggctgccttcagctcgtcttcacattcccaagtagcttcttccttagcgtggttgctccattggaccttgcaaaaacggattacccggttcctggtccggcgctccatggtgtccaggattttcactggcctctccacgtaggtcaagtcttcgtgaacttcaatttgctctgaatcggcctgctcggatggcactcgaagtcatttcttgagttgcgacacatggaacacatcatgcacgttgcccaaggatgcgggcagctccaactggtaagcgacttctccacgtcgagcaacgatacggaaaggacccacgaaccgaggtgcgagcttccctttcgtctgaaacctgtgtacgccccgcaatggcgtgacccgaaggtacacaaaatcgtccactgcgaattctag

SEQ ID NO: 59917 - DNA, 3159 bp, Oryza sativa
ttggctcaatcggctaaccccatccgactcgaactctgccgatcttagccgtagtcgattcggattccaaccgatccttactctgtttccgggacgatttctcgatttcttcttcatctccgatccctgaattaccaaatttggtcgttaacacatgccccccaagtccagaatattggataatgtttcagatttgccatatgtcgattccgagagaaatccgctcttgccgttttttgactgttattccagcgctttaaatactaaccattacccccgagaaatctcacaccatcttcttccgttttcaccgccgaagtaaactctgtcttctctttcctcggcgatttctctgacgcacaaggcgatcctcagacgacttcgtctccggctagatcgtcgcccgcggcgatgtcgtcctccgccagcccttctgccgcaccgtcggtcgagtacgatgaggtaagttctcatcggctagatctctcttcttcacaacagatcgattttccaactcctcatcttgttttcctcttctcggttcttctggatttgtagcatctctccaacctagttgcaattcccagcctgtcacatgaaaattactacttccttggcccagtcggcaacattgatcctaccgagttcatcattggcgaaaccaataggattccctttagattggccaacccagatctaggtcactggaagaacacctttaaatcttggccatctattgagaaaaccccacccaagaggagctggattacatggtacaagcgcgtgtcggccagcaaaaaagttcactgggacgatagccaattcagccaaagatgaactcatgatgtccgccgccacctatttctggtccaagaccatcaatgcctttttgttcaaccaagggccgatgactccaactctaattgacatcaccatgatcactggattagatgtaacctcatcgactaaccctatgagcatgaacaccaaaaatcaatttgatttcaagaccaaaagcataggcggttggtctggctatgtggcagcatatatgggtcaaggatcggttactcctcgagaacatgtggcctttttgctcatgtggctagaaaagttccttttctgtggatccagttgtggccctacaaccaattggcagtttacagccgaggctctggaatcaaaaagagaatttcccttaggcaagatcctcctcggctacttataccaaatgctgaacaatgcatcggccaaaatagctgttggctcagtagttggagcaggctgctgcagacttggctaaacctgatggtcatgaaagttgtcaatccgccatctgtaatagaagccgaattcccaagtctagagccgattatagaagatgatggagaagagcgcactcatcgcagatgcatgtcatatgaagaatatgcatgcacaccagccgatattggagcaaattatcggctgaactgctcaaggactgggttctgcagttctatgagggctttcagaagatgctcgagtttggtttccttatgaagattgggcaaaccttgagctcccatcggactttagatttgaagacataaatcatgaaagataccaaaagtccagggaaattttctcagctgcaatcagcccatgcatccttcctgtcggtatccatcagggaagaaacatccaagtttcttatgaattctatcatccaatgagctcagccagacaacttggaatgggtcaactcctaatcggcttattctttgccgataagatccagtgccgaggggaaatttcatcaactttgatgatggatcggcagctcaatctccaaggacctcctctgggtagcattgaaaatatagagctggcaaagttcaggagcaaaaccattgacagatggtggggtgaatggaaactgcatctattccataaatcagcttccatgtacaggatagacctctttctagttgttatccctcaggtatgccttgatttaactaactctgtttgaataattgcttagccgattcataacttgactaattttcttttggacctgcagacgacagaattctcccctcctcaccagagcaatagtggtagggacatagagtatgctccaggccttattccaaatggaggtgggccatctccccctgtcatcggctatcatgcccctaggacttcaactcttctccaagggctcatcagagaaccagccgatgccggcaagaagggaaaaaccagatcatcggctgtagatacttcggccccagctccaaaaaagaaaaccaagccaaagaagaccaaggaaaccgatgacttgcctgccctagatccatccattaagcaagctctggatgaagtagagatcggagaggatgttgatcaagctgcagacaaggtgagtgatacagagaaaacaccatcagcttcacccaagcaaactcctccaactccttctgccacagttcatttttccagggtaaacaactctccttgatccctttcgtaatcagttcactttatagccaataactcagagattttatagttgcagaagaaaaaaattgctgtgaagaagaaatctgcagcaacaattctcaaaccggctccaccagtaagatatccttaattcttccattagttgatctcagcagattttatctaacacttgtctcttttatagcctcctcctccttcttctcctgtacaacaatcattgagtgactgtcacgtcctgataaattcatcccgaaattaaaaaaaatcattttctaaaaggaataatagaattaattaaaattcgaaaagaaattggcaaacactgaaatacgtacaagaaaaatccaaatgtgacccggagaatttttgttaaattctccttggtcaaaaaggagccctcaaattttacttgaattttcagagtaccggaaataattattaagcaacaaaaacaattatcaaagtttactaaaaagaaaagctaaaaataaatccccctcctccctttgggccaagtttggcccaaagtcctcccctctccctctcggcccgcggccgaagtcctcctctcctccctctttttctctccctctccctccccctcccctctctctctcgggctgttcctccctcccctcccggcctgcccgg

SEQ ID NO: 59918 - DNA, 2777 bp, Oryza sativa
gtcctcgtccccgtgcagccactgccggctgtcctcgtcgcctcctcgccggtcccggtcgtcgtcgtcgtcgtcctctcgtcgttcccggtcgtcgtggcgttcgtccctccgtcgagccgttctcgtccgtcgtccgcgttcgtcaagcgagccgctgcagccccgtcctcgtcttcgtcctcggctccgcgtcgtcaagcctcgtgccggccgcgtctcgccttcgtccaaggatcgccgccgaagccgtcccctcgccgttcgtctccgttgtgcccgtctgtctccgccgcgcccgttcgtcgttgtcgttcccgcgcctcgtcgcgtggtggtaaggatccctctccctcgctgccccgtcctcgtcctttcggtgtcgcccgtgctcgttgtgcggttgtcggccccggtacccgtgtaccggtgtcggtagtcgttcacgcgtgcgggtggtgaccgtgtagtgtccgtgttagtgtgcccgctcggtagccacgtggtttccacgtgtgcaacccgtgtggtgtctagtggagtccgtttgtcggccactcgcctcggttgacacacgggatccgcttccgtcgacccggggaccgtctctgtgtactcggtctaccgcggttctttaggttgacatctggggtccgcatgtcaacggcgcagccctcctgtcttttccaggctagcgcttatacatgttttatagttgcaaagcttaattataataatccgcaaatctccatataacagcattaaacttcggatgatcatatcttggtcatacgagctccgaatcgacccgttcaagtctcttaatgtttgttataacctaaagaaccctgtgctttgtttttatgtattgttattgcttctttataggcttgtagctttgcttgtgtgcttcgcgtagctttcgtcgttccggaggttccagaagcgtggttcgcggtcgtcgccgaaggttcggaaggccgttctctctgagcaaggcaagtcacgtcatccttgaacatattgaatcccagtttataaaattatgttgctttaaattactgcattaccgctttatttaaattcccgcgttatcactattttatttagccatgcctatttacctttgttaagacattattattgctattgttattattaccttgttcaccctaggataaacaaaaccccaactagtgggtactctattcatggttccactagtatgaatttaggtagatgcttcgctgattaattaggcaacattaggtggttttataactttagactttgggaatattcatatcacctggacactatggaattgttggattatggtggaattggacatacacctctcttcctctttcaaagcccctaaaacctgtttttcggtggggtttgggtgcatgccagttgtgggaagtagcactccggccaatataaggattaagctcgggcctctgttgcaaagcactaccgtacttccacatgtctagtgggtaaggcttagtttgtggctcagtctggttataaacaaaagtacacggatggagatggacgaagtcgggggtcgatggacatctctgggacaaatgaaggctacacgagctgcggtccggtagtcgagatgtcatggcacagggctggtgtcctgctgctagggggctcaatcctgcctacctgtcccggaggttccggccgtaggtggggttgggtcggtactcttgttaatggctaggatgggttgggaactatgtcacgtcttccgtccgtataccgtggtggtatgtggcacgtggttacacgtgaggaagatgtgtcttgtgggtaaagatgtacacctctgatcagagtataatctattcgaatagccgtgccctcggttatgggcaagccgagcaatgtacccaagttagtgttttaattcttaaaatttgcttaacaactaaaatgtggaatggttggcctgggttggcttgggacgagctgggacccagggtcgggttgccagttcggtctgaatcatcgtaggccttgggttaaggtaggttcgtgagggttcacggccttgattaataatactgtgtagctctaggatcgtctttataaaatggctttgggcaactaagtgacttttaaatgctgctttctgcaaaacttaacccctatattattaccccttgtacccccttgcattaatcatgcatctgccggtgtggcttgctgagtactgtggttgtactcattcttgctcaatctttcccctcttcagtaagagaagctttggagaagatgtcttaggtgaagtcctggcttataccccagttgagcgcctgtgaagatggagccataggcccgctagtccgctgctgtttattttttattgccaggcctgaagcgcctttgtaatagtgtaaatattatcgatataataaagatgtgtcttttatatcatgtttgtgtggtgtaccccggcttttcctgggacggggattaatacactagcgttcgggaaaaggcaattctcccggtcgcgacagtgaccaaactccatcggctgcagagagccatcatattgaagaagaagaacaaccagctgctcctgctataccagtaagtttccctttgacacaagaatttagatcggctatatctatttagctctaactccctttaaataattactgtaggtcttagccgatcttttctctttcgacattagagattatcttgatgagacagaaggggataccacaagcaaagctttagcccca

SEQ ID NO: 59919 - DNA, 987 bp, Oryza sativa
cgaaggaggctaatactgataattcaaattgccccctggtaattctggaagttcgactgaatattgcgcatcagatgttcgagaacaacttgaggtatcatcgtttgatctggctgcacataatgaactaaatgcactgggacaacttgattcacagcatgctgccctaggtgattgttaggtgttgcaaatccagtcgatgcattcatcaaaccttgttgttgaataggctgaataacctgttgccttaatggcgtttgctgaatcggctgcaaaacctattgtcttggtggcgtctgctgaattggctgcacaacctgttggattgggggtgtttgttgaaccagctgcacaacctgcagccttggcggtgtttgctgaatcggctgctgctggactgggtcaacggtaggttgaggtggtaaaaacatagctgcaacctgatcttacgttagccgattcacattctgcccactatgctgtggttgttctctcaccaacaaccaaggattgattaattgacctggagccgacgaaggtgcagcgggtgcaggagccgatactggtgccgtcggctgagtcgatggtgcgttaggaggaactgattgaacggcttgttgattatcagtgattaagggccgataatttgggaaagtacctccttgaagataaactggtcccgtagtctgatattcagctattgaaccatcaaccattgacttcaccatgtttgacaaagtattgactaatatcccaaattgattgatcaaaacatgatgtatggcatagtcgtcctgatcctggaagttgttaaactgtagctgtgccgcgttaccatcttggttaagattaccaccttgaaatccctgagaaccatcaccttgaactccttaagagccaatgccctgaactccttgagagccatcaccttggtctccttgaaaaccatctggcagcacctttattcactcggttgagctgagccat

SEQ ID NO: 59920 - DNA, 1033 bp, Oryza sativa
atggccaagttatggccatttgaagtttatatgctctttgaatgaaaatttgcgaatttcttcatttggattttattttaaaaagggtttattgcgtcagccgagggagaggggcgcgcggaccgggtccacgggagtggggcccacacgcagcctcacggtccacggtggaccgggtgcacccgggctcacaccggccggcgccgtgggccccacacgtcagccgcacccgagggcgcgggcggctgacggccgggccccacgcggcagccactcggcatgctcgagggctgccatgccggtgcggtcggcgggaggcggcgcgcccatgccccgatggtcgccgccggtgaccaccggcgcggcggagcggcggccgagagagggaagggaagggggaaaggaggcgacggtccacggctcaccccggggcaatggcggcgacgggggaggcggctggagcggagggaggcggtggcgcggctcgggtcgacggggacgacggcgctccggcgggaggcgaccgaaacggagaggtggacgaggtcggcgaggatgcggcgaagccgaaggaggcggtgccaaggtgggaggcggtccggggcgacgacggtggcggaccggagctcggcggcgacggcggagcagagagcgacgtcgcgagctcgaatccggcgaggaggaagggcggcgagaggcggaaacggacggaggaggtgcggggagggtttaaataaggttggaagggggagagagcggccggaggggagggaaaccggcgcgggaggtacggccgcgattaatggcgccggcgagatttgccggggcaaatccgcccgtttgaatgcgagagagagagggaaaaaaggggggaaagggagaggggatcacggggagtatttccccccactttattgcacgcggggacggcgggatgcggcggatttggcagcggcggcggcgcttggagcgggcggagcggcgggagcgacgggaggacggggatgacgggtgggccccacccgtcagcgag

SEQ ID NO: 59921 - DNA, 5402 bp, Oryza sativa
  unsure (1)..(5402): unsure at all n locations
catataagcagcagcatcgacaacaccagggggcatcgaaagatcatttggacttggcagagcagaacctcccggcggcggaggcgacttgggtggccggtgggcaccctcgtcgatctctctcccctacctctcctccgatctccagccttccctctcccctcggttctagaagtttccagcacttgtattccatagcttcttcttctcttgtccccaaaacagttgttgcttctatggtggatgcttgttgttgagttggaagtagtgggttcctaacaatgtataacagagaatgtttctttagaacactcacttctatatatgtatagatcttttaaaatttccaattatgatatttccaaagagaatgaccatatatgcaatgtaatagaaaaaaaaaatgtttctgcagcctaccaagtaatgcaaatagacatggcgagcttgtgcactgtggagaagtgcagccctgtatgtccacgtcatcaccctaactggtgctggcgagcactgccttggcctggccctcatgtctgcgccactgtgggtgccagtgcaccagcgattgccaccatggagaagtgcttctccaacggctttggcctgcctgggcgcgcatgcgccagccgagctgcacgcctctataggcggtgcccctcgggacctcgttgccgacctcgtcgctctcctgatgccaaccgttgccgccgtcaccggccacacgttcgcaatcgcgcatgacgcggtggacatgagcgccatgttggtatttcttagtaacactactggaaatataattcccagcaatagcattagaaataatcctggtatattatggttacaaatatgatccgcaaacgcacggatataccattgtagcatttcacccgggagtattcgaaggtatcgtatttattttatcccaaggaaatatatgataagagagtactatgctaatagtttatgtattacatgtatacatcaaggtctatgcaggggtaagttaaggataagggtagagtgacacagctaaggattccgctaacccctccttatcttcaatatgactaagtggaaatagaatagaaatgtctcactcttgtacttcaagtatacaacatcctagtctattctaactagtataatctatgtagtataactgttgacgtaaaacactatgcctgggagatctgcttaactccagtgcaggtccaaaactcgccttcggatatgctagcgtgccagttgatttgatcctgcaatcaacaagaaacagagacaaagaaaccgtggttaaatccataaacgatagccgatcggctaggtgccgatgacatatcatctatctttgagtcgatgtcatttatgcatcgatcggcgagcgttaataagtaggaaagaactaaatctactcgatcggctgtagatattaacaatatataatccttatatcgatatatacttaaatcaagtgattgggatatatcggttgccatgccgagacagtataaatcacttagatcgaaatatatattaacaataagactatatacgttcatagcatagccgatcaaatagatctagcatgtatcggctaatactccgataccactctatattaagatatgaaagcaagtagcatatactaaacaaaagcataatatacttaaaagcaacaagatcttaacataaaggcagatttaacatatcaatcaagcatatagaatagatgtagttaaaccaggtaagatcggctgaaaccccgatactaccctaatcggcaaccaatgagcaggctagagatagagattctaatcacgactcataagatcaaactcaactgatgcagctataagtatgaaaagaaagacaatatctagacaatctttttgaagcaaatgacagcaggagatctgttggatatattagaaggattagaaatcagttatagaggggagtaagagacagtccaactacagcagttgctatttcaaagatttacaggaaaggtgatcaacaacttgagaagtgcaaaccctcagttttgggggtagtacttaagaagatctatattttcttttactaagaaagctacttgggtggcagttaatagttgttgatggaaaattcttcgattgcgttctagccacacctgccaccaagttatgaggagcgcccctatcattttctttcttctccctctatgccctgaattcgctaatatttcccaccagtcagagatgtgttgatattgtgactgatttggaacctgtgtaaggcctaaccaactgcagatctggttccaaactgaatttgtgaagctgcactcttttgctaaatgatttgtgtcttcaaaagcatcagtgcaaagactgcaaatccagtcacatggccaatgccgaattagaagattatctgatgtgagaattttctggtgtaagattagccagccaagaaaacgctgctttggctctgcttcagctatccaaaggggttggaaatttgtgctgataatggtaccttggaactgtgcttcataggcgctttttgctgtataaattccattctgagtccatttccagatgatgctgtccgaggttttggcttgcagattgatctcttgcaatagactgccgaggtgaaccaattcattgatttcgcttattgtggtgattggtctttagcgaaataatccagtgattaccctccatctcaaaatgtatacaattagcttttctttttgctaatctgaaaattgccggcgctatgtctttgggtgcacatcctgataaccaattatcttgccaaaaacaacacttctttccatttcccagggagatttttgtgcttgccctaaataattttttgtcgatctcatcacatggggtttccatgttaaaccagggcttactttcatctttccattcaaaccaaagccagcgtaatctcaaggccattgcgaatttttccaaattcagaattcctagacctcccaaagatttgggtctacaaactgcattccagtttacaaggcaactgcccccatttactttttcaggatcatccccttccagagaaaagctcttctaaggcggtcaattcttttgtaaagccatttattttgatgaagaactgtttaatggaatattggtgtcgaggacaaagtgttttttaccagaatttctcttcctgcagaactgaagaagcgccctttccatccagggattcttgaacccactttatctaccagcggttgaagatcaattttgcgcagctttcttgtgtgaataggaatgcccaagtacttgcaggggaaggttgaaacctttccaggaaagatggagagacaatcttccaaatcaacttcattgcagcttatgggatagatttcagttttgtccatatttgtgtgtaaatcactaacatctgcaaaggcagagagaattcgacgaaggactaacatttcttctcgctttggcttcaagaaaagagcaacatcatctgcatagagggaacatctgaaacgtctttgtctttgtagggtggagaggaagccatgagcttctgctttctcaaataatttgtataaaggttccattgcgagaataaaaagcataggggagagcggatctccctgtcggagccctcttgcatgatcaatttctgattctggggtggcatttaaaaggaccatcgaagaggaggtgccgaacagattggagatccaattacaccacttttggctgaaaccaaaattttgtagaacttcaagcaggtatgcccaattaacagtgtcaaaggccttagaaatgtcaacttttaggaaaagagtaggcttttttgctctatgaaaagatttgatcatgttttgaacgaataggatattgtcatggattgctcttttcctaataaaagcactctgactttgggagacaagatatcctaatttcggtgcaagtctgtttgcaaggagtttggcaatgatctttgcagagctgtgcattaagcttataggtcggaaatcttcagctttggaagcatcagtctttttaggaatgaggcatatgtgcgcacagttcaaatcatgaagtctgtagtaacccatgtctccaaagaaagaaacagcttgcatgagatccgttttgataatgctccaggcctgcttgaaaaaagccccaatataaccttctggtccaggggccttttctgagggtaagtctgagatagcctccttaagttcttcttcaaagaattcttcatcaaggtcggagagatctactgtcggcaggtccagagatgaccagttcagacttttctccctaataacaaaggaacctagcttttgagtgaagtatctgttgagtttttcttctttttggctttttgtaactgcgacactactaggggtgtgaaggagaagaatgtgattctttctttttcgcccatttgctttaatctggaagaattttgaattgacatcaccaagctttaaccaagtgattctagctctctgtctcagacgagttctctcaatggctgcaagtcccagaattctggatttaagagatttccgaagggactgttctgcatctgacaaagttctttcctcttgggctacatcaagctgataaactacctcgttggcaatgatcaactgcaatcttatgtctccaatttttgtagctttccatcttctcaaatctctagcaagtctttttagttttagatgaagtcttacaaaaggattggaggtctgtataggcctattccatgaatcttcagttatttgaaggaaatccgggaatttgagccaatacgactcaaacctgaaggaattgttttgctctctttctacacagccggttatgaaaaggggggcatgatctgagcaagaggtggagagagcagacatttgggcagagtcaaaaaggatatccgattccaggcaacagaaggctcgatcaattttcgtttgcgttgggttagaacactcctgcgaccaagtcaatttctttcctgagaggggcagctcttttattcccaacctgtccagggtcgatttgaaacgctgcatcatacctctgttgagcctgttgttgttcttgtctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 59922 - DNA, 811 bp, Oryza sativa
atatatatatatatatatatatatatatatatatatatatatatatatatatatatatatatatatatatatggagagagagagagagaatcacgtgaacagtgccatgcattcgcatgcgcgaccattcgagaagggcgcagctgcgcgccaggctgtggaggcggcggggccgcacgcacaccgagcggaaggagccggctggcgcgatcggcggaagcaagcggggccgtgcgggggcggcaaaccgcggtcgccgcagaggtggtgacgaagccgcatacggcaggcggaaccactcgcggctgcacgtggccggcggatcctcgcctgtccgcggtggtggcgaggcgcatggggcctcggaggcggagctgcgaagccgcatgcggctacatgctgcggcgtggatcgcacgagggtggggaaacacttttaatcacctaggtggacatccacctatttgttgcttgtcaactaaatgggtataaaaaaaatttaaaaaatttgacaagatagattcatatacaatatatcaccccacaaacatgcaaatttaaattcaacttctacaagttgtaacaaaaataacaaatcaaaagtttgatttgttactttttttacaacttataaaagttgaattttaagttacatgtttatgtagtgatatattatatattaatctatcttgtaatttttttaaaaaaaaattcatgatcatttagttaacatacactaaatgagtggacatccactcgagtgattagaatctacgtcccacgagggtggtcatgccgcggacccatatgta

SEQ ID NO: 59923 - DNA, 962 bp, Oryza sativa
ctccacaccatcagcttcactgtagaactcttcctctaatgaatgattgcaaggtgagtatatgacatactcagcaagtcacgcagcaaatatgcaagtgcacaggataacaaaggatggcataatagggtttcatttgcataaacaacatttaataaacatttcagaatttaattaaacagttgagtaataattaaacaatatcaatctaacgctatacaacataccctgttgtataggcccaacctttctgaacaaccatacccggctgtacagatctatctccaaaccaggaatataccattccaaaccaggagctaaacaaattattaccagttatagcatctgttatcatgatgagaggtgtgagactaatcacgaaagacattgttagaccagcccataaccgcgggcacggctattcgaatagttttactctggccagaggtgtaccactgtacccacaagacacagccccacaacatgtcactatgtgcctcaataccaccacggtacctcggaaaggagctgtgacaatacccctcgcacaacacaatccaccacagggcacctttcctggatcataatcacccccttataaacaaggcatggactcccagcgacccccgtgggcttatctccgccacttctcagtctggtgctccgcaatgaaccatgctatacaaaaggtaaagccgttgcccacgctggcttgtggttggcacggttaatgtttcacaaccgaaactcgtgaaccggtccttaattgtcatgagcacgactctcaaaaccatgtgctcacaacccaccattatcaagttttagttggcaagtaattaattaaccaatcacgattgaccatcgtgagctatcattaagccatcattaaataatagtgaatcataagttatcccaatcgctgcactgcacgggtctagcttttttccccacggcatgcaacc

SEQ ID NO: 59924 - DNA, 790 bp, Oryza sativa
ccatgaatagagtatccactagttggggttttgttattctagggtgaacaaagtaataataataacaatagcaataataataaggtcataacaaaggtaaataggcatggctgaataaaacagtgataacgcgggaatttaaataaagcgataatgcaataatttaaatcaaaataattttataaagtgggattcaatatgttcaaggatgatatgacttgacttcttaaggaaaaattagagacttgaacggtccaattctgagttcaaatggccaagttatggccatttgaagtttatatgctctttaaatgaatatttgcgaatttcttcatttaaattttaatttaaaaagggtttattgcgtcagccgagggggaggggcgcgcggaccgggtccacgggagtgggtcccacgcggcagcctcacggtccacggtggaccaggtgcacccgggctcacaccggccggcgccgtgggccccacatgtcagtcgcacccgagggcgcgggtggctgacggccgggccccacgcggcagccacttggcatgcccgagggcggccatgctggcgcggtcggcgggaggcggcgcgcccacgccccgatggtcgccgccggcgaccaccggcgcggcggagcggcggccgagagagggaagggaagggggaaaggaggcgacggtccacggctcaccccggggcgacggcggcgacgggggaggcggccggagcggagggaggcggtggcgcggctcgggtcgacggggacgacggcgctctggcggtcg

SEQ ID NO: 59925 - DNA, 1867 bp, Oryza sativa
cttcagcttctctcaggatatcagtcccgaacacttggctttccctgacttggtcccacaatagtggtgttcggcatttgcggccatacaacgcttcataaggtgccatttgtatgctggcttggtagctgttattgtaggagaactcggcaatggggagactcttatcccaggtcttccctaaatctagaacacaggcacggagcatatcttctaggatctgatttagacgctcggtctgtccatcggtttgcgggtgatacgcggtgctgaaatttaatcgggtacccaactcttcttggagcttcgtccagaaatgagaggtgaactggcttcccctatcagatacaattttcttaggaacgccatggagactcacgatcctagcgaagtagagttcggctagtttgttcccttcataggtggtcttcacaggaataaatcgagctaccttggttagtcgatccatgactacccatatagaatcatacccgccttgggtttttggaagtccggtgatgaaatccatcctaatttcatcccatttccattctggtacttgtagaggttggagaagtccggccggtcgttggtgctctgccttaacacgctggcacacatcacaaagggccacgaactctgcaatttcccgcttcatactaacccaccagtatttctctttcaagtctaagtacatcttcgtactgccagggtggatggaataaggactttcgtgagcttcctaaagtattagctgtttaagttccttgtcgtccagaacgcatacacgatttccgttccatagggttccatgttcatcttctgtgaaaccagcggctttaccctgtttcatattcttgaggatcccatgcatatctggatcattcttctgagcatcgcggatttgatcgagcaaggtaggcttggcttccagaatagccaagaatccatggctaacgatgcttaggtttagggcttccatctgttgattaagttccggtggaatgccacggacgccaagagtgttgcaacggctttttcgactcagcgcgtctgtgaccacgttggccttaccagggtgatagtggattgccacatcataatgcttgatgagctctaaccatcttctctgccgaagattcagatccgactgagtgaagatgtatttcaaactcttatgatcagtatatatttcatagtgatttccaatgagatagtgccgccagatctttagagcatgaaccacagtggctaactccaaatcatgggtagggtagttgccttcatagggccgtagctggcgtgaggcataggctaccacatgaccttcctgcatgagcacgcaccccaatccttggcgcgaagcgtcacagtacaccaggaagtccttgcgagtgtccggtaagattaacactggcgaggaaaccagcttttctttgagagtttggaatgccttctcgcattgcaggctccacacaaatttttcctccttcttcagcaactgtgtcatgggtcgagctattttggagaagttctcgatgaatcttcggtagtatcctgccaaacccaaaaaattgcggacttgagtgactgtcttgggttgcttccagtcagtgaaggcggtcactatttcggggtccacaacaactcctttagcggatatcatgtgccctaagaatttgacttcggacaaccagaactcacacttgataagcttggcatacaattgatgttcccgcaactttcccaacaccagacagagatgctgctgatggtcttcctctgattgtgagtacaccaggatgtcgtcaataaagaccacaacaaacttatccaaagtattccatgaacactttgttcattaagt

SEQ ID NO: 59926 - DNA, 1882 bp, Oryza sativa
cccttttctttcaactcttccaactgtttcttgacttcggccagttcatttgttgccatacggtagggtcgcttgtacagaggagtggttcctggagcaagatctatccggaactcaatctctcgcttgggcggcataccgggtagttcttccggaaacacatctccgaactctctaacgatgggggtttccgacagtcctatctgatgaagttctgagctgccgacagaggttgagggtgcaaagaaaacaaccggttgttccggtcctcggtacagagtgacagtgcgtcttacgcaatccactactccttggaattgagccaaccaattcatcccgaggatcacatccaagttcttggtgtctagaagaatcagatccgagggaaaaggaattccctggatttctataggaacggcagggctataatactttgctgtcataacccctccaggggtggtgatgagcagagggttcctaagcctttctacccccaactgatttctccccacgaatggcacagatataaacgagtgggaagctccagagtcgaacaaaatggtagcaggaatagaatgaatgaggaacgtactcacgatgacgtccggagtcgtcagcacatcctcggcagtcacgtggttcacacgacccggaatgacatccttaccaccgttgttggggcggggaggcgcttggccttgctggcgcctcggctttgggcatttatccgcaaagtgcccgggctcaaagcaattgaagcacagacgttgttgtccttgagcatccctgcggccttgtccaggctgcacggctggtgcaggaggacggggcgcacgagtcccttgctgactctgctgttgctgcggctgtgagacgcgcaccacgaattgaggtcggggcgcggagcgaggttgctgctgctgctgctgcgaggaggatccccctgggtagggattagtgtagcggaccctttggttagccccctgttgattgcggaaattcgccaagcgacgcttgtgcgactccagttccttgtgcttggcttccaagcggatgctcttgtccaccaaacgctggaaatccggataatccccggagaccagacgcacggacagctcagggtccattcctgccaagaacttctcctgcttctcctcatcttcatgaacatcttctggggcgtaccgggccaggttgttaaactcatgcaaatactccatcacagagcggttgccttgcttcaactctcggaatttccttttcttaagggccatgactccggcgggcacatgggtcctccggaaagctgcggtgaagcgggcccaggtaataggctgcccctctagctgtgtagcctggaagtggtcccaccatagagatgcgggcccctgcagttgatgggcggcgaagatgactttctcctcatcgttgcactgcacggtatccaactttttccccacggcatgcaaccaatccaaggcatccacggggttattggagctagagaaggtaggcggacggatgcggaggaactcggcaagtttagaatgttgcgggggtggtggtggaggtggagcattatgctgtggcggaatttggatgtgatggataaaagcagccatcatgttggcctgctgggcgaggatttgggtgaggatggagttggtgtctggtggtggtggtggaggcgggggaggaggtggaggtgggctgtcatggttgttgtggttgctgccttcggggtgactgccttcaccggtagcagcacttctcctggttgtcaccatctgaaaatcccacacagaaccggcaaacagagagagctggttattaaaactaaccactcatgactaccataattcttgaatttattactgctatt

SEQ ID NO: 59927 - DNA, 3426 bp, Oryza sativa
ctggatcataatcaccccctaatagacaaggcatggactcccagcgacccccgtgggcttatctccgccacttctcagtctggtgctccgcaatgaaccatgctatacaaaaggtaaagccgttgcccacgctggcttgtggttggcacggttaatgtttcacaaccgaaactcgtgaaccggtccttaattgtcatgagcacgactctcaaaaccatgtgctcacaacccaccattatcaagttttagttggcaagtaattaattaaccaatcacgattgaccatcgtgagctatcattaagccatcattaaataatagtgaatcataagttatcccaatcgctgcactgcacggtgtctagctttttccccacggcatgcaaccaatccaacgcatccacggggttgttggagctagagaaggtaggtggacggatgcggaggaactcggcgagtttagagtgttgtgggggtggtggtggagcattctgttgtggcggattttggaggtggtggaggaaagcagtcatcatgtaggcctgctgggcgaggatttgggtgagaatggcgttggtgtctggtggtggtggtggaggcggaggaggaggtggaggtgggctgccatggttgttgtggttgctgccctcaggttggttgccatcaccggtattagcacttctcctggtcgtcaccatctaaaaaccccacacagaaccagcaaacagagagagctgacaattaaagctaaccatccacgactaccataattcttgaatttattactgctattaaattggttaattaaagttcaaattgcttaagcaaataaaataaagacaggctccgacacagttatgccacacaccggcataaccatgccccacacgactccaacaagaagacaaacgagaaagaacacacgcgcaagcctactaactgctcgtctaccgctgcgacgggccaggacggaaggtgagcaacagcgcatcctccgtgctaccaacgccggaggcttccccctcctgaggaaccacgggcgcgggctcggcacgaggggtctgaacgaagcaagtccacgccagggactgacgaacaagctcgggcctggaggtgctcttgcgggcggtgatcttctggctgcggcagacgcggcgacgcttggggcgacagacctctccctgggcgatcttgagctgatgcagctgcgcctccactgcgtctaggtccttcttcagctgcagattctcctgacgcggctccaggatcttcatgttgttctcgaccatcccacggcgcaccatctgatggaagtcgatacaagtcgcgtcgtacgcctccaccatgcgcgccaggtgcatgatggtagcgtcatcctccgagctagcatcccggaaggtggcgaagtcgcgggctcctccgtggcgagggtggtagcggtagggcgagtgctgcaactcgtccgggtagcgctggtgaagagtgccgatggcgaggagagcggcgttctggcaagcggcggagaaagaatctccacccgcggtgactgccaacgaagtcctctcgggtgagctagtgaggatcactgcagtaacctcccaagcagcgtggggctctgcatcgtcaccctcctgctccgggagcggcctgccctggtagtccactctatgcggataccccaggacaactcacatgccccacagctccaagacgaaaccagtcaggtccagaccacgacggctgatgctgccggccatctacaaacaaaaacaaaaagaaaagcaacatttaaaagtcagattttggcgataaatgaagcagcaggacagagagagactagagggttttcacaattaagacaggatttttatttttgaaaatattgctaaggcttgggatctaaggctcgtcctagggtcaagggggctctgataccaacttgtcacgaccggaaataacccaacgggcgttccttacgtgcgtgtattattccttgtcccaggaggcaaggtacaccaaaagttgatacaattcagagtttaacaagcggaagcgtaaatagataatttattacatgggcagcgaaggcccggcacacacaaagacaaacgagaaacagcggaagactagggcgacgaccacaggcgcttgacggcaggcacgagctagacaccaaagccttcatcttccagggactcctcttctgggtttgggaaaaattgagcaagactgagtacaaccaccgtactcaacaagacacacccacaagtgcagaataaatgcaagggagtacaagggagttataatataaagggttagggtttgcagtaaacagcgttaaaagacacttagttgctcaaagctattttgtaatcacgattctagaattatacaatattatttatcaaggccgtgaacccacacgaacctgccttaacccaaggcctacgatgattcagaccgaaccggcaacccgaccctgggtcccagctcgtcccaagccaacccaggccaaccattcctccttttagttgttaagcaggttttaagaattaaaacactaacttgggtacattgctcggcttgcccataaccgagggcgcggctgttcgaatagattttactctgatcagaggtgtacatctttacccacaagacacaatcttcctcacgtgcaaccacgtgccacataccaccacggtatacagacggaagacgtgacatagtttccaacccatcctagccatagccaagagtaccgacccaatcccacctacggccggaacccccgggacaggcaggcaggactgagcccctagcagcaggacaccggccctgtgccatgacatctcgactaccaggccgcagctcgtgtagccttcatttgccctggagatgtccatcgacccccgacttcgtccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttggggattttgaatagagggggcggtgtgaatccaatttcacaataatccaacaattccaaagtgtccaggtgatatgaatatcccaaagtctagagttgtaaaaccacctaatgttaactaattaaatagcgaagcatctacctaaaatcatactagtggtaccatgagtagagtgtccactagtggggttttgtttattctagggtgaacaaggaaataataacaataacaataataaggtcataacaaaggtaaataggcatggctagataaaacagtgataacgcgggaatttaaataaagcgataatgcaataatttaaagcaacataa

SEQ ID NO: 59928 - DNA, 10132 bp, Oryza sativa
accgctgcttcgcttccctcttctctcctctctctcggccgccgctccgccgtgcctatggccgccgccggcgaccataggggcgcgggcgcgccgcctcccgtcggccgtgccggcaaggccgccttcgggcgcgccccgcggttgccaggtggggcccggccgtcagccgcccgcgcccgcgggtgcggctgacgcgtgggacccacggcgccggccggcgtcagccgcgtgcgcccggtccaccgtgtaccgtgaggctgacgcgtggcccccactcccgtggacccggtccgcgtgccctctccctcggctgacgcaataaatccgatttttaattaaaatttaaatgaagaaattcgcaaatatccatttaaagagcatataaacttcaaatggccataacttggccatttgaactcggaattggaccgttcaagtctctaatttttccttaagaagtcaagaacccatttttgtgctttgtttctgctgttatatggagtttattagagtaaaagccttttcttttccattggtcgtgtagacgctgcagcttcggaagatccgctcttcgtggaagttgaagccgacgtttgggaaagcgagcaaggcaagtcacatcatctttgagcatattgaatcccagtttataaaattatgttgatttaaattattgcattatcgctttatttaaattcccgcgttatcactgttttatttagccatgcctatttacctttgttatgaccttattattattgttattgttattattattaccttgtgcaccctagaataaacaaaacctcaactagtggacactctactcatggcaccactagtttaattttaggtagatgcttcgcaatttaattaggtaacattaggtggtttttcaactatagactttgggaaatattcatatcacctggatactatggaatggtttggttattgtggaattggcttcacaccgctccttctattcaaaatccccaaaatggttttaggctgggcgcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggaggtggatgaagtcgggggtcgatggacattctccagggcaaatgaaggctacacgagctgcggcccggtagtcgagatgtcatggcacagggccggtgtcctgctgctaggggctcagtcctgcctgcctgtcccgggggttccggccgtaggcgggattgggtcggtactcttgtctatggctaggatgggttggaaactatgtcacgtcttccgtctgtataccgtggtggtatgtggcacgtggttgcacgtgaggaagatgtgtcttgtgggtaaagatgtacacctctgatcagagtataatctattcgaatagccgcgccctcggttatgggcaagccgagcaatgtacccaagttagtgtttcaattcttaaaacctgcttaacaactaaaaggtggaatggttggcctgggttggcttgggacgagctgggacccagggtcgggttgccagttcggtcttaatcatcataggccttgggttaaggcaggttcgtgtgggttcacggccttgataaataatattgtatagttctaggatcgcgtttacaaaatagctttgagcaactaaatgtctttaaatgctgtttactgcaaccctaaccctttatggtataattcccttgtactcccttgcatttattctgcatttgtgggtgtgtcttgttgagtacggtggttgtactcagtcttgctcaatttttcccaagcccagaagaggagctccttgaagatgaaggctttggtgtctagctcgtgcctgccgtcaagcgcctgtggtcgtcgccctagtcttccgctgtttatcgtttgtctctgtgtgtgctgggccttcgctgcccatgtaataagttaactatttacgcttccgcttgttaaactctgaattgtatcaacttttggtgtaccttgcctcctgggacaaggattaatgcacgcacgtcaggaacgcccgttgggttatttccggtcgttacaagttggtatcagagccacccttgaccctaggacgagccgtagatcccaagccttagcaatattttcaaaaataaaaatcttttgttatttgtgaaaactgtctagtctctctctgtcttgctgcttcatttatcgccaaaatctgacctttaaaatgttgtttttctttttgtttttgtttgtagatggccggcagcgtcacccgtcgtggtttggacatgactggcttcgtcttggagctgcggggcatatgcgtggtcttggggtacccacatggagtggactaccaggccaggccgcttccggagcaggagggtgacgacgcggagccccacgctggttgggaggtcactgcagtgatcctctctggctatcccgagcggacttcgctggcagtcaccgcgggtggggattccttccccgccgcttgccagaacgacgctctcctcgccatcgtcactcttcaccagcgctacccggacgagttgcagcactcgccctaccgctaccaccctcgtcgcggaggagcccgcgactacgccaccttccgagatgctagctcggaggatgacgctaccatcgtgcacctggcgcgcatggtggaggcgtacgacgcggctcgtatcgacttccatcagatggtgcatcgcgggatggtcgagaacaacatgaagatcctggagctgcgtcaggagaacctgcagctcaagaaggacctagacgtggtggaggcgcagctgcatcagctcaagatcgcccagggagaggtctgccgccccaagcgtcgccgcgtctgccgcagccagaagatcaccgcccgcaagagcacctccaggcccgagcttgttcgtcagtccctggcgtggacttgcttcgtcgagacccctcgtgccgagcccgcgcccgtggttccccagaagggggaagcctccggcgttggtagcacggaggatgcgctgttgctcaccttccgtcctggcccgtcgcagcggtagacgagcagttagtaggcttgcgcgtgtgttctttctcgtttgtcttcttgttgagtcgtgtggggcatggttatgccggtgtgtggtataactgtgtcggagcctgtcttattttatttgcctaagcaacttgaactttaatgaacccatttaatagcagtaataaattcaagaattatagtagtcgtgggtggttagttttaattgttagctctttctctgcttgctggttctgtgtggggggttttcagatggtgacgaccaggagaaatgctgctaccggtgatggcaaccaacctgaaggcagcaaccacaaccaccagggcaacccacctccacctcctcctccacctccaccaccaccaccagataccaatgccattctcacccaaatcctcgcccagcaggccaacatgatgactgctttcctccaccacctccaaaatccaccacaacataatgctccaccaccacccccacaacactctaaactcgccgagttcctccgcatccgtccacccaccttctctagctccaacaaccccgtggatgcgttggattggttgcatgccgtggggaaaaagctagacacggtgcagtgcagcgatgaggagaaagtcatcttcgccgcccaccagctgcaggggcccgcatctctatggtgggaccatttccaggctacgcagccagaggggcaacctattacttgggcccgcttcaccgccgctttccggagaacccatgtgcccgccggagtcatggcccttaagaaaagggaattccgagagttgaagcaaggcaaccgcttcgtgatggagtatttgcatgagttcaacaatctggcccgttacgccccggaggatgtgcgggaagatgaggagaagcaagagaagttcttggcaggaatggaccccgagctgtccgtccgtctagtctctggggactatccggatttccaacgtctggtggacaagagcatccgcttggaagccaagcacaaggaactggagtcgcacaagcgccgcttggcgaatttccgcaatcaacagggtgctaaccaaagggtccgctacaccaatccctatcccgggggatcctcttcgcagcagcaacaacagcagcagcaaccccgctctgcgccccgacctcaattcgtggtgcgcgtcccacagccgcagcagcagcagaatcagcaagggactcgtgcgccccgtcctcctacgccaacggtgcagcctggtcaaggccgcagggacgctcaaggtcagcagcgtctgtgcttcaactgcttcgagcccgggcactttgtggataaatgcccgaagccaaggcgccagcaaggccaagcgcctccccgctccaacaacggtgggaaggatgtcattcggggtcgtgtgaatcacgtgacggccaaggacgtgctgacaactccagacgtcatcgttggtacgttcctcgttcattccatccctgctaccattttgttcgactctggagcttcccactcgtttatatctgtgccattcgtggggagaaatcagttgggggtagaaaggcttaggaaccctctgctcatcaccacccctggaggggttatgacagcaaagtattatagccctgccgtccctatagaaattcaggggattccttttccctcggatctgattctgctagacaccaagaatttggatgtgattcttgggatgaattggttggctcaattccaaggagtagtggattgcgcgagacgcaccgtcactctgtaccgagggccggaacaaccggttgttttctttgcacccccaacctctgtcagtagttcagaactgcattagataggactgtcagaaatccccatcgtcagggagttcggagatgtgtttccggaagaactacccggtatgccgcccaagcgagagattgagttccggatagatcttgctccaggaaccactcctctgcacaagcgaccctaccgtatggcagcaaatgaactggccgaagtaaagaaacagttggaagagttgaaagaaaaggggtacatacgtccgagtacttccccctggggtgctcctgtgatttttgtggagaagaaagacaagacgaagaggatgtgcgttgactacagagctctcaatgaagtcaccatcaaaaacaagtaccctcttccccggatcgatgatctgttcgatcagcttaaaggtgccactgtattctccaagattgatcttcgttccggatatcaccaattacgtattcgcgaagaagatattccgaagaccgcattcaccacgcgatacgggctgtatgaattcacggtgatgtcattcggtctaaccaatgcacctgccttcttcatgaacttaatgaacaaagtgttcatggaatacttggataagtttgttgtggttttcattgatgacattctgatatactcacaatcagaggaagaccatcagcaccatctccgtctggtgttgggaaagttgcgggaacatcaattgtatgccaagcttagcaagtgtgagttctggttgtccgaagttaaattcttaggacacgtgatatctgctaaaggagttgctgtggaccccgaaacagtgaccgccgtcaccgattggaagcaacccaagacagttactcaagtccgcagtttcttaggtttggcaggatactaccggagattcatcgagaacttctccaaaatcgctcgacccatgacacagttgttgaagaaagaagagaaatttgtgtggagcccgcaaggcgagaaggcgtttcaaactctcaaggaaaagctggtttcctcgccggtgttaatcttgctggatactcgcaaggatttcatagtgtattgtgacgcttcgcgccaaggattagggtgcgtgctcatgcaggacggtcacgtggtagcctatgcctcacgtcagctatggcctcatgaaggcaactaccctacccatgacttggagttagccgcggtggttcatgctctaaaaatctggcggcactatctcattgggaatcgctgtgaaatatataccgatcataagagtttgaaatacatcttcacccagtcggatctgaatcttcggcaaaggagatggttagaactcatcaaggattatgatgtgggaattcactatcatcctggtaaggccaacgtggttgccgacgctctaagtcgaaagagccattgcaacactcttaacgtccgtggcattccacccgaacttaatcaacagatggaagccctgaacctaagcatagttggtcgtggattcttagctgcgttagaagccaagcctaccttgctcgatcaaatccgcgaggctcagaagaatgatccggacatgcatggactcctcaagaatatgaaacagggtaaagccgctggtttcacagaggatgaacacggaaccctatgaaacggaaagcgggtatgcgttccagataacagagaacttaaacagctgatacttcaggaagctcatgaaagtccttattccatccaccctggcagtacgaagatgtacttagacttgaaggagaaatactggtgggttagcatgaagcgggaaattgcagagtttgtggccctatgtgatgtgtgccagcgtgtcaaggcagagcaccaacgaccggccggacttctccaacctctccaagtaccagaatggaaatgggatgaaattgggatggatttcatcaccggacttccaaaaacccaaggtggatatgattctatatgggtagttgtggatcgattaaccaaggtagctcgatttattcctgtgaagaccacctatggagggaacaagctagccgagctctacttcgctaggatcgtgagtctccatggcgttcccaagaaaatcgtatctgataggggaagccaattcacctctcacttttggaagaagctccaagaagagctgggtacccgattaaatttcagcaccgcctatcacccgcagacagatggacagaccgagcgtctaaatcagatcctagaagatatgctccgcgcatgtgtcctagattttgggaagacctgggataagagtctcccctatgccgagttctcctacaataacagttaacaagccagcatacaaatggcaccttatgaagcgttgtacgggcgcaaatgccggacaccgctcttgtgggaccaagttggagaaagccaagtgttcgggactgatatcctgagagaagctgaagctaaagtcagaatcattcgggataatctaaaggtggcacagtcccggcagaaaagttatgcagataaccgtcgccgtgacctggaattcgcagtgggtgattttgtataccttcgggtcacgccattgcgaggtgtgcacaggtttcagacaaaagggaagctcgcacctcggtatgtgggtcctttccgtatcaatgctcggcgcggagaagtcgcttaccagctggagctgcccgcctccttgggcaacatgcatgatgtgtttcatgtgtcgcaacacaagaaatgccttcgagtgccatccgagcaggccgactcagagcaaattgaagttcgcgaagatttgacctacgtggagaggccagtgaaaatcctggacaccatggagcgcaggaccaggaaccgggtaattcgtttttgcaaggtccagtggagcaaccacgccgaagaagaagctacttgggagcgtgaagacgagctgaaggcagcccatcccgatctcttcgccagttcttccgaatctcggggtcgagattccgtttaaggggggtaggtttgtcgcgtcccaaaacgactctaaaatacatcctcgaaattgtgcaaagaataattaaaattcatgtgaaagcctccaacaattaaaatgtgcaaatataaaagtcaaataaggcttggaggatttttgtatatttcctaaaagcctaaaatgcgtaaataaattttagtggaattttcagagcacaaataataattgagaagaaataaacaaagttaaaaaggtttataaaaagaaaaaccctaaaagaagtcttctttcccccccttcccttcttgggccggctcggcccaacttcctccctccctctcctctcccccgcggcccatcggccttcccccgcgcgcgcgccgctgatgggcgggcccgcccgccaccctcgctgacgggtggggcccacctgtcatcccctacctcgcgccgcgcccgccgcccgcccgtgccctagcgccgccgccgccgccgaatccgccgcatcccgccgtccccgcgcgccataaagagggggaaatcactccccgtgattccctccctcttttcccccgcttttccctctctctctacctcggattcgtccggatttgctcccgcgatcctcgccggcgcatcaatggcggccgagatttccgcggccgattccttcccctccggccgctctctccccctcccgacgctatataatcgctccccgtgcctctctcctccgtttccgccactcgccgcactctctccccgtcggattcgagctcgcgccgttgtcctccctctccgccgtcgccgccgagctccggttcgccgccgtcgtcgccccggacctcctcccgcttcggcatcgcctccttcggcttcgccgcgttctcgtcgacctcgtccgctcctccgtttcgcccgccgaccgccggagcatcgccgtcctcgtcgacccgagccgcgccgccgcctctctccgcttcggtcgccgttcccgtcgtcgccgtcgacccggggtgagccgaggaccgccgcttcgcttccctcttctctccttctctctcggccgccgctccgccgtacctatggccgccgccggcgaccataggggcacgggcgcgccgcctcccgtcggctgtgccggcgtggccgccttcgggcgcgccccgcggctgccgtgtggggcccggctgtcagccgcccacgcccttaggtgcggctgacgcgtgggacccacggtgccggccggtgcgagcccgggtgcgcccggtccaccgtgggccgtggggctgccgcgtgggccccacccccgtggatccggcccgcgtgccccttccctcggctgacgcaataaatacattttaaattaaaaatttaaatgaagaaattcgcaaatattcatttaaagagcatataaacttcaaatggccataacttggccatttgaactcagaattggaccgttcaagtctctaatttttccttaagaagtcaagaacccatttttgtgctttgttcctgcttgttatatggagtttattagagtaaaagccttttttttctttccgttggtcgtctagacgctgcagctttggaagatccgctcttcgtggaggttgaagccgacgtttgggaaagcgagcaaggcaagtcacatcatccttgaacatattgaatcccattttataaaattattttgatttaaattattgcattatcgctttatttaaattcccgcgttatcactgttttattcagccatgcctatttacctttgttatgaccttattattattgctattgttattattattaccttgttcaccctagaataaacaaaactccaactagtgggcactccactcatggtaccactagtatgaatttaggtagatgcttcgctggttaattaggcaacattaggtggttttacaactttagactttgggaatattcatatcacctggacactatggaatggttggattattgtggaattggattcacacctccccctctattcaaaaccctcaaaatggttttaggctgggctcggggtgcatggttttgatggtagcacctcggccatataaggaccggtcttcgggcctctgttgcaaagcactaccgtacttccacatgtctagtgggtaaggcttagtttgtggctcagtctggttataaacaaagtacacggatggagatggacgaagtcgggggttgatggac

SEQ ID NO: 59929 - DNA, 1232 bp, Oryza sativa
ttggcaccggaacagaggaaccttgagaggaccatagtcaagttcccatatgtcctcgatggcaccgtaatacgtggcagttgttccatcgtgtcctatggcatcgacacgaacagcgctgttttggttcgtgctcttcatgtcttgggctctcgtgtagaatgtgtacccattgatctcatatctctggaatgtcgcgatcgacccagacggtccccttgccaggaaggcaagtagttggttgatcgactcgttacccatgagatgttgtcgtagccacgtggggaaagtatcaatgtgatgccgtgtaatccatgcatcggacttaccgatgttcctggcgcgaactagagccaagtgctcctcgatgtaaagagctaccaatgaagagtgttgcagaacagtgaaatgggctttacggaataaattgttgtctaccgtcattattgctttccttccgagagttccctttccccgtagtctcccttcatggcgtgattcaggtaccccgattgggcgaaggtcttcgataaattctatgcaaaattcgatgacctctctgttccataaccttggcgatgcttgcctttggacgagcacggttacgaacatacttcttcagaatgcccatgtacctctcgaaaggaaacatgttgtgtaggtacataggcccgagaatacggatctctttcacaaggtgacaaagcagatgcgtcattatattgaaaaatgaaggtggaaatatcaactcaaaactgacgagacattgcaccacttcattctgaagggcttctaatctatccggatcgatgaccttctacgaaattgcgttcatgaatgcacatagctttgttgttgttgcccggacattgtctggaaggataccccttattacaactggtagcagttgtgtcatcaacacgtgacagtcatgagactttaggtttgtgaacttcttctccttcgtgcttattattggcttgatatttgtggagtatccagacggtacctttatgctctccaagcattcaaacatactttccttatctgccttgctaagagtgtagctggctggactcaagtaatggcttcctttctcctttggttccgggtgaaggtcgccgcattgttccatatgcttcagatcattacgtgcttccagtgtatctttcgactttccgtatacacctaggaagccaagaaggtttacgcaaaggttcttagtgaggtgc

SEQ ID NO: 59930 - DNA, 2412 bp, Oryza sativa
aagatggtttctccaccagtgagtatatataccgctatttctagattagtaacacaccgttattcctgattagttgtaacacatttttctggatttttggactactaatatatatcacttttcatacattggtagtaactttttttcatactagtatatactgttatttctagtgtactaagtatataccatttttttctagattttcagtatataccacttttctaaattagtagtatgtactgctcttttttttttgtcagtatgtactcaatgacgatttggccagcacgtatatactgcattcctcattgaagctagattgttttttttttttttgcataatagtagtatatactgattttttttcgttgacggagtatatatatactgcccccctttttttttcagtatatatgtagtattctttggccagtatatactacattcctcattgaagatatatgtacacgattattaaaaaaaatgtactcgtagcagatttacccagcaaggggtgtgtatagaattgtacgagctgcagaattgtcagagttacaacaactactgagtatatatatccctggagaaagaagtatcgtttcaatttttgtacaagaattgcatcgcctcaattatgatcgaggctgtcacctggccggaatctctgctgcacggccatacaggctagccgatggatcgatgccgtcgtcgtcacccggacaccgcccgggaagcggcgagatgaatgatggcgccggaagcaaaaatcagtatatactactaatctgcaaaaaacaatctagcttcaatgaggaatgcagtatatacgtactggccaaatcgtcaatgagtacatgctgatatttagaaaagtggtatatactgcaaatctagaaaaaaaaatagtatatactctctatatgagagaatctcttaatgccactagaatttcaccaattcccttatatgccacttaaaattggcttctcccttatatgccactagttcaagtttttccacccttttatgccacttccaccactatagtgttagttgactgttagtcaaaggttagtttttttcataaatgaccaatatgccctctcaactaaaaaatgtgtaaacttcaaaaaaatcataactagtttattttaaatcttttttaagtgaacaaaattttgtcataaccagtgaaaaatgctctttatattaaaaatattgttggaaaactgcatgtttcatgcttacattgaaaatttatttgtgatggtaatggtaatggctaaaattgcatgtgatgcagaaaaaatcaattttcatatgttatatccagtagctatattagtactaaaatacctattattggttgtatactaattctcaagggcaaatgcatctttttacaatcaagttaacggtcaactgacggtggattgacggtaatggcataaaagggaagagaaacttgaaccggcggcataaaagggagaagccaatttaaagtgacatataagggaaccagttaatttagagtggcatataagggattctctctatatacttatatacttagtacactagaaaagcatatactggtaagaaaaaagttaccgccgctcaggaaacggcgagatggatgatggcgccggaagcaagatctatgcatgcatccaaagaaaattaattaaacagaagttcacaatcatatttggaaacgaatgatttggtgcatacctatagagatctaacaagaaaacaaaaagaaaacagatccatcttcttgatgatcgatgacgttgctgtatgattcagcgagcagatcgatcacgccgtcgcctccggcttgccgatgggctgcgctgtggacaccattgccactggatcgtgacgtcggctccggcttgctaatgtgactgcatcgtagatgcagaaacgccgacagatcacaccgtgaatgtacgccgaattgccgccgcggacgccgagtcgcctatcgatctcacggtcaccgccgaattcgtccgtaaatcaaggtctcgccctgggatcgatctgtggtttgatttggcaccaccgtctacgaacgagagtttttaaaagtggttttcacggttgttcggatcgctatatccacgaaaatcaaaacgggtccggtagttagacccagtaccaggtttgatcgggactaggccgctgatgtacggtggatgagagcaggagtacgtacacctgggtgtatatatatatatagaatcggatctctcttttgtactcccaggtgtatgtactatcttttcttaatggatatccattagttcaaaatgaataattagattaaaaaaagaaaacaccattctttttttcaaattatctgcatgcaacggctggtgcgtaggactaggttaaaaa

SEQ ID NO: 59931 - DNA, 3861 bp, Oryza sativa
tttttacctggtagtatcaacgatcaaagaacagtacgtatataccactaagcagtgcatgctgtttaaacaaacgagcagtgtgtaatcatactgattacaataacgagtggtatgtaagatataatcgattaagaagtacagaaggttaagttataatcaactaagaagacggtaacagtacatagatacaactgagattaagaaaaagaaatcatagctacagaggaaaaactgcatcactgcatcgccatcgtcgtcagactataatcttaagctaagctaattgttacatctctaccagaaaccaaatcacaatgggagatgtgcgtacatgttcgtatctgcggtcttccaccgttgccgcgtgattcattagctgggaataactctacaaactggcatcatcgtgcatggtcgatctgtggcagccgccggccgaatcgttcgattcgtttgcctcgaccagccgtactgattttagttggaggagagttcgcgtttcttgctgcggtagtggaactgtggaagccgccgccgaccctgatactgttgccatgggaatcctgcgaaaggggagtaatggatgtaaacaaccatcaatgataattcaagcattgaaaggacgtaaatctagtcgatcggcaccatcgacggggagcacaacccaactacctgatgtcgttgctaatcccatccgtctgaggactgtatgaggaagcgggtggtcgaactggttgatggagcgcgccgtccacccgtccgtggctgccgtggcaagattgctccagttcttccaccgccggcggacttcgcgacctccaaccaagctaccgtcaaggaaccgtcgccgcctccgcctcgcgtcaaaccgcaaatgtcgcgagagctgttcgatctgttgagtactaaccggtgcgatttatataattaagcgctaattaaggatcatggattattattttacaaaaggaaaatcaaaacgggtccgttcggtgatccgctaaggagcttcatcgagatggctgtgatggacggtagatggaaccgggtgtacgtactcccgggagtacataatcattttcatatatatatatatatatatatatatatatatatatgacatatattaataatatgtatttatacatatatctatgcatatgtacatgtacaaaatagacatatatgtatatacttaacattttatgtgcatatataatatatttacactaaagtaaatgtgtacatatataaatatagatatgtattacaattcattatgtcctagctacgacttcgacgtagtcgttatctcagaagttaacgacttatgaattgtagatccgtcgtagtagaattcaccctcgggatcaaggacttgttcattgatgaatcccatgagttggttcttgaacagccgtgataaagtcctcgtgtgtgaggttgtccctcatgtgaataacctatgaatgtatgaagttaattagtaaacaagaaatcgatacatacgcaatgaaattttgaatggtttatttatacgtacatcgagttctcttgtggtgatgatttgggttgtaacgcagtggcaatactcgcatatgtagtagccgcacaagttagttccctcttcctgttttgcacactatatacatgacaaacgacgagagattttatatttgaattagagattcgatataaattttgatcatgtactcactacaaatttgaacctccggcgaagtttttctttccaagtgccacggaccaaatgacggaaccgataccaagccctacatgaagtttaaaactatatatgattcgtactagcaatagcaaaattcgtaataattaataacactggaacatatgacattacctgtttataagttcaaaaatctggtcaaaagtagactcatctttattcattgagtcatagacattgactctacattccttcaagtcgaagagtaaaaggacccagtggaatatgcaatttgtgtgagatgatatatgaaacactgtgcatctatatgtacgggaacgaaatttgttcggtagatagtaaaaactaactctgtgttgtacggcagtagtatgaacgtcttgaaatgctgctccttgaggagatggacgagattgacctctgtgggttgcggatacttggtgaccatttcgacgtttactttccgagggtcgatgaatccagtattgaaaaacccccgctgtcgagccctttgaatctccattctacaacgatgaaggaattgttatatatggtgtacatatatacaaggagctaattaaaggaacgtaagaaatataactcaatgatatgtacaaaatccatgcgctcagaatagagacgtccatgcgcacagaatagaggacgtcgagggcatctagttggtatagttcgtagatatccttgaaattgatccagagaacatcttctccttgtaagaagtcggagttcttgattctcgctccaataatctccctaccgctggcgctcatctccatgtaccattcatggaattggtacatctgtgtgggtagggactgcagctgctcaggcttgacaagcggtttaccaagttcgtcaaggtgtctcacttccgcctttggaggtgcacctctaagtaactgagccctagttagcccgatatcagaaatgaattcttttattccaatttcttgcccagtcaccaatggctcgacctcctggtttggttgctctccaagctgagggacttttttggactttctataatatgctttcctaagtgttcgctcatagtccgttagctttaaggcctgcttgagtggtcccgacatcttctggaagaacttgttggcactcgggtctataggaatctgcttttctggacttcgaggcttcaattatctcttcacttctacagccacataagcgtcaagctcctcttgcgtgcaatcgtacggcggctccttgttctcggcggcgtcaactttcgccttcttcattgcccttgtgccggcaggcagtggagcttggtgagttcttgacttagaaggtgccggaggacacggcgcaggagcctgatcaggaggagacggtgcaggagcctgaggaggagacggtggagccggaggggatggtgcacgagacgccgcttgtcgcccagggaggatgaggtagcgcttgcgccatagtataatggcgtggcttgtgtcacgtagatgcgtctcaccgtctcctccagggtagtccaattcgaggtcctcgtacgtggcttccaccagctcaacttcgactctcgagtatcctgcaggaatcggcctacagtggtaagtccctgaagggtccgttgggatggccattcccgacacaaccttcacgtgatgagaggttatctattagtaatcaacctaagcagaaacttgcggaatgtacaagtccaaaaaacataaactacgggcataccttgattgataagttcttgaagggaatatgcagctcacgtggtgtctactgcgtgatttcatcaacggggcaggtggttacgtcctgagtttgcatagcatccatgctctgtgatcctacctgccccgttgggtcatggatcaattcaagttccttcttataaacttgtttatggacacgaagcggttttgccatgggaaactaaaatcggctccagacgattagatttacaagacagtttagcagccgatgagtattacaatctcatggtagatgaaacagaagatttggtccaatccagattgagagcccttgccaaggtgagtaaggataaggaacgggttgctcggcattataacaaaaaagtggtgcctaagtctttttctgaaggagag

SEQ ID NO: 59932 - DNA, 732 bp, Oryza sativa
gagccagcctggtttcccccatctagctcttggtctagttgagaaagttctcatcaagtagggtgccatggcaatagaagacaaattggacttgctgttgaggcggatagaggagtacgagctgaggcgagaggaggctgatcggagaactagagctgatatacggtctctcatagatgtggttgaagcatgcacaccggaagttgggaagaaggcaaaagacttgccagcgtcaattaagaaagagcagtcaaaggtgacgcccaccacatgtttgacgaaatgctctagtcccgacatcgagcccaaactcacactggttgcgatggtcaaatgtgccgccactgccatggcctccatgaagttggtagctgataatggtgcaaccagcaccaccaaaattcccaccactgactattccaaggagacgcacgccaagtgttcgatgttgggcttcgatgtcaagtgggacgccaacaaagccgacatcgcgttcctgaccaagacggttgtacttgagaccgttccagcatccattgcatcattgagcgccttctcaccaaggatgatcgccgacatcaagcattacacattgatgcccaccaggtattcagcgaaatgttctgggtctaacaactctcaagttgtgtcttatttgtccttcttaagcaccccagtgttagtggaatcagttgaaggacatttgttagttccatggcaactgctgttgca

SEQ ID NO: 59933 - DNA, 11176 bp, Oryza sativa
ccggtgatatgcaattgcatgagaagacccaaaagtccaatttaacaatcacaaatgggcttagaatgtatgtcactgatttaggggcccacatggaagtctcctggaggaagctgggggccaaaagagcccatatggggtcggccgaccccttgtttagcccaatccagccgcattttggccaggagataatggaggccgaggaggaagcagcaggccagaaaccaggcctgttgggccagtctagggttcggccgaaccctgatcttagccgttggctctcccctttggcgtggacgctccggattaactcctgatggcggttgcagggcatttctgacaattcccatgctctacaaccgtcattgggagctataaaaggacctcacctccttcactttcaacacaagctcaagtaaggattgaagctccatttctccaaagttagaattagtatagtactagtggaatagaattatagtagttccgagttgcggaagctttaggaagttcggtaaagttcttagcttttcctttcttcttttataagacttcctttttattaatataatatttcttctttatacaagttcggtactttattccaatcatagaatatgagtaccattcttagtttatttataatcagtataatcttagtagttaaaccttctgggatttgcattgatgctggtataatgtctgattaccaggtcataagtctgctctggctaggctgagaactatgccccggggactcagatgctctacaccgattgcaaggctgtagagtaataagtagtaacttaagcatggggtttaggttatcacttatcattattttggggtatattcgccgggagagtagcaggccgctgatggtgacagcttagtacgtgcgtcttccccacagtttatatttctacgtacaatttcctggggttggatacacctttgtatcctactttggtttgagggttatgataggttgtcgtaagaaactcgtcaacctagggtaactttgcgatgcatcatatcgggagggcatagctgagttctggcttagctatgctgcattgttaaagggaatatactacatagagtatactagctagaatagactaggatgttgtatactagaagtacatgagtgagacatttctattctatttccacttattcatatttaggataaggaggagttagcggaatccttagctgtgtgtcactctacccttaagcttaacttacccctgcatagaccttaatgtatacaggtaatacataaactattagcatagtactcttttatcatatatttccttgggataaaataaatacgatatcttggaatactcctgggtgaaatgatacaatggtatatccgtgcgtttgcggatcatatttgtaaccataatatatcaggattatttctagtgctattgctgggaattatatttccagtagtgttactaagaaataccaacatggcgctcatgtccaccgcgtcatgcgcgattgcgaacgtgtggcaggtgacggcggcaacagttggcatcgggagagcgacgaggtcggcaacgaggtcccgaggggcaccgcctatagaggcgtgcagctcgactggcgcatgcgcgcacaggcaggccaaagccgttggagaagcacttctccatggtggcaatcgctggtgcactggcacccaaagtggcgcagacatgagggccaggccaaggcatgagtgctcgccagcaccagttagggtgatgacgtggacatacggggctgcacttctccacagtgcacaagctcgccatgtccatttgcattacttggtaggctgcagaatcattttttttctattacattgcatatatggtcattctctttggaaatatcataattggaaattttaaaagatctatacatatatagaagtgagtgttctaaagaaacattctctgttatacattgttaggaacccactacttccaactcaacaacaagcatccaccatagaagcaacaactgttttggggacaagagaagaagctatggaatacaagtgctggaaacttctagaaccgaggggggagggaaggctggagatcggaggagaggtaggggagagagatcgacgagggtgcccaccggccacccaagtcgccgccgccgccaggagcttcagctctgccaagtccaaacgatctttcgatgccccctggtgttgtcgatgctgctgcttatatgctgctcccttccgtttgcttgggcctcatggcgatgggctgaccagcctgtgtgcggcccacccgggatcctgacaatcccctcttcttgaaatttggcttgtccacaagccgatggaaaacacctctcgaatcccatggttgctccaaatatttggtgttagacaatgaaccatcattgaagaagaatagagcaagtagctttagcttgaataactgcttactccatgtaaagtacacctgggtgatgcatgacaatggcactgttacgaatcgcttgccaacattgattcccaacaatttgatatgctgcaaagagtgacaacctcgcttgatcaacaccactgtaggaactaacccaaaagtatacttctcatcatgaattgaattaatgcaacttcttccatttctttcacccttttgcagcctttttcatcagcaatcacatatagcaaatatctttcaacattcaaaccaatgtaatttgattccaaacatgatcagattctgatatcaccatgcaaattattctcatattccatttctccactctagtttggtagtagttgagcaacatcccctgaagatcaacagatgataaccaaacagataatgatttaggatcacaaaataactagattgctttccttgctagcaagtgatgtcaaactgacctggaaagttagatcccaaaacttctgcattttttgctcaaagcaagtgcaagtttcagtaatcatcattttcttttgctcattccatggaattatacttgcagcagaatcagtagtgcaacatttcccttctctaacttccagcaaacaaactaatggcagccaaggtggcatgacaaatagtctgagcttgtcaacatgttttcctttgaaggaaaagttcacagaaccaaattgcccagtactgctcagctccacaaccatcactcttgcaagaagtaagtgactccaacttaagtagcagttgccctttctttccatttcaacaaaagatagccccaaaagtaaatattcaggttcaccagcagcatagataccttccttgctagtggctgctataaggttgatcaaaaaggacaactcacttttcactccaacattgaatttcagcttattgctccacaaaatttacctccaatgaaaataatgttgtgggaaccaatcatccatccatattgatattttgcaaaggtggacctttccatcacctggatcccacactagtggcccaaacatgacatgtataatgttcagcgagtttaccaatgaaaattgcttgcccacaaagagttgaaaccatttcgcttcggttggagggggccaaggtggcagtatatgtactttacaacagctgcagttgaatgccagccatgacattaactgtgactccaatatgatcaactcttgatcccttgatgttatgggtggccatggatcaacctcaaagtgttgcaacagcagttgccatggaactaacaaatgtccttcaactgattccactaacactggggtgcttaagaaggacaaataagacacaacttgagagttgttagacccagaacatttcgctgaatacctggtgggcatcaatgtgtaatgcttgatgtcggcgatcatccttggtgagaaggcgctcaatgatgcaatggatgctggaacggtctcaagtacaaccgtcttggtcaggaacacgatgtcggctttgttggcgtcccacttgatatcgaagcccaacatcgaacacttggcgtgcgtctccttggaatagtcagtggtgggaattttggtggtgctggttgcaccattatcagctaccaacttcatggaggccatggcagtggcggcacatttgaccaccgcaaccacggtgagattgggctcgatgtcgggactagagcatttcgtcgaacatgtggtgggcgtcacctttgactgctctttcttaattgacgctggcaagtcttttgccttcttcccaacttccggtgtgcatgcttcaaccacatctatgagagaccgtatatcagctctagttctccgatcagcctcctctcgcctcagctcatactcctctattgtcacaccctgtagttctccaactaagcctaaaagtgaattaataagagaccctaagaaaataccggtgcaaagcaagagtaaaccctattaaatcaatgcaaacaataatcggaattggcatgtggaatttttcttgagttctacaagtcgaaattcactaacaggatttttagtggaattttgagagctctcgaaataattttaactatttaaaattgagcttgcaatattttaaatcccagggaaattcttttcctccttttcctcttcttgggccgtcggcccagtccaccccgccatgcgcgccctcctccttgtgggccgcccaagccgcccctccctctctccccgggacgccgacaggtgggccccacctgttggacccgtccccttcctccagccggcgccgccgcgcctgcaaccgccgccgcgcccacgcctccgccttctccgggccacgtcagccacgtccgcgcgtgcgccgcatctcccgcacccacttctcccctctcactcccatccgcgcccgcgccccgcgcccgagatggccgggattcgattttcgaatcccgcctctctctcctcccccactccccacgttggccggcgaaatcccgccccttccggccacatccggggctcccctcccctatttaggcttccccgtcaccccctctcgctttttccccatctcgccgaactccctcgtgctccccatcgctcccgcgccgtgcaaccacccgccaccgccgtttccgctactccggccgccgctagccgccgctagggtcgccgccgcgccgcgccgtcaccgccgtcgggttcgcgaggctaagctctaccccggccgctccttccccgtcgagtttcgtcgccggaattcgcaccccctcgcgctctggtgagttcaaccgctatcgccgccttcggccatgaatgccggtcgccgtggttcatctccctctctctaatctctctctcttccttccttagggcaccccgaaacccgtccgccggttgccgtcgtcctcccgtggcttgcagccgccgttcgccatcgtcttcctccgcgccggccaccctcggtgaggtttcctctcccatccattcccctccctctccttcctagccgccgcttagtgccgccgccttcgcgtcgcctttgcgccgtcgcctccgccgccggatgccgtcgccggcaacgcgttcgcgcgcgcacgccgtcgccatcaccgcggccggtaggccggccttgagccaagccgagccgggtcgtcgccgcccgtccgatcgaccccgagggcgatctaggccgtttagactagagattggactagggattgcttagccatgcttagttcaactagtgcacaatggggagaatcctattaatgtttagactgttggttctaatggtattgttggattagtgccaccgctttggtgttggttaattaaaagaaatcacatggtgggctgtgggtgcatggttttactggtcgcacccatggcagttaaggaccagttcgtgggatgccctggaagaacttatcgtacttaccacaagccagcatgggcaacggctgggcttgtaacgtagctttcctctagccgacgcatccaggcaagggtgggcgtgatggagtttggatgggccctgcgacggcctatgcggcttccggattcacctaggcacgagaggggactgcccgctgccttgcgaggagtgggggtgaaacctgaggtgtggtgtgcttggttagagggggttatgcgaagggtcctgtcacggcctctttccggtatgtcgtggtggcatgtcggtgcacggaaacgtgtcgtggggctgtgtcttgtgggtacagttgtacacctctgatcagagtaaaactattcgaatagccgtgcccgcagttatgggcggtcaaccagattcaacgtgattagtctcaccctagtgtaatcttttgaatttggatagtttaggttgaggtttgggcctgttgcaatgtgggatagcgttggacagtggatagttaatattaattaattattacaactgtttaaatctttcaacttctgttttttttaatgctcgctttatgcaaacgaaccactttagctcttctttgataattccttgcatcatgcctctattccggtatgacttgctgagtatagtggatagtactcagtcttgctctatttttcccaaccccagagtacgagtatgtgtcagatggaggtttctctgaggagtaggcttcgtccgtgccgtcaaggatgcctgtggagtggtgttcccgctgcagttctagtcaaggcttagctcctgttgtctttctttctttccgctgcatttatgtgagacttttatgatgtttgtaagacgtggatctgaatgtcaacattgtcgtttgtgtaccccggccggtcctagacggggattttaatgcacattctgcttggaattctatttggaaatttctgggcgtgacaagttggtatcagagccaggttgaccgtaggacaagccaaatggaaaaacctaggagccctctgaatccttttcattgcatatgttctttgcaattggatttgttccgggaaaattgggatctgttcttgtggttcaaggggaaaaatcttggtcgctcgtttaagtgagatttgtcaaaacaagtcagtccagggttttagtaaaactattgagatttattcgtcagtcagttgggatttgatgggtgaaatgcattagatcctagctcgggaacatgggttgcaaggtatttatgctcttactgttattattagtatgtatctaatttccccaatattttatcgttatgtgagtctgtcttatttattcgctctcatgcaaaaggatctatgcataaaatttcgctcttattcgattctcttatttgagtcctttattgctttatttaaatttggatttgagcatgcattgatcctactcctttgtcttctctagatggccggccacccacccaaccaccgcggagaaggcatgattgactttgtggcagagttggcacgtatgacgctggtggtgggctaccccaacgcgccagagtacacgactgttccaccactcagtggcgagcttcctcaccgtgttcgcctggaggtccacggctacgtgggtacctgcctagctaatatggtggttgaggcatccggaggcacagcagatcacgcctgttaggaggcagcatacctgatgatggccagactacgggagcgccacaactacatcttccacgacacggcgtaccgatttcaccctcgtcgatttcaaagaagtttgtcgggatgcatgggttaaggaaagaagagcttagcacaccaatgagggttcataccccggaaaatagttcaacctcagtcagttttagcccttcagtgctaatagaaatccaaagatcaccatttctagccaacctcattcttctcgaatccaaagacctagatgtcattcttgggatggattggctaaccaagttcaagggaatcattgattgtgcgaatcgcacagtcaccttgaccaacaagaagggagaaacagtagtgtacaaatcaccagactcaccaaagcaaggggtctccttgaatcagattgaagcggaaatcccagtggtcaccgtggagaagaatttgaggaagttggaagatatccccatagtctgcgagtatccagaagtgttccccgaagacctcactaccgtgccacccaagagagagattgaattccggattgacttggcaccgggaaccgctccaatttacaagagaccgtacagaatggcggccaacgaactagcagaggtcaagaagcaggttgatgagcagctgcagaaagggtacattcgaccaagtacttcaccttggggtgctccggtcatttttgtggagaaaaaggataagacgaagaggatgtgcgttgattatcgcgcactcaacgaggtcacaatcaagaacaaatatcctttgccgcgaatcgatgatttgtttgatcaactgaaaggagctaaagtgttttctaagatagacctgcgatcaggctaccaccagttgagaattcgggaagaggatattccaaagacggccttcaccactcggtacgggctatatgagtgcacggttatgtctttcggacttaccaacgcacctgcattcttcatgaatctgatgaacaaagtgttcatagaatttctggacaagtttgttgtggtattcatcgacgacatacttatctattcaaagtccgaagaagaacatgagcaacatctccgtctggtactcgagaagttgaaggaccaccagctatacgccaagttcagcaagtgtgacttctggttgacggaagtcaaatttctgggccatgtcattacagctcagggtgtggcagttgatccatcgaacgtagagtcagttaccaaatggaccccaccgaagaccgtgtcgcagattcgaagttttcttggacttgcaggttattaccgccgattcatcgaaaacttctccaggatcgcccgacccatgactcagttgcttaagaaagatgagaagtttaaatggacagccgagtgcgacaggggttttgaggagctcaaaaagaaattagtatccgcaccagttttgattctgcccggccagatgaaagacttccaagtctattgcgatgcatcccgccacggacttggatgtgtcctaatgcaagagggcagagtggttgcatatgcctcgtggcagttgcgtccacacgaagggaattatccaactcatgacctggaattggcagcagtggttcatgctttgaagatctggaggcactatctgattggcaaccgctgcgaagtatatacggaccataagagtctgaaatacatcttcacccaaccggacataaatctccgacaacgaagatggttggaactaatcaaagactatgacatgagcattcactaccacccgggtaaagccaatgtggtggcagatgcattaagcaggaaaagttactgcactgccctatgcatcgagggcatgtgtgaggaattgcggcaggagtttgagcatctcaacgtgggaattgttgaacacgggttcgtagccgctctggaggcacggcctacgctcatggatcaagtaagggcagctgaagtaaatgattctgaaatagcagagctgaaaaagaacatgagagtcagaaatgcccgggatttccacgaagatgaacacggcacaatctggttgggagaaagattgtgtgtacctgacgacaaggaactgaaggatctgatactcaccgaggctcatcagacccagtactccattcatccgggcagcaccaaaatgtatcaagacctcaaagaaaagttttgatgggtcagcatgaggagagaaatagctgaattcgtcacactctgcgatgtttgtcaacgagtgaaggcagagcaccaaagaccagcaggtttacttcaacctcttcaaatcccggaatggaaatgggaggagattggaatggactttataacaggactgccccggacatcatcgggtcacgattcaatctgggtagtcgtggatcgactcactaaggttgttcacttcataccagtacataccacgtatacgggcaaaaggttggcggagctctacctctcgagaatcatgtgtctacatggagtacccaaaaagattgtatctgatcgagggagtcagttcacctcaaaattctggcagaagctgcaggaagaattggggacccgtttaaatttcagcacggcctatcacccgcaaactgatggtcagaccgagcgagtcaatcaaatcttggaagatatgttgagagcttgcgctcttgattttggtggagcttgggacaaaaacttgccatatgcggaattctcgtacaacaacagctaccaggccagtctacagatggcaccgtttgaagctttatacggccggaagtgccgcacacctctctcttctgggatcagacaggcgagcgtcaactgttcgggatagaggtattaacggaagcagaagagaaagtcagaatcatcagggaaaggtttaggattgcccagtctcgacagaagagctacgcggataaccgccgaagggaactcacttttgaggcagggattacgtgtatcttcgtgtcactccgctccggggagtacaccgttttcagacgaaaggcaagttggcaccacgcttcgtgggaccctacaaaatcctggaacaaaggggagaagttgcttatcagttagaacttccatccaatatgatcggcatccatgacgtgttccacgtgtcccaattaaagaagtgcttaagggtacatgaagaacaggctgattcggaacacattgatatccaggaggatctaacctatgtggagaagccggttcatatacttgataccagcgaaagaagaactagaaacaaggtcaccaggttttgccgagttcagtggagtcaccattcagaagaggaagcaacctgggaaagggaagatgagttgaaagccgcccatccgcacctcttcgccagctcctccgaatctcggggccgagattccgtttaaggggggataggtttctcacaccctgaagttctcctcctaagcctaaaagtgaattaataagagaccctaagaaaataccggtgcaaagcaagagtaaaccctattaaagaaatgcaaacaataatcaaaattggcatgtggaatttttcttgagttctacatgtcgaaaatcactaataggatttcagtggaatttcagagctctcgatataatt

SEQ ID NO: 59934 - DNA, 10475 bp, Oryza sativa
tgtcgtttgtgtaccccggccggtcctggacggggattttaatgcacattctgcttggaattctattcgggaatttctgggcgtgacatctatccgcctcaacagcaagtccaatttgtcttctattgccatggcaccctacttgatgagaactttctcaactagaccaagagctagatgggggaaaccaggctggctctgataccagattgttaggaacccactacttccaactcaacaacaagcatccaccatagaagcaacaactgctttggggacaagagaagaagaagctatggaatacaagtgctggaaacttctagaaccgaggggggggggggaaggctggagattggaggagaggtagagtagagagatcgacgagggtgcccaccgaccgcccaagtcgccgccgccgccaggagcttcagctccgccaagtccaaatgatctttcgatgccccctagtgttgccgatggtgccgcttatatgctgctcccttccgtttgcttgggcctcttggcgatgggctgaccagcccgtgtgcggcccacccgggatcctgacatacattcattgtggattaggtgcaagaagaggccgtaagtcaagcaattcgattaagatgggggaagtaggaagatacagtaaacccattcatcatgagcagagatgaccatttcatggttattgagatcgtagagagtaatcaaattagttcactcagatcaaacacaaagacaacaggccgtgtaggatatggaaaaatggtgtgcccattaatctaatcattttatcgaaaggagtaacgaattaatttatactgcgaaactgttgtttcagaacaggtccatatcctgtcgtgtggtaacacaactggatggaatcataagatgaaaaggagcagcaagaccgtcttgccggaaattttctggtaatttctgaacttatttgtgcataaaatcctcgtccaggaatcagctgaggtacataaactgacaatttaatataccaatccatcataataatatcgttacatacttacaaaagaaaagaaaagctgcggcggaattacggtctagcgaaggttcggctccactcccacaggcagctcaattggggtataagccaaacgttttctccctctggatcattttaatttcttcaactgaggttgattgattattgcaagatgagtacgtggaatactccacaagccacacagcaaatatgtgagtgcacaaggattccgaaggatggcataatataggctcatttgcaaaagtagcatttagcaaacatttaggagtagtaaaacaatagagtaattaatcatcaatattaatcaacactgaacagcacaaccatgctgcacaggcccaaccatcctaaacaaccatacccagctgtacagatctaattccaaactaggagctaagcaaattattacctgctatagcatcaataattattatgagaggtgtgagactaataacgaaaaacattgctcaacccgcccataaccgcgggcacgactattcgaatagttttactctggccagagatgtaccactgtacccacaagacacagccccaaaacatgttaccatgccctcagtatcaccacggtacctcgaaacgggactgtgacaatacccctcatacaacacaatccaccacagcgcaccatacctggatcataatcaccccctcaataaccagaggcatggactccgcagcgatccccatggacttctcgctacttcacagtctggtgccccgcaacgaactatgctatacaaaaggtaaagctgttgcccacgctggcgtggaggtactggtccacggtgacggcgacattttggcgatcttcggcgaaggaaaaccggtggccgggcttcagcttggcgctgcgatgctgaggaagacgacggcgaaaaccgaccaccacggagtcatcgacggggctcgaccggaggtggagtagatcgggttcacgttgatgaggggattccaatgggtttcggcttcgggaagatggctgtcgggcttgctcttgaccttgcggagccgagggaggaagaagcaaagaccgaggacggccagggcgacggcgagatgtggctggagcggcggccggcggtagactgagaaggcgaacgcggcggcagcgctacaagcgatggtggagatagggagaggtggcggccgaaagaggagagggtggggactttatttataggcgtgggaaagagagatcggctcgggaacggatggattcgttgaaggaaaattagggtttgtttttgcagagataaactcaatccgagctcgattccatgtcgaattaaaagggataaagtctagggaaacggaagagaaccaattcaagaaacggctgagagaatcgagcgaatcaggcggaggaaacgacagcgtctcggcagctgcacgggctctatctggagctggaagacgacactgtagctggagggaaaacgtatagactttcagctgggcttcatcttccaaggcctgattaaagagggaagcaaatgcccggtttatgggagcttctcccagctgcagcttttcccaaaagctgcttctgttagaagctgcctcaaacagtccacagcttctgagaatctgtagttatagattctgaaaaatgaactaagaagccaaaagctggagaagatgggtttcagagcttttccacattctcagaagctggctaccaaacagctgcttctcagaatctaaagctcccccaaatagccccaaagcagacttcgacagagagaaagaggctgctggatcggctgggctgaaggggagagatgggccagattaagacctgagctttcgaaaggattttaattacttttccaactaaattaatcactgaaatgatatttgaattgttaaaaatacttcaaatactgaaatatgttcaagaaaaatctcgcaactacttggacacttagagtatttaacaaacttaagataagatcatttaatgactaatttaatatttaaataattcctaaaatgttctttgtattattaaaattagtaattgagctctaaaaaatccgagaaaatttcagagagtataattaaccatgtagaatttaataaaatttaatccatccatgctttatatttaggaaattttatttcccacatttaacttcacttgtttattaatgtacatttaatataaattttaataataatttattaaataatttataaatcctaatacgaaaataaggatgtgacaaagactgctagaagaaatcacaagaagaaagatagtgacttgactcctacaaatgaagggatgcatcttacacgcagtgtggagattatgggtagttgggtaccacatacccacatggcacgtatatccgactggttataggtaatagcttgtacagatagaatatgtttaggaaatgactcgggaattatgttaacttgtatgtcaaggaaatatccagtagtgccagttagttacagttgtaatacatattcgttagcctagtacgtaagccatatgggctgtacattgtaatcttggctcctccccctatataaggtcgggtccaagtgtacctaggggcataacttttctcccagatcatcagatcaataatacactcggtggaataattcccccgctgtataaacctttgcctcctacgtcctaacctatccacttttccagcttgattgctaccccttttagtattgccggaatcttgttttgacagttggcgcgtcaggtaggggttgcgccatgtttttcgccgactagtgcgatgggattcgtttcgggcatcaccgacttcgctttccctcccgggcagacgtgctggttcggcggcccatggacctcatcagccacccgtacatgcatgcaaagaagacatcgtacgacagatcaatccatgattataaatcaagctaataatactatatagattgtgaaagaagttcttctgtatatgtgcagaatgaaggatcccttaaagcaaattgtttttgattggttgcaagctttatagttttatttagttccttcgactgtaactttgtaaatattttttgagttatataaaattacactgctcggcaaagcgacggcgctcttcggcttgacgacggcgacgatgctccggcggtcttcgacggcaacgaaggagcggacaaggacggcgacgacttggcgatcacgacggcggtcttcccgagcgacggcgacggctgaaacgacggcggcgcacggctggagcggcggcggcgacggcgaagctagggcacacggcgctagagcgattccgacgacgagaggcgaaggcgaaggtggcgacgggtagaggagacaccgggggtccttttaaaggggctcggaggcggcggcaaaggcccacggcgacggcaacggcgaaggaaagctcgggcttgaaggaaagaggccgatccgaatcgaactcgattccacgaacttccaaaacgaattagccgatgattccaaaggagaaaaggtagaggagatcccggagattgtttcccctctaacaattcggccggagaaggaaaggaacggccggatttggaaaggaaacggcggcggcgcgaaactagggtttcggcggcggcggccgaaggtagacgacgactgacaggtgggccccacctgtcagcgagcgagggcgcgcgcgcgggcggcggactgggccggctgggccgaggagagagaagagaggttttgggccgactttcggcccaaagccaaaagaagactttttaaaacctttttcaatttaaattatttcttaaatgcaattccatttattaaaaatactttcttagctcaaataaaccccagaaaaatctaggaattatagaattaagcaaagtatttaacgaaattttatcttgccccattttatattggaatttatttattaaaattaaatcttcttttcaagacttttaaaattatttctaaaaaaattccatttaaacaacaatttatatattttgaattttcagggtgtgacattagtttatttataatcagtataatcttagtagttaaaccttctgggatttgcattgatgctggtataatgtctgattaccaggtcataagtctgctctggctaggccgagaactatgccccggggactcagatgctctacaccgattgcaaggctgtagagtaataagtagtaacttaagcatggggtttaggttatcacttatcattattttgggatatattcaccgggagagtagcaggccgctgatggtgacagcttaatacgtgcgtcttccccacagtttatatttctacgtacaatttccttgggtaggatacacctttgtatcctactttggtttgagggttatgacaggttgtcataagaaactcgtcaacccagggtaactttgcgatgcatcatatcgggagggcatagctgtcacgccctgaagtacccctcccttgctctaaattcataaaataaatcgttcgaagaaattgtttaatttaacctagagagaaaccctaaattaataaatgcaaataataatcggaatcggcatgtggaatttttcttgggttctacatgtcaaaatacgctaacaggatttttagtggaattttcagagcattggaaataattttaaccaattaaaataagcaaagtgcaatattaaatccctgggaaaatcctttttcctttttatccttcctttttccccctcttttcctcctttgggccgccggcccatctctcccgacccctcccgaagtccaggtcgcctccccctcactccctcgggcgctgacaggtggggcccacctgtcagcaccttccccaacctccagccggagggacggcctccctcctccctaccgccccgcgctccctgccgccccgggccacgtcgcccactcccccgcgcgccccgcactccccgcgcccacgccccactcccgctcaccccgcgcccgcgagatggccgggattcaaatttgaatcccgcctctctctctctcctcctccacctcctccactactccggcgaaattgcgccattcccggccacgactcgccgcctcccctcctatttaagcacgcccgcaccttcctctctctttttcctttctcggccgagccctcccgagccctccatcactcccgcaccgctacacccgccgccgccgccttttccactcctccggtcgccgctcgccgccgctggagccgccgccgagccaatctgccgccgccattagcttcgccgccgccaaagctaccccggccgccgcatccccatccaatcccgccgtcgggacccgcttctccccgcgcgccggtgagtaccaccatggccgccgccttcgaccggcgaatccgctcgccgtagaccacccctctccctctaatcctttccattttgttccctaggaggccccggagatcgttcgcccgtcgccgtcatcctcccgtcgctcgtcgtcgtcgttcgccgtcgtctccactcgcgccggccaacctcggtgaaaaactccccctcctccgtctttccctctctcccgtgtgcgtcgccgtcctccgcgcgcgcaccgtcgtcttcggccgccgacgccgcttttcgcgccgtctgccgtcgccgtccgcgccgccggttgccgtcgccggtgaccgcgcgtgccgccgtcgctcgccatgcttggcctgccggctttgaagccaagccgagccaccagcggcgcccctcccgccttgtgccactgccagtggggcccacgtgccggcgcccctccctctctctcttgagccgccgctcggtggggcccgcttgccagccgcccctctctctccttgagtcactgacccgcgggtcccgcatgtcggcgccgccccaccccttgctgacgtcagccctggggcaatattgcgcaataaatcgattaagggtttttcttttatagtaaaaacacagagaatcttctaaaaatcataactaattcatccgagctccgattaagtccattcaagtctcagtaaattcataaaaatgtgtagaatccattaaaaatggttttgcttcctgtttcagtagtcttatagcatgttttgcttgtgtgctttgtttgtcgcgtagatttcggccgtttcgtcgattcgtggtttctcgaagacgttgctgtggttccatcagtgcgagagcaaggcaagtcatacattgcaattgatcatattgtacctaatttacaaatgtcccgcatttctattaaatattgcattgttttacaatatcatgtgggatgggtcctattactcagctatatgttgtttcccttatgccattgataacttgggtattaaaatgactagatgttggtttaggagatgcttagccatgcttagttcaactagtgcacaaaaggggaccacattaaagcatagacttgattattggcaatagctttggattagtgccaccgcaatggtgttggctaattaaaatacactacatggtgggctgtgggtgcatggttttgctagacgtgcccatggcgattaaggaccggttcgcgggatgccctggaagaatttatcgtacttaccacaagctagcgtgggcaacggctgggcttgtagtgtagcttttctctagccgacgtacccaggcgagggtgggcgtgatggagttgggtcggccggggtgtccggttgatcggctgctggattcaccgcggcacgaaaggggggctgcccgttgcctgctggggacgggggcgaaccctaaggtgtggtgcgatcggttagagagggttatgcgaagggtcctgtcacggcctctttccggtatgtcgtggtggcatgtcggcgcacgggaacgtgtcgtggggctgtgtcttgtgggtacagttgtacacttctgatcagagtaaaactattcgaatagccgtgcccgcggttatgggcggtcgaccagattcaccgtgattagtttcaccctagttagcttttggaactggttagttcaggtggtggtttgggcctgttgcaacgtggtgtaacgttggacagtgattggttaatatggattaattactacaactgttttactgctttcaactactgctttgaaatgccggctttatgcaaaagaacctttagcctcccttggatatatcttgcatcatacctcctcttccggtgtgacttgctgagtacagtgggtagtactcagtcttgctctcttttcccccacaccatagttgaagtccttcccagttgaagatgtctcgaagaggttggtttcgtcgctgccgtcaaggattgcctgtggaatggagtcgcccgctgcaggagtcaagtcttcaggcttagctcgcttttatctttttccgctgcatttgtaatcttttatatttttgtaagacgtggatctgtatgtcaataattgtcgtttgtgtaccctggctggtcctggacaggggtttaatgcacattcagcttagaaattctggttcgtgaatttctgggcgtgacaagttggtatcagagccgaccttgaccgtaggacaagccaaatggaaaccctaagagccctctgaaaccttttcatctgcatatgctttttgcacttggatttgtttcgggaaaaattttggggttttgttcttttgagtttgtgggaaaaatcttggtcgcttatttaattggatttctcgactagggacagtctagggtttggtaaaagtttatttggagtttatttgacagtcagttgggaatttatcgggtgatatgcattaggtcgtgtctatgttcgatggggcaatgttacgcgcaccatttttcatgcatctagtttatgcattaagctatagtttagtcagtcgcattagtgtctttatccgggttcatgaaaaatgttctatgcataaaaatcatcatgcttggctagttgtttgggccagttgttgcttggtttaaatttggatttgagcatgcattgattcctatcccttgtctaccttagaagtcagacatgttcttcgatcgcaagcgccgctccaagcttcagagtcgccgcccttagctttatcgtcttcttagttttgtttgcttgctagtttccgtgcttaggtttgttgcttgtgggttagtcggcggtcgatatcatgtgtgagtggtatgacagcctttattaggagttgtgtgcctctttttcagtgttttaatcaagattaagataattgcacttaatcttataagaaagattagtttccgagccgtctgttttcttcctttctcttatttctacctatcctcctccagatggtgaagacaaggaatgatccccgtgactccaacgacgccagtggcagcgaagagcagaccgatggagctcatgtcagtggtgcatctggcagcagatcatctccaccgcccgaaaacccaacagtcactcaaatgatgacaatgatgatgcaacagatgcagcaacattaccatcagatgttgcagcaggcgcaacagaaccagcagtttggtcctccaccatcacacgtgtccaaactgttagactttctctgtatccagccacccactttctcaaacaccaccaacccaatggaggccaacgactggctccgtgctattgagaagaagctgaacctactgcaatgcaacgaccaagagaaagttgcttttgctacacaccagttgcaaggtcccgcttctgcctggtgggataactacgtggcgacccgtctagatgcaacggaggttacttgggcagagttttgtcaaagtttcaggaaggcacagattcctgaagggattatggcacaacagaagagagagttccgtgcgctccaacaaggaaccatgtcagttacagagtacttgcatgagttcaaccgccttgcacgctatgctcctgaggacgtgcgcaccgatgctgagaagcaggagaagtttttatttgggctcgacgatgaattgaccaaccagctaatctccggagtttatgaggactttgagaagcttgtggacaaggctattcgtcaggaagagcaacgcaacaaaatggaccgaaaaagaaaggcagctcagatcagctttcctcaggggaacaatcagaagcctcgcttcatgacgggacagctaggtgggccttccaccctgatcgtctgtcagcaccgtccctatcacccgagtaacttcgacaacgactacaacggtggcaggcacaacaacagtaagcagcacaaccacaactcgactccacccccactaatggcaccagctcagtcagatccgccagctgtgtcagttcagtcagaacaacccaagaagggggctgtaggaaagccaggaccctgcttcaactgtggcaagcacggccactttgctggcaagtgtccga

SEQ ID NO: 59935 - DNA, 2985 bp, Oryza sativa
ctggatgtcattcttggaatggattggttgaccagaaacaagggagtgattgactgcgcaagccgcaccatcaccctaaccaacgacaaaggggagaagatcaccttccgttccccagcgtcgcagaagtccgtagcgagtctgaatcaggctgctattgagggtcagacagaaacagtggagaaaagtcccaggaagttggaggatattcctatagtacaagagtatcctgaggtgttcccagaagacctcactacaatgccaccgaagagagaaatcgagttccgaattgatctggcacccgggactgctccaatttacaagaggccgtacagaatggcagctaatgagctagcagaggtcaagaagcaggttgacgaacagctgcagaaagggtacatccgaccgagtacttcaccttggggtgctccggtgatctttgtggagaagaaagacaggaccaagaggatgtgcgtggattatcgcgcccttaatgaggtcacaatcaagaacaaatatccgttgcccagaattgatgacctgtttgatcagctaaaaggagctaaggtgttttccaagatagacctgcgatcaggctatcatcagttgagaattcgggaagaggatattcccaagacagccttcatcactcggtatgggttgtttgagtgcacggttatgtcatttggactcaccaatgcaccggctttcttcatgaacttgatgaacaaagtgtttatggagtttcttgacaagtttgtcgtggtattcattgacgacatacttatttattcaaaatcagaagaggaacatgagcaacatcttcgtctggtacttgagaaattgaaggagcaccagttatatgccaagtttagcaagtgtgacttctggttatcggaggtcaaatttctgggtcacgtcatttctgctcaaggcgtggtagtggatccatcaaatgtggaatcagttacaaagtggaccccaccaaagacagtttctcagatccagagttttcttggacttgcgggctattaccatcggttcatcgaaaatttctctaagattgccaggcccatgacacagttgctaaagaaagatgaaaaattcaaatggtcagctgagtgcaaccaaagttttgaagaactcaagaagaagttagtctccgcaccagttctaattctgccagatcagacaaaagacttccaagtctactgtgatgcatctcgccaagggttgggatgtgtgttgatgcaagaaggcagagtggtcgcatacgcttcgcgacagttgcgtccacacgagaccaattatcccactcatgaccttgagttggcagcagtggttcatgctctgaaaatctggcggcactatcttattggcaaccgctgtgaagtttacactgatcataagagcctgaagtacatcttcacccagcccgacttaaatctccggcaacgaagatggctggagttgattaaagattatgacatggggatacactatcatccaggcaaagcaaatgtggtagcagatgctttgagcagaaaaagctattgcaatgccttatgcaccgaaggcatgtgtgacaaattgcagcaagatcttgagcacctaaatttgggcatcgtggaacacgggtacgttgctgccctagaggcacggcctacgctcgtggatcaagtcagagcagctcaggtaaatgatcctgaaatagctgagctaaaaaagaatatgagggtcggaaaagcccgagagttccatgaagatgagcatggcacaatctggttgggagaaagattgtgtgtgcctgacgacaaagaactgaaggatctcatactcacagaagctcatcaaacccagtattcaattcatcccggcagtactaaaatgtaccaagacctcaaagagaaattctggtgggctagcatgagaagagaaatagccgaattcgtcgcactctgcgatgtttgtcagcgagtcaaagcagaacatcagaggcccgcaggactgctacaaccccttcagatcccggaatggaaatgggaagaaatcggaatggatttcataacaggtttgcccagaacatcgtcagggcacgattaatctgggtggtcgtggatcgactcaccaaagttgctcattttattccagtacacactacctatactgggaaaaggttggcagagctttatctttcaagaatcatgtgtttgcatggggtacctaagaagattgtatctgatcaaggaagtcaattcacttcaaagttttggcagaaactgcaagaagaattggggactcgtttgaatttcagcacggcttatcatccacaaacagatggtcagaccgagcgagtaaatcaaatcttggaagatatgttgagagcttgtgcacttgactttggtggagcctgggataaaagtctaccgtatgcggaattctcttacaacaacagctatcagtccagtttgcaaatggcaccgtttgaagcattgtacggacgaaagtgccgcacaccacttttctgggatcaaacaggtgagcgccaactgtttgggacagaagtgttaaccgaagcagaggagaaagtcaggaccgtcagggaaagactgcgaatcgcccagtctcggcaaaagagttatgctgataaccgccgaagagagcttactttcgaagcaggggattatgtgtaccttcgtgtcactccgcttcggggagtacaccgcttccaaaccaaaggcaaattggcaccacgctttgtgggaccatacaggatcttggaacgcagaggtgaagtcgcttaccagcttgagctcccatctaatatggttggaatccacgatgtgtttcatgtatctcaattgaagaagtgtttgagggtacctgaggaacaagctagctcagagcacattgacatccaggaagatctgacttatgtggagatgccgatttgtatcctcgagactagtgagagaaggaccagaa

SEQ ID NO: 59936 - DNA, 776 bp, Oryza sativa
aaaatgtggaatggttggcctgggttggcttgggacgagttgggacccagggtcgggttgccagtttggtctgaatcatcgtaggccttgggttaaggcaggttcgtgtgggttcacggccttgattaataatcttgtatagctctaggatcgtatttacaaaatagctttgagcaactaagtgtcttttaatgctgtatactgcaaaccctaaccccttatatgataacccccttgtactcccttatatttattctgcacttgtgggtgtgtcttgttgagtacggtggttgtactcagtcttgctcaatttttcccaaacccagaataggagttcctggaagatgaaggctttggtgtctagctcatgcctgccgtcaagcgcctgtggtcgtcgccctagtcttccgctgtttcccgtttgtctttgtgtgtgctgggccttcgccgcccatgtaataaattaattatttacgcttccgcttgttaaacttttaattgtatcaacttttggtgtaccttgcctcttgggacaaggaataatgcacgcacgtaaggaacgcccgttgggttatttccggtcgtgacacagttcttgagctcattcacggagacccgcaagggaacacttgttcagaagtacaaagtaaaagtaattgctgatgttcctgggacaggttcttctaaagatggagaagtgaaacaagctccagatggctcagctcaacccgagtgataaggtgctgcagatggttttcaaggagaccaaggtgatg

SEQ ID NO: 59937 - DNA, 742 bp, Oryza sativa
aatcacaacctttttggtttcaggacaccataacttatagcctttcacactagacggataaccaagaaaaatgcacttaatagctctaggctccaatttaccattatcaacaggagcataagcagtacaaccaaatactcttaagtctgaataatttactggggaaccagaccatacctcaattggagtcttcttatcaatggcataactgggtgatcattgataagataacaagcagtggaaacagcttccgcccaaaactgtttaggcaaacctgcattagacaacatacaacgggcctttgatataattgtcctgttcatacgctcagctacgccgttttgttgaggtgtgtgaggaatggtgtagtgacgcacaatgccttcagacttgcaatatgatttaaatatcttagaacagaactccatcccattgtcagtacgaaggattttcacctttctttcagtttgtctttcaaccatagttttccactctttaaacacatcaaaagcttgatatttgtgcttcaagaaataagccaaacttttcgcgaataatcatcaacgatagtcattatgtaacgagcacctccaaaggatgtcttacgagcaggcccccataaatcagaatgcacataatcaagaataccttcagtggtatgtgtagatgtgttgaacttcaccctcttatgcttgccaaagatgcaatgctcacaaaatttgagcttcccgatgctttgtcc

SEQ ID NO: 59938 - DNA, 1107 bp, Oryza sativa
gattttgtatctcgacgacaaagtgaaggaccttgggtgtactttttccttatatttgctcgtgaattgggccacatgtgaaccgtccgatcaatctatcgttcatgtgccgcgggggattaggtgggccatcgaagcaaggccttagatgggccatcctaacctgtggcccagcaatcatcatccccttctccctctctctctctctctcaaaaaaaacaaaagaaaagaaaagaaaaacatccctttctccttcctccgatccttgtcccccaccactcttcccggcgagagctccggttaatgcggcggtttgcgtccgccgccgcttttcgcctccgtctacagatgggtaagctgtcgtttcctcctgacatatgcgagagtgcgtgaccaagcctcgccgtcgcccgtaccgccatggcgcatctgttagagcaggttagcaaactagtcagctataaacatattttaaaaagataaaaaaagagagaagagcagcgggcagcacaaacttcaagacgtaacgtgtgtatgacatgtgagaccagatattaatagtatagtaagtaactattgtatgaattggctattgtattggttatagatgatttaaagttagtagtgggctatactattaaacttgctcttattgctactgtgtcttcaatggtggcgctgacggtcggcaaagatccggtcgaatctaccaagcccgatgccacatgtatcgtcttctcaagttcctcacaccacctccgtctctcccacctccgtctctcacattattagtactggtactaagagcagtaagagcggatacaatagcagactataagccaactataaatatattttaaagagataaaaggaagagagaaaagagcagctgcagcacggactccgagacgtaatgtgtgtatgacagtcacggagctcgtggctcctcaccgggagaccgcgcagacccccctttgccagttcggccgggggcttagggtgagatctcaagctctctctgtatgtggaaagatcgcgtgcccggaagaaacgcgagacacagacgatgtatacaggttcgggccgctgggaagcgtaataccctac

SEQ ID NO: 59939 - DNA, 705 bp, Oryza sativa
caacaaacattctagatatatacaggcaacaaagcgtcaaagcaaacggcttttgatctatgtactcgggcctcgtttcagaaatgcaggaagccatagctagctgaaaccatttctttctctcttctgttttttatccttgttctcgttgtgacagatggtaacctgacggctacattgcacgggacacccgccagcgccaatatttagttttgtcgttcgtgcagcacgtaggctgataaacctgtaaccgggattactctgggctaaaatatatagtgatatgatcaaaggacatgaagtagagcattagctgatcttttggagtaccactttaatctgaagtaaatttgtgcccatttcacggtagtacatcatctttctcaaagttacttgtactacaatgatgtgctttgtctacgaggcaaaaataagataaactaccaacgattaaaatgtaatgaagggaacaatatggtgccgtttgagtttgatgaagataaagattaagtaaaaatatgctaaacaaaaaaatcatcagcacctaattaataaagttttatttattataaacaataaaaatatatttaaattaatattttagaacggccattatataaaatatttttgaaaagagtatcgtctagcaggtaaaaaaagtggtaataaaaattgagatgtactccaatttgtatgttattaatc

SEQ ID NO: 59940 - DNA, 1186 bp, Oryza sativa
gctcaatctttcccctcttcagtaagagaagctttggagaagatgtcttaggtggagtcctggcttataccccagttgagcgcctgtgaagatggagccgtaggcccgctagtccgctgctgtttatttttgattgtcaggccttaagtgcctttgtaataatgtaaatattatcgatataataaagatgtgtcttttatatcatgtttgtgtggtataccccggcttttcctgggacggggattaatacactagcgttcgggaaaaggcaattttcccggtcgcgacaagctggtatcagagccatctcgactgtaggataagccaagtggataaaacccaaggacatattttataaataaaaaaattatttgcgaaagttcctttttctccttcccctaatgctatttgcaaaaggtttactcttttctttcttcggatttcaactaagtactagatggtcagctttgcgaagaagaagatgtcgtcagttgtttgccgaagctccggaagactgcaggatccgctagcgaagcaaaggaagcagtgaagccagctgtgaagcaggagtgaagatcttggagaacccgtcgtagaacctaagccaccctatagggtagtgttgttagtcgtgtgttccttgcttgtgtgtgtagcgcgtggtttgcatcagtgggttgtgatgtaaccatgctaggttgtttgcttaatcaacttgcagaataagcctaacatacatcataacagcaaaagacttagatctgttaaggtcctatccttagttctaatctgtctctcccctttgttttccctctctccctctccaaacctttgcaacagatggctgacaatgagaaaggcaataaggtcagaagtcaggacattggtacctcaagctcccgagtgaatgaagcaccagacaccagttgtgtggcagtggtccaacacctgattaaccagaacaaattgcttatagagatactacagcagcatcggatgccaattttgaacccgagtcagatgcaacctcaagtacagttggaggcagtccaagcactcacaccacaagtcagcgcaccgccaacatcccagaaggcccctcatgccatgccacatgttgacccaaaagaagcaagtatcatctgttttatgtgtgatgagcaagggcactacgcaaggaactgtc

SEQ ID NO: 59941 - DNA, 1414 bp, Oryza sativa
ggcctgggggcctgagcgacgatgacgggcgagctccggcagcggcgagctctggtggtcgcgcgctggggcctgggggacgccgacgggccggcgctggtgggaggcggcgacggaggctggcggaggagggacggcggacggcaggcggcgctggcggtcgcgcggcgagggacggcaggccgcgcgcccgccggaggaggagggacggagggacggcaggcggcgctggcggtagcgcggcgagggcggtggcggcttaggtcgctggggggaggaggactggagccgactagtatacctggccaaatgggccgggccaaggcgtgccggcccgagcacggcagcactgtagccggcccaggaacggcacggcacgcccgctcgtgggccgtgccggcacgacccgttcagccgtgccgtgcttggcccgacgtctgagcccatgggccggtacggcaccgcacggttgccatcgggtcggcacgtcaacgccacatcagcaaaaccgccatccaaaaccgctgagggagtcaaattgcactagtttgaatagttcggggagtcatcctatccggttttacggttgagggtcacggattagattcgggtgacttttaagggagtcaaagtggacttttttccttttattaaatttaacattgaacatattttgataatatgtttattttatgttgaaaatgctagtatatttttttataaagttggtcaaacttggataaaaataaaagcaacttataaggacaagttcactgtacttctttgcttgataatactaagttcataaaactacatatacatgggcctccgcgtaatgacgctagcgtacacagaaaaatacaatcatcacatatataagcagcttcagcagtcagcatttcgcaacgtgcatactactagtactaagttactggtagctaaagctctgaaacaggctaatgctttcgtcgtcatcgtcctcttcagcttcagagattgcagtcagatcagatgacagatggtaaggctctactccaaggggttgctcatcatcacagaagaatggcttgggaggaacttggagatcatcgctgccaccttcaagcatctctatcacctcgctcatcgtcggtcgatcagatgacctcatctgaatgcaccgtaatccaacaacgcaaagctccttctccagctcatgcatgtcgacaatgtcagagatctcacatgtttctcgtcgagtcaactgcttgtacacccgggatggatagtatgcctgacttgagtttgctgcattcggatctgcatttcttcttcctccggccatttctagtagcagcatcccaaagctatacacatcagatttgcttgatatggtaccaaagctccgagagatcatctcaggagctatgtaacc

SEQ ID NO: 59942 - DNA, 2393 bp, Oryza sativa
  unsure (1)..(2393): unsure at all n locations
cagcgtgtgaaatacagttcgctccagaaaatagcacggggcatattgggaatgcttgcgccggttatatgctcgttgaagtacctgcagatcacaccattttacaggatgggttaagcgaaggaaacgcgtctttctccatagacactacagaatttatgagggaaacaaaaaaaacagctcacacgagggtcgagagtattcatgccatacgtatttgagagcagactgaccttactgaattgttgaggcattccttggtgctgatatgatgattgaggtggtgtttggatccagggacttaactttagtccctgtttttagacactaatttagagtattaaatatagactacttacaaaactaattatataaatgaaagctaattcacgagacaaattttttaagcctaattaatccacaattagagaatgtttactgtagcatcacataggctaatcatggattagttaggctcaatagattcgtctcgcgaattagtccaagattatggatgagttttattaatagtctacgtttaatatttataattaatattcaaacatccgatgtgatagagacttaaaagttttagtcccatctaaacagggcctgagggaactatgatccattgggaatcgaacacgaaaccccttccctatgaatccaatgatatcagtataacttgcattttgtagctgtgagactgatatatgttgagtatcaaagggaatcatggacaagtatcgacaagaaggttgaagctctccaattgtacagccataaaactcgttgagataaacaaaagaattgttggtaggcaggcaagagacgggcctgtaccatggactagtagtatcttgtattggtctggaacaattcacaaagcatgcccaagcactgtctgaagaagtagccaaatcgagaaagccataagaatcagttgtagtacggtccaacagatcgtcagtactgtaaggagggtgatcggatggaggaagagggcagctgctatcatcatcctgcatggtggcgtcggtgaccaagaaggacagatcggtgtagttgatgctactcacgtagtatgttcttgtgttgatctgaatggtggccttgccagtgttgctgcaggacaggtcataccatggacggggagcagcaacgcaatcgcgcgaatcgccttgaagacggaaagggtaggatatgttgtgaagatcaccacaggaggaaggaggacagtagtggttgttgctttgccctcctccaacatctgctgcaacaagcaaagaagaagagatcactagagctgtctgcaaggtgtaggtaatactactgctactaatggagctcgccatggctgcaggggcctgcaggctgcagcttcaagacctggatgaatgacttatgacttatgaccgcgagtggacgaactgcagcagtagtactagtcaaagttggacggccacaccagtcgtccaggcacagatgagacacgctcctacacgaattattgggatattatatttgcgttaatggctcttcttcgcctccatgggtcagacagacagaaacgaatagtccagtcaagatgagctctgagcttgctcttgttgcaggaccctgcttgctgctgctgtcgtctctgcttctgcagctgcaggccacggcatgggaagacaaggatttctcagctactgcccgccgtcgcggtgcagcgagcatggccccgagatcaggttccctttccaacttgaatccaacaatactacaccatcctcatgtagcgtaccatgcatgaagctagcatgctccggccaagacaccatcttagatagcagatactcgtaccttggaagcccatacaaggtgaccgccatagattacaagcatactaccctcaccatcatccctatcggagacttggattcatgtccgcttctaaattctgtaccacttccttctcagccactccattatcattatcacggtgcaaactggagctcttgcgacatatacaattggggttctgcagccctagtaagctgttctcaagagttgacacaaactgatatcccttccactcatattgctggcccaatctcttgcctgtccaccaactcaactcacttctcctatttggtggcttatgatgtgcctacgtgtcttattccaatccagtgcgaggtcatctcagatggccccattccgataccatattttactctggccatgcctcgctcaccttcaggcaaagtgtcagaaagaatcccctcaatttntgctgacacgacggtctattggagatccttcgcaaacccagccgcttacaattgctcacagtgtgaacaacaaggccgacgctgcgcatacagctcacaaagaaatcaaacatt

SEQ ID NO: 59943 - DNA, 1132 bp, Oryza sativa
gtagggcatgcccgcaccaaatcctgcacgagctgtttcatgttaggaaaatgaaaatcacgccgcagccggtgcagcgtgcgctggacgccttcgtgtccttcctcgtggacagccgccatgagctccggcagcagaggcgaggccgggggaatgtacagccgcccgctgtactggatcatcccgtccacggccgcccacggcagagcttgggagcccgaggtgagctcttcatgcatggcgacgagggccgggtcagtggtttgcgcgtggcggagcctgtcgacgaagtcaaagcgtggggccgagagcgccaagatggtgccatcctccggtgtgtcccggcgcgacagcgcgtccgctacggcattggcatgtcccggcttgtactcgacggtgaagtcgaacccgagaagcttccccacccagtgatgctgaggaatcgtcgcgagcctctgatcgagcaggtacttgaggctgtagtggtcggtcttgacgacgaagcggcgcccccacaagtacggccgccagtgacgtacagcgtgcacgaagccgatcagctcacgctcgtatgctgcgagcgcgcgatggcggggtgccaccggcctactgaagaaggcaacagggtggctgtcctggacgagcaccgctccgaagccatgagacgaagcgtcgcattcgacgatgaagggcttggagaagtccggcatggcgagcaccggggcggtggtgactgctgccttgagcgcgtcgaacgccgttgcggcctcccctgaccaggagaaactatctttcttgaggagggcggtgaggggcgcggcgatggcgccgtagttgtgcacaaacttgcggtagtagcccgccaagccgaggaagctgcggactgcgcgcgccgagcgtggcgccggccaatcccgcacagcctgcaccttggccgggtccatggcgacgcccgcctcagagatgacgtggccgaggtacgcgacgacgcgctggcgaaggcgcacttggcgcgcttgaggaagagctggtgccgctgaagctcgctgaggacggcgcggatgtggcgcagatgatccgcccaggtcttgctgtaaattagtatatcatcaaaaaacacaagaacgaaacg

SEQ ID NO: 59944 - DNA, 1812 bp, Oryza sativa
ctgcaccccttgcacatgactacggcctttcacccacagtcagatgggcagtcagagtccgccaaccgcgtcattgtcatgtacctgcggtgcctcactggtgatcgaccgcggcagtggctccagtggcttccgtgggcggagtacgtcttcaacaccgcctaccaaacgtcactgcgggacacaccgttccgcgtcgtctacggccgcgatcccccatccatccggtcatatgagcccggagacaccagggtggccgccgtcgccaagaccatggaagagcgggataagttcctcgctgacattcgcagccgccttgaacaagcacaggcgacccagaagcgccactatgacaaggcacatcgccatgtcacgtaccaggtgggtgactgggccctactacgcctcaggcagcgcgcggcatcttcactgccacagaccgtcgccggcaagctgaggccccgcttctacggccctaccgcatcaccgagctcatcaacgacgtcgcggttcgcctcgctctgccaccccgagctcgtctgcacgacgttttccacatcggcctcctcaagaagttccatggctccccgccggatgctccaccgcccctgcctgctgttcaccatggtgccgtggtcccggagccggaacgagccgtcaagacgcgcctcgcacgtggtgtgcgccagctgctgatccaatggaagggagagtccccagcttcggcgacgtgggaagacgccgacgctttcatcgccaagtaccccgacttccagctcggggacgagctggctctcgatgaggggggagatgtcatgtggggccgcacgtacgcgagacgccgtcgcgcgcgtgacgtgcgccgcgctacagagcgcgcccagcgcacagctgaggaagccaccgggagtggctaagattagaaagaagggattagtttccttgtttcttccttaattgtaggcatgttcgattcagtctgtggactatttttgagtcttgtattcggcactgtggagaaaaaaaatcaagaatcactcacctaatctcctcttctctctcccaaacctgaacctacggctgaggggtaaaacctcgccggagaagacggattccggctacgaattacgtagccgcggtccagctaccaggggccttgacgcccttgacaacctggtatcacggtcacgccgatcctcatcctcctgctccgccgacccacccaacgccgccgctccattcccagccgccgcgccaccactcagccctccaccatctccaccatcagccacctccgtcaccgcaccaatggtggaaccctccaacgccgacctcgccaagctgatcgagagcctcaccggcacgatcgccgcctgcagaccgacgtcgcgacgttgaagaaggacaaggaaaagtcctcttcctcgtctggcccgggtggcggcactgacgggcaacatcacaacgaccgacccccgaggttcctgtttacacccaaatttagcacctaggcttaaaataggaaatattgccaaaatttggaagtctaccggtttccttcgaggtaggccagtctgactgccgtgtgttgggcggtcagaccgccggttgaaggctggtcagaccggcggtatgtggccggtctgaccggcaggcccgaatccgattctgttgcgtcgggtttcgaggtttccttgctcgggaaggcatgtttcgggtttcctttggtttctaccccgagttggacgtggagaagggcctgtagagggcaagaccaacccctatataagggacaaggccggttcattgtaa

SEQ ID NO: 59945 - DNA, 1828 bp, Oryza sativa
tcctcgccgcccgagacggggacttaaacgacgtgagacggcctcgcctccgcctccgcgcccaacaccacggcgcccgcccgcgcggggccgcttcgccaatggcggcgacgcagcgtcaccgacgccattcgcgaccggtgcgcgcgcctcgcccggtggcttgctcctcagccgcccgccggctgcccaaagaagtgaagagaaaagaagagagagagagagagggagaagggaaaggaggggaaagagggggaggcttacgtggccaggctggcatgtggagcccgtgtgggtcccacgctgactcagccgccacgtaggccaaaaccggggtcaaaaccaccgaaggatccattatgaccggttttgattagttaagggactccgaatatctggttttgtgattaggggacgttttttaactcggtgacaagttgagggaccttcggtgtactttttccgcaaatataatgctccaacttgatgactaataacacactagcaccagcagctagttgcttatttatagtagtatttcatacacggaaaaaattttaagcattagtaaatatcaattgttggatcgatgaatatggaataataacaaccattatttatgaacgctaattgctagctagattcatcattgtcatcacagcctagctactggctaattcagatattccatcgtcctcttctgaaattgcagtaagctcggaggagtgaaagtaagaatccatgacttgtggaggtggcatgccattgccaatgccatccccatcgcagaaaaatggtctcggaggcacttgcagcgcatccacacccccttcgagcatctctattgcctcgctcatcgtcaggcgatcgtgtgatttcatctgaatgcaccacagcccaacaaggcatagcttcctctccagctcatgcatgtcagcaacattggatatctcatcaacttgttgatctgctatcagctggtcatacacccatgctgggtagtatgccctgcttgcatttgagtttgcatttggatctgcattccttctacctccagccatctcaagcaacaacattccaaagctataaacatcggatttgtcagatataacgccaaagctccgggataccatctcaggagccatataacctactgttccccgtaaagccctatctgacacaaagctcttctcccttgggtacagttttgcgaggccaaaatcagcaacctttggaacaaagttatcatcaagaaggatgttgtgaggcttgatgtcaaagtgcagaatctgcatctcgcacccctgatgcaggtagttgatccctcttgcaatgcccaaagcgatctcattcagcttgtcccaggagaaacacttctctaatgagaagatgtatttatcaagagagccccgaggcatgtactcatagacgagcgctcttctcatttcttccgagcagaatccgaccagacgcactacattgatatggtggatccgaccgatggtggagacctcactaatgaattcatctccgttgcagttggagttaccggacaacatcttgatggcaacatgtacattgccggggagcagtacgcctttatatacagagccatagcctccttgtcctagcttgtctcgaaaatgggatgtgattgcaatgatgtcagtgtaggcgtacctcattggaccaatcatctgttgcatctggagaaacttctctaccgcatcgattgtgatccttgttttccagtacttgtgggcaaggaagatgaataccaccagcggcgccaacattaacctgaataaaactttgcagaaatgccaag

SEQ ID NO: 59946 - DNA, 1276 bp, Oryza sativa
tgcagtcaccttgcaggagcctagaactgggtgatacaggatggtgtcctgtccagaacatgataactccatgagaggtgtgccgcacgacggagattgtgatgcaaggcggagtgggaaccggacttttggtccatgtttgctgcactgatttggtggacaactcttgaagttgaagaagctctcggcatcccatgctgtggccgcatagatgagaagagatagtagcagcacaacaacaagaagtttagccatgtttctgtagtgctgttgaagattgaaggcacaaggagaaggccatgaatgtaactataatgaaatttactgggagtttatgctgtgcttgtcatgaactcatgatagcagcgtacttttggagcaatcccaaagtacaatgaaacttctgtggtcccatgttgcagtcctttttagtgtgactgcattcctggcgtcatcagaaaatgaagccgcacttccatgcaacggtgaactgttgttagtgttaaacttaaactgtgaatttgctggcagtggctagaagctattgtaaatgaccctctgcagcacagccctgtgtagtaaagatattgtgaagttcttcatagatagtttactccaatccatatccaattgtaaaagagttctccgaaagccttattctgcacactgatcttcctaattattttgtgacagatgatgggacggaccagcttcagtccaaatgtgcatctcgtcttcactctggaattccagatgaggtactccagttttatttgctctctccaaatttaccagaccacatgaattgaatcccatagttttcactgctttactgatactgatgctctaatggattgaggctggagacatgctctcttttgtcacatccaggctcgattgtttccttccccaagtcagtcaatgccatcactgtcatctgctctcagccatgtaattgttacccacccgtgtccatttgcaattgagatcctctgctgtattatccctatattgaaagtcactgacatgtgggctaagcatatagctagctagcttggacagcaggcccctctctattgtaataggcttgtttgcactgcctgtgaagctagctaccgtagcgatggctggtgcgtttcgtcgttctgctgccctgcaggccatggctgccttctctgtgcttgcacttgttgtaccagatcaggttcaggggagaggcaagtgcccatctttctcctgcggacgtcttaactatgtgcatttcccattccgtcgt

SEQ ID NO: 59947 - DNA, 832 bp, Oryza sativa
gcagtttctatgctcctattcctatattcctgtagaatgcgtatatgtgggcttgtacgatttattatcttgtgcttcatctgtatgaatgcatgcaaaaatcgagctaagctagtgttctgtgttggtcggcactgttgctatgttctttcctacgtgactgaaatctagcaattcccggttccgattcatattttgcttatctatatgcttatttgtacgacttattagcaattaaaaaaattgtagataaaaattttaaatacgggttcttagtaattcaaaagtaaatgctataaaataaaattccgtgaaaaaaccacaaaatctataagttataaaaatggtcgatttacagttataaaaatttccacgagcagaaagaagacaggcctcccgcaggtcttttttggtccaaatgcaaataaaggcccattagcggcaggagctttagggccggccccattactagccctaggccgagcttagtttctggttgcaaaccgtacggaatcccctttcctccctctcttgccacgaacccttcgccgtcgccggcgatcccaccgactcccggccgcctctgcttccccggcgatgtctcttcttagcactgcgccgtcaacgcgcgttgcccggtctatgcgtcgccttcagttctccctgcgtccttgtgagacccgagccgcaaatccaggccccaagcgagatgccatgccgagccgcaggattgacagaactcggggagatctcctgatccggtggttgttcagttcgctgccccctccttgcattgataaaggtagcccgtttcctctgcttttgattattt

SEQ ID NO: 59948 - DNA, 2495 bp, Oryza sativa
gatgaatttgtccaatggttgctacttcattgatgaattcttctccatttcctgtagtgtgttctatcattttaactgccacgggcactccgtttggtagttctcctttgtagacacttccaaatccaccctgacctaattgttccttgaagcgtcttgctatcttcttaacatcagagaaattgtaccttgtgggtttcgatgtgccgtatgtcctgaggaacatttcaaccttcaaatgtacctcctcgtcataccttgacttcagcgaaatatagagcacagtggctatgatcaatgaaagaacaacaaatgcagctgccgatgatgtagctgaataaacagagaatgggaaatcagcgcattgcaataggatagaaagctatggactagtgatcaactgattgtagttgcctgatgggtaaggcaaggtagtgtcctttttagcaaaatattgagtcagaagcgccagcaataagaactttttattgctgataagttataacagtgcttcttctctcttttgaataatgaatagagggtaggtttgaattatagcagtacctgaaatgactttgacactcgaacctgcaagtaccaaaaaagataataagatttgattgatggtttaactgataatgaacaagtacttcttgaaaaaacaatgagatccagcatagttaattagttacacaacatgtcaacagaacatggccctagtgggataggatagagttttagttttaaaggaacaactgcactatgagtctatggttatatgaatatgtttgcaatagtgaatttttccttacatcttagttagcagtatcatcataagccagttctgcatactagctctgataattttgtcattatgctagaatgccagataaggatgttagagcgagttgaggttgattgcgggttaacttatcaagggttccacatatcaactcttgtatctactgatcattcattgaagcaaccacagatctagctgcagctcctgttgtatcagttaacaaaagcaatactcaggttatatctttctcagtcaagtgctccctcgcagtctcaattatttacactttcgagctactttgtaattctagaggcagccagacgccaccttggttactcctgggtgttttgttttgtcttgcatggtttcatagttcatatgggtccatcaaactatttcatttttccaggagcacattacctcagtgtattagcaaaatcagctccagaatgagccagagtgacatcgatattcaatcattttctcttttttttttccaggattggttgtcaactggctctcctgcagttccaggatgaaccaggacagtatcgaaaatgcagccacaaaatctgacaagtcagtaatgccagaagggaatgtgattcctatggactcagcgactgaagtataatatggtctgacgtgtttacttctatggcctcatgagtcacttgatactgttggtaggtaatcttttctgttttagtttgtgtttattcctcagaaaatattcttaaggattgtatcaagtgcgtatgaactagcatgtgtactggtccgttaccaactctagcaactcgaagttctttaatttttcctttttgttatttgtgacgatgctgagctaaatatgttgatggaggatttttcttctctatgttatccaaattgtgtttcttgggtaaatatcgtgaaaaatcttaacagtatatgagattgttacatataaaaactggctggttatgcttgtttaaaaataaaaagctggctatttattaattggtgcaaaagactcagacagttattatgtgtgcaatcttttgtgtgtaacattatatcaccgtacttctcatgaaacttttggccaatttaatttcatcatttgctttctggtcctttttgtaacaatgctctagtgtcctgtatacctgaaaatatctctgagaagttccagattttattatcaaatatcaaattatcctactgatgcccgtcgaacaaatatagttctatcttcatttcactaagtattgggacatttttattggaattgtatggaaggaataatgacttaatgtgcgagaaagctagctagtaagcttcctagatggttgctaggagcagactactggcctgcaaaaataattttgcagtatatctcatgtaagattaatgatgcgagagcagcactctagtactgtatggctaaatcataatagctactccctccatttcataatatagcaacctaggaccagatgtgacacttcatagtacaatgaatctaaacagtaagcaggttcggatttgttgtactatgaagtgtctcgtccggtactagattgctatattatgggacggagggagtggaaaatagaaaagtagttcaggaaataaaactagggtgataggattggattttgagaagttagcaatggtaccgtgatgctcgcggctcatgcagaatgtt

SEQ ID NO: 59949 - DNA, 1090 bp, Oryza sativa
atatctaattaattatgcgttaatggctaagacgtatactcaattttctgttttccccttcttggtagcgcgtacgtcgtactacttataagtaggagccggccgagcgagcaacaagtagctagcttggtagcctacactagaatggaagcagctgctttgtcgaccgtcctgtgtgtgctcgcacttgtggtagcggatgcagatcatcacgtcgtccatgtccaaggacgacggcatcgtcagtgccaacctttctcctgcggccatctctcaaacataactcatccttttcgccggcgaggcgaccctcgcaggtgcggcgtctcgtcgtacgagctagactgcagcagcgatgatggcaaggccaccattcggatcaacacagggaaatactatgtgagtagcatcgactacactgcttccatcttttgggtcgtcgacgccaacctgcaggatgatgcaaacagcagctgccctcttcctcgctcggaccagctgccttacgttggtctgggtatcccaggatcacacgacagctgggacttgggccttgatgatatgattacttgggtcggctttgtcaattgttcgcaggaactaattacgaacagtagtagcaaataccagcccatgaattgcctgaccacgacttcgtcctacgtttattatatgctcccatcgtttggagcaccatctatccaagacatcgaaccttcttgtggatacttggccatgactcctatcggcggtggcagtaacggtaacagcattaatctgtccgaatatgaagatgttgtaaaatccatgaggggtggatttgccgtcaaatttcctacatatggaggaccttggactacttggtatggtctcatcaaagattgcctcaacgagtctgttaggtgagcgccttaattccttataatctcgaaacctttactttatcatctgaaaagggccgattttgtttagctcttctcctccaatcccgtttaattaactctttccaataaatgatcttgcagcttagctgatagccatgacaatccattacccagagtaggcatcaaagaccggatcattgacatcc

SEQ ID NO: 59950 - DNA, 1711 bp, Oryza sativa
atctcttaaggggataccacatgtacccttccctttttaaactggacttttcttctttacataaatggacggagatttgcacggttgccctccgaacgtccttctgatgggacggcacatacctacctccacttctgccggggcaggcgcgtcgtgggaacgtggctgtgcgctgacgacatgagcagtgtcagaccggtcaccaatcggtcattcttgtccaccgcgtgtcagcttagcaacgtgcatgtttgcccttcttcacacaacatcttgcctgtaatggttaggatgaagcctggcatatatcgatcggggctaacgtgccatctctgggatgtatcacgctagctccagctggggacgagtgcctagaggctctcgtcttgacgggacggggcgaggcgtgcgtcagaccgccagtcgccacctaaccgttgatctgaccggtctgtgactggtcacagaccggataaaagagcgcgctgcattgcgctgcatgcagcgtgacacgcttgaccagaccgcaataaatgcggttaggtgagccctaccgtgttcacccaacctatgtacatagtgcaaaccccacaaggggtcggggcacctcggccctcggggccggggcaggagcaacccgaccccccctcggggaaatcaggaggagggcggacacctcaccctcgggcccgacgtccccgaaggtgccaggccacgtgggcgattccatctgcctcaagcctccgggcgcaatactcccggtcccatatcaccgacagtagcccccggcgttatgtcagggcgatcatccttctcaagggaagcggtcgggcatgacgccactcataaagcctggtgacaggtgggaccggtctccgtgattgggcagaaacccaacggtctcaaaccacgcatatcggtaatggtgtcttggccgtcagtcatgggcggtctcttcaagactgccacatcacttgagcagcgctcgaatctgggcgtgcagattcgtttcgtctggagatatggtaacgtcgcttcggtcggcgatcgtaattaacgcgcacacgatacgatctatctcgactgccacaaccgcatatccacctcatgcgccgcaagcgggcgaatggaattagtggaagcgtgggcgcgagaaacgagggagcgagatagcgagtaacgagggagcgagatagtgggcacgagaaacgaggagccgggctcagcgatgggaagggtataaagccatcgaggaaaggacttgctcccttcctttcgccactattcccctttccttcgccgtttgcgccctaaactctctctttgctgcgcctcaccttcgccacacacgctcgttctcaaccctctctttctcggacaacatggcacggggctccgctctgctcgacggtagcgtactaccgccttcccgcattgtgggcgagaggcaggctgggctgccgcgtcgcttcatgccggaatccgccaccggccgggagatagtgatgctgggcgaggcgcgcccagcaccagattacccggggcggtccatcttcttcctcccttcgcaatggccgggttggttcctcctttttcttctttctttatggatgttctggagttctacgatctccagatggcgcacctcacccccaacgcagtgatgactttggccatcttcgcgcacctgtgcgagatgttcattggggtg

SEQ ID NO: 59951 - DNA, 1036 bp, Oryza sativa
aaggactcctccccctctgctgcgatccagaccgcgcctccattctgaccatcatgatgggggtcggggcctcagaggaggtggctcctaagggccacgacggcgccggcgggagccgccaggaagaatcaaccccaggagggggccgtgcttctgggccccgcgacgggggctcggggagcaaccgccctgccgacgcccgggggaagaggaaacagggaggaacacctcccccatctcctccccgaggggacggggcggtgcgtgccagccgcaggcgcccggagggggccgcgccgacatcacagcccgagacggagcgcaagaagaagcggctccgcaagacgggggagacggaaccatcccggggaaacctgatttcccctccaaggtggtcgttcaaccgaccccctcgcaggttcgtttcacgcctttcacaaccatcttccctttatcccaatcagcaagttttctcttatccaccttgtttgtcttccggttttttcttctgcttcagcgatgtcccgtcgcgttcctcccgccatcccaagtccggccaatccgaggccgaagatccggcggccgcagaggaacggaggcgagaatctgaccggcgagaggccgcagatcgccttcgggaagctgaagaggccgcccgggaggccgctcgggttcggcaggcggaggataccgctcaggaggaggccgcccgggctcgccaagccgaagaagctgctcgggaggaggccgcccgggctcgtcaggctgaagaagccactcgggaggaaaccgcccgggctcgccaggctgaggcgatggcgtcttccgaggcggttcacgacaagaccgccggcgcgtcgctcgggcccactccctcgggtgacgctcaggcgacaacctccggggcggctcgcgacaaggccgcgggcgcatcgcctgggcccgctccctcgggcgacgcccaggaccaaacgggtccgggggacatccccgagctcagtgcgtcttctggcgggccgagccgcgtcgcattttc

SEQ ID NO: 59952 - DNA, 7761 bp, Oryza sativa
ttcttcagaaggaaaaacggcacagacacaacctttaggaaattgaaactgcttttattgaaatgctgaaataagaaaagtaaggctgtgcatgtgtggtagcccccggctaaccctgcacacccgaggggggtgcggggttagcccgagcccgaaacctgacacccgacccccccctcaggggtagaagcgacgaaggtgttcgatgttccacgggtttggcagctcagtgccgtcgcccgtggccagccgtacggagcccggccgggggacaccgatcactcgatacggaccctcccacattggtgagagcttgctcagtccagcacgcgtttggacgcggcgtaggacgaggtcgtcgacgcagagtgatcgggcccggacgtggcgctgatggtagcgccgcaggctctgctggtagcgcgcggctcggagggccgcgcgccgccttcgctcttccaagtagtcgaggtcatctctacgaagctgatcttgatcagcctcacagtacatggtggcccgaggagacctcagggtgagctcggatgggagaaccgcttctgcgccgtagacgaggaagaaaggcgtttccccggtcgctcggcttggtgtggttcggtttgcccagagcaccgctggtaactcctcgatccatgaatcgccgtgcttcttgagaatattgaaggtcttggttttaaggcctttgaggatttctgcattggcgcgctccacttggccattgcttctggggtgggcaggtgaggcgaagcagagcttgatgcccatgtcttcgcagtagtcgccgaagagttcactagtgaattgggtgccattatccgtaataatacggttaggcactccaaaacgggccgtgatgcccttaatgaatttaagagcagagtgcttatcgatcttgacaaccggataagcctcgggccacttagtgaacttgtcgatcgcaacatacagatactcaaacccgcccggggcccgtttgaacggtcccaggatatcaagtccccagacagcaaatggccatgacagtggtatgatctgcagggcctgggccggctgatggatttgcttggcgtggaactgacacgctctgcatcgccggaccagatcgactgcatcattgagagctgtcggccaataaaatccttgacgaaaggccttgccaaccagggtgcgcgaggcggaatgggctccgcactcgccctcatggatgtcagcaagaagctcaacgccttgttcctgaggaatgcacttcaggaggattccgttagccgcgcgccgatagagggtcccttctaccagcacgtagcgtttggaaatgcgttgtacgcgttcactcccttcgcggtcctcaggtagagtcttatctgtgaggtatgtttggatctcagagatccaagcaatcaatctaagggagcttggagcgctcccttcgggtcccgaggccaggactccgacgggcctcgggggccggtcaggcgcatccgtctcccctaaggggtcgggtcgcgccgacggctgggtaagcctttcttcaaaggcgcccggtggggtctgggctcgcgaggacgcgagccgtgagagttcgtcggctatcatgttatcccgtctgggcacatgccgaagctctatcccgtcaaaatggcgctccatacgccgcacttggtgtacataggcgtccatttgcgggtcagagcaccggtactccttacagacctggttaacgaccagctgggaatcgcctaacaccaggagacggcggatccccagtccggctgccaccctgagtccggcaaggagtccctcgtactctgccatattattggtcgctcgaaagtcgaggcggactagatatctaaggacgtctccggtcggggaggtcaaagtgacccccgcaccggcaccctggagggacagagaaccatcgaactgcatcacccagtgggtggtgtgaggcagctgcgaggagttcgtgctggcctcggggattgagacggtctctggagccggggtccactctgccacaaaatcggcgagggtctggctcttgatagcgtggcgtggttcaaagtgcagatcgaactcagaaagctcgattgcccattttaccacccgtcctgtaccctctcgattatacaagatttgaccgaggggataagacgtaaccacagtgaccctatgtgcctgaaaataatggcgcagtttcctcgaggccatcagaatagcgtaaagcatcttctgggcctgagggtatcgggtcttagcgtcccggagggcctcactaacaaagtagacaggccgctgcacccttcggtggggccgatcctctttgctaggggccgtatccccggggcgttcttcattcaagtggcctttcggggcgcacttgtcttctgtgccgatgacctcggggtcggaggatgaaaggggcggccttccctcagtggcctcggggccgtcctgggggtcgggggctcctggcatcgtcggacaagcaggcaaagggccaactccggtcgtcaggggcctctggcctccgttcggctcgggggcctcttctccctgctctttcccgggtcgagtcagcacagggttagcctcggggtcaaagggcgttaagtgcggccttcccgcagtggccttggggccctcctgagggtcgggggcacctagcaccgtctgacaagcgggcagagggccgactccggtcgtcaggggccgtaggccaccgtccgactcgggggcctctcctccccgctcgctcccgggccaagttagcacagaatgggggtgcacgaaatgaggattgttttcatcgcgctccacaaccaacgctgcactaactacttggggggtcgccgctaagtaaagtagcaggggctcatttggctccggggcgactagaaccgggggagagctgagatatgcctttaactgagtgagggcatgttcagcttcctccgtccaagtaaacggccccgagcgcttgaggagcttaaacaagggtagcgccttctctcccagccttgatatgaaacgacttagggcggccatgcaaccggtgacgcattgcacatccctaagtttgctgggggggcgcatccgctcgatagctcgaatcttctcggggttggcctcaatgcctcgggcagagaccaagaacccgagaagcttgcccgcaggtacaccaaacacacacttatcggggttcagctttatgcgggcggagcggaggttctcaaaagtttccgctagatctgaaagtaaagtttcttggttgcgcgtttttacaaccaagtcatcgacataagcctcaacattacgtcctatttggctacccaaagaaattcgagtagtacgttgaaaagtaggacctgcattctttaacccgaagggcattgatgtataacaataggttcctacgggggtaatgaacgcagttttttcctcatcctccctagccatgcgaatctgatggtaaccagagtatgcatctagaaaacacaaaaggtcgcaccccgcagtggagtcgacgatctgatctatgcgaggcagggggtaaggatccttaggacatgccttgttaaggtcggtgtagtcgatgcacatccgaagcttgccgttcgccttgggaacgaccaccgggttcgccagccactccggatggatgacttcacggatgaatccggcctccagaagtctcgccacctcctcgcggatgaaggcttgacgttccggggcctgccgccgcactttctgccggaccggccttgcgcccggccgcacggcgagacggtgctcaatcacctccctggggaccccgggcatgtccgctggtctccatgcgaagacgtcagtgtttgcccgcaggaaggagacgagcgcgtcttcctatttgccatccagaagaccaccgatccgtgtggtcttggatgggccgtcgcccaaggcaacctccttgaccgggacctcgtcgcatgtggcaatccgctgcctcggggcggtgggggcggaggtgccaagcctctcgtcaccaccctcgggcttggtcgcagcagcgaggtggtccgcgcgctgctccatgcaagcgagcgcgactttaaggtcgccacggatagagatggggccaccggggcccggcatcttcatctggaggtaggcgtagtggaccgccgccataaacttcaccaacgcgggcctccccaggaccgcgttgtagggcagactgaggtccgccacatcgaagttcacccgctccgtgcggaagttggctgatccaccaaaggtgaccggtaggtcgatgtgacctaacggccatgtgtgccccggcgtcacaccgatgatcggttgagacggctggagcaccatccccggggccttgatagcatcaaaggccgcgggggaaaggatgttgagagccgctcctccatctatgaggacacgccccaacttcacattgcagatggtgggggaaaccaccatcgcaatctgccctccccgggcaacgcacggtgggtggtcggtctggtcaaaggtgagggccacctccgaccaccgcgcccgacgtgtcgcctcatgagtaggggccgcggcgagaagctctcgcctcatggccttgaaactccggtgagaaacgtgagcacacgctcccccatcgacagtggcaatggtggccccaggttcttggaaacctaggtcatcatcaccgtcatcgatgtcaacggcgggggccttctgtttggcctcacttcgccgtttaccggagggaactgccgcggacttgccctcacggcgttcctgcctcctgtcctcctcccacttcctcgttcgctcagccaagtttttgactgcgcgacaatccgcgagatcgtggagggaggtgttgtggacggagcaccacttgctggctgggcgctccctgctgggagtaccagcctctttctttttgtcgctcgcaggcctcccctttcgggtggcccgcggaacgccctcgacggcgaggacgtgaccctcgtcgccggaatggaccgaccttttcttcctcctcctgtcacgccgccctgtctgagcggcggatccgggggcggccgaagctgccacaccggaaccggaggggttccaggtccaggcctcctccttacgagccactcggtccgcgagctgaaaaagctctgcggtagtctggggctctttggaggcaatcttttcgagcatgcggttgtgccgcacaccccccctgaacgcgtagatcaccgcgtgtgcagggatgcaaggtatagtattgcggacttggcagaaacgctgaatgtacgagcgaagtgattcatcatcccctcgctgtactgcgtgcaagtccgcttcttcacctgggcgtggataagtgccttgaaagttcatggtgaactgctggcacaaatcctcccaggagtggaccgacgcgggcggcaggttcattagccaaccccgcgcctgtcccttcagggccatgggaaagaaattcgccatgactctgtcgtcacccccagcggcctcaatcccggtcgtatagacctggagaaactcggtggggttgacactcccgtcatacttctcggtgatggtgggccggaaccttgggggccaacggacattccgaagactcgccacaaaggctctacagccgacaccaccagccgggggcatggagggctggtcctcacgtccctgtcgaggtgacactctggacgaagaggcgccctccgttgcgcggggagtacgccggctattacgccgacgctcgatgtcgaggcgggcatccggctctccatgccgatcctcccgagtcggaggtgccgacgagggagtggcagccgaatggcgtgcaacagccgccgctcgccgcgccctccgtctcgacgacgcggaaccggtagtggcggcgccggaggtcttggtggtggcggaccgtccaccagcacccaggcgctgctgtgccgtcatgaccaagttggccacgtcgtccagccatcgctgggctggagactccgggtcagggacgacaggcgggtgacgtaggagcgcgccaacagcctgaagcgcgccctgaggcgtgctgccgtcaccgtagacgaggaggcgacgctccccatctcgccgttctcctgcaccacccgcgactggcgatgctgcggatttttcgactctctcgagtgcctccccctgcttaggattttggtgtggaggaggtgggggagtacgagctcgacggcgtgggtttggctccccgtcgtcgccgctcacactcggagagaggtcgtgcacctttgcttgctcggccattaggctgaacaagaaaaacttggcgcacacggaagagtatgagagctcagaaaacacacgctgagccccctacctggcgcgccagatgacggagctcgtggctcctcaccgggagaccgcgcaggcccccctttgccagttcggccgggggcttagggtgagatctcaagctctctctgtatgtggaaagatcgcgtgcccggaagaaacgcgagacacagacgatgtatacaggttcgggccgctgggaagcgtaataccctactcctgtgtttttggtggatctgtgtaagagcaagttacaaaatatcaaccagccctctcctctcccgggaaaatcaaaatccccccttctcttcgtgggcatggtccttttatctcttaaggggataccacatgtacccttccctttttaaactggacttttcttctttacataaatgtcacgtcctgataaattcatcccaaaataaaaatcatcttctaaaaggaataatagaattaattaaaattcgaaaagaaattggcaaacattaaaatacgtacaagaaaaattcaaatgtgacccggagaatttttgttaaattctccttggtctaaaaggagccctcaaattttagtggaattttcagagcacaaataataattgagaagaaataaacaaagttgaaaaggtttataaaaaagaaaaaccctaaaagtcttctccccccccttcctctcttgggccggctcggcccaactctccctccctctctctcctctccccgcggcccatcagctcccccgcgcgcgcgcgccgctgacaggcgggcccgcccgccactctcgctgacgggtgggacccacttgtcatcgccttcctcccgccgcgccgccgccagcccgtgccctagcgccgccgccgccgcgaatctcgccgtttcccgccgtccccgcgcgcattaaagagggggaaaatcacccccgtgattccctctcccgtttcccccccttttccctctctctctccctcggattcgtccggattcaccccgcgaagttcgccggcgtcttcaatggcgcccgagatctccgcgcgcggtttcctctctccccggccgcgctctccccctcccgttgctatatatttgctccccgtgcttcgctcttccgtttccgccgctcgccgctcgctctcgccgtcggattcgtgctcgcgccgtgctcctctctctccgccgtcgccgtcgaccttcggctcgccgccgacgtcgctccggtctccctcccgactcggcgacacctccatccgcttcgccgtgttgccgccgaccccgtccgccgctccgcttcgtccgccgactgccggagcaccgtcgccctcggcatcccgaaccgcgccgtcgccttcctccgctctggttcgccgccgtcgtcgctccggtc

SEQ ID NO: 59953 - DNA, 703 bp, Oryza sativa
acacaaatcttcgatggttctagttacgttttattttcattgagtgagtaacaaacttgccatgcatctaaccaagtttctgtgcgtttttcaaaagtgtattttgaactcggtagctacaagcgatgggatcaacggtgcaatatgtgcacaaggccgtgaatacgcggccgatgacacgggctttgcctttgtcaattgtcgcatcaccggcagtgggctgattttattgggccgtgcatggaggccctactcccgcgtggtcttcgcgcacacggacatgcccggtatcattgtgccgagggttggagcgactgggacgacccgcaacgagatgcgtacgtattctttctactactacttccgtttcattttatattagctgtatgtttctaaacatgtatactacggttttatttgttttaacagcacgatgttctacggtgaatacatgtgtacgggtgtgggcgccaacatgaccggtagagtaccatatgccaaaccgctgacggagcagcaggcgcagatatacctggacgcttcctacgtggacgcggatggtggttaaaaccgttcaacgattctcttatagttaattgagtacaataccatgtaaataatggcgggggtgcaattctttgtacttaacacggttgtttagtactactaagggaccacctatatattcgtcgataaattttct

SEQ ID NO: 59954 - DNA, 1688 bp, Oryza sativa
ccccgtgcgtgcagtgtgaccgtgccagtacatgcagccgttgcaccaacttccactgttactactagctaaggagtagtagagagtactgtagtaaaggttttctgcgagaattcgttgacaaattaaatccatcatcaacttctacatgaagcacgcactgtacatagcggtggaactagtggagtgcatgtacgagagacatcatgggcaactaatctcgcgcgctaaaacattttgtatagatcggttggttgttaatgcgagtgacacatgtgattgctcaaccagacatgcaaattaaatccactgttccaatcacaaatcatcaatacagaacacagtgaaatccgccgacacgctccgctcgatccgagctcgatatggtcgatcaacaacacatctgcgttgcattcatccatgtttgcatcgtcttcttcttttttgttttttgaaagattattcatgcatccatgcttgctcgttcccggaatcatggcatcgtcgtgcatgtgagccagttaatcaacctgctggtgtgacgaagctcgaatccacatttgctcctgaagggcaaagtatagtgatagacgtacgtgaggcttgcttgctcgtatatgctataataaatttattattaatggtcagcgtggtacctgtaattattgtcagctgcacgatactcctacccccaacgccaacgacctctctatgcatgtgcaaggggaatttgcgagtgagtttactaatccaaagtcaaattcctcatgtctccaaatcatcattccttaattaacaacgcaatccgatcatttcgtgtataatgagacgaaaaaaaaaattcccgtattagattaaggccttatctagttggggaaaaattttagatttggttgtcacatcggatatacggacacacatttaaagtattaaacgtaatctaataacaaaacaaattacagattccgccagaaaaccgcgagacgaatttattaagcctaattaatccatcattagcaaatgtttactgtagcaccacattgtcaaatcatggcacaattatgtttaaaagattcattttgcaatttatacacaaactatttagttgatttttttccacatttaatactccatgcgtgtgtcaaacattcgatgtgatgggtaaaaagtttatgttatgggaactaaacaagacctaaattcccccgaaattcttgtgttacgaaaggaggctctgaactccgattcatgcaccatccaaagctgtggctaatcaaccgttcaacaaattaaatccaacagttcttaaaaaaaatccgacatgagacattttaagtggagtgtagttttggagtttttttttctcccattggatacaccataaagtgtagtggatcaaggggccgacatggttgatgcgtgtctgatgaagttcataaattctcggagatgagatattgaaggcgcgtacagcatgcgtacaggaagcccattacgctggccacggtacctttgctctctctgacaacgatccacgccgttttatctagttggtaagaatacccaatgcatggattaaaatgaaagcaactttcaatgatctgtataaatttccatggacactatggccttggcatgcatgcgtgtagaaacagaggtacatacacgtacatgtatatatgtaccaa

SEQ ID NO: 59955 - DNA, 704 bp, Oryza sativa
ttctcccatagccactttagattgatctttatctaagcacttcaacaagacaccatctatgtttcggcgatacaaatctccttccacaaattccttcatgtatttctcccatagccactttagattgatctttatctaagtactcaacaagacaccatctatgtttcgacgatacaaatctccatcaagcaatgtatatttgaatgcttgccgccgaatttttcgatcaaccttaaatgtgggatctttcaaatattgaatcaaaggaattctcgaatcctcttctgtatcctggacacaaacgtccgaattcacaattaattcggcttcaaaattacttgaaacgtgccccccagcattctgcctagaaccggtcagaccggccacacagggccggtcagaccgctcagggatgccggtcagaccggcggcatgtggccggtcagaccgcccctggtcacggtcagaccggccgtgcaacgtcggtcagaccgcctctggtccccaactttgccaattttgcgcaaaaatttaaaatcaagcaccggctcttctaatatcagaaataaccccctttttacattataaccagatgtttgttgtgccaagtcatttgctctaaaattatcacacctagcaatatgtctaatagcaaaattatcaaaattggcaataatatctaaacatgaatcgaggtacctatt

SEQ ID NO: 59956 - DNA, 2045 bp, Oryza sativa
tgccttctctatggatttaggcctccatactggtggtggtcgcaactcattgaaccttttatcccttttctcttcggcctttttctcccttaattcttgggcccgaagacgttgcaaccttctcttttgtgtagccgtcaaatccttaggcatccacctaggattcggctctgttccaggaggtaaataatgtcctttattaaccttgtttgaagacgatgaagcccttacatcgccttttgcaactctcccgtcaaaccggcgctggaaaccggtcagaccggcagcagaccgccggtcagaccggccagatgcgccggttagatcgacgttagacacacggtcagaccggcctgaggcgtcggtcagaccgtcgtcagatcggcggtcagaccggccagatggcccggtcggaccggcaacatggccgcggtcagaccggccagaaagcctggtcagaccggccgactgcaaggagctagaaccggcttcggactttttacttggggactttccaactccatcttcggaaggtataggcacatcatgggatcctatcttgatggtaatcacctccgaagtcctctcttctatcttgacgcgctttccttccctcttctcttcattaacccgatttttaccataaaatcggcttttgtttggtgaagataaacgctcatgaattggcctccgtggtcctccccatccttggttgaatctcattggcggcatatgattgtacattggcggcgttgccccccctggcataaagtaaggataaggataacccggcggcggcattggataaggaccccatgacatgtcttgtggatgaaaatatggaggtgaacatgaccgtcttggcgaatgaccaaatcgctccctaggaggtgatcttggtcttttccctttgttgtgatccctctcaccaccttgcctctcatacttttccaaaagcatatcaaaagtcactttggtctttctaggggccttagaagtcgaagcttcacccttattctccttccaaacgccaatctcctgcttctttggcaccatcatcttaggccttggctcaccaatgaccactttctttcccttggtagattcggcttgctccggccgaatcaacaccttcttattattgaaattaattgtattcaccggaaaaggatcatgatcaaacttcatcttggagccatcggtgaatttcaatcgtccctcatctatggccgattgaacctgtcgtcgaaacacattgcaatcattagtagagtgagaatgagaattatgccatttacaatatgctcgacgcttcttgagaaggtatgacatggcctttaggtaatctaatttgcttctcttgcaaaagataatcaaaatcttatcacacttagccacatcaaaactatatttaacctcactttgccgatctttacgaagagtcggcattaagttagaacaaacaaaaggtttatttttgttagtccatgaccattcggcaacataaatatcatgatcaccctcctcctcactatcactagcatcagagtaatcaactgcattaacattaggatttttgtctaatggtctagcaaattttttattatctttaacctggctttcttgagccagagccctttacataagttgactaacatcaagaaattgttggccatctagtttttctctaagaggagcaactaaaccattaaaagcaagaccggccaaatctctatcagttatattcaaagtataacatcggtttctaacatctctaaaactcttaatataatcaacaacagattcattatacttttgcttaaccgatgttaaatcacataacctaagctcatcttctccagtatagaaataatcatgaaatcgcccctctaattgagaccaagtatgaataaaattcgcccgaaagaagtaaaccatgtaaaagcattaccggataaacataaagaaaacaagcccaatttaaaagtttcactattagcctcaccacattgcgctaaaaattgacctacatgttcccatgtggt

SEQ ID NO: 59957 - DNA, 2500 bp, Oryza sativa
  unsure (1)..(2500): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggtgttagaaatggtgagtgggaggaggaacacagaaccaaccgttgagaaccaaaatgagttctactttcctgagtggatatatgagagagttatgaatgggcaggacctggtgcttaccatggagacaacacaaggcgagaaagaaatggtgagacagctagctattgtagcgttatggtgcattcagtggaacccaaaaaaccggccctcaatgacaaaggtggtaaacatgttgacggggaggttgcagaatctgcaggtgccccctaagccctttacatcgtctcaaaatcaacttgtgatttagatcatgagaccgcatcgccatggtttggactttggagaccagcaaagcaatggagcttggccagcatttcctataaaaaggcatcaccatggtttggtgcctgagtgagagatatgcttaatccacatatcagaaaatagttcttagtgagctgaagcatgcacatatagtgtttgattattaaactaaactgggcaaccagatatatgatatatcaccatgtactcttgtaatttgcaacatatctcaatggatttaatttgcaatataataatagttggaagatgacaactaaattaccttattccatcgttgatgctagtccactaatcatccttgctgaacaccaacaataaggtcatatttactcccagtgctgcattttcttttcaagataaaaaaagaagtgctgcatcatccagaagaggaaaaaaaataaaaataacaaaggaaggaagctaagcaaagggattattaccaaggcagcgaggctctggatggacatggactaataatgtgggagacggaggtggtgtgagcgacttgagaagacgaaacatgtggcatcaggcttggtggattcgaccggatctttgccggccgtcagcgccaccattgaagacacggtagcaacaacagatggcgccatggcggtacgggcgacggcgaggcttggtcacgcactctcgcatatgccgggaggaaacggcagcttacccatctgtctacggaggcgagaagcggcggcggaggcggctcgcggaacggcataccgccgcattaaccggagctctcgccgggaatagtggtgagggacggaggaagaagaaggggatttttttttttttgttggagagagggagaaggggatgattgctcggccacaggccggttaggatggcccacctaatcccccgcggcccatgaacggtggattgatctgacggttcacatgtagcccaattcacgagcaaatataatgcggaataagttcaccagaggtccctcaacttaacagcgtgatttttttgaggtcccttaaccacaaaaccagaaatgtctacccctaaacttactcaaaccgttcaccagaggtccctcggcggtatttttgcccggttttgctgacgtggcatcctagtcagcaaaaaaatttaaaaaaagtacgtagagcccacatgtcagctgcacatctttttttcttctcttttcttctccttctcttctcttttcttctctcccctctcttctccttcaggctggcggcggacgcagctgcgatggccgtgctcggccgccaccaccgccgtacccccgcgggtggccgacgatgctaggagaggcaccaccggcgggagaaggggaagaggcagaggaagagattgtttcttggtcgccggccgcctccccctccctcccaaactcgctggccgccgcgctcgctcgccgctgctctgccgcgcgctcgcgctccgctactctgtccgcggcctgctcgcgctccactgctcgacccgccgctgcgctcgcaccttccgctgctccgttgccacgctcgccctcgttgcgccgcccgcatccgtgctcgccgctccgccgccgcgctccgctgcctccgctcagccgccggacgaccgcaccgcgtagcctcgcccatggcgacgacgacggtagagagccgatgacgacggcggccacggcgcgcggctcctccgtccgcagcctgaaggagaagagaagagagagaaaagaaaagaaaagagaagaggaaagagaagaagaaaaagatgtgcggctgacatgtgggccccacgtgttttttaaaattttttttgctgactatgatgccacgtcagcaaaaccgggcaaaaatattgccaagggacctccggtgaacggtttgagtgagtttaggggtacacatttctg

SEQ ID NO: 59958 - DNA, 7462 bp, Oryza sativa
ttatttatgaacgctaattgctagctagatacatcattttcatcacagcctaactactggctaattcagctattccatcgtcctcttctgaaattgcagaaagatcggaggagtgaaagtaagaatccatgacttgtggaggtggcatgccatccccatcgcagaaaaatggtctcagaggcacttgcagcgcatccacacccccttcgagcatctctattgcctcactcatcgtcggccgatcgtgtgatttcatctgaatgcaccacagcccaacaaggcacaacttcctctctagctcatgcatgttggcaaagttggatatctcatcaacttgttgatctgctattagcttatcataaacccatgatgggtagtatgccttacttgcactggaatctgcatttggatctgcattccttcgtcctccgaccatctcaagcagcaacattccaaaactgtaaacatcagacttgccagatatgatgccaaagctccgggaaaccatctcaggagccatataacccactgttcctcgtaaagccctatctgacacaaagctcttgtcccttgggtacagtttagcgaggccgaaatcagcaacttttggaacaaagttatcatcaagaaggatgttgtgtggcttgatgtcaaagtgtagaatctgcatatcacacccttggtgcaggtagttgatccccctagcaatgcctagagcaatctcattgagcttgtcccatgagaatcttctctcagatgagaagatgtgtttgtctagagatcccctaggcatgtactcgtaaaccaaggcccttctcatttcctcggagcagaaccccaccaaacgcacaacattaacatggtgaatcctaccaatggtggcaacttcactgatgaattcttcgccgttgcaattagagtagccattcagtatcttgatagccacatggagatcacccgggagcagcacacccttgtatacagaaccgtagcctccttggcccaacttttctctgaaatgccctgtgattgcgataatgtcggtgtaggcataccttgtcggaccgagcatttgttgcattcggagaaatttctcgactgcatcaattgttatcattcttttcaagtacttttgtgcaaggaaaatcaatacaaccaagggtgccaacagatacctgcatggtgctgcgtacacaagttcgatcggttggaatcaagaaattgtaacatgcgtatataactagatgaaacactagaaacaattgagatgatgtgggtttataagaaaagatagaaataacattaactattaatgggataaattatatagggtagggacgtagggtcctggtcgatgacttacgtacgtgcaagcatcgtccagaacatcaaggcatacaatattatgcccaagagtatattgtatggcgatggaattttagcagttgcgcaatccatgaaattttcagtcaccgaaagactaaaccaatctgaaagtttgcctataccagtcgatttgctgcatgcaagaacaaagacggatagattcaggcatatataaatggaggggaggtcggaggaatgtgcaatcagatattatgtcaagatcaggaactcacggaatcgactccattaggcaatccttgaagcttcgatttctatggtgtctgaaaggaaattggacgcggaatcctttcctcatgaattttactacgtcttcataacttaagctatcaactgctggtgctacacgacccataccatccaaaggagtcatggctaggtaaccacaggaaggctcgaggttttcaatgtaacaggacaatctgccagtcaagacataaacgaaggagctgctggtgcccatgcaagcaacaggactgtacataacattgttgtttatttccttggaacagttgacaaagaaagaccaccaacgtgaagcagggtccaattcgacttggatgttgtatggcgatgattcttcgtcgtcactactaacatcatcatagtaataaggaatgcgtttccagcgaggaagagggcaattgttacgtgaatccgagatgttggcgtcgacaacccagaaggtggaatcactgtagtcgatgcctgtcacaaagtatgttccgttgtcgatctgaattgtagccttgtcatcggtgcaagtcagctcatacgatgcaacaccgcactcgtagcctcgccggtggaaaggagacgcgactttgctaagatggccgcaggtgaacggagggcatgcaggtattccatgaattaaaggccattctatatccggatctgggacgacaaatcgaagcacacacaggacagagaaaacttgcagggcagtcgagcgacggaagaacggaccaggaatcaccatggtgtggtgtagcagctagcttagctagttcgcccaagcagagcatgcaggagctaggtagtgacacggatgatattacaagtgtctatctccgcgcggtgcgtgcactgtatgtaagcagtgtaactagagttttccaagcaaataaatttagctaaaaagcaacacttcatgtccttgactgtgatgctgttgacttggaagtctttgatgacacgaagcagattagtctaaggcgtagcattcagttccacaagagtctaccgtgctgcatcggtcaccgtttattgatgttgccgaaaaagattggtcaaagtgcacacattaccagtcgcccgctatcacgagccttatcattaggggaacagtgcttcacgggttaatttcaaaagcccccaaagctaacatagtgtattcttctaaaactatcttaacaggacgcgactacaccgagagtgctagctatatggtgctaaagagagacacctttctttccaaaaaaaaaaagctacttatacactcaatatctatgtatttttttccttcttagagaagtttctcttaaattacttatctgatttataatccgattacgccgttgtgtttattgcaattaaatctttacaacaagatctcacatgattatattttgatgaaaaatcacaaattacttttatgatatgtctaaattacgtttacatttcactaagttacttcttaaactataaaagtaaattcagtaagtctaaaagtaatttatatatattatagaagtaacttagaacaaacgaagataactttggcatgttatttgaagtaaatccgttgtatagataaaaacatgactctatctaaaaattaaattaatcagcacaaattatggaatttactaaaaagtcatattttatccctacaacgaatttacttctaatgtcgtgacaaagttacttacattttgttttaagttacttttaaaatatatgtaaattacttttagactttattgaatttacttttatgtctaagaagtaatttagtccaatcttgtcacgtcctgataaattcatcccgaaataaaaatcatcttctaaaaggaataatagaattaattaaaattcgaaaagaaattggcaaaccttaaaatacgtacaagaaaaattcaaatgtgacccggagaatttttgttaaattctccttggtctaaaaggagccctcaaattttagtggaattttcagagcacaaataataattgagaagaaataaacaaagttgaaaaggtttataaaaagaaaaaccctaaaagaagtcttctttccccccctttcccttcttgggccggctcggcccacttctctccctccctctttctcctctcccccgcggcccatcggcctcccccgcgcgagcgccgctgacaggcgggcccgcccgccaccctcgctgacgggtgggacccacctgtcatcgcctacctcccgccgcgccgccgccgcgcccgtgccctagcgccgccgccgccgcggattccgccgcatcccgccttccccgcgcgccttaatgaggggggaatcattccccgcgattccctctcccgtttcccccgcttttccctctctctctccctcggattcgttcgaatcgcgcccgcaatcctcgccgacgtcatcaatggagcccgagaactccgcggccggtttcctttctctccggccgccttctctcccttccgacgctataaaatcgtccctcgtgcttcgctcttccgtttccgccactcgccgctcgctctcgccgtcggtttcgtgcccgcgccgtgctcctctctctccgccgtcgccgccgagctccgtttcgccgccgtcgtcgctccggtcctcctcccgactcggcgccacctccatcggcttcgccgagtgattgccgaccccgtccgccgctccgcttcgcccgccgaccgccggagcaccgtcgtcatcgtcatcccgaaccgcgccgccgctttcctccgctccggccgccgttctcgtcgtcgtcgttgtcccggggtgagccgaagaccgccgttcgctttcccccttctctccgctctctcgggcgccgctccgccgcgccgatggtcgccggcggtgaccatcggggcgcgggcgcgtccccctcccgtcggccgtgccggcgaggccgccttcgggcgcgccctcgcggctgccaagtgggcccggccgtcagccgcccgcgcccgcgggtgcggctgacgcgtgggacccacggcgccgaccgccgccagccgcgtgcgcccggtccaccgtggaccgtgcggctgacgcgtgggcccccactcccgtggacccggtccgcgcgccctccctcggctgacgcaataaatgagtttttaattaaaatttaaatgaagaaattcgcaaatatccatttaaagagcatataaacttcaaatggccatatcttggccatttgaactcggaattggaccgttcaagtctctaatttttccttaagaagtaaagaacccatttttgtgctttgtttctgctgttatgtggagtttagtagagtaaaagccttttcttttccgtcggtcgtgtagacgctgcagcttcggaagatccgctcttcgtggaagttgaagccgtcgtttgggaaagcgagcaaggcaagtcacatcacccttgagcatattgaatcccagtttataaaattattttgatttaaattattgcattatcgctttgtttaaattcccgcgttaccactgttttatttagccatgcctatttacctttgttatgacattattattgctattgttattattaccttgttcaccctaggaaaataaaaaccccaactagtgggtactctattcatggttccactagtataaatttaggtagatgcttcgctgaataattaggcaaccttaggtggttttataactttagactttgggaattctcatatcatttggacactatggaattgttggcttatgttggaattggacacacacctctcttcctctttcaaaacccctaaaacctgttttcggtggggtttgggtgcatgccagttgtgggaagtagcaccccggccactataaggattaagctcgggcctctgttgcaaagcactaccgtactaaccacatgtctaatgggtaaggcttaactcggtgctcagtctagtcctgaacaaaaggacacggatagagatggatgaagtcgttgcgacgatggatatctctgaggcaaatgaaggctacgcgagctgcggctcggtaatcgagatgtctaggcaaatgaagactacacgggtcggtgcccgttagtcgagatgccatggcactggactagtacgcgggtggtctcacccctatgtgtgtggcgcacccggtctagatcttgttgctaggggctcaaccctggcctgcctgtcccgggataccggccgtaggcagggttgggtcggtacttttgttcacggctaggatgggtgaagggttatgtcacatctttacgacgggttccaaggccatggaatgcggagtaaagatgtgtcttgtgggtaaagatgtacacctctgatcagagtaaatctattcgaatagccgagccctcggatatgggcaagcctagcaatgtacccaagtcagtgttttaattcttaaaatttgctcaacaactaaaatatggaatggttggcctgggttggcttgggacgagctggaacccaggtcgggttgccagttcggtccaaactatcgtaggccttgggttaaggcaggttcgtgagggttcacggccttgtttaataatactgtgtagctctaggatcgtctttacaaaatggctttgggcaactaagtgacttttaaatgctgtttactgcaaaacctaacccctattattatccccttgtaccccccccttgcattaatcatgcatctgccggtgtggcttgctgagtactgtggttgtactcattcttgctcaatccttcccctcttcagtaagagaagctttggagaagatgtcttaggtggagtcctggcttataccccagttgagcgcctgtgaagatggagccgtaggcccgctagtccgctgctgtttatttttgattgtcaggccttaagtgcctttgtaataatgtaaatattatcgatataataaagatgtgtcttttatatcatgtttgtgtggtgtaccccggcttttcctgggacggggattaatacactagcgttcgggaaaaggcaattttcccggtcgcgacaaatctaaaagtaacttatatatatatatgataaaagtaacttatgtatataataaaagtaatttacaaatataatttttttttcatcgtaagtgaagatttaattgtaacgaacataatagcgtaatcggattgtagatcagataagtaatttgagaggaaactttatttgaacaagaaaaaggcacccacgtgaactttatttgaaaggaaaaagacatccccgtggatggacatcatgacgacgtgcacagttagacggctctcagatgcgtcgtgctatagagctaaaccgagaacgctctcgaaatagatttcgcgatcttaatagtatacttcctccgtttcataatataagccattttaacattgtccatattcatatagatattaataaatctaaatatatatatgaatgtaaacaatgctagaaagttttacattattaaatggaaggaataataaatgatgtatactgcttatgcacgttcctataaaaaggcatcgccatgcatggtttggtgcctgagcgagagaaatggttaatccacatatagtaaattagttgtcagtgagctgaagcatgcacatatagtgtttgattattaaactaaactgggcaactgggtttgtgatatatcaacatgtactcatgtaattctggtagctagcaacatatctcaaattctcaatgtatttaatttgcaatataataatagctggaagatgacaactaaattaccttattccatcgttgctgctactccactaatcatccttgctga

SEQ ID NO: 59959 - DNA, 1418 bp, Oryza sativa
aaccattacaggcaagatgttgtgtgaagaagggcaaacatgcacgttgctaagctgacacgcggtggacaagaatgaccgattggtgaccggtctgacactgctcatgtcgtcagcgcacagccacgttcccacgacgcgcctgcccccggcagaagtggaggtaggtatgtgccgtcccatcagaaggacgttcggagggcaaccgtgcaaatctccgtccatttattgtcgcgaccgggaaaattgccttttcccgaacgctagtgtattaatccccgtcccaggaaaagccggggtacaccacacaaacatgatataaaagacacatctttattatatcgataatatttacattattacaaaggcacttaaggcctgacaatcaaaaataaacagcagcggactagcgggcctacggctccatcttcacaggcgctcaactggggtataagccaggactccacctaagacatcttctccaaagcttctcttactgaagaggggaaggattgagcaagaatgagtacaaccacagtactcagcaagccacaccggcagatgcatgattaatgcaagggggggtacaagggaataataataggggttaggttttgcagtaaacagcatttaaaagtcacttagttgcccaaagccattttgtaaagacgatcctagagctacacagtattattaaacaaggccgtgaaccctcacgagcctgccttaacccaaggcctacgatgatttggaccgaactggcaacccgacctgggtcccagctcgtcccaagccaacccaggccaaccattccatattttagttgttgagcaaattttaagaattaaaacactgacttgggtacattgctaggcttgcccatatccgagggctcggctattcgaatagatttactctgatcagaggtgtacatctttacccacaagacacatctttactccgcattccatggccttggaacccgtcgtaaagatgtgacatagtttccaacccatcctagccttagacaagagtaccgacccaatcctgcctacggccgggatacccgggacaggcaggcagaactgagcccctagcattgggcaccaaccctccgccgtatgacatctcgactaccgggccgcagctcgtgtagccttcatttgccctggagaatgtccatcgacgcccgacttcatccatctccaatccgtgtacttttgtttatgactagactgagccacaaactaagccttacccattagacatgtggaagtacggtagtgctttgcaatagaggcccgagctttagtccttatagtggccggggtgctacttcccacatctggcatgcacccaaaccccaccgaaaacaggttttaggggttttgaaagaggaagagaggtgtgtgtccaat

SEQ ID NO: 59960 - DNA, 745 bp, Oryza sativa
atacgaggacttgtcgtgccatcctgccaaatcgacgtccgccgcgggctcgcgccgcgcgcgggacggacgggacatcgcctcgcgcccgttcgccgcgttgcgcttgcgctttgctcgtgaaacgcccgtgcggcagggtgggggcgcgcaggtgcaaagcggcccgtgggcggtgggctctctcgcatcggcaaaaaacgggtggcggctacgtcccttgtcccaggtggcccaactgaacggggagctagttttggacgagaaattgttcgagaggcttgggctcgcgataagatgggccgagacaccagtgctgcaagccggccacagccaggggccaatagcccactactgcggggaccgctaatgcgcgggtccacacccctctcccctatacgtctctctcctcccccttcctcctccccttatccaaattcatttgcacttaataaataccagcttctgccatagtggaacggaggcgcgtcgccatatatatacctcttgtaagccgccgtgcggcgttgtaacctcaccccagatatagtgaagatattttgctggctagcgtccgtggtttttctctccctactttgggagggttttccacgttaaaatctcgtgtcttctgtgattaatctattattctttatcttttgtttgcctatcatttcctaacaccttcttctcttccctactatagtacaccacaaaattattaataaaaaacaagggctgcagg

SEQ ID NO: 59961 - DNA, 726 bp, Oryza sativa
gtaatccgatcgaaagcagaaagaggaaatttgagttctttataagttttttttcttctgagttctgacaactggaaagtaaaaaatattagcagcaagtgacacaggtgatcgacgttacgcaaggtttggggccaaaaggagccgacgtttcgtttcgctttgccttttccttctcgttttttcttttgtgccgtggacaccaagcttgatcgaggcttgtacgagaatgctgtttgatgctgcaaccaagagattaacttgtagactgtcagagtgtatcgtgttaagtcttactgaatactgagaattatttgtcgttgttattctacctgcgtggctgtatgagtagtttcttagtttttgggccgtcctggtcaaggcccattaatattttcgacatctaataagtttgtgaaagaatcataccaacaacatcagagtggcgcagcggaagcgtggtgggcccataacccacaggtcccaggatcgaaacctggctctgataatttagttgagctgtttttctttaaactttctcggttttctttctgctttttggtttttatcttgcatctactgttttaatctttctcggtttttgttttgcatctactgttttaaactttatcctttttggttttgcttccgtttttgtttaaactttttcggtttttatttttgcatctatttggtttttattttgcatctactgttttaaactat

SEQ ID NO: 59962 - DNA, 937 bp, Oryza sativa
ctggctgctgctgctgctccccttttgctctgctttgcggcgaaggatggacatgtacttgcccctgtgggctgtggcctgctgctggtcaagtgcctcgtcgccaacgcgcaacaaacttcaggtcccgagcgagcgtgattacgcaattgattgaatgacggatcaagcgtttgttgggagccagggaaaaatcgtaggacgtcacgcaactctcttttaatttgggacattgtctacaccgtggctcgatcgatcgttgctctcctggagaatgaaaaacacgttttgctcttctgtttttgtttttgtacttccaggacaacatgaaaccgcctactcagaatgatttttttcttgcgacctggtaattgagatcctaagcatggcagcatcgtgggctaattttgcgtgctcaattgctcatggaaccgtgaaagctagcctggttgcatgcacggcaaggctactgatccagcactgtgtgaggccgattgaagcttccgtggagtagaagaatcttctggcgtttgatgtacggagtacttcatctccagggacaggtacggtgatggtcgccattccaccaacctcgaggataaatgcgtctggttacagttgttaagttgatgatgtacgtatgaacgcaatagatgagcaaagtatttcaagcacatgcgtcgctaattgatgcgttcacaacaaaacaagcccttaaatggagaactgtattaggaccatccatgataagtaccacaaatggagttgcacttaaccttcttgctgacgcgccagcgcatggcgatgacccaagcacgatctacgaaactggctgttgagagtatttatgtcatagattctccattttcggtggcagcggtccagttggtttctccgtttctgcaaactatgtagtcttgtactgcaaaatggacgg

SEQ ID NO: 59963 - DNA, 1939 bp, Oryza sativa
aaagatcaatcccaccactccaactgatgctacctgccaagatatagccgtccacagcagtgtcattacatatgacagcttcccagactggaatgcatgcatctctccttgtaaagtcatccattcaccacttgcaaataacccaacaagagaagccaatgttgccacgagagctgtatatatctgcatgttcaacacaactgagaaggtctccctcttaataaccttctcaaatgtgacttgcatcagggagagaatgagcgagtatgtagctgatgcccctagtgtcaacaggaaacccaaaatgtacttcccatgtgatatactagtagttccctgagaatcttcatcaactccaaggagtgaagcagaaaacgtaaggaggactacggaattgaaaatcagaggggtgaatttttgagcattgaggaaatatgagaagacagcattgaaggcaagctgactagcacagatgagcgaatatgttgagaccggaagatatagtaggccataggaatacatcaagtcgtctgcagcaatgatgaggcccaggacaacatatatcagagtaattttggggatagaaattgtaggggcaggactactagtgactgtttgtgtagaagatgtctttgaatggaaaagaaatagggcaatgaacaaaatcggaaagccagcagtttggacgaatgtggacatccacttgctattgccgccttgattgtagtagaacctcccaagaagtgtagatgcggtctgaccggcaatgaggaagaacatgttaactcccaccatcagccaccattgccaactcttgacaggagagttctgtataggtacttcatgagttgacgaagttgcagctttggatgaatctgcaagttacagaaggtaggcagtatcaacaggttagcccaaacttcatgtgttaagcatagcacggccaactgaaactttcttttcctattcaaaatagactaccaaagttcccatagtgaagtgaaaccctcctctcctttttttccccccaacaattggccatataaaccccaaaagctctaaatttattgagagaaagtcgagcaacacaagactatagctccatccttacagtattgtccattggtgaaactatcaaatgaaagcgagttacttggaatctcagggaaatcctgcactaatataaaaaaactaatataaagattttacttttgttaaatgcagtgcattactatagctggtgctatcatcaaccacttatccagctcatgtacgcgaacaacaggggtttgccaattaaactcacatgcctactctgccactcgatgatgtcacgatagtctgaaaagttaatatggtctataaacaaaaaacaaatcccatatgggcatatggccatatccaacacgccacgcacgagaaggcaattcatcgaacacctcgcgggcttacttccccacaccatcgaacaccaaataagcccgagagaacgaacgagttcatttcatctgcgtttaccgccgcccatcgcaagacgactctaacctcctcacccccactccctcaacgaagaaaatcggacatagctaaacagtgaggctttcgacagaggaagggggggaaagatttgattgacctgcgatctgtatctggacctcctcatcccggttgctaccgccgtcgctgttgccgctgtcaccggccatgcccgtcgttgggggcgctgctccgcgcgagcgcgagcgcgatccgaggcaagcggagcggtggagagagagggagttgataggaggagaagatgagaagaggtgtggcgccgcacgggggaagacaagtggggaaataaaaagagtaggaaagggtggggcgctgcagtcgtgtgaaaattgaaaactgcctcctccttctttcgcttcgcgagccgccaaccgatccttgg

SEQ ID NO: 59964 - DNA, 1132 bp, Oryza sativa
ggaccagcgaacctccatgccgtggcgcgagaacgacatggtgcgcgccgtgaagtcccatgttatcggccccagggtaaccatccattgggttcccagaacgagatcgtatcccgccaacggcatgacgaagaggtccacgtggaactcctctccatcgatggtgatcggcgcctgtcggagcacgcccgggcactggatcttctcgccattggccactgtggccgtgaggcgcggcttgggctggatggccaggttggtgcggcgcgccgcctcctcggcgatgaaattgtgggtggagctggtgtcgaggagggcggtgagggtgaccgcgcccagcatcacccggacttgcatcgtgtcgcagatcgggactcctgcgaccgcctgcaaagagaagacaggggcctccccatcttggtccgcgtccaacgcggcgtctcggcgtcggtgagcgtcacgccgtcgatgtagaagatgcggcggcagacccggttatggccacgggagtacttttcgtcgcaattgtagcacagcccgaggcggcgacgttccgcctgctcctcctgggagaggcgtttcaccggtttggcctccatcttggccacgggtgcgctcgccggcggtgcagggagcgcgaggcgctggggcagtgccggcagcaggccgcggggcgctggccgggcgggaactggagccggcttgtcgagctccatcaactcaacttgacgggccaggctcatggcggccgcgagcgactgcgggttgtgaatccgcacagcgtgactcagcggcggaaggagtccccccgtgaatagctggaccagctgggcttcctgcagtggaccggcgcgtggtaggagcgcctggaagctgttctggtactccttgacggtacccgtgcgccggcactcggcgagctcgaacagcggcgctgagcgcaggggcggtccaaagcgcaggtggaggaggtccttgaagcgattccatctgggagtaccctcgtcctcctggagttggatataccacaattgggccacgtcctccaggttgtatgaagccatccatactttctcctcctccatgatgcgttgttgatggaaataagattcacatctgttgacgaagatca

SEQ ID NO: 59965 - DNA, 731 bp, Oryza sativa
aaaagtctaatttccctccccctcttcttttctttttcaaaaaggatttaattaaatccttttcctttagaccaaaaatccaataatcttagaaattcaatatcttcccaaccgtaaatccgtttgactccgttcaacttccaaaattcctcaaatctcgagatctatctaatggcacgcttagaggtcattaatagggctttattttcgccgtttgttgagttgtcccgtttcgagtgtagtttcggagcccgaagacccgcagtgcgaggatttcgaggatcaagcccaagatctcgagcaaggcaagccacctttgaacttaattatgttgcttgaaaaatattatgcattgataggatcgcacttaatctgtttgtcccgtctgcaaggcagattggcagacctacctagtttgttgcatttgatccttcctttgttaattgttataccatgttcccttgtaaccatctagttgcgcctcgatattcgtgcactctgtgcgagtatcgacggtcgccttcaaacttaaaatttgaaaaacaacttgggtaaaacttgggttttacaaaagacttggaaaacccgacacctgggtcggtgcttgcgaactaaatgaatttccaaaaccgcggaccggggaacgtaccgggtgtacggttttccgctcttgcacttaaggaccgtttccttggattttcatccgaacataagacaagtacgaccacatg

SEQ ID NO: 59966 - DNA, 1441 bp, Oryza sativa
tttctaaaatggttactgatctttctccctctttcaaaattgtagatggcagtgaacgccagcttcagttcccacggttttggtgagggtcaccacgttgctcagcttcgtgacctcgcccgctttgttggcttctcgtgtccggagtacacggggtactccgtggaccgtgttccccctcgttgtgagctctctgtgtacctttaccctcgtggaggtatacacggagctggccttcgcccacaccacttcaccgtggccaggcccactctccagatcgcgtaccaggacctctcctggactgcgcttcgtcgcttggcccacgactacagccaccgtctcgggggctctgccttccggcagcttccacgccttccttctggccacgcagacgccaggtacccttgtccttacagcgagtctcagccagtgctgactcgcatggttgagctttcggaggctcaggccactcagcacgacctactccttgaggcttaccgctcccttgcccgccgctacgctgctttggaggcccgtctggccgaggagggtgtcacctcagttgacactgtctcctaggactcaggccgcctctgccacgccagccacctgtcctcccacagctcccgcggctctgcccgcactcccagtggcccgcgctcccccagctcgcgtgcgccatactcaccagtgtactctccctacccacacccagttagcccttcctacacccccggacacaccccagttgcttcctcccgccgaggcccacgctttatccgcactgcgcggaagcgtgttgttggttcttccaccgtgttccgtttcgactacccagctcccccaccgccagcggcccgtgctgctgccggccctcgacaggttccgccggtcccttcgcgtcagccgatcgacgtttcttcgactgaggagccgactacaggaagcagccaggcagacgaggagtagaggaggcagtcttcagcagccgtccgtgtgttaggcccttttgttccgccgccaactcttttggagtcgtggcgaggtagtgcgtgcgtgtgtttgttgtgggtattgtttggtagtctggttctcctaggtggtgtgcgcacagtcaagctcggcgtagctctgtgacttgtctacacccgttgtactaggtgtttttatgatatgaaaaatccagtttatgcctagtgtgtgctatctgagttgctatttactttgctccttgccctcctaagtgcttatctgactcttaccccgccctcttctgggagtttagatggttagccgcccccgccgtgctgctcgtgcaccagcccgctttggttttgaggatggtagagttgagccagaagcaaatcatgagtcagctaatgagcagtctcaccacagcaaccgttcgcaccgtactgcttcccgcaacgcaggggtgcag

SEQ ID NO: 59967 - DNA, 745 bp, Oryza sativa
caggcaagtggacaaggttcacgtgcttccaacaactttggtcgaggccgggtgaaccacattcaagctgagaccgctcaggatgctccagacgtcgtgatgggtatgttctctgtcaactccgtacccgcaatagttctatttgattcaggagctttccattctttcatatcacaagcttttgtgaaaagaaatggttggaaaacccaaaatttgcgtgtaccaatgatagtacattcccctgggaggaatataagggccactcaaatatgcccggaagttaaccttagaattgaggaagttgactttctagccaaaccgatagtcctagactcgcaaagcttggacatcatcctagggatggattggttggctaagcacaaaggacagatagattgtgccgaaaagtccatcaccttgcaaggacctggaggaaagcaagtccgctttacctctaacacccctaccgcaagtcggtctatcctaacctgtttacaagtcacctccttggagtcggtgcccatagtctatgaatatcccgacgtatttccagaagaattaacgagtatgccaccagaccgagagattgagttcaccatagaactggcaccaggcaccgcaccaattgcaaaaagaccctaccgaatggcagctaatgagttagcagaagttaaaagacaaatcgaagaattggagagtaagagttatgtgcgacctagctcatcccctgaagagccctagtggg

SEQ ID NO: 59968 - DNA, 738 bp, Oryza sativa
tgcacccctgcctttcttgtgtccattggttggcacaatggcacgggcgtatggggatgctcatgtcgttgtttgggaacaatgtgctgacttatctgaatgcgtctgcaatatgactactatcctcttgcacttcaaaagccagaccattgccctttttcacttttgctttttatatttcagtacttcatataactagttatggtaagcattgttagtcgcttcctttttttatcattatttttatggctatgcattaatatcctttgtgttggtctgcaggaagttcacaggatcaaacgtgaacatcctgatgatgatcagtgtattgtaaatgatagagtgaagggtcgcctaaaagttacccgggcttttggtgcaggctatctcaaacaggtaattgtgatactgtttgagtgggtcagccattcttttaatttgattcttatacttacgatgtttgttttgtgtggtatacatatccatcttcagagcaagtgcatttgttgtcagtactttgtacttttaactagaaactatatctgtcatgtgttctgattaatccaatgccctgattgaattaatatagacactagataattcttgatcatagaacttcgtgtatttgtgcaggcaaaattgaacaatggattgttagagatgttccgcaatgattacattggtgatacaccgtatatatcatgcacaccatcgctttgccatcacaagctcactgca

SEQ ID NO: 59969 - DNA, 771 bp, Oryza sativa
cccctttcgccgttttggagttgtcccgtttcgcgtgtagtttcggagcccgaagacccgcagtgcgaggatttcgaggatcaagcccaagatctcgagcaaggcaagccacctttgaacatcttgagcctatatttgaagttaattatgttgcttgaaaaatattatgcattgataggatcgcacttaatctgtttgtcccgtctacaaggcagattggcggacctacctagtttgttgcatttgatccttcctttgttaattgttataccatgttcccttgtaaccatctagttgcgcctcgatattcgtgcactctgtgcgagtatcgacggtcgccttcaaacttaaaatttgaaaaacaacttgggtaaaacttgggttttacaaaagacttggaaaacccgacacctgggtcggtgcttgcgaactaaatgaatttccaaaaccgcggaccggggaacgtaccgggtgtacggttttccgctcttgcacttaaggaccgtttccttggattttcatccgaacataagacaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgtcggcatatggtaaacctgtgtcggctttcgaaatgccttgtcatgaaagcttggaggtct

SEQ ID NO: 59970 - DNA, 998 bp, Oryza sativa
gacggcggcgcgcacacacgtcggctgccagggagttgggcggcggggaaggaggaacacggcacagcatcgacgcgacttggcggcgacggtagggcagcggcgacggtttcttagagaaggagaaaacggcggaggaggagggtaaggcacagcagcggcggaggacgaacacggcacggtgcaagttggcggctcggctgggtattgggccggcttgggccgaaggagaaaaagaatttcggcccaatttaggtagaattggtttctcaattttgaaagggatttgaatagaagattttgaaaggaaaatatatttggagataatttgaatagggaaggttgaaaggaaattatatttggatctaatttccaaaacagatattttctaatttgagtgcaatatttttggaagtggaatatggtggaatttaatgcactcaaatgagaggggaattaacaatataattcctcaatgtatatatatgtttggaggagaatggttggaggtaaaataaataggatttgaatcctaaatttgatagtagaagtatttgaagaattatttgtggctaatagggaaagttgagtgaagaatataaattgctattttcttagcacaagagcaattattcacaatatttacaataatactattcttgtgccgaagaggaaatcaagccacaggaattaaattggtggctagatcaaaaggaggaatttggacatttggatcgagaatcaaaggatgggtttaagaacaaagaatgggctaacaattaattataataaaattggaattactttgttttaggttctaggacagtatgggaatgtttctttgaccataattcataaaaaaatagaaagagttttcaaactaaatttgaataaaagaatcttagtctaaagaaggtttttaaattaaaaccaaatcaagaaacaccttaatttaaccaactatatttttaaatgaaaaacacaaaagaagttaaata

SEQ ID NO: 59971 - DNA, 1439 bp, Oryza sativa
  unsure (1)..(1439): unsure at all n locations
agtgaaacaagatcggactacctaaggtggaaggatgagcatgaacgtcgaattgctgctgaggctttagaatggcacgtaaatcccctaggactccccacgtggcgtgagcgtccggagtgtcgttgtggtgaccgttgtcaggtcataaggtccgtaaggcaccgaactcgaggacaaaggtgtttcgtgtgtccaaatattgtcgacgatgatttcgtggtaattacaactattcttttcatcactcctcagtactatcattaacttaactatcccaaaatggatgtacataggaggatgtaaggaaatgtcaattcgtacaatggattgacacagtcagagttacttcaagtggcgggccgataacgcaacctgaaccgaccatacagttcattcatgcttggatggagtacgatcgggtggaaattgcaagcttagactggaggaacaatccattagggttacctaaatggtccgagcgtccaaagtgtgggtgcagagatcgctggcaggtggctacatcctttgctgaacaaacatttcgaaggagatattttgtctgccccaatgtagacaacgatttcgttgtatgtctaaccatttacaaaatccgctatgatttgcacaaaattactacccaaactgaataacattactatttttacagggcaatccaaggatgggtggatttactcgatggatcgacaatgtcactctatcatatcatggccagaagataacagagtcagaaacacaagtagagtatcaacgattgaaggaccacgagaatgcaatgcattctgaccgacctagaagatgccgataggttaccgcatgcttgattcgtcgggatcgacaaatttgtaccgtgtatcgatggcacttcttatctatcttatcattacaatgtttaattatggtggtgattttttgtatgcgtaagactaagggcctatttggattgctaccaaaaacatgccctaccaatattttggtaatttgaatagtacttgtgtttgatttcgattgaagcttattcattagtaatacgtaatctagatttgagattatgtagaacattcttcactacaattttacattttggcagcaaaccaaatatgatcaaatgcaattttaccttaccaaatatttggtagtgccaaaacttgcttatattttggcactaacaaaatatttgtacggtaacattccaaataggccctaaaaaataataaaattgtattttaccagtcttggagattttaatcttgtatagttttcaatataaaaagatttgataactattgatatttatacaaaaatataaagcaagtataaattcgccctcccccagagcggcaagggggccgcctgcaaaattccaggccccccgccgcccatttgcaggcggccccccngacgctacggaggcgggc

SEQ ID NO: 59972 - DNA, 962 bp, Oryza sativa
taaaaagccgccggttggaactttacgccttccatggggatgttcgcggtttactatcctcgacgtcggaccgttggttgtaaagcccgacaaaaaccaaacctaaggtcgaagtgctgctcctagcaccccacgccttgatgcgtatagcggtcggagcttcactattccctcgacctccacagcacgccgcacagttagctctcgggctcttttgatcttagccgctccgccgccactcacggttgtcggagtaacacttccgccccaccaaacctacaccaacctcatattcctctagccgatatactgtcggtcgacaccggctagagaagacactaaatctagtcattatgctgccaactctagcaacgactagcaaacaaccaaaccctagccgataccttgctagtcaaatcccagttgtcatccaaattccatactgtcacgccccgaactagtaccgaccggaactagcccgcgacgctccaaattaacctgttaattgataccagtcccaggaaacagtgctggtatcacaggaagacagattatcacagcaacagaggtctctttattatagagtagaggtacagtcatgttgggccgcggacagatcccgagctcacaactgcattacaaaagggaagcggaagccaggacttggaccaaacaacacaggcgcgacttgggaactaggccgaaaccctaaaactcatcgtagccggcttgctcctggaagaactcctcatcagcaggatccgcttcatcttcttcagcaactgggggggattatttatatagagcaagggtgagtacgggagtactcagcaagccatgggaaataagtgtttaatgcaggctacaaagaaagggctgctgtttttgcaattgattttatttgaactcttttctgaaaacaactaagtgagtgcttctcaaacgacacggatgagacagtg

SEQ ID NO: 59973 - DNA, 710 bp, Oryza sativa
catggagtgtctacaggacaataccatttacagaatcaccatatgatatttctgtatcattttcacatctatttccttacgatagctattcagcctattctaatactagtatatgctctgcatagaaaatgtgaaatgaaaaacattcgggatatggtccactaaacagcataggaccatgaacaacattttttttctttatgggcacgagaacaagtgatcaacagttgacactgcacaatcatgactaatctgaaggggcgagttggcaagttgcttcagaccacgttttgttgaggagtgaaccagataatttttaggtcatacactgtacgacctatccaaaaggttttttgtggagcttgtgcacccacgatactgaaagtcttcagatcatgcactattttctatagtccccacacactcaaatcaaaagccccatttttattctagtagcatgttttgtcaaaagcaatcatggtatttaatcgttgaaaattgattcgaggtaacaaacttggacagttcactgccccagtttaattgtagctctgtttatctaccccaattcgatcattttctgaattctgataatcgaaaaaggctatcaggaagaggcagggaacacacctaaccttaaaatttggccacgatattactggattctgtttctctcgccccgggacatttaagaccaaggaaggggtgca

SEQ ID NO: 59974 - DNA, 828 bp, Oryza sativa
atgtccatctctcttgcagtatttgcatgacttatacctgcctctggactttgatctcccacggtagctacttgagcttttatctcttgatttgttgtttgtgttcttctcctgttgcctaccccgacaaccaagctttctgcttgtgaatttgaaccttcagagggtaccatcttcttcatcttttctttggcatgcaaagcatcataaacttctttcaaagttagagtatcacgactataaagaatagtatccctgaagtttgcatatgagctaggcaatgaacacaataaaataaggcctaaatcctcttcatcatgctttacctccatagactcaaggtcagcaacaatttccttgaaagcggagagatggtccatcacagactcatcatcttgcaacttgtgcaaaaataacttttgcttcaggtgcatcttactggtcagatccttagtcatgcatatctgtttcaatttcaaccacagcccaacggctgtctcctccttaagcacctcctgcaaaatattgttagatagatgaagatgaatatatgacataaccttatgatcctttttcttctcatcaacagaccaatcctgtgtcctcttatcaaatccagaaagcgcatcatcgaggtcttgttgtgcaagaacggctcgcatcttcacttgccaaagtgagaatcttgtgtctcggtccaggagcggtagatcatacttcaaactcgccatgggaattaatcctgaaatttgctagtaagaaattagggtaaactagaaaaaaacacgaactatggtacacctcctgtgtgcaccaagcgaagtactg

SEQ ID NO: 59975 - DNA, 1248 bp, Oryza sativa
ttgcatatcacacccatgatgcaggtagttgatccctctggcaatgcccaatgcaatttcatttagcttatcccaggagaaactcttttcagacgagaagatgtacttgtcaagagaaccctgaggcatatactcgtacacaagcgctcttcttatttcttcagagcagaacccgacgagtcgcaccacattgacatggtggatcctaccaatggtggagacctcgctgatgaactcttcccctttgcaatttgcgtcacccttcagcatcttaatggcaactcggacatcaccagggagtagcacacctttgtagacggagccatatcctccttggccaagcttgtctctgtaatgacttgtgatggcaataatgtcggtgtaggagtatctcgttggggtcagcatttgttgcaattgcagaaacttctctacttcatcaactctcatctttattttccagtacatgtaggcaacggaggtccacatcagcagcatcaccaggacgaacctgcatgctacaccataaacatgttcatccctgctgtagagaccaagtgtatgaacaaatagagcatgacgagactacaatacagcgaaaaaggaaaatgtaactgaaatttgatatgtgtgattgtcacgtaccagaaatgacccttaaaatccagaaagtttgtggcactaacatcaggagcacaacaaaagggtgtggaagttgagttgcatggcggccgcatatcgagaagtaagaattgatattagtaacaatgacgaagatccgatatactgtcggttctccattactgtcgctgcaagaccacgatgtcatgcatgagccattgtacagcaaagcaaatttccaagataatgttatttggcattggtaaatttcactatcaagaatgtacaaggaagacgggccaaagtgttcagttttaagtcccaaataaattgactcacctgatcaagccccttaggcagtcgatgaatcccccagacctgaaaggaaaacgaacagcgaatccttcactcatggatctgacaacatcttcataatttacatcctccagtgtcgcagccgcagtagcagttcgccaattctctagaccacccagagctaaaggagtcattgccaggtatccacaggaaggctcaaggttctcagctaaataagatcccagaccagttagcacatacacgatagaagagttgccgcttcggcaagccacaggcctgtacatgacattg

SEQ ID NO: 59976 - DNA, 1439 bp, Oryza sativa
tagtaagttgttcaagagatttatcaagagatcagcatggtgtagttggcccaataatttgcgtcagtaacaacgcaagccagtggtatttgatacatccttatgcatattgtctgttcttcagccagactgcaaagttgttagtaatggcatccaggcaccctcaacttttaaggaaacagaaaatggagtaatcggtgttgatgagttggtattcacttggtactccagtgacataaccagagattgtcaaaaatgtgaaaatgaagcaaacactgtggtttcagctcacaaaggggccgagcattctcaattatggtattttctctttctgaagcagaaatcttacatcaatattatgacttgctttgcctcggtaggaaactctatggtctttaccttttcattctcttagtttaaagtttgccaattaaattgttcaaaagatttccatagttgaattagttgtaaacactgcagatcagagcagctgctagccaatggaagcataccaaagctctaggttcacatgcatggttattctaatttaaaacgcgcgcacacaagagaaggttataaccgattaagagtaacggaatttttttgaaattcttaaaattaaaaaaaaaaccattcatctacaaggtaacctagatcaaaatgaatttttctttaggattggagcataggcatcccttggtaactagagagggtgctatgaatgaacacactctccaaaataccattgttagtatcaacgtatagtttatttgattgtaaccatttggactggaccgcctatacatgttccaagttaaagaaaaaaaaagaaagaagaaaacataatttacttagcaacaactgctaagcctcacgttggttccatgtattccagccatagaaaccacacccacattccttaatgtcaatactatactctctactctagcttatcactagaaccaaggatggacatgctctcagatttgatgtggtgttctggttatctttaatttctcactttttcacaataagcatgacctgaactttggcttgtcagcaccttcttggatacatattcttgaaaaaaacaccatactgggtacttgcaaaaggaaaaaagaagaaaaagtgaactccatgtagggtcatattgatattttaattctgaactcttgcatacctatgttagatacacagaaagcaacaggatcttcagcatgaacatgtttgcacgagttctaggtcactggtgatccatcatgaaacacagcttggtgcccaaagaaaccagcatcccatctgtctattgataatatatatttttttagagtaaatttcacttagagccatcttttattactgatatttcgctttggccctttaatcaatgttctcactttcgaccagtctttgtttttaacctttgtggcactttg

SEQ ID NO: 59977 - DNA, 4716 bp, Oryza sativa
ttttaaggaccacctcttcctagcataaggttgcaaatagatcaaaatctatatcaagcaattaaaaaatgggagtactgaaatcagactaaccatttcctcttgggttaagatcattctctgagtcatggaccggagggcctttgtttcagtctctgcttcctttagctgctccatagctgttacaacctcttctttggcacactattcaaagcatgagaagaaaacatggtcaaataaaacaccatatacaaaccaacactacttccatattttgattggtaggaagtatatttacatccagttcatgctttagtgttgtcacttccccatctttaccatcttttgattcccttgcagccttcagtgcagcctgtagacaaaaagcattatataaagtgttcgttgatgggtaagaaatatcctctttatttttctggtaaaattggaaggtatgtactccagcatatccttcaggttcagattttttttttacaataagaacctagcatgactatagtaccgcatgtgcatttcaagacaaataaagcagaaaaaagatcaaatgaaattccaaaatgtttcatccttttgttttcacaacaagaaaaacactaaaattctaacacttccaaattttacatataaattctaagataaaaaaaacagtactacaagattggcatgccagctatccataggtaaaacacaagaagaaaaactaacctccctctgtttaagggcagcttctttcctgccaataatcatgacaatgttaggttatgagtctatgatcagttctgaatttgtgaaacatgcatatccaaacatgatgcaaacctgctcaagaggcgagcttctaatgataccccttccccaagggcagctacctgcatatcaacaaatataaccttagctaaccaaagatacaaaatgctcagtgtaatgaacacctcctcaagtaaaggagaatattcgttccaataattcaaattcaagtttaaattgtagtgaaaaattcccgccaaaagaaaaactgtagtgagaactagagatagactcaatgtctagtgcacatgtccaatttatcataatacaaaaaaaaagataaaacaatgtttaatataagattatctcacctgtttctcaagctccttggctctagcttctgcttcttcacatctttcttcagcaagtcgtagctgtcaatcaagattcagaaaataatttgttaaagatcagtataaaatcaagtactagattgcctataaaacagctctatggttgctatttcaccttttctagaacactctcattctcctcttgtagtatatcaagctgtaggacagcattgcattagtcttaaaaacatctgataaacactcctcaaaaagttctaggtcaaagttcgtgacagaaccatgagctaaaatatattatacgtataactagtttatagagaataaggaaaacctcatcttgaagtgcagacgcctccctttttggtgttgattctctggagttgagatgccctgtatcaaacctgaggcaaaaaaaaaaagtaaataacttacctgatgcctatttttaggaacatttgaaaaaatgggaaaaagaaattcaagctataagaagtggccagatggtcataatgtgattattccaaaactttaatgcaacaagcaatgtggtgcccctagtaacatacttaaaagagaaaagggtgcgtttagcatggtggacgactaaagggcactttattttactaatcctagatatattaactagtcagcaagtaaacgtgcttgtagcatgatggtaaataccttccagtgggaagctaacgaccagggttcaaatcttggtcttgcaccaaaaaaggtcactcgctggttctaccaaaacaaggttaggaattgatctatcgtccttgtgtagggggcaagagcctcaaagcatggattaaggcccgatccatagggggcggctccccatgtaggaggaccagcttttgtggcctttctggggcctcggtttcaggtgcttcttcttaattgaaatacctcaggggagatctttccccttggggccgaattttttgttattattaataactagtcagcaatgcccttttcagcacaataaaagaaatcatttgctagaataggtaaaaattatgtataatttgatagattctgcggcgcagttcagcaaagcgcggtaataggaaactggccaagaggcacacccacaaccccaagatgctgaccaattgattcaatcaaatatcagatttcacaatttaggtaagcgattaagatttcggacgcataataatttactacccatccttaataagcatgtattattgaactcaaaacttttcaatccattacgcccaagataagagggctctccactataccgaccaaaactgaacacatagtttggcatagggctgttggttcaaccttatgatatcaatgcatctttttttactaacaacgccaccaaccaaatacatccctttatcaagagcagtttagttaatgttgtgaactaccaacatcacttcttctgaaaaacagcgcaagcagtaaaaataactcatttctgctcgatttggtggggttgctagtacaattaaccatgcattcattttaatatatcctaagagaagtagaacttaaggaatgctattttaagtatagaaaacacagagaatgctgcagaccatgcaacagatctggggaatgtcattgacgtaccttttctgccgactgcggtccactggaggctccacagccacaggtggaataggcgatggtgtccgcaatgtcgtgctggttttgatcggtggaaccaccgtggtggtcggccgtgaagcaacggcaggcctcccagctgatgttgagcggacagtaggaggtggctctacaatgttcctacctaactaatgaaaacatgaggagatcaaattagcagaagggcacaggataagcggtgatcaaatcacgaagcagccagaagtcccaatgcattcatcacttctcccaatttttacaattcagaaggcatcgctatagaattggactgacattggcgagatgtaaactagcttcactagcaaattcatctgctcaagcatgcttcagaaccaatttgacttccgattgaccaactatgactcattcgtgcaccgcgacagttcaaaccatcgaaatcctaagttgagacgcagcgggtagcgagatcagcgagagatccgggggaagcagaatttaccgcaggggagggagatctcgcggtgcggccgagcaacgagacgccgttgctgccgtgcgccgcggcggggcgcgcggagccgaacctcgcggggggaggggcgggcgggtggtcattggcgtagtcgtcgtcgtcgtcgtcgtcgtcgcggcccgcggcggccgcggcgctctgtgacgccatgacctgggccagcctcgcggcggccgcccgcgccgcgacgttctgcgtgcggcgcacgttggagacgccgccgcccagccccgcggcggcggaggcggcggaggaggtggaggaggagcggtggtgggacggggagacgccgcccggggaggaggagcccgtgctgctgccgctccgctgccgcccgtagacggggctccccgcgcggaggcggtccatggcggaggcggtggcggcggcggcgctcgccggagggatctgggccgcggcgcggagatggcgaggcgaggttgagaagtgggaaggaggttggaggagagtacgctgctcgcgactccagtagagtttcgctgttttttttttccttctgttttgccttctcgcagtaaaccccctcgtcttctcaatttttaaacaactacgcgtacttgtacatttatgtttgtacgttaggagtacacctagtagtatttgattgatttgtgagtgtttcttggatataataccacatctgttttatattataaattattttaattttttataagtcattttatatttttaacataaataaggaaactatcagagaatatattcaatgttaaatttaataaaaccaatctgatgctataaacaatatttttcctataaattaggtcaaactttaataagttaaaattttagaaattcaaaacgtcttatatatggtatgaaacggaaggattatttgcttttttggataatggggttgatttcattaagtaatgaaattacaacatgcttatgcactttatgtcaatattttcttatataagagaatatattacatgtttactgtaggagaatattccatattctattaagtgatactactattccatacttattacaagataatatttcttttttaattatagcagcaatattctctcttatgccaaatttgtgcgaccatgttctgtttgataaaatatggagaaagacacggtatgatactatagtacttacatacttagctggcacctgtcatgttagaaaaagatccgcaagccggttatctactaagtcatatatttatgtcgtatcttattatactccctccgtttcaaaatgtttgacactgttgactttttagtatgtgtttgaccattcgtcttattcaaaaaatttaagtaattatttattcttttcatatcatttgattcattgttaaatatactttcatgtacacatatagttttacatatt

SEQ ID NO: 59978 - DNA, 28641 bp, Oryza sativa
ccttttatcttaaacaaaaagtactatcgaaaaaggacctgttgcactcgaacaatgcttgttcgataacacaacaaatcaaataattgagctgacctccttaataagcaataaggtaaacaagtctgcagaaaacgatatttgtttctctaagtttaacaaaccagttagacatattttattgttcctagcagaactgtctacaaagatatgttggatgccctcatgcacagggaacatcgacaggcctcttatcaattggtggttgtgtctttgctttcttaggcaaaaaatgcaacattagcagagtccagcacaccaccgacatttttcatccaatcatttatgcaagaaggatttttcatccatcggtttttcacccagaagaagccagaagaatagaactacagaagggttagtcctcaaagaaagatatctccccactggtcagcctgttagtagccattagaaataacacaagaacagtggcacgggaaatgcgcagttgatggcatgcgaagggaaagatgatgctgcagggtacaaatacagagtcagttcaccaaaaaaatacaatatcaattactcagttcagattcaagaattcggtggcacccagatacaagaaaatgcttcaatatttgcattcaggaggaatgcgatttcagttatatcggaagatttgctcaataacaatacaaacatgtatagtaaattggaaaccagttatgtcaaatgactgtttggtgtcattttgtcagctcatttccaagttctaagaccaatcagttctgatctgtgattactaaattaaaatgcagaagaaatgtccactgtgccaggatacaaaatgcaggaacatctgaacaaacagctcttttaacagacaagataatcatgacagacacagatagaggcaaatgattctattaataacagggtgaaagaagaagatctggtcattacaattatctaaaactctaaacattttttgctacttcccatatatattaatctatattcctgagaggaagggcatttggttccagatgccatgacccttttggtatatcacggtctttaatttcaataactacataagcaggaacacgatgggaaaagcttagcatttcagaccttgaaatcaactttgtcaaatggaaatcttccactattactctctggaaaaaggttaaacagccttttacccgagtcagcctgcatacattgactccaatttcatctgagtaatcagagaggatctcaaccatgcgaggttcacatttgtcgatgtcagcattactgaaggctatcttccagtttttgtacattgcccatatttctcctttctttgggaaaattcggtagaaagacctctttgcgctccagtcacactccaccggatgagagaattctgatatctctttgcaagcagtctcactaccagctcgaaacaccccacaagcaactggtagaccatcttcaacccaatgtatttcttcattgagcatagggtgaggttccagcttcaacacagaaactgcagtatgggataccacacggattactctgacatacaaccttggcattctatccggagcatcatatacagcccagatctgcccctccacaaaatgctcaggtgataacttattattgtagttcatcattccttgttgggggttacctaaatccattttgctggttgaaggatttgataagtgtgtggcagcaacttcatgaaaaccatttgagtcatcatgtaaaccttgaagagggtacaaaggagcaacacttgctgatgtattttcatattgcaagttttctggaacagcagaatgttcaagctcaaacaccgttccaacatcacaagtaaatctaaatgaaggaatcctgtgagaaaacatgagcagattatgaatgtggacttgtaataactgctctctcccactcctcacgtgcctctggaaaacgcttctatatccatctacctttaccaattgtgcgacagtgcagcctgagccttttaaataactgttaagaatttctacaacataaaaggtgcttttcttccgcatcccagggtcattgcaccacccaatgtcccaatcactgtagattgcccatacctccccttcctggggataaactttaagatgatgattccaattgtcagaagatatctgatgacataacatagttggacaagttaccgatattttacattcatccgcaataaaaattccacaaacaaatggcaagcttgcactaaaccacctgttctcgtcatgggattgtggggatggtttgaaccatgaaacatataagtgctctttgtcagccacaatcttgttaatccgtgcatatctgcgagggaacttctcccagtcatatgctgcccaaatctgaccagcagcgaaattcactatctccctatcattctcaaagttatgaacgtcatattgtgtaatagagcaaagctcgtcttctctgttatccaatggatcagtaaacctgtcatccaaatctacatgtggcgatgacacacaatgcacatccttttcgcacacactcttttgcttcttgtcaacatggttctcatcaggtaactgaaaaccatcatcagctagaaagcatgaatcagtcctcttagttttggaagagctagcaacatttgaacaatcgcccacatccaaacatgatctgtcagtctgttgagcatatgaaggcacattgtttgagatgccagccaccgcattacagtctgcctcaaggctgcttaatctacccagttctgcattcggataatcatgagttgatctatcagcagcgcaaatccctttcgtttgtaaaatgtcttcgcaccacagctcaacatttgccaccgtagaatcataccgcaccttcttcgccggatcagacagcacggcgtacgcatcgttgacgagccggagggcagcctcggcgccgggcaggtcgtccctgaccggctccacctggcgcacgatgctcctgtactgcgcgtcgatcttggcagcgtcgtcgcgggggaggacctggaggatcctgtaccaatccacgccgcgcccgcggccgaggccggggcggcgcgcccgcgtctcggcggcggcgcagaggacctcgagcacggagagcatctcgaaggcgtcgtccagcctagggttggtctggagcgtctcgagcagcagcgtcctcgcgccggcgtagtcctccccgcgcatcttcgccgcgatcgcctccctccccgccgccgcctcggcgtcgccgcccatcccctccccgccgccgccgcctcagaatcctccgcgagcacaccacctgtgagacggaatccgattcaaacgcgagcattccgtccccaaatccagatcccggtgaccaaattccgccgcatttgagcccatgctgcagatgtgaggatggatggattcaattcgagaggaaattgggaacgggctcttacccaaactgatttgggcgaaggttggattcaaatcgatggctcgattccgagaaccctaaaccctagcaccgatttggatttagggacggtggctacgcatgaacacggcaatcaatctggaggtggaatgctgctcctccagctggtgagtgggttcttctacgcatgaacgctgcggcttcgtgggccgtgtcagtggcatcagaagaaatttctgggcctttggggaataaatgggccggtccttgtgtattgggtctagccgcggcctgcgagaagaacacggggggcgaggcgacaggcggtgggcccacctcctggcacgtggggaggggagtgtccccacatgtcagggagaggacgcgtggcccgaaacggggcaaacgcgagcggcgggaaaaaggggagtcatcaaagtacgggcccctgtttggttgtggtaattactcatctcgtctcctccgctgtttttttttttcgcggcagcccctagaaagaaaagcaaaggtgccaaaagaaaagggaaaagaaagacccaacaacaattgtagtatggctgaatgttgttgtatgcccgtaggtgtatggctgaaaagcagtgaaaaataagtaaaagaataaaaaataatttatagatatatttatctattatcaattaaagtaaatgtctagaaaataaaccgtggtgtaaaatagctaaaatcaatttaaatatattttaaaattaaaatttgactgtaacaagtactactaccgttgcaaccgcctcctgataatattcgttaagcactgaatgcaaactaaaatcttgtttgatataactccagatcttaattcacgttggatttaaagtttgtgtgttataatatagcgttttaaaattttatatttcttctaaaatagaaataaaaataattttctaaatgttactccgtattaaggtaactatagatttatagagttagaaatatccggttctaagaaattttggtttaaataggacctaaaaatctcatatttgaaccagaagagagcaaaatgcgtgcattttttgcagtgttcttcacagcgggtgaaactaaaactggactacggccctatttaatttcctaaattctcgacttttctcatatcacatcacatcgaaaacttttctacacatataaattactaaatttttttcaaactactaattttctcctaacccccaacttttccacaatccacagcctacatacaccgagcaaacactcctatggaaaaaagaagttactgctatgctaccctcgcagcagtagcagcagcagagtgagcgtggaggggaggagatcgagatagttctcactttgaggagggacagaggtaaaaaagaaaaaaagaaagattggaaacagtgttgggtaccgtacgtgcacggctaccaacacgagcccctgctcagctgctctctcctctccggtcgctctccgctaaagccaccccctttgctgctgctgctgctcctgctctacccaagttcataatttcagtaaaaatcggtcgaattttacgaaattttgatattttgatacggctcggaattaagttttgattagaatttcgaagattaaacagtaaatttaatcgaaatttattaaaatcgattaaaatttatcgaaaaccgtaatactgatgaggatcaaaatttagtgatcaaccgataatgtaagcactagctccaccctccggatcgaagcggaggaggtggtaaaagaaaaaggggagagaatgtctggcccggtcagcgtgccgcggtttggtttgggtgcgtggtgaaaagtctcggcttttggatttgatttcggctcccgcaccaatgcccacgctagctgctgctgttgctcctctcctctcctctcctctcctctgctctccgagtgaaacttgcttctagtaccagctgcgagcttgttatgttccgtttcttccagctttggtgctctctcaactctgaagaagaagaggttttctctgtctaggagggagagattgtgcagcgaggtttctttctctcactaggaggtttgaggttgctgggagtggttacgaagctaattaggagctttgccgctttggttgagtttcttggtgagaggtgaggagagcgtgagcgagctcgctctcagtctcacgccttttgtgttgtgttgtggaggaggagaaaggaggcggttttttgttgtttctgtcagcgttttctcgtcaggtacagcctactatacttctttcgagttcatataccgtgctgctctcgaattcggaagcccttttttttctgctatcttgcgaagctcctgtgtgcaaagtcgaaaaagtttgccgaagatgaagtcttgctgaagctgccctgctttgcagctgcagtttcttgtcagtttccatggatgagtagcatgaacaagacgcgagcagaaaatggcatcttcaaccagtggaggaactcgagctcacccatttgatcctgttccttgagcattctatctcccaaaggagcaatcgcttctcctctttccatggagatgatggcgagcaagaaccctaccaaaaccctcctcctcctgctcctcctcgtcttcttcctctcgctggcttgctcccagccgctccactcggagcccatgtccaccaccaccaccgccacccagcccgcgccaccgcctcccccgccgcaatccaagattccccacgcggaggccggcggcgccgcccgcctccgccgcatcgtgctcggcgtcctcttcggctccctcactggcttcctcctctccctcgccttcctctacgccatccgcgtcgccatcctccacgccaagtacgccccggcaatcgtcaggggccccgtctccttcaccccgcagatttcccccaagaacctccactccgcgctcccctccgcgcagccgctcgcccatggccccaacggcaagtattacaagctggttcttgacaacgatgtcaccgtcgccgtcaagcggctcgaggctagccgccctgaggcctcgccgtcgtcgatgcccaatgtttccaagtctgacatgaggagggtgcagaggcagctggagttgctagctcgggtgaggcaccagaatgtgatgggattgaaggcgtatgtccgggaagccgaccggctatcgctggcgtacgatttcgtgcccgggggcagccttgaggatgtgatgaagagggtgaggtctctgcaggtgaacctcaattgggatgcaaggaacaggattgcgattggagtggccaagggattgaggtacttgcattttgagtgcaccccccggatactgcattgcagcctcaagccgtcgaatgtgatgctagatgaagatttcgaaccgagattggcagattgcggcgtttcaaggctaattgcatcaggttcagctgatccagaactggccagcagcctttattctgccccagagtgctaccaaagcagcaggtaaaatccatacgttcacgatttctgatcatattgtttagtctaacaagcaagtttattctctgaataatttcatcaatttttagtttattcttgacaatataactgaatgtgtttagatcggtctatgtggtttgcacatttgaactattgaggggaaacttaaacataaatcattcttaattttggtattttcagttcacctgcttacaagcttcgacatagcattattcttgaatgcaagctaatattcatatcttctcatttgtttatattatgctcgcgctgtaaaagatagacctgagaaaatctttagtaaaatctggttgtattttttcaaaatgatcgttatggcattggaatttttatggtccttgggaggtagccataagcttatacttccttaggttatttagagattcctcctatcgttaggcagtgagaggtctatagactaattaaaactaggaggtataaatgcctcttgatatctgccatgaacctctgtgaggatatgaaacaaacaactcatggtatttcatatttgcagaactatctagtgtatatggatgtttgcttacttgcattgggtaccttagatataataattttgataaccagcatggagtgatacatcagattagttggttctacaatcgcaaacaatagtacatttgttttggcaaaacaaccattcagagactctttgattatagcttacatctgcagatgcattcttttttccacatttggctttctttcccaaccagcagtatcaatccttaccttgttaatactgtccttttttttttcttatatgcatctctgttgcattttgtttcacaagtcgttttctgataatgagtagtcttctaagccattaattaatgaaaaggctcaaacagaagacataaagcatatagataaagaacggccccatggcttaatgtaggtatccgacttttgctttttgtaacacaagaatctttgctttattagagaacctgcatttgtcccttttgaaatgcctttgatccttatgcttttcatatattcctacgtgcatgcatgtggtatttggtctgcccccaaattttaaattgttctttttcattctgacctcccatatccccatcagagaataaatactttcaggattggcgttctgattctatattctttttctgttctcttttagccaaacctagatacgtcattactatatttttgaaagttaatttctcgacaagtgctttgtaaccagacctgattcattcaatgcccaagaagggcctggttagtgctttatctttgtcaaggtggatattatttccaccatatatttttgttgtttccaacggatccagcgttagttccagttaaagtttttccatttcatagaggttctgcttattaggtcttactgcccccttttaaattcaaaatatttgattgtgcagatacacagataagagcgatgtctacagttttggcatgatccttggcgtgttgctaactgggagagacccaacagatcattttttctcgggagaaaccgggcgcggtggattagctagatggcttcggcacatgcaacaatctggtgacgcaaaagacgcactggatagtagtgtcttaggagaggaaggggaagaagatgagatggtgatggctgttagggttgctatcatctgtctctcagatttaccagccgatcggccatccagtgatgaactagtccccatgctcacccagctccacagcttatgatctccgtcgaacgcttcttcgtaaagtactaatctctggatgttcttcatccatggcacagtttctgaatcatgctggagggtcaaaactcaaaaccctggatgcacaaactagtgtagctttcagtgtattcccttggaagagcccatgctaaatggcccacatgggaggggagctaacagttttcagaggccaatgtaggaaggaaatctggtaggtcttactagttcagttgtcagttatgttgtgtgttgcagctacatgctggtggttgagtgagcctcattgtcatgtgatgcttctttgcccttacatgatttggaggaggtaggcaaggaagatgtgaatattgtggtgtctttgtagagagaaagctgtctttttcttggatctattgcagacctgcagtggtggtggtatgatgatgtgcttctgcattgaccgatccatcaattctatcatgtactagcagtacatcggctccaccccttgcccatgacttgctgcaggagtgtcggggtccaaacaccattttgatggcatttttctcttcagttcacatgctcgcctgtccaacagcattttgatggccatgtatcatgcacagtcacattttgtgtaaaatgtaagggcctgtttggagagtttttggcagctgcggattctgagaaatcatagttgtagaatagttttcccaacttctcacaatctgaaagttgcttttcagaatctaaaactcccccaaattggctctgtaaatctcctttggcatgggaaaatttcattggaaacctaggagtactcttcctatgcttagcttagcatgtctgcatgtgtaacttgtgttgttgagcatgaggagaggagcctactactagtatgttgacaagaatccaatgtgaaatgaaattgtgaacctgaacaaacgttgagcatctttttttttcccttgcctgtctttctcttgcttatctctaaaactctgaccaagggttgcaatgtgtagtaagcagtggctatatttagttcgcgccaaaattgaaaaattgattgaaattggaacgatgtgatggaaaagttggaagtttgtgtgtgtaagtttttatgtgatgaaaaagttgaaagtttgaactaaacacggccgaagtttttagagtagcatagtactagtaattgagagagcttttactgcaacctaacctagtaggagtagttcactattttgcctgcatcatatcctgcagcttgcattggctgggcctgctgcaatgcgatgcaaggcaggcctgtgggcctctcatggcagaagaagaaatgaagagagagtggtttggctgctgtttgttttgcggtcagctttccattgctttggcacttctgctgttctgcattgcagtgcaggcgaaggcggcagaaagacggaactccacagtgaaaggcaggcagtccggagaagggcattgccgcattgccattgacatggagtagtacgttcctagtactggtagtacttctctttctttgcattgggggcattatgctattgagatagtaatggagatgtgctgatatatgctcactgggaaaaaaaaaactgcacggatattaaagctgatcagtgttgcagattaaaaagttactctagtacttagtacgtcagcacagatattaaagctcatcagtggtgcagattactcctttttcatactactttacgttttagttgttttttagggtgaatagccatttcacacagtttcatgggagaatgacttggcatacttacgtggcatattttgtgggtcgaaggattatgttaacctaaataattaatttggatgacttgttcagacgatttaaaacctcatggactaaattgttcgcttcaggaccgtattagctattcacccttttttttaagtcaaatttttctaactttaacaatcgattcctaaaaaaaattaacatgtgaataactcatggttacaaatatatttctcatagttaatctaaaaacataaattttacaatattaaactatacaaacttctaagaattgatggtaaacattagtaatgtttgactcgtgacaaagctaaaacaataagtacttttcttctagaaaacacaacacaaatacaagtgcccacaacatgtgtacgctcacccatgtggagacgtacatacacacatcctatccttataaacaccttcgaaagactggaccatcatatctcgagattgatgaagtctccacggatacctcactatcgacgagtatgtcgtctaccaaactaccaatgaaagaataattaaccgtaaatgcaagtgttgatctcaactgggctggttccaaaaaaacctaatctctactacttaaaaaataagaggtgcttccatcgtccgtcaaaaaaactgagcgaaaaaaccgagcgaaaaaaccgggagaaaaaaaaatgtccgatccaaaaaaaagatgtccgatccaaaaaatatgaaccgggcaaaaaaaaccgagcaaaaaaacacatataaaaaaacgtctgatcaaaaaaaaaggagaaaaaaatgtccgatccaaaaaaaagagcgaaaaaaaggacaaaaaaaaacaaatctatccgatccaaaaataatacggggcaaaaaaacgaaacgaatcagtaaaaaaagcatttttttttaaaaaaaactgtccgattccaaagaaaaaggaattatatgtgacgcggtaaaaaaaatcgaatcctattatacctagaaaggtccgacactataataaagtggtgaaaaaaaaccattcgtaaaaaaatgcacgataaaaaaaagggcggaaaaaagcgcggtgaaaaaaagtctaatttatatttatcattttagtagtccgtttatatctcttctttatctctaatctaatctaatataactatttaaaaagagaagtttctaccatatattaaaaaataaaaaatgcgcgagaaaataaaaacggtttaaaaaacgcgtgaaggaaaaaatgtcagaaaaaaatcgcaaaagaaaacgcgctagaaaaaaagttccgtagtccgtaaaaaacacgcgagaaaaaaaatatttccatcgtctgtaaaaaagcaaaaaactattagaaaaaaaggctaaattgatggacacttggtcggataggctccatcgacttttttccatctcctacacgacttttgtttcgttatctattctcctatattagagagcctgcacatctttgtaggcaattatcataatatttttgtgaagtatagctattattcttgataacatattatatataaataatcttagaaaataaatatattctaattgttatttagagaagagtgcatagtgactctattttgtgtagacttgaccatacgagacagtgtatgatttgattggttgcaagaatgagattaaaagaatattttagattatatgcatgttgttatatgaataatccaattattttaggtaaagcaaatatcgtaaggttgccatcatggaggttgggctattacatttaagctgttccaattttctaattttctaattgtcatcgacatggttatgcatgaacaacgtatattatcattacgttttttcacccgttgcaacgcacgggcatgtttgctagtagaataaaaataagggagtaaaagttaacccctatcactttatcagatagtcgaaaatagccctgcctcatatgttttctctgcttttttaaagaggaaaagaaaaacgttcggatagtcgaagaaggtttttgctgcagtacagtagcgatggtacacgaggcacagcgcaatgggccaaggcagcacagcagcgcagtgaagcgagcgaggaggggggcccacccaccggcccaagctaagcgaggacggcgtggcggtgagctgcagcgtgtgtgggccagggcctcctccgcctctctcccacccgtgactcctcctcgggcgtcgcttagactttcttttgcttttggatggtgtacggcccaccacgacccatccggatggacggccccgatccaccaacgcggcgcgaatctcgaggccgatgggcttttcggaccgtacgatggatgggtggtcgacgaggtgactggccttgtcgcagagagggggtgtgggtgtgtcagtgcaactcagtagtgggcctccatggcccatgccagatggggcccatctctctctctctcactcactctctgctacgactgcaagtctgcgatgcctgcgtctctgctcgaatcgatggatggatggatgtgcttgggcgctgctgagctcgtgatcattaggctccggttaattatgacaaaacactattactgtctatactgattagtagtactacgtactcctactaagtagtactcctatggtatttggagtattttgagagcaaatcaaagccattttggaatcaagaatagatccaaacttatcgctgcaaattgacaaccacctgtgagattttcttttagctggtgcttccgtgaacttatctgatgcagacgtatggagtattggagcactactgtactatacaactacagtactactgtagactgtagtaaggccggcttgtttgttcatgtagctacaactttctcattttctgttagcagggttcctaaattgctaggtcaattttttttaaaaaaaaactttttatgtagaagtctttttttaaaaaaaaaacgaacatgcactgatatcttaatcatgtttaatgtgtaatccagttaaaaaagctaaccgccacctctcgctagaactgagctagtgctcccttccagcaagacgcgtgatctgatgaatgttctttgctgtctctgtgttcttgcgtgtgaactttcacttcacggggaggaggccgtttttactttaaccgctcgacgaccactggccggggaattatccccacgcggtcaattcatagatttcgagtcgccacctcaggcgatccctccataaaatttttcaccacgtcacatcaaagatttaaacacctgatatttagtattaaatatagcctaaaaagtaactaattatacatattgtgattaatttaagagacggatattttaaacctaattattctatgatttgacaatgtggtgccacagtaaacatttgctaatgacagattaattatacttaataaattcgtctcgtgatttacttgcggattttgtgattagtttttttattagtgcccgaacaacccatacgataccctatataatacccaatatgacacgtcaaaactttacgcactgaatctaaacacccctcaattttccataatatatactcctacttcagcattatgtatctgggtctccattcctcctagtcgtagctgacttaaaaaataactactaccagctgttatttttcctttttataagtgtatttatcaaggaaaacaccaagtttattcctttcatgttacagttggtcagaaactggtcgttgaaatagagaggacctaattgagctatagctccatgacttgcagttttcacaacacaccacacttctctgtctgaatgaaccttcctaggtttagacctagtcttcatctaaagctcaaacctacaaatgatgaaagtgactttttttaacgtttttcattttttttttctttatcgaaggatagttttgcagctagcaaatgctgcatccattcccaagtataagggttttggctacacgctattttagaactaagatagcaagtattagcaagtacacatcaaccgagaagtcatcgtgaaagtacttagaaaataatgttgtgtcaatccaggtgcataactaaaatatctcatatttccaaatgttagacggtgataagcactaagtaagtatacatcaaccgaggaggtgtcacgtaaaagctttaaaaaacaaagttgtgtcaattcagatgcataactcaaattttttatatttccgaaaaaatagtaagtgctagtttttcgcatattccgcacataataacaatattaaaccagaaagattagaatactcttactttaaaaaatccaaatacgattatttctctctttatatactcttgttgtatttattccttgttttcataaaatccgatgcaataattgtttaaaaattagagttatttggatacaaacaggagaagccgtcgcgaaaaagcctcagaaaattacagagtgtgaaatgtccactacgatccatcagcagagacagagatcgccattcccaaccggtcatgccaattaagcataggaatcagggagcgtgacagtgtcatttactccatttagcagcaacaacagcaacaacaacaaaaaagaaagcgtcgtcgccgatgcaaataaaaagttctggaaatgtggatctcctctgatacccgctgaattaattaattaatcagccagagaaaggctgtccgtgttagggaggattatataagagcaagtcatctataactaatataatagccaattcatactattaatatatggtcccacctatcatacgtacagtgtgtcttagagtatgtgctgcagctggctacagatctatagaccgctgctcttttctctcatcgtttatctcattaaaatatgtttatagctggctaatagcctactattgtacatgctctaatctatctccattgtcaaggcagcattagcatccactaatttaattgttaatttaattgaagggaaaaccaatgaaatgtcactggattcagtattgttcccggtcagagcccaacagcgcgatggcggagattaagatgcctgcaattacgcatgagtacaaatttgttttcttttcaataaatggagcctaagtccaacaaactcagcatggttcgtcgcacattctttgattatttttgttattgtcatatcattttccacatctgatagcaatgcccttgccacgtcaaagacctagacaaaaacagacaaaatgtcaacgtaaaccaattaacagattaaacaaacggacatgattttcttttttaaaaccacacctgcttatcctatttttcagctgtaccgacagagatttccatgaaattgacacacgttacatagccaaggtgaaatttctatcctttttttttctttttgataaccaattatacaaaatttacagtcaaaataaccacatattactgcaaaatataatttgtaataaccgactaatacaaagtttgtaaccaaaacaattacatattattgcaaaaatacaatttgtcaggaaacaatagaggttgtgtttagttactgaaaaaaattaaaagtttgagaaaaaatggtagtttagaaaaaaaaattaagagtttatgtgtgtagaaaagttttggaagtgatgtgatggaaagatgaaagttggggttaactaatcacggccagaaataaccgaaacgccagtctaaagactggtataacaatctggtgaaccttcatcctcgattggctaaagacaggtaaaacaatccacggctaaacctttatcttgatttgtaaaaggctgcacaatctttttatataaatatgtactctagttcttgtcccctattccttttcctttttccttttcaatttttttaagaagcagtgtgaaaatttcaccatctgtccgagtgtggaagccgggcaggtccacgtgtcactttcggatgatccccatcaggtgagctggagctgctcgacggcagtgactcgccatggatggacggcagctggctctgtagggatggaaggcaggaagcagctgcagctggctggcctgcatgcttgccgtgtcgaccagctacaggagaggcggtcaaaattagtgccgtgaggacgaaacccacatcattagagcaagtatactataaacctactataaacttacgtaaaggagagaggtaaacaaaagagaaatgtgttggctctcatacaagagctaacttaacacaagctctaagacaaatacattaaatatataagtgagagatagagatagaagaagaaaattatagctaaccttatagctaatctattatatgtgttgactttagtttaggctaatagtaggaagtgggctatattagtatccttgctcttagcagcatactaatcagcccagccttttagggccccgttgaattgtaggagtaaaaaaatagcggaataaaaaatacaggattctgacagaaatacaattgtagaacaaaagattacaaaacacaagaaaaacacacgaatgaccgtttaattggaccaaaaaaaaacacaggaatcagatgagagagatagactcagaggaaatgttctaaggggttagacctcttgcaaacttttctccaaaatatatataggattacctattgcatagtaattttaaagaattggataggatttaatcaattgtttcaaagactttcggtttttttctataggattgaaatcctccaaaattcccgcaaatcaaaggcgcccttagcttagcttccggagcgttcaattatttaattaccgcctcggatacacaactaatcggttaattaattattagtcgagatgagatgagattccttggacgactcagcagcaggatgcacagtagtagtgctaggtcttcacgaccggagagagataagctaaacaaatatactagcgccactaccatagttaattaattattatttaattatatcgtctctctaatgacccagtaatgatgataaactttttagtattttttctccatttagttttgggctgcaaagcaggagacatatgtagtactagtagagcaagtttaataggatagctaaatggtggcttcaaatcatctatagctaatataatagcctatttatataatagttaactataaaaatatactacaacattaatatccggtcccatatcatacacacacgtaacgttttaaagtccgtgttgcagctggctataaatctgtagcccatttttttctatttattttcttttttcttgatacgtggttatagcggcttatagtgctactgtacctcctcgtagtagaagactagaagaggcaatagcttagagtaggtacaatagcagtctataagtcagctataaatatattttaaagagataaaagaagagagagaagagtagcgggctacagatatgtagccagctgcagcacgggttctaatatataatgtgcgtatgacaggtgggaccagctattgatagtatagtaagtatctattgtatgaattggctattacattgactatagatgatagtagtaggctatattattaaacttgctcttagccacagtgcaggcccagcctgagccagccatcgtggccagctcgcgattagggattattaattagtgggtgcaatcaattatggtggctaatgggaggggattagtagtttaatcacgttcccccgcggccgcggccgtcgcggtggaaaggaacaggagacgcgcgcgttgttgccgtcggatgccgcgacagcgcaggccctgctccccgccgtccccgcacgccgggctccgtctccctcgccgttaagcaccgcaattattgcacccctcccccctctcgccgttaagtatagttaattagtggatcggattcgatttgattaggacagtcccaaccttccatgtaggatgatgtctatggtattaactacattgtcatataggaattttagcttatgtgtcactatattatttaagagagagtaaagagagaaagaaactgagtctcatgcaagacacaactttaacacgagaaataaaatgtgatgctgctgctttttcctctgatttggtggtgatcgctccatggtgcggtttcttgttatggagcaaacaccaaagcgttggtcgtgtttattgctgcctttttttagctcttactttgagtacgagaattcgtttctctttcttataaaataatcaacgcgtacaggttcttttttttatatatatgaaaatctgcgtttctggaaaatgctccatgcttgtttgttcatataagtctctgaatcgtggagctttgaccatttcaaatttacaaggaattcataaatattctgaaatattttatattatcatcaaattttgtctgcgtgctaaatacagccatacaattttctttccaatcaatttaataattcaaaataattagcggtcaacatcaaagcaacaacgatcagcaagtaaacctgtaaacggaaaccaggggtaatgttctttctatcaagagcaatcagtagtttctacgagccaagttacgtggttgttaatactcgaattattccatcaaacaagttaataaagctgggggggggggggacattctttttttttttccagaaaaagaaggcgccggcagaggggttgggcaacccgttcaagggctcgttttgccttgccttttccgggcgagacgaaaggatccatcacacggccggggggctctcattcccaaccccgctttccacatttccaaatctagacgtgctttgcttcgccggaaatccaacccacttgctcccaccctaagccccttccaaacacgaaaatttttttatcccgtctcatgtaccgtttcagtataagggtaacggtgggtttccatatttaatgtttgattattcgttttattttaaaaaatataattaatatttttattgttattagatgataaaacattaatatactttatgtgtgactgattttttaagaaaagtttataatttttcaaataagacggacgattaaacgttagatatgaaaacttacaaacacacttatattaggacggagatagtatgatgtatacaaaatcttggatgacgtttgtgtaaatcgtatgcgtatgatttcactcgtcgtaaatttaaattctactagtgtttaacaaaaatcacataacatgcgggtgtgttttcaacggaattacggtgagaatagagagtcacagctactctatgtctgtttgttctgtttgtttgcatgtgttttagcgcatattcgtcggtatgtgagcgtggtgttgagtgtacagcagagtgtaagcgtgaattgaaaagaaaaagaccaatactagcactagaataatgaaattgtgaaaatgatcgaaaagaaaataaaggaaagggagatcacttgcttatcacctgcggtccaatgggcgacggaaacatggagcccgtgatgtaaaatactcgagagaaaaaagaagaattagcaggaaaacacgagcagcggcagcgagcgatggaacggagcaagtgggggagagaaaaacagggaacgggggtgcagcttggtctctcgggtcatcaccgtccacatcatcacgcgccacgaaatatctcccccttttggtaaactcgaaattaggaggaaactgtttgggttctgtagcagttagtgacctattagagcagatacaatagtagaccataaaccagctataaacatattttaaaaaggtaaagagagagaagtagtatcacggactccaatacgtaatgtgtgtatgataggtgggaccggatattaatagtatagtaagcaactattatatgaattggctataaataatttagagctaatagttggctatactattaaacttgttcttgcttttagtactagtgctctgttttaacaccactgctgccaatagttttactgataccgattcttcatgtctcagtagccatcaataccagcggcttgacaaaatttaactctacaaagataaaacgcaccttcaataatgcggtagagtggagttttccatcatggttgtacacacgaatcctggtgcagtaactctgtgtttaagcgcgcaatactacaactaattaagaagtcttttgagctactccaccggacaattatcgtggactaattttttgatgcctccatttattataaaagtactatttctattgtagtactgcttagggctaaacacactttaaccgtttatcgctttatcaaattttaaaagttctataagttttttctcttaaaactataataaaatttggcaaaaggcatgaaagtaaacaaaaccaacactaaaatgtgcttaaattttcgtatggttgattcggtgaacaagtccttgttaacttgatctcagcatactagtatcacttatctcctcctgtggcatacatgttagggtgacacaccactgcttgcccgtgtgttacgcaacagagaagagagacaagatagtagtaaaagaaaaagaaaatatcctatatactccagcaaggggagcagcgtgtgtgcacgtagcacgcacagcagtaggtgcgcgaagcaatggggcatcgtccaagccaaaaaaaaaagaaaaaaaaagaaaaaaagaaaagctgtccgtaggtgagggtgtgaggcgagagacggtgctgcatccaccaccccgctgcgcccgctgccgctgcagcctggtcagccagccagacagcccgcacccacgcggacagggcccaccacgaaccaaaccggcccggttcggttcacagccacacgccgcggcccggtttatttctcttgatttatttaattggtttaacttctttttaatactaatgttttagcgtgtggttttttggtgtactccctacaaagagaccaccaccaatccggctaccccatcccccctcctctttctctcctcttctcctctccacaaaaacatttctactgcttgctcgtctagtattccccacctccctttccttgccttcctcgctgcctcctcctcttcctcctccgtctccgctagggtttccgcgccgccgccgccccgatccgagatgccgccggccgccatggctccccctcccccgccgcagggctcctccacaggtacgcgcgcgcgcgacccgccccgcgcggtcagatctggtcaacacagctctcctcgcttgcgagcttcgttggggttgggtttcgaggttgttaatggttttggtggtggtgcaggggatccgctctacgacgagctgtggcacgcctgcgcggggccgctcgtcaccgtgccgcgggtgggcgacctcgtcttctacttcccgcaggggcacatcgagcaggtggggtgaagcttccccttctgattcggcaattttcggcttgagaggttgctttttcgagcgctgattttggttttttgatttgattgattgtgctgggttgctgcaggtggaggcgtccatgaaccaggttgccgacagccagatgcgcctctacgatctgccctccaagctgctttgccgtgtcctcaacgtcgagctcaaggtgtgcttcctacttcccctttgatttgcttgctcttcaattccggagctcaccgacgcgacccctctctgcttcatctgtttgtttgtttgttctgcttcgattttgactctgttgctttgttatttttttttgttggggaattttgtaggcggagcaagacaccgacgaggtctacgcgcaggtcatgctcatgccggagcccgaggtaaatttcccgcgtgaattcttcggaggatgagtaatttttgccgtctcggtgaagttgtttaatttctttctctgtttgaatttgtttaatttctttctctgtttgttcctgcagcaaaatgagatggcggtggagaagacgactcctacgtccggccctgtgcaggcaaggccgccggtgaggtccttctgcaagacgctcaccgcgtctgacaccagcacgcacggcggcttctctgtactccgccgccacgctgatgagtgcctccctcccctggtatgtgtgtcttttaaccctggagtagatgatcctattaatgttcttcatttgaagtgtgtttaagttgtaattgatctgtgctactagctgacctgatctgcttgcttgtcaggatatgacccagtcgccacccacacaggagctcgtggccaaggatctgcacagcatggactggcgcttccgtcacatctttcgcggtaagttgtgtgcccctttgcttaccatggttcatgccatttttacaccgtcttgcatacacctgcggctctgcagaccactagttgtaattgctgttagttctttgtcaattgattagaccactgtaccattcaagcatttctggcaatgttacacatcaaatctttcaatgaatcgcaaaagttttttctttctgtacttgatgttgacgatgatgatgattattgtgttattgctgttgaatatcatcagggcaaccgaggaggcatctccttcagagtggttggagtgtgtttgtcagttccaaaaggcttgttgctggggatgctttcattttcctcaggtctgttgtggtaccctctctgcccagcatttcaattccttgatcaagtgttaactttgctgtgctctacgcagaggagagaatggtgaactccgtgttggtgttagacgagctatgaggcagctgtccaatgtgccttcttcagtcatatctagccaaagcatgcacctgggagtccttgctactgcatggcatgctatcaacacgaagagtatgttcaccgtctactacaaacctaggtatgttgagatgtccactacaaatctattgttttatctggctgttaggctattcttgcatagttgcatgatctgtaacatatcgaagctgttcctgccactgtgatcccatctaattaaacttctctgaatgatgatgataggacgagcccttcagagttcattataccatatgatcagtatatggagtccgtcaaaaacaattactctgttgggatgaggttcaggatgaggtttgaaggagaagaggcaccagagcagaggtatctgttgtcttgatattctatgtaaatatggttttatgtggattattccaagtgattgcttgattaaacttatttccattatgtaggtttactggtactataattggcagtgagaatctcgacccagtgtggcctgaatcaagttggagatccctgaaggtaggttcttgtttactactggcattttatgtggctggagaagttatgtattgatgggaggagtttttcaataatgtaggtgcggtgggatgaaccatcaactattccgcggccagatagagtctctccttggaaaatagagcctgcttcatcacctcctgttaacccccttcctctttctagggttaaaagacctaggccaaatgctcctccagcatctcctgaatctcctattcttacgaaagaaggtaactacacaatcttatagatcttaagaggaagggtgatgataatgcgtgttcaattaatcctctgaaaactgttggtgccatttgcagctgctactaaggttgacactgatcctgctcaagcacaacgaagtcaaaacagtacggtcttgcaaggtcaagaacaaatgaccttgaggagcaaccttactgagagtaatgactctgatgtcactgctcataagccaatgatgtggtctccatccccaaatgctgcaaaagcccaccccttgacatttcagcagagaccccctatggataattggatgcagttgggaaggcgtgaaactgactttaaggatgtccgttctggctctcaatcttttggtgattccccaggcttctttatgcagaattttgatgaggctcctaaccgtcttacttctttcaagaaccagtttcaggatcaaggttctgctcggcacttctctgacccatactactatgtatctccacagccttccctaactgttgaatcaagcacacagatgcacacagacagtaaggagttacatttctggaatggccagagtactgtgtatggtaattcgagagaccgaccacagaatttcagattcgaacagaactcatcaagttggttaaatcagtcatttgcccgacctgaacagccaagagtgattagaccgcatgcatcaatagctccagttgagttggaaaaaacagaaggcagtgggtttaagatttttgggtttaaagttgatacaaccaatgctcctaacaatcacttgagctccccgatggctgcaacacatgagcctatgcttcaaactccatcatcattgaatcagttgcaacctgtacaaactgattgcattcctgaggtatcagtaagcacagctggaacggcgactgagaatgagaaaagcggtcagcaagctcaacagagttcaaaagatgttcaaagcaagactcaggttgcttcgacgaggagttgtacaaaggtatagtattgttttcttgatggtcatgacaatgtgcatgtcttttctgttgcacaattttcttttacttaagaattactgaatgtttgttgtctagattatgctagctgttgagaacaaactatccagtcatatcagagtgaattgattctggtggtgttaaagcacatattgttcttttattcagcacatgaagttttttcttctcgtagttgacatgctgaagttctcgttttgtaaatttcttgcaaaatctcagttttatcccctttgtggtatggtaaacccaattttgctatttcttgtcccaaaaaaaaatcatgagcaatattattcagtgcagcatgagtgtgtcaagtttgactattggtctgcactatgtaataacatcatgtcattgattcttcatgcaggtccataagcaaggcgttgcacttggcagatctgtggatctttcaaagttcagtaactatgatgaactcaaagctgagctagacaagatgtttgaattcgatggtgaattggtgtcttcaaacaaaaactggcaaattgtttatactgataatgagggtgatatgatgcttgttggagacgacccatgggagtaaggcttctatcttgggtacctgcttgatgttttgttaagctttccttcctaatactgattctagctggttcattttatgagcagagaattctgcagcattgtgcggaagatttatatttacaccaaggaggaggtccagaagatgaattcgaaatcaaatgccccaaggaaagatgactcttcagaaaatgagaaaggtcatctgccgatgcccaacaaatcagataactaggtatgcctgctaaattgccttatctggattaatttattcaattgtcgataaaacttgaaaacaagaaaggaagtcgtagattggaagtgtagccgtaggatagtaaaattcggtttctgtgaacttttattctctttccattgcctctgcctggcttttacttattcttgatctgcaagcatggtcacgtgatattgttgtttgctatgaagagcttgctccgaaagcgattcacctttcagttgctgtttttggcgtttgtgcaggttcagtgaagcgagatgatacaagaggtagatcgcatggagtcttgagagagagatgccattctgcgggtcccagtcaagtaaaccccctgatgtgttggtgatcacccctgcccccccttttgcttatctgatggctgatgcaatgcaaaccctatggctttagctagtatgagatgtagactgcctattgtttatccttttgttcctttttcttctcttggcagaaagatttagggccaagatttatcattattgctattgcccctctcaactcctcccaactctctgatgtaaatatttatctacgtagccagccacccagccagaagtagagcagtagtagtagagttaccccctaccttgtattaaccagcagcctattcccccggataaatttgtgtaagctctgtagctcgagataaaaaaaaatggcgatcgaacgaacgaacaaatggcgtatgtattgtctgatctttgatataaatatttatcaatgaatgtatcatagatggatatagatgaaggcatgctgcaacgtgtttaatttggcaacgttggtgtggaaaagcagaaagctgagagatcattgttttgttgtatatgctcgtccagtaatcgattggtgatttggcagcagttgattgcgtggtcgggggagggggatggggatggggatggggatggggatggagacgcggccgtgtgttgggggtgttggaacaaacaagacttggttggaattggatggccgcgtcgtgagtgctggtgggcgcccactttgcctcctctcccttatcatcatcttctcttcttgttgattcctacggtaggtactagctgatgaggaagtcttgagtggtgcggtcttgcagtgcaaaccaagggaacaggaaataaaaggggaatagtagtattggcatggcatatgctgcaacccccttgtgtcactttcggtgctcgtgtgtttcgttgactagagagaatggcaggtgctctgtccgtcccataaaaagtctcataaaataaaaaaaaacttatactggatatgacacattctattacaacgaatctaatactagaatgtgtcatatctagttctagaatcgttttttttccaaaaaacatttagttttagatttgtttttttttttccagatggagggagtactccagaaagctgcctctactagtgtgctctcaatactgcgctacagtagctagtaccactgctattgctgcagtgcttacctgggacattttgttgcgatacttagtgttgcgaggacttgatcactcgtcgaccggctttcccatcgatggagagaggagaatgaatggatcaatcaatccctctatcccttcctgtgggggagcactgaagaagtcgactttgaccgagtaattgactgcatcgggaggtcgtcacggggaagatgagatgcgatcaacacgagccgacgccgacggccaccgagtccaacgccggtgctgagcctcagcacacaaataattataattgagtattaattattactccctccattctaaattaatttacatataatatttttgagattattcctaaatgatctacatatttgtgttcatttattaagtctattcgttatttgtgtattggagtaaatggacattaatacatgcatccatgcacacaagtatttataacccacatgcaatatcttgatttgctattggctaagaaatagtgggaatggtgcatgcattgagtttgttgctaaagtaaatatagtatgagagagttattagtttttcttggtcttggtgtacctatgaaatatgtagatcaatttggaatagagggagtacaaattttagaaataaatttatttgatttttttgaaaaaacttatatatatatattttaaaagaaccgtgcgttaaatttgaaaaccgtgtcaacggaaggagctgaagtttagttgaagaaaagaacggggcttgcacggcactggcaggtgggcccgtcctacttcgcatagcaggcgtagcacatgctgggccggcccgctcgtggtggcagtggcactgacaaggcggggccactgaaagcgaggtggggggcccatcttggttgggcctgacaggatcgagtccacgcaggcgggcgagtccaagcgcgtggcgacaaggcctctgctttactcgtggccagcagccagcagccagggccccacgcgattctctgtctctcagactctcactcgtctcgtttttctcatgctactcctacatttgcatcactaattcactacctcctctgtgccttttgttgtacgaccatggcctggatcgatgaatcagtgatctccgaatcaaagtccaagtcttctcgacttctcctctttagaagggcatccacgagaatattctattcaaccacctattaccattgtgcaactagtccatatagaaaaaaggggatcccta

SEQ ID NO: 59979 - DNA, 1704 bp, Oryza sativa
atatatatatatatatatatatatatatatatatatatatatatatatatatatatatatatatatatatatatatagtcagttcgtacattagttatttatactagtagtacactattaatatctggtgacatctatcatacacacattatgtcttaaagtccgtgctatagctgattataaatatgtagcccactactcttgtttttttatagcttcatgtaaaagaaaaaaaatgtttatagctgatatagagcaagtataatagtaggctataagccggctaaatgctgagttggaggaaagaagagaggagagagaggagaagcgggctgtgaactaacagccggcttggatgcaagaaccaagaaactctttgagagagacaagtggactctgtattaattgtgaagagctaactattatatgggtaggttgagaaaagtctataaagaaccttatagccagcaggtcggctgtattattagccttgctcttataatctgttatgttatggtaactactgttactagttttgaatcgaaatgctagtgagtactaatgcttcgttgacaatccaacgtgaccaatgctcctaataactcatcgagtcgtcatcatcatctctcacatagcatctttgacaaaaacactttagttctgcacggacgaacagcagcagcaagcatcgaatcgttttcgatgccgtctatcacgctgtcattactactccactttaggatgcgcatacggtgagacatcttctgaaacatatcaggaactcttgtagttcatgtgaaagtcctgcaaaattcctacagtatattccaaaggaatcaagtgttacacagaacagaacacaattgtattgctagcttcaaatttcagtgccattgatcttaaacaagttcaggcgaggcagttgtcatgcaagctccagttgcttgcatcctgagtacttacttgccagaaccagaagagtaaagacagatcaatgtaccaaacatcaaactaaaccaactgaatgagagagaggcaacgcctaagcatcgaatgctggtcatgcgagtgaagtgataaactggaggcgatgctagaaggatgcaacaattttcaagtgtgagaagagtcttatcaaggactaccttggatgcaatatactcctagaaactgagggattatcttttgtaagttgatacaaccaatgcttgtaagttgtaacaatcacttgagctccccgatggctgcaaaaaacatgagcctatgctacaaactccatcatcattgaatcagttgcaacctgcacaaactgattgcactactagaatcagtaagtagtaaaagtacagctggaactgcgactcagaatgagaaaagcggtcagcaagctcaacagagttcaaatcaaaagatgttgaaagcaaagtctcaggttttctctgaagttcatgacgatgtactacatgtcttttctgccgcaattttccttttttactcaagtattattatgggccgagaaatgggcccaaatggcagcctgaatcaggcttgccaagacctaaccctaccaagtctcgcggatgccgccgttccttcctccctcggtaaacaaatacgaatctttcctgtttttttttttgattttgacgatttcatcctccttgttggtaaaaaagatctttcctgtttagtttttgattctga

SEQ ID NO: 59980 - DNA, 6507 bp, Oryza sativa
cctctcacggaggtttctgaatctgatcgtggacaaccgcttccctggatccaaatcgctgcgctgcatcgaccttacgctccagaatttcttcaacatatcagattccaaagttgtcgcggctgatgcctccgcagccataagcggcagcatggattggatccaacttccaagcccaatgttcaacttccaagcttcaagtgtggcccatcactgggaaattagctgcttcccgctaagaggtcgtgaggtgctctgcatcgaccaggatgaatgttgtttgatcttcttgttactatgcctgacctctatcaccccaagggatgccccatctccctattcgttcccagcaccaatgttgatgatgatgatggtgatggcaccctcttcatcatggagagggtcgttaaaccggagtcgccgagaagttcaccgtcgcacagcgatcagttcgaggctgttttctaccgaacgcagagctctgtccgcagtgtttcgtccacctgcaaacctctacctccaccgcctttcgtcagagaccccaaattctccaacacacgcaccacgatcaactcgtacgcggtggtcagtggtggatctgagatctgcatttcggtggagggtgctggcacttactgcatggacacagtgaagcatacttggaggcatgtaggtcagtggacattgccattctatggcaaggttgagtatgtacctgagctcaagctatggtttggcctctctgacaagaccaatcacttggctgctactgatctctccgccatggatgactgcttccagaggccagagctagtgagagcttggatggaactctcaccttgtcagcctgggctccggcaggttctgcatcgcaaggttcttctacactcaggcattttgcgggctactatcgtgatcaaataattgatgatccctttgttgtcttgactggtgtggatgttgtgccggatgatgctagtggtgatgcaaatggcagcatgggggaagtccagctccggatgatcaagtattgagtctaaacttgccagcggtgcgatcgagagagtgttctgaataatttggatctttcgttcaactctatctgctagcattatgtaatttttggtctagggctgtaaaagagatttggtatctttcgtaacttttgtgacaattactaaagttatttatccatgagatattgatatgatgtttagttttgtttggtaaacaataatcaagttaataacttttgtgactgttacaaaactaactgacagaaagccttttattttcctatttattatatctagcctagatttcattgagttttatttcatattcaaattctcccatttaaatttctttgcaatgttataaacagctcaatttattcctctaaaatcctattatattagcacagctttttttcctaattaattcctatgacctatattttttttatcctacctacacataaatttcaaagttcctacatctatgacaccccttaacctaaattcttaatcaaccccttctagatctctttatttaaattcgtttgaaatcctattcttacaaatattctgaattcagacatctatcttgttcaacatcttccatttaacaccttcccaattttataaacatctcgatttattttcttttggctaacacttgttcttttagccatatccctttttccataacttaaattccttaatttccgcctccatagacattctgaagtatttataccaaaggctcgactctaaattcaaatatttattcttctatccaaatactcttcctttacaccaaaaacccaaataaaatccctatgaatttctccctcctccacctaggccgaccaccagcccatccttcttatccagtcctcagtagcccatcaggctccaggcccagagtcgcggcccactgatccgacctcttctcctcctcacccccctccgccgtcacgactcacgagccctcacgagcaaaaatctttcctgcttgattttgattttggtgagagctcgaattcaatttccaagttgattccgacaataccgaatttcatccttcttcttggtagtaacaagtacgaatctttcctgtttattttgattttgatgagctcgaattttgattgaatttgaagttcaccccaacaatggccctctcccggaggtttctgaacctgatcatggacaaccgcttccctgtatccaaatctctgcgctgcatcgacctcacgcaccactgcaatctcttcaacgccacaccaccgaatttcttcaacggatcaaaatccaccataatcagagtggagaacaggattcaacttccaagccccatcttcaacttcgcagcaggtttcggcgaagctacacgtgcaggtttcggcgaagattggaggatggattgcctgccgtttcttgatcgcagggtgatctgtgcggaccagtcgggacgctgttttctcttcgaggcagacaggagccgcgtggttatgctgcctcgtcttcacggacccaagcaggtgcccatctccatcctcatcccctgccctgaagaagaatccggtgaattcgacggcggcaacttctacatcatggataagatgagcagagctggagtgtcgggaaccaatcagttcgaggcgttcgtctactgccactatcgtggaagtcgcatcatgaaatcatggacatgccagcttctcccgccaccgccgtatgtttatgacagaacatacttgggccgatggctggagatcagatcttatgttgtggttgattatggctcgaagatctgcatctctgtcaaaggtgttggaacctattgtatggacaggaggagcctcacgtggagtcacctgggaaaatggatgctacccttcattggcaaggttgagtatgtacctgaggtcaagctctgggttggcatttgttcaagcacccatgaactggctgctgctgatctctcatcgatggattcgcagccacaattagttggtacttgcaaggagtttgaaccgccggaggaatggaagcaatgcagggatcctcaacttgtcaacctgggttccggcaagttctgcgtcacaaggttctttcgcaatcaggctcccaaaggggattctgatgatgagttcattgggaggaacattactgtcttgaccggtgtggaggtgatgcagagtgcttgtcatggcaatggcaatggcaatggcaatggcagcagtggggaaatggaactccagatgatccctcacagatcgagatggtatggtggcgataccatcgggacagtgtgctgaataaaatgtttcatctgggacaactcagtatcttgtcggacaaattctgctcttctgtgctgcccatttcatacttcgatgtattttggtagtatcctctgcagtggtttgtaatgtagcacgggtgtgtttagtttgcgaaaagaaaatttttgggtgtcacatcagatatttgatcggatgtcggaacgagttttcgtacacgaatgaaaaaaattaatttcataacttgtctggaaaccgcgtgacgaatcttttgagcctaattcagccgtcattagcacatgtgggttactgtagtatttatggctaatcatggactaattagacttaaaagattcgtctcgcgatttccatgcaaactgtgcaattagtttttgtttttatcaatatttaatgctcatgcatgtgtctaaagattcgatgtgatgtttttagggaaaaaaattttgagtactaaaccagaggccttagttagatgagtgatgacatgtcttgctgtgacatagaaaggagaacgcaaactaagactttagatcaagtttttttaatacttttaaggcactttagatccaaagtgaaagcacattcaagcgaggaacttgtgacgcatgctccagtcgttttgcatcctggtaaaaaacagatcgagctaccaaatgtcaaactaaaccacctgaactagcgaggaaacaacgcatcgaatgctggtcatacgagtgaaaaaataactggaggcgatgctagaaaacctgctccaggttgcaatatttgtttttctggggttgtacggactaagctgatcagctcatgtgaagggcttcttcctcgacttctgtcaggacatcgtcctcgaagaacgcctggtggagggcctttatgcactgttttgcctcgctatcatgaacaatcagagacatgttaacctgttgaaggcggcaacattgatatcaggaaccaggacatggatacagcgttgtcaagtgtgagaacagtcttatcaaggactaccttggatgcaccttgcgagatcatctggacattcaccccgcttttcctcaacacttgaaaggccttcaagaccagatgtgtaggtgtgttcagtgtgagtattgcggctatcctatggaaagaattaggtatgcgcagaaaatcataccttttccagtataagagatgatcgccgtacgtttccaatgagtgatattattgccctctgctgaagtagatggacaactgcaattttctcaagctcttcaactacatggtcaagttcctggaaatttggcaacaaagcgaacaagactgagaaggcaatgatcagagcagaatgattctgagaatagctacatgccacaaaactatggggaagctaacatttttactacctatatatgccacctttagagaatgagcagtccaagtgcactaatgaacatttaccatcacaaaataccatagtaagttccatatttatcactaacatgcaattagaacctaaaatggtcaaagttgcggactggagaccgtgttgatgtccaaaacaacacctaactagaaactgagggagtatcttttataaggcaacagccaatataaacaaataataagctcattttttgcaattatatagagttagttttaccttgaaagaatgtactagtttggtcagaagtaccggcatacagtattacaactacttgattttgcatgtagataggtgcacttgcctgttgaataagttccctgctccagatctttgatggatcaagcgacacagaaatactaacttcactagtagccacacaatctacagatatccctagatcttcgaatatagagaagaccttctcaagcgcatacagagagcgatcagaataatgacatgtgaattaaaattactggaccaattgctgaacatacctttgccagaaaaccaaattgaccaagcatccgagtgcttactatatccaacatagtgacatttgacttgagcactatgctagttagcacaacctatccagagaaaaataaagaacaatagaaataaaatccatggcccgagagttgaatggtactgatgtgagaacatgttttaattaatctgctacagaccttatccatctctctttgtttagtgatcagggtgcctggagctttagggttgtacgaattcttaaccctgactggtatatcaccttctctagcaggtctcatagattgtggatgtaatacctatcatggagcacaacaatgcattactatcaactaaaagttctcttttctaaacgtgcgaagagcaacttaaattgacatagtgagcaaacccttatcactttgcactttgcatatatagcatttactttgcagtttgcacttcgcacaaatattttcatttacatctaactgtgaagagcgtaagccattcatgctccaaatgaatacatacctgggcaccaaaataagcaagttctgctgcctcttcaaatgttaagtatggcacagtggttgcattcgggtagatatttggatcacaggtcagtacaccatcaacatctttccatacctatgacaggcagtggtatgctttcagacaaagtaggtagtgactttctgctccactaagctaatcagcatgataaacaaattaaaatagcaaactgtaggctctaatttttgtttgtgaagagcaaaattatatttagacttcaccatggacctgaatttctctcaaccccagggctttaccaatggttgtagcagtcaagtcactgccacctcggcctaaagtggttacagcgcctgatttccagccctgcaagtgatgacgattgacttctaaaagaaaaggtaataacaattacaatgaactaatagtttgcttcataatgaataccctctggtgagaataccttcccaaggaacccagtaacaataggtatcgctggatcacgaatccagtctccatgtaatctcttcgcaacagcaggataagttgcctccaagatgtccgcgtttccgaaatcgtctgttgttatgaaaccaatatcaaatgcgtcgtactgcaaaagcattggcaaatacaatttaaaaccaacaaaatttcacattacgattcacaacacgtatagctgaaatttgatctacagggaatttagaaagctgctaacgttaggggaagg

SEQ ID NO: 59981 - DNA, 10207 bp, Oryza sativa
agttcatccagcatagctatgagttccattcacagggagccataagattattgcattaatggaacgaaatctagaagatgttattatggtagtggagttactgtgtattacagatcttggcagtgcaagttcctccacagttctggattgatagcaaagaaaccatcaagtgaaattagaaaacagtttgaccagtaaactgtttgaaaagtagactcacttaatgtgtagatctttgatcaaattccactcttcaatttccgaaacacggatcacgccgcatcccactgccttctcaccagcctacaaggatcacagtaacatgtgttcaagacttcaaagtagtagtgctaaacaagtaaagattctttaagtcgctctgcgctcgaatatctcggctacaatgcaacaatgaattctgaaggaaggtttgccgttaaccaaattttcatttacttacagctaaagctactgtgtactatcgtccagagagcctatatatatagtcaatgttgagacactgcaatagcaaatgatggatagaaatgaagctttcacctagcaactctaatgtccacatattcctggtcagttgcgatcatcattatggcagtagaggtgcaaaattcacttcatctaacactacccagtgattacattgaaatgaatgctcatggattcaggaaaaacttggtaaagcagacacatattacagagaggcatatctatagcctagaggaggaggaggggaattggaaggcggaaacagtacgaggaggaggagattggtggtcttccccatggcggagaggacgacgacggggcgctcctcggggaaggcgaggatgaggcccgccacctcccgcatcctcgccgccgacgacaccgacgaccccccgaacttcatcaccacgctcagctggtccccacctcccaccccgatcccacctagggtttccgccgcggcggcggcggcgcccactcccttggcccgacagcgagcggagtcatcggcggccgccgccgccacctccagtctcccgcctccgccgcggcggcggcggcagcgagccctgcccaggacaccgatacgagctgctcctcctcctcctcgtcgtcctccatctcccgcgccgccgatcgccggaggggccggcgagacgaggcggaggcggagcggcgcggccgctaatcggagagcgatcgccattctcctctcctctgcagtttggtagagtgagagagggagaggggagctcactgtactgggtagcgtgaaggcggtttttcggttttacgtaacaggactctaaaggcggaaaacgtaattgcgagagttcgcatggatggagaacggtgagaggccctccctgtgctcttcccccttctttcctaactgacatccatcattttccacgcgcacattttttaagctgctaaacgatatatatttttttaaaagttttctatagaaaatttacttaaaaaattatattaatccatttttcaataatacttaattaatctcgctctgatcgcttgctttgattccgtgtcaagaggggaaaccttgccttctgaacacatcctgaagttgacgagtgataataaacttataagcttactagaaatttagcattgattctttttcttatcgaatatctctcgagctaacattggcacgttgctaatgggatctaagagaaaaagaaaatactccgtctggtcataaatatttaatgtttaaaacaaaactcggtcaatcttacagaagaataataagtatatgatttcaaaagaaaagaaagagaaaggaataagtttatggtactactatgatagtgtactaacttttaagaaaaatcttgaaataccattttttttagtttttaaactatttaaactaagtacgtacttgaaaagttattgatggttaaagttttaaaaatgtttgaccgaatcttatttaaaacgtgaaatatttatgaccgaacatgatttttctactgattttgagcataagttaatgctgcatttcaaatctggatttggtccgggaggctgatggcaggaggcaacaactgctccaacctgcatgtctgcatcctgctttgccaggttgggggacagggatcactgaaccagcacagggaagcagccaatccaatccaatccaatccaaccaaatccctaactaatctcttcatttgtgtaatgtattagccagatgtgcatatgagcaaatcaaatctagtatgaatctagtatctatcacctcagcgttgcacataggcatgattcagctggcaatggcttcctcactgtctgcaaaaaacagtttgcataaataataagaggccagagaattcaattgtgttggatcaaggaccagactgcctgcccgctgatcagtgacaaaatcattgttggattcagaagaggctgaatctcttgtgcataagcttctttattgtgcatcaagctgtgtgtgtctgcatgatcgatgtcatggaattcattcaaaagacactgggttcatattctcatcatgataatggacatggtttcaatggacaaagatcctattacatcacaaacaacattcagaaaaaaaaacgacaacagaaagaaagaaacccagttacatcatcatcatcacacatgtctctagatggcgagcctcatctcatcagttctcctagataaacagcatatatgccatacttactataactttttgataaaccagatcatctgatgcaaatgatcactgatcaaatcccagtgcattggtcttgactgctttctgacttgctgattacattgcgttctgaaggccagcagagtgcaggagcacggtcttaatttcttcaggcccgagtccaggaccatccctgcattgctggcaaaacagaagtacagagcaagcattaagagagtgaacaacaacggtaggatcagatcgaacacaactgaaaaaaaaccctcagctggaggagaaaaatattatgatgtggagaatgcaaacctcggcgcggaaaacatccattgcaaacccattgaaacagctgatgaccgcctgctcgatcccgaggccaaggctgtcgagagccctcaatgtggacatcagaatgccgggcctgcgtgcgcagaacatgtggatattgactgcatgaccttccctcatcctaacttcgacctgaacaaacaagagaggtgaatgtcacttggttgctatacaccatattgttaccgctacatgaatcaacaaggcctgaatgatcaagtacttgtgcagactgcaaagtgcaagtaccgcgaaataagtaatattccctccgttccaaaatataagcatttcttgtccagatacatagcaagaattgcttatattttgaaacaaaaggagtagctcccaagtgcgttaatcttgagcactaaagcatgcttaagcatataagtatcaagggccaattgcataattgccactagtgcaaaggcttaacaatcatggtcaaaatttgactaaccgtggcttgttgaccactagggcttggaaatgaggttgggcaaagttcctccttaacgcggccaggaaacgtctgcaatgtgggtgttgatgggtggaagctagccgatgatggtccagtaagcgaagagctaggagcagactcaagttcattgtgaagatcgttaatcctctgcaggagctccttcaagtactcaattgcatcaccaaggatagaagctctgtccatctgtcacaaaggagaagaaaactggtaatgagatgataaactatagatattaacatgaaacgagtcagacatagttggcattaagaacactttgacataaattgttttgtactgctacactaaaaaacggcacatcgtacatggcgctgaattgttagactgcaacttgtcataatatcccaagaactgtagtacatcaggtctttctttattgttcaaaaccatcttgatcgctgtgaaggaaagtagtaagttcttcacacgaaaggactgcagagaactgaatatgcacttcgcatgccgaaacttccaaagtgaacgacttttttcaaggaaaccaacaaaagttaaagacaaaacatccaacacgaagaactacaaaaaaaaaacagaaagaaaagggggaaaagaatttgtgagttatctggtatctggtcactttcaactacatcttgtgcatggcactgtgttaatcatgcatcactaaatctggccatggatcagaatcaaagttccccataatatgtgtaatctcaagctacgacaaattataaagtcctagaaaaaagacattgaagtataatttcagaactgaaattaccataactgaactgtaaaacaaccatccagcaagctgaataggaactcctcatgttaccatgtgaacatgacaaggtatgacatagatctaatgaaaaaaggatgtttttttggatctgaagtggagccaattcaagaattcagcaccaaaattggaaccaatttcagtgacaaatatcatgacaaacacactcctacaggacctacaccagtatacatcactcaagaactgaaacatgttgccaaaactgaaattagaaaagtagaaatagaaaatgctgattaatttaattaataagatacagtctagtagaaactggagctgctgattaattaaataattagcaatgaacagtgaaaaaatagaaatgaggtcattaatcaccttgctgatcttgggcaccacggagcgcagcatgtagaggcggtcgttgagcttcttcctgcgccgccgctccgccatgaggttcttggccggcatccccttcttcttgcccctcccaccgccgccgccaccgccgccgcctcctccggccgccacgggcgcggcattctccagcgaggccgagacacccatggacgaggcgtccacgctctgctcgatctcgtcgtcgtcgtcccaccccatcccgccgccgaacgcgccgccggggggccccaggaacccgagcttctgccccggcggcgcgaggaacgggggcggcgcgtcgtcgaacgggttggaggaggcgaagtcgtggaacggcgggagcgccgccgtcgtcgtgggcggcggcggcgggacggaggacgacgggaaggccgcctggaagtcgaacatggccgcggcggtggccgcgtccatgttgaggagcagcgacgacggggtcgacgccgagagcacgtcgcggtggtggtggtggtggtggtggtggaacgggaacgccgtgaacgacgccgccgccagcgcgtccgccgcgaggtacgaccagtcgccgccgcctcctcctcctcctcccgccagctcgtccatcttcgccgccgccgccgccgcctccgcctcgtccatggcaacctcgccgccgcttcttgctcgcctccttgcctcgcagcgctctgagaagagaagagaagagaagaggagtccgagtagagacgccattgctgctgcttcttataggagaggagaaagaagcagccttgagccgatgtgcttaattacatttatacctaattaattaatttaattagttaaaccaaaacttgcttaactttttcttaaaaaaggactaatacttacaaggttaattagctttttttttggtctgacaaaaataaggttaacattacaagattagcctatgatatgactatgatgacactatgttttttttaatagagatatacatgcatggccagcttgttcagtttgtgtcacgctagctacaaaacatctctgggtttaattgcagaaaaaaaaaggacgactttttttaggttgtttaacactttggtttttggtaattgcatctttctgttcgttgcagacgtgaaacagacaaatctgacaagatagtacaagggctatacgggaggtgttttaattggaaacagtgttgttctatttccttgctttataattttttttacaagattcataattgtaaaaagctgtgatattctgcgtatttacttcttttatgcagtgttttgctgcaatgttgaaacaaaaactgttgcaccggggtagagacggcaggaggcgaggaggggcttggtctcccaaatggcttcgaatttttacggcaataggtttcgcaaattttcaaaaaagtaacactttggccttcttcaatcaaaaaatttttaaagtgtttttggctccgcctttgcacctaataatttacaaaattctaaaatgtaaaaagctgtctttatattattttcatgttattgtttttttttataaatttgtttttatgcagtgttgtgctgccatgtttgaaacaaaaaactgctccacctaatcattcacaaaaattctaaaatgtaaaaatctgtgatattctgtatattattgtttttataatttttttatgcagtgttgtgccgccatgctgaaacaaaaactgttgcacctaatgaaagaacaaatgacctggcagacatgtctcttgaagcttagatggatcaaaagggccaaaaagaaagatgttttttttctaattgatacgaagaacctgcagggaggtgtacacgtgtaaggctgcctactgcacccagtagccaaaagttgccttctgtttctaatctttggatggtctcacaaaaacagatgcttatctactggtaccttgtggacatatgtaaaaactgtctttagccaacagatttgtcagttgctttagctcattggtcaattttattctatttcagctttccaagtatactaaagtttaggacgatatatggactttagcttaaatataaccggcattgaggaaaacctgcatataatcgtattagcaactatgtaggaataactgaacgtagcatcttatctaaatggatcagccatatgatgtgtattggatgcattgtatttgtatataacgtggtgagtcaatcattcagatattttagaaacctgtgaaattttcacttaggacacatgtgggtattaagaaattggaaaggagggagaagagagataaaaaaaaaaagaagagggaatgatcattctattcacggtttgagaatgagaggagggtacatgattacattgctgctcaacacacctcgagagtgtgcaatgcaacatgcccaattacaagttctcccaagcatcttgtgaccctgccggagatgagccaagaaaatcataggatggaacacaatggaatagaattgaaggagaaaactgtgggcaaaaaaaaaaaaaagtatgccctgcccactacactagggctagggatcacatgagttcctgtaaagagagagagagagagagagagaaatttggttgctcttgccattcgctggtctaaattgtcatggtcaatttttacactataactattatcacaagttggcacgctaatacaagagtgctgaacaaataaagggcaagaatttttaaaaacaaagatctgaacattagagaagggagtgctaactagtgctagcttggatataagtttcaagttaaacacatatatgtgcacaaatagaaagacaagttcaaagacctttgtctgttcacctgacatttaacgttgacaatgtttgcatcttcatgtatgcctctaccatcgacgcctatgtcctaatttgatgcctcgacatctcaacatgtcatagatcaccatatcaccacaacaataattgataactttgcatcttagatctcatagtatatccaatagatacagtcggtagtagccaacctcaacgcttccaagagtcgatgcgccatcaccatctatatatatggtctattgtcatcactagaattcgaaacaaccatcgtaccgctagctggtgaaactaaccactggttgtgaccatggataggggatgacagtgctattgagtttgttgagtatgggagaggaacaagagaggggagagcagatataggctaatgacaagaggaattatctatttatagactaatttttgggtgggctatacgttagaggtgaagcagtgcaaaacaagaggaatgagataaaaaacttactgcgtatgtgacgtaatatatagtagtgaggtggaaaacatagacactcatagtcatgcgctatgggcatctatcttgtggctacacattatgcttgtgcagaagcccccttctgtttccaatgagtttgattactaattgttgcaaatcagaagatggtaaaaaaatatatagatgatgtgatgtatttgttgagggttggagataaatatgaaagcgtggagtacgtgtcaagatagagtgagtagtaaatgcataatgaaaaagaaagaaagaaagaaaacttagggcactatatcactgtatccgatgcaataaggtaatggattgaaaaacttaaccgctattttttttcgtacacattttatggccacccacatattatgttggtgtagaagttacatgtctatatccaaaccctgtccatgtggaactaatgttgatcatagtgttataaggggacaacctctaacaagccaatggtgttttttaccctattgtaagaacacttctagatccccttaaacacatcttgttatatactactacctccgtccttaatataagggattttgcgtatggagttgcataggtaaaatcccctatattataaaatgtaggtagtaatttggaacggtgagagtaagtgtttgtcaagcgtactataaaaaaaatccaatgtttttgtgtggaattcataaaatcgtgtcaacatccatcgcaggaacataagtcccatcttggtagttctcattccgtcccaaaaaaaacacttaacgtaggataggatgtcacatataacaaagaatccagataagcttcaatttgttcagatttattatcctatattaagctttttttttgagggggtacatgtctttgctgacaggtcaattgtagctctctactagatctgattacatcgaacccttgattttgagaggccacttgtatatcatcaacttgcagttccaggtgctgcagcatacttacaactctaccgtccattcataaatttgtcattatttttgttgaaattaaatcaacatcaacacaaagtgtagggtgagatgaggccagtgtcatcaagaggggaaaaaaagctggattctatttcagcgtggctccaaaacacatctttattttttcatgcaagctagaaaactgagaaacaattaattcaatagcaaaatataactcatgcaagctagaaaggatatgggctaatctgaaccgtcaagataccatctagggatatcaaaaataagtgatgatgtgcctttttatggtggctagcttatttatactccctccgtttcacaatgtaagtcattctagcattttccatatttatattgatgccaatgaatctagacatatatatctatctaaattcattaacatcaatatgaatgtgggaaatgctagaatgacttacattgtgaaacggaggaagtagcaataagtacattaaagcagattgcagctactcgcctactccctccatcccaaaatatttttaattttcacccatctcacacgtaccgatacaaaacaaaaggactagaatgcatctactttattgaatctcaatgcaattgttccccattttatctattctcaatacaattatttcatgctttcataaactccgatacaatgattattataaaaataaatttattttggaacaaatgaaaagagctaaaaatggaacttatttggaacagatggagtatgtagaacacatgatcgtggtggatcttatgatatctttttgcgaacacatcctacaatacaattgcatataaatataagtatatttacaaaaatataagcaagggttgtgtattaattataagtcttgttttgaagacctaatttcgtgcataattgcacgtgaaaatccattattagttcgtgagaaaacaacggctcccatcggatggcctattcagccaaagaaaaagccaaaatttgaattttcaaacttaattttgatattgattttgagatattttcaacgtattttctttttcagcattggcttttaagtcaccgagaacacatatatgaaagttttacctacaaatttatttttattctctaataaaccgttttggcttat

SEQ ID NO: 59982 - DNA, 1717 bp, Oryza sativa
agacatatatgtgtgcctagattcactaatatctatatgaatatggacaatgctagaaagtattataacctgaaatggagggagtacaagtttcaatcccaattgcaccaaacataagagtggcagactaccagaaagaatcatcacttatgatttgctcatttgtcgcaggaagcatagcttcctctctgtatattttactgaataacaggcagtacacatgtggtgtaatcacaaattcacaaattggatgaagtgagatcaccatcatattgccaggacaaaacaattacacatttcacaaaaatatttcgacaaaagataaatggctcgcacatgcactacacaatatctctggacaagcccataatatcgctcaacacccgaagactgcccattgctcaacacccgaagattgcagcaccattcagggatccaatgatggcaatggcccaagaccagccgcgaaaaagcatttccattctccaaaattggaataatcatgtaccataaacaaccttgagatgtgcctagtgattctcaattgccgatgaatcttcatcgatatctgcacgtgatccttcccacagttgctgctctatgcccagtttcctgagctctgttagacctcgctccactgcagataacaaaactaacagtgctcagtaaagcaaaaaactgaaaatgatggcattcttggataggagaaaaaatggatgaggtgtgtaaatctaggtaaaaacaattggaaaaacaaaacagattataggcacaccgcaacatgtaatatatatgagggcatactcaaaatgccttctgtatacccccaatatcccataactgtttagacaaaaaaaaacacatcaatcacattaatagtggttcatgtaagtatctcacatataggtggtgtttgaatctcctgaagatgaagatgaagataaagattaagtgtttcacgcaaaacgatgtggtaataacgtgtgattaaatgagttttaattattacaaacttgaaaaatggattaatctgatattttaaaacaacttccatatagaaagttttcgcacgaaacgcaccgtttagcggtttcaaaagtgtgccacgaaaatctaaatcttcatccaactcttgttggagaaacgaacgggaccataatgttcgtaccactataccgtactttggattacagatgggaaagaggacagtaaagggcaaagagataaaatacaacagtgaagaaataataaaaggaggaaatagaaagttggtttgatccctacaaaagcatcacatgatcaactgttggggcatgctgtcaaaaaagagctgcacaaataaaagacatcccagggacgttggatggttaaatagtacgataaatcattaactaacaggtggataactcccaatgctaggttattttttcaacaaggaaagttgcttattaccatctatagcatcatgagaagttggggctactgcattgcgaccaatccagaactgaagccgttcttcagcaatgtcttcctcaatgccatgagttttagctcttctccagaagtatataagccatgcctgcattcaatatatattccataaatcacacgtaataaatggatgaatttgatagttcacatcgctgaaaggtttacctgcttaaagctaacatcttctgcctcttcatggctaagatctgcaataggtcaaaaagtt

SEQ ID NO: 59983 - DNA, 712 bp, Oryza sativa
tggatcccctttgtcgcttccggcagtacggtgcaccacagaagcaaggcagctgacaatatttccatcaggcccaacaacactgtccaagacatagccataatcatatgaaagctcctgcaatgcaatggtggtcactggtcaggacaaaacatataaatagctgtaactgcagaaaccataaggagctgaaataagctgacctgaagaggaagtatagtgtcagcagcaaagagcgtcacctttgccagcttaacatcattatgggagctcaagacacactggacaaaaaggttaggctcgcagctgtggtttataaaccttgcaaagttgccaatagagccagcatcaatgcaatactctggtgcaggtggatctgaatcattctccgcatgaagagacggcagatgcatgtcagagccagcccttttctgcagaaataaaggtagctggtagtcaggaaattgtgcaaagcagcatttattgatatctcaacatgaatgaaaacataagtatttacagtacttcactttgcgaaggagcaaaagttgagcaccgaacagtgacattaaggatgtcacacaatggcagcaagggatgatagattgcaattgaacgattgattcaacattgagtactgaggaaagagaaaataagtacctctcttccatccagacccttcatagtttgaagacaatcaatatcaaatatg

SEQ ID NO: 59984 - DNA, 1186 bp, Oryza sativa
ggagtaagttttagacaacaatgggttttgaggcatactgtacttctatctatgctgtcattttatttaatctgctaatatagcaaaaaaaaaatttcgaaggagtaaaatacatcaatggtccttaaatttgtacttcctccgttccaaaatgttgctacctaggatgagatttgacccgcaatatttttgggaaggaggtagtaagaagtttttttttttgagcaaattttagcgaacgtcacgttttatggttgaagttgcataaaaccccaggcattatgaccaatggcacataggcccagctattgtggttctaaagtatttagttaaaatttcaaaacgtagaatgtatatgaaacttttagttattgatttcttaattaaggttgtcggtttactcttcgctactttgaaaaatattattttagatatgttgaaatcaattgaaattagaataaaggtggggttttatgaaacttttacaccataaaacctgtggttatttgccacaagtcataatacccgtggttttgtgaaactttgaccataaaacatggggtttatgaaatttaactttttttttcttcatcatgttattgtcacatttattccttgttgcttactctgaactcgtgtgggttgtcctatttagttaaagtttgtgtgcaaagttgtgaactataaactcaattttggacgagaatgggttttgaggcattctgtacttctatctatgttgttacatgaaatttggtttattctgctgacacaactcaaaagtatttttggaggaataaaatacaccaatggtccttgaacttgtaaggtgtgacttactgtaggtccatggacttgttaaagcatgccatactatctgaacttctcccggtgttgacgtggcagcagatatggacccagatgtgtctgccatctgtatcctcgaccctctctcatctctctcctttctccctcatcgatcatctctctcatcctttctctcccctccctcatcctccatcatctccctcgttcttaatttcttctgttttctctgccacatcacatgcatagtcttccatatcaagaaccagatcacggtctgaaggggtattgaactgtttcggacctagattacatacttttaacacgtttaggggcttggatctgtattttgcaacgtcta

SEQ ID NO: 59985 - DNA, 2030 bp, Oryza sativa
gaaatgctcaagaagaaaatggtaagaagtaaagattcaagaacattgctggttgctgctatacattgtcagcctgtcatgtgcaatgctatttatgtcctattgattgacatggttagtggtatgacatgattatttggcctaatgaacatgcttgttatgagacgacattagctgtactagattaacttcttgctaattttctttgccgtagttatgattcgccagtagaatgacactgattttctatggcctcttagttggatgagataaaaagagatgagtatgatgagattaatttcttgcctgtttctgctggatgccaaaattgcaagctttgattcccgatttaatggcggcgatggccgcagataaatcccagcttggtggatccctctcgatcgatcgagttccgggaggcagcagcagcagcagcaatgtcgggcgccgccaacgcgacctcgccggcggcgggcgccggcacgccgcggtcgcggctgccgcggtggacgcggcacgagacgctggtgctgctccaggcgaggcgcgccatggagcaccgcgggcggcggtcgccgcagccggtgaggctcaagtgggcggcggtgtcgacctactgccgccgccacggcgtcgagcgcgggcccatgcagtgccgcaagcgctggggcaacctctcctgggacctcaagaagatcgtcgcctgggagaagaacctcgccgccgtcgtctccggcgccggtgacaacgctgtcgccgccggcgaaggcgaaggggaggcgccgccgccgccgcggctcgagtcgttctgggacatgcgcggcgagcagcggcgcgcgaggcagctgccgtcgtcgttcgaccgggaggtctacgacgcgctcgtcggcggccacggcgccgcgccgccgtcagacttcggcgaggacctcgccgacggcgacggcgtggacgccgacgagctgccgccgccgccgctcatggtcatgcccatatcaggtcagaacaccacccccacttgtccatttgtatttttctacaaaaagaatgcgtacatttgtacacttcacactacgtattgtacgtattatctgcgtgtatatacggtagttgatacgtttggcttgcactgtcttgtacgcagcgaggaagtacgtgccacctactgcttcatctcaacaggaatgctctgatccaggtgtcattttgcacgcatttttgtccatcaaattttatcatgttcatagaccaatcatgtactacctccgtttctaaaatataaacatttttcaactctgacatgatttccaaaatactactttaaccataatacatataaaagtaagatattttaaataaaaagtgttgcatattataatagttttttttacacgacagaattttttttattattaattgttaaagttaaaaatatttgacacgttactatattaaaataatgattatattttaggaattttcaaactaaaatccaattcaaatggctcctttttaaactaatcctattcataattattggtgtctatgtttctagctacggtgagcgccaagagaggcggcgcggcgtcagacaagaactcgacgtcgcagcatgacggcggcggcggcggcggcctgaaggacagcgaggcgacgtacggcgccggcgtcggaggggaggagggcacgacaacggcgacggcgacggcgacgacgacgagcatcgggaggcaggtgatcgaggccctggagagagggaaccggatgctgggcgaccagctggaggcgcagcgcgcggcgtgggacgccgagagggagcagagggtggcgctcctcgccgccgtcgacaagctcgccggcgccgtctgccggatcgccgataagctctgactgagcaaccgcaaatccatacgctactactatactagcatgtaaaatactctcattaaaggttcagatcaggttacagattatactgtttcagttaaccatgatgaactgcgtttcaatgaaattgtgtggtttctagg

SEQ ID NO: 59986 - DNA, 4174 bp, Oryza sativa
tcttttggcatcttatctcttgttcttgtccgtctttgagcctggatctcacttttgctcctgcatgctgttgcttttctcaaaaggcagaagcaccaatctttggcacctcctatgattagcatcagtgctgtactgaactttctgatgaaatgctttactcaatttatctacccaggcccggatttatcatatgtactctttctttttcttttttgttttttaaacaaagccagaatcactgtcttgtttcattgataaagaagagatacacatcgatctccaaatgcaccatcttacaagcacctcaagaacattttccaaagctacactaaaacacctgaaaacaccaaaatttatcatatgtactattctagttgtcttctattcttgaaaccagtataatcaattacagcatggaaggcatcaatctgaatgtgaactttcactcgtagctgagttcactcattgcacctccaatacatgtacaagccttccatcacatcacatgtgttctttgatgtgaaacctgcactttcaagggagcatagctctgaacattttgccctgtttgtgatcagagtgagtgtactataaacccaggtaaaaacataaagtgtctatcatcaagcacagcatgtgaaggcgaatattcagtcgccactaatccctgtcccccaagcgtattgcacggatgcagttcgttaacgcttctgttgttccattacatttggcgtcattgcgacgctgaaaacattctctgaattttctgaaacattttgcgaatgttgcatatgcctgaccaacctctttgtgtacttcagtactagcttgtaccattaactatatatctggttgtattaggtccaaattaacattttttaggtgaacatgtaattaactttgttatccttgcaataccacctctaggctacaactttggatgcatctgatggcagcgagaaaagtgtctcctggctggcgtagtaccctacatggatccgattctctaggcgtgttgggcgttggttatactgatcgaataagtactttgcatcatcgttagcttggctgaaaacgacatccatccactggctttggtttgggtagtgttgggttgggttggggtcgttcagagtttcagatggtcctagcaaagaataaagtaagcaatgaaccctcaatattgtacactctagcatgttctttttcgattaagatacaattttatcttgatttccgttaaaacgtcttttaaactgtaaaacgatgtattttgtgcaaaaactttctatatagagattgctttaaaaaatagataaactcaattaataacgtgctaatagctttcttgttttgtatgttaccttgcaaatagaggattttataatgcacagttatgggcagaatatacacatttcctaccatcatacgttattttcaatcaaaaagaaaaataataaaacatgagaaagaaagaaattgcaagaagaaactaaagagaaaaataaacaattaatcgagcagctatatagcttctagatatatctatatatattagtagtatataagtaacactatatgtagactatagtatgcactagatagtagtagttgctatgaactgtagcatcgtagaaaccaggccagcgtcctggcgctgtcattgctctgagaagacgatttcttctcccagtttgcagcgattcccttcttgttttcctcatgcttcttcttgtgttgcttcctcttcttcttggtgtgcaccatcgtccctctcactgtcacctccttcttcccaaaatccaccatgtaatctagcaaccctgctaattaatcaaacagatggaaaatatcaacaacagatgcagtaattaactgacagtaacactagcagtgatcagcatgctattcacaaacagttcaaacatgatatctctgtatctccatgcatgtttctgtcggtgcaatttaaccttaaacttaacgagttctcaggactgaagctatgtatgtgatgtatttatcgggtcttcagatttgatgtgacccatcgatgctctcttgtcgatctcatagaactttcacaagggttattagattctcaccgttcatcttggagacaacctttgtgacccgctgtcggcagtgcgaacagcccatgttggcgctcatcaccaccacctgcacctgcagttttcagttccatttcacacaattaatcccactagcagcctccataaataccatcaattcttcattatcatcttctgtatttgcattgcttctaagtaatcaggaagttaattaagggaccactctgcaataatcagctatgtataaccacttattgatctactaattaattaaattataccactactttattagtgggttaggctggtcttacactatcactgttgatgagactcactaattaaaagactagttagagcgactacgtgttgccaatggatacatgtgtggtctcactctcacttaaccattaatctccatctttcgctaattggcaccttgacaatatgaaggtggtcctctcctgtcctctaaaaaccacatgagagccactattgacctgcattgttaaattcctcatctgttcttgttcagtttgctatgggcatacatacagttttaaatttctgtccctgcttctatgggatgcatgcataaatactacatgcctacatgatatgctaatataattaatccgagcacattgcacatagattattatgtagtacttgtgcatcacgtgtagtccctactctaccgttgtgatcatcagtctgcaggcttaattacctgcatggtgggcaacagcatgtggcctctcataccctatggtcgggtggccaaaatcattgacatccatagatagctagtcgaggcagcaagtaattaatttatttactaatccgatgggaatcttactaatatatttcttcttagctgtaatctaagggtgtacgacatccatgccaagcaattccagtattctacctatataagtagtaaaatacatgaggttggaaatgtgaacttctctactgtaaaaagaaatagtaaaaatgcaggaactaatacacgtatagataaagattggtcagagctgtacactctggcttagctatgaaacggtcactaatttgcacggaccagtataaaatccgtgcacgtcagcacgtgcatgtggtcaaaatatacgtagctgttactggcatttagcatgttaattattacgataacgatggatgaatggatgaaatggatgtattgcctataattattagttaattccgtatacatgtactctaggtcaaataaaacgtattgtgccacatgtgccgaatttgactagagatacagagtacgtatgtgagaatagatcttttcttaatgtaaatataagtacagctgtacgcacgcatgaagaaagacagactaagtatttttgctatgccaatggatgctacaatcgatggattctgatcggacggtcgaaagagaaggtgaaaaacaacaggtagaagttattctttgttctaaatatttctttatgattctttttctagagtaaacggctccatcccttgtgaggataggagaccacgtgactgccaggtacttggtcaaaaaaactcagaaaaattcaggctttgttttgcactgcatcccattaccaagagacagccatttagatgtagatagttaattagaaaatggatttaattaatgagatcattcttttttttttgaggggttaatgagatcattctgatctcagcagttttgttcctgctcctagctagaagaaaactctgtagctactgcagtgcaattgtttggttgattgatagtccctttttaacctttaggctaaaagcctgaaagttgagaggtactaaaaagtgactgagaaataggggcccagtatccgaggagataaactatggtcgtcactcatcacacacatctcaatgtgcaggggacacaggatgtaatggcaagacaaaaggcagtaaacaacagctgacattggaggtgctgatgcattgagaaagggaaagagattctggtaggaattctgtcattgcctattgctatgcatgcatgcaccagggagggagaagaacatggggttctggaaaag

SEQ ID NO: 59987 - DNA, 26115 bp, Oryza sativa
  unsure (1)..(26115): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgagcgagaccattcagtatctgatggaatgcatctcctgcctgagcaggctgggggaacagcatggcctgcttcatcgacgggttcgcgagaagcctctgcttcctcaggataacatctgttggtatggatgtcaggatactgtccagcttcggaacatcctcctcggcgacaaacacgccaatctcctcccaggggatagcatcagcaaaggggaggacaatgtcatctgcaatgatcaccggaatacaaccgaaaaccacagcttccaccagtctggggctccatggagcccagcccaatgggcacaagcagaacacagatctctgcatatcttcgtagtacgtgggtgggtgatcggttgagatgtcaaacagcgggttgttcttgaaattctcccaaaccgacgcgcgggcacctctgataggacatacagaaacatcagactccacatgctacgagccaatgagcagatgataggatgtattggagataagcggaaaatttaccttgcatagtatccaccctcaggatcattgctggtatcgtagaacagaccacggaaatatacaaagatagaccgaggggtgtctgggggaataagatgagcctgcattttctgtgggggtgcatatggcggaatggtgatcgagccgtccttcaagcagacatggttcttttgtccaaaggtctgaaccagggtggcacgctgaagcaatgggaggattccacgtccaattgccttttcttcctgaaacaataacagaagcaaaagatcaatacgctgaaataaccaaagagaatgtgggcacaaagtatgatagaaggtgccaatcagggtagatgattaatcatgaatatgaatctgaccttagtgtgacatttaaataggttgagagaaaatatttttttctgaaaaatatttatattctacaaagggacaaagaacatgtgcaaactgaagtgttccaattaaatcagagttgccaactaataatattaatacagtgaatctagcatcttgatgccccccattgctccccatgttctctgctgcaattagaaatgtcccagctgttgcaaacttaagtgttcagtactaaactaatgctcaaagtccagaatttgctcactaaaggaggaataaatgtgtccaacagcaaggttttgtacttgtgcatgtacctgatagtggaagcaagcgccaaagtcatgtggtgtaacaaagaaatgatcagccccctctgatctattccagtaaggccaatttgttgcaatcagctcaattgcgctgcgcatcattcttggggatttgaagggcaagggaagaccggagggagtcaggtcgcatgtagtgtacaccggtgtgtagaaccaatcagcttcctcgggattaaaagttcggacagcgcttgacaacaggaaccgatgcatgaaaatctcagcggcaaacatgtggttcaggcacctaggatccttcttcagcagcttcttgttgtacttgcttgggagatcatagacatagaccttaagcctcccaacagggtcatcttccaacacatcaccagcacttcctgcatttgtttcgccacaatattaagcaaaagctatggagtatctatagaccttgcacagaattagggaaaagaatattctaaattttagaagcatagcttgggatcaaggtatgatacctaagcaacctacagggataaagtaagtgtgttcctatgctagattaaatgaaacataattaggctaatggctatgttcttatcatattggtgcctaggaacatgatactgcatatcataaagaagatgaagaggaggaaaaatatttgaaggttcagaggacagaatggcattcaagttttttggcagcagatgtctcgaggaccacaaaatccaataagaaagaatgcctaccatcaacaggtgtatcaataccagtagatgttcaataaaacaaggtttaaactgaatccaagcattgaaccataactcaaccaaatcatttagaataatacaccaacataaacaacctccatttgcgtctgatctgaaatagatcctatatatttagggtggagaggtctgaccacaaacaaatcaaattgacaggctaaatgatttcaaaatgctttgctttaacagtttcttagatgcacaaataagcagcttgggttgagttctactaactgacaagaatgtatccatcaagatcaaaaccaagaagagaataacacaagaaaaacaaaggccccccacctgagatcctctctgtctggtggccctgccgcacctcctgggcctgagctccaaggaagaagcatacagcagcagcaagaatggcaatggccaagacccacctcctcatcttcttgatccccacaggcctcttcccagcacctgtgtctcctctcctctccaaccctctccctgtccggccttatgagctagcaggcaattgccaggaggtaattaaaggatccaaggagaagggggaaacttttctggcaattctcctaccaagaagcgtttggtgagttgagaaggtgaggggaggctttcctaggcttccttccttcttcctccaactccacatataagcaggcttcaagaacaattaggggggccatgctcttacttaaaaggaagaaagaaataaaggaaagagattaatatttgctcagagagggtaggagggctgtctactgctgattcttttgcttctttttctatgcacccccccttttcctccagctttccttgctttttcctcttacaccaatgatgagctgtagttctgtggagctcctaatagtctattgcaaatgtgttccaaaaaagaggttcggtgagaggtttacctcctcttcagatgtcaagtttctttcctttcaccaaacatggactagacctctcacttgtcttaccttaacatgtcaaactcttcacttctctctctctctctctctccttgattttttttttaacccaagaattactaccctccatctatgatctgccaaatagttaatttttttcagtttcatgtttctccggtccttttcttttggtttacttattccgcgtgacagtcaagccgtttcctccaggatatcgtggtgatttggattgttgcctcctttgcacatggtgattcattcatttcattgtcatggctcatgagacacccatgagaggggggccataatcattggcaacaaggcccccatttgcagttaataccttccatttgtttatacaatattaaaaatcttgggagggacaattcacagtactctcttacctatactttattggtggtgattgttgattgcagaggaagagattagtgccaatgctcatctcccaaaaaaaaagattagtgctaatgctgcaattacctgcttgtagggtttggtgaaggttagtactacaagtagtagagctgtttgtttgtttgttatgcttcttcttctataatttgggattaagcaaaatggggaccccaactcccaagaaagtctatgaactgaacatccccaaagacttctttaacatggtagaccccccatgtgagcatctcaaatttagaggattttttttaatttgagaaaaagaaaagggatctgaaattggatggctttgattgctgttgagcggaaagatatcaaaaacagcacaaaagcagcggatcatcggtgtgttcttgcgttactagtgcctatagctcttggttgaactgttggggagcaagtggggcgtaccgatggatggatgctcggcgagcgccgccgccgctgcgacgaagcggcgcgcgcaccctcgccggagcagggcatcgtcgccgccgcaggggaggcacgcctcggagtcggtcgccgccgccgacgaggaaaaggcggtgaaaatgtgaaatcctctgccgttggggcgtaccacgtacagtagaattacgcttcgacacggcgaaagcgtattcggtgcaggcgtattccgtattcgttttgtccgcataattatccacgttacagtagaattaaattgagcggtttttgtcgtcgaatcgaatgtgttacagcataattaaactatttttacagatattttatacatactactatacatgatacacccaacccttctcttaaaaaaaaattgatacacccgttgactttcaacgacaacaaggagcactagtatttttttacacccattgacctggagtaactgatgcggacagctgggaaaaaaaataaagacgacaacaagctactcgcaatatacaatgtagtaatataaatataaatttcagtttgagatttatcacatgtttgttgaggaaaataaaaaaggcaaagtcgtcgcatgttttgacatatatgctgagttgacacatcttgttcgtcggcgctcgcaatatacaagagcacgtagcaggggagcatgcagcagcagtttatacaagcctcaaacatgaagtttgggtgtgttatataccacatgtttacaacttctagtcttctactcctttatctttatctctcatgtgtgcgtttttttattattaaacggtatatttttttaagaaatttttttataaaaaatcgctttaaaaccacactaatctattatttatagctaatattctctctatttttaatatatgacgccgttgactttttaagatgcgtttgattattcgtcttattaaaaaaattatgtaattgtgttgacagaaaacacgaggactggaagatctgcttaactctagtggaggtccaaagctcgccttcgaatgtatgagtgtgccagttgatttgattctgtaatcaacaataaatagagacaaagaattcgtggttaaatctataaatgatagccgatcggctaggtgccgatgacatatcatttatctttaagccgatgtcatatatgaatcgatcggcggttataaatagacagtaagggactaaatctattcgatcggctgtagatattaacgatatatagtttttatattaatatatacttaaatcaagtgattgggaaatatcggtcaccatgccgagaaaatataaataacttagatcgaaatatatattaataacaggattatatatgtttatagcatagccgatcagatagatctagcatgtatcggctaatactccgatactactctatataaagatatcaaaacaagtataatataccaaacaaaagcttaatatatttaaatgcaataagatattgatataaagggcggatttaacatgtcactgaagcatatagatcgaatatggttaaatcagataagatcggctgaaacttcgatactaccctaatcggcaaccagaggacaggctagagattgatattctaagcacgacttaatagatcaaacttaactgatgcagcaataagtatgaaaagaaaaataatatctagacaatcaagccgctggatgttttataaagtgatagatatcttatataatctaggacaatgtcgctatttaacctaatcggctgtcttctattaacagatgttagccgattgtaggttagataacaatattgccaaggattatataagatatatgataactcgacgaattatatagacaagattagagtgtcataaagatggaagcactgatctcgagaacacaagtcgtcataacaagttttacctcttattgaagatcgaaaccgatgcagctcaacccgaaagcaagaactcgtcgaaacaaaactaaagcaaaaatgtggcaatgtgccaaaattgtattgaacgtgtgtgttaaaaattacatagggctcggggtctatttatacccgagaattacaagatatgtccataccggacacgaccactatctctaacaaactctaagataccataaatctttacggcagacttttgcccaaacatatttgtaaggaagttacataaaacatcttaattaatagatacaattgccttctaaggactctatccatgtgcggcaatcatcttgaagcacctcaattcaacccgatgtcatacaccaaattatactgtcggaatcggctgcatcggcttacctagtccgactcagactcagccgatactaatcgtagccgatctagacttcagccgattcttgttcttttctcggatcaatctccgccttcgactccacctcgatctaatctccttttccgatgctgatattaccaaatttggttgttaacaaattgtcatttattttattgtggcttgatttatcatcaaatattttttaagcatgatataaataattttatatttgtacaaaagttttaaataacatgaatagtcaaatgttgataaaaaaattaaatggtgttatatatattaaaaaacagaaacagtaattaattagacatatttagtgagtaagcccacagaaaagaagttctaaacttctgtccctaacacacttgagtcttgaaatgttgcgagaaatagtagagatggtaaaattattttcctgtctacaactaggtagtatccacaagaatcatatttattgtcttatgtaaaatttcttatttttttcaaatataattgattttaggctttcttccgccactgacccggcgaaaaagaaaccgtgtgttggctggttggttgattgttccgctggctgtggagcaggaacgcggagtcgccggcgtacggaatggagtagccgagtagggacgcacgcggtggatcgacctcaatcattcacattttccgccccaaacctaaacaaaaccaccgacactatgcaaaactcactaatcaatccattcagggcatgtttagttggtgaaatgaaaatttttttgatgtcacttcgaacgtttggccggatgtcggaaggggttttcgaacacgaatgaaaaaactaatttcataactcgcctgaaaaccgcgagacgtatcttttgagcctaattaatccgtcattagcacaggtgggttcctgtagcacttatggctaatcatggactaagctcaaaagattcacctcgcaatttacatgcaaactgtgcaattagtttttctttttatctatatttaatgctctatagatgtgtcaaatatttgatgtgaattttttgggaaaagttttctgggaattaaacagggcctcaatcaagcaggcaagcaaaagcagtttgaacctgcaacccactctttgggtacactatgctggcagtgttttgctacggatgtcaacacggcttctgctcctttttgcattcgcgtcacctttcattttatttccaagcagtctctggcatggcaataggatttgtttccaataatactttctccgtccacaaatataataactttataacaattaggtttatctcaaaatataacaacttatttacctatattccatttccgaacgatcacaactttccaccactaaaaatctccatctacttttttcttatcaaccaatcaaatattctttcatttaatttcacttaatttcttaatatctgtatatattaagaaggatgcaaaatattattgtctgaactatgttgacattatttggtacttactgctttactgatgcaattggatgtgctgtgcctatgaaccactaactcagtttcaaaatataactacttttgactatgatttatgtgactaacctaaaagtaattatatttagaatggaggtaggatgtaatatttccgtttctaactgctcctattttttcttttttctttttctttcaaggtatgtccggtaaaaggctcgtttcgaggccctaactgcttgcggtctggttgagaaaggcccaaattacggtccatctaggatgcctacgaggcctttgattcgatgggtggtgggccgggccactattcatacgagagacagcgagggccttggccttggccttggccttggcatgcgcatgctcctccaagtcagcccaataaagcccacagcgatgggccgttggcgacgcctagatgccatcatactgatgttggtagatcgatgacgaattgattgagagacaccaaaataaacatcacggtcacccacgcagatgccggcaccgccatgataaataggcttgttcgtttgtgctatattgcagttagctgcggcatataagaatttcggttggataggatactgctataatataaagaattgtccagagtattagaatatgtctcattcactttttcaactctcttcgtttgttagacgcacactttcaaactactaaatggtacgtttttttaaaaaaattatatacaaaagttgctttaaaaattatattaatattttttacaaagaagttaatacttaattaatcatgcactattgagttgctctattagttcccaacccaaggagccgatcacagcctaacatatgttccgaacacattcagtgattgttcgagctgttgggatacgcgtaggctacgatagcataaatcaaaattttttatcgcgtaaaccatgaaccatgcaagtattagatcatagatcgttaccactcgacgcgctgcgcagcggaagaagacgctgagaagtcgaaggaactctcgcgaagtagcgcgcgtcgatgcagaggaagtagtcgatcgcaccggctcgaccttctccccgtgcgttctcctcgccgtactcccacgctgatcaacaccgcaaaccagcagtgcctctaccggtatccacacgtacagggacggaatgccacgcgcagatgtgctagcacccgcgtgcggctagggttttgctcggggagggaagtgacggctagggtttctcacgtgatgcaatgcctccgccggtcacacccctcacgaatatataggatccatcactcgggcctccaaggcccgtaggactcctattcggatccctatccgaattaagctcatattggatctccatccaatctccttattccggcccattaagcgtgtgaccctgtagtttcatatatactcggctgtaacccgaaaactccttttcggtccacgcgtcaacaacggcccctagcagaatatattgacccaccagacatacataaatatcatatcggctgaacctctagtgtatacttgtacgaacccctttgcctcacgatatcgattaagcttaaggctagatatgtacctagaggcaatcactaacacgagctacgattgaaaagtcataaacataataaagaagcaaaagataatttatatataaaactttaatatacgtgttattagcgctttaaaagtccacactaattaaaagtagactataatgtaaaaagcaacatcaactctcaataaaatttaaaatttattcattgttgatttgttaataagtagtggacgagaagaacctaaagactctctgagttactaacgagtttgcaattagaatcgtaaagagggtcgagcttgaattgaaatgctagcgatggcgacgcttatgaaagatggtccatgtagaaaacgcagccaatcgtgcctatttttacaattaattgttgtctctatttcttctctctgtttctgtttcaaattgatgattgttcaacggtaaacatgcatgggaggactttgcatatcgtgtgaaaaaaaaaaaaaaccatcaccagcagcagcagcagaccggagcctggagagtcaaaccggcgtgagcgaatcagtgttcgacacgtcacgtgggctcacctgcaccatatcttaatcccacgatcttcggagagaaaaaagtaaataaaaaacatattatagtccacgcggcctgcaagttccggactcgcagtgggtggatggatgcattcagaggaagggaacaagacgagacagagacagcgagagcagtagtgaatagtgatgggccatggaaaaaatatcgcaaaagaacaaacgagatgaaaagtagatgagaatattgccctattcgataaaagtggtactccctccgtcgattttgagtttttgtttacattgtttgattactcgtcttattcagaattttttgaaattattattatttttttggcttactttattatccaaagtattttaagcacatttttcgttttttatatttgtacaaattttttttgaataagacgagtggtcaaacagtgaaagtaaaaactcaaaatcccttatattatgggacggagggagtatgtttttaaaccgctaaacgatgcatttcgtgcgaaaactttctatatgagattaatccatttcttaagtttgtaataattaaaattcaatttatcatatgttattactatctcgttttacgtaaaatacttaatattttatctttatctttgttacattcaaacactactatgtgtaacagatctgataacgatcgttattacaacaaagtatagattttcaagtcctaaattcaattctaaaagttggattaaaagtagagttgtgaagctgtctaaacttttttttaaaaaagttggaactatttggttagatttcagctttagaaatttaagttgtgcaaaataggttctatatttcactgtaaatatgttttccagaaaatgtcttctactatattgcgtaaaccactagttacctaacatatttttttagataatagttacctaacatatgtataagaacattcgttcaaaaaaaatgtataagaacataggatgatgagacacatcataatgctactaatctgaacaacctgtttaaattcataatattaggatacgtgtcttatccgattttaagtttttatactttataatagagggagtacaaattatttcttctaacctaaaatatagctacaaagtatagacatggcaaaaaacaaggagtttccgctgtcgttgaggcctcgtcaagtgctttcgctccgtctaaattataacactaagtatgtccagattcttactatagctaggtatattttgaacaataaaagtactattattgtttgtcaagttcgtttattaatccgatgtcaaactcaaaccacgaccgtatatgcatgctgcgaatggatccaatagtctccccacgccgcttactttctggggagcttccctgacttcctacacctctgtattggaactattacgaccacatgctctcttcctactctcctccttagaccatacggacttaatctctctcgccctaatcatcatcgtcttcctcctcttggatcttctcctctgccatggcgggcaacagaggaggcgatgccggggaaggggagtggctcaaggtcgccgagctcagggccacggtggaagcccaggacccccatgccaaggtacgcgacgagatgcatctcatccaattccaaccaaaacttactccatccgcaactgcatgaacgaattgaatttactcattctttcgttctttcttcctgcttcgtcattctccgttttgttctgcttactgttcttcctgttctctgttccagtcaattattgtttagacgaactcagtgtgttttgattacgcagcagagctgaataaaccaagctgttttgactgtccagccatataattgtgttggattgacgaaacgaacagtcatgcttaatttgtgcgaaaccaaagagaatttttgcgtaagaatctttgctatggacgagcatttagttctctcgaatcacacgcttttttctagcttccactcctcagcaacagaaagaatgagtgtcggattagcaaagccatgacgggaaagcagggcaaccaatcaggctgtcgctatttgtagagaaatatcgaattaattagagtattactacatcagatttggctggcagttgatccaacagatcgtaccagtagtaattaagcgatgtgatgagtaattagtgccttagtggatcattggccaactgtacagatcaccggatcgagtctggaagtacagggtgtatggggtcgccagctgaatgaaccacgtgaagaagaatgatgcttaaggagtaattttgaaggctaatggaatatgctcccgtggacgcacacgccagccattacatggagctggacctacgtttcaggggcaattatattctctccatcatcgtctggccagaatagcggaatagattacaaacattattataaagataaaaatatactttatttgtcttataaaaaccaatttagtactagatcctatattagttttttataagacggatggagtattcaaaacattcttttaagaatattatatacagaaagttttttttccttgaaaattcaccactgaaaatgcgtcgaattcattcattatttcatttctcaaaacagaaaaaagagcatgccaaataataaacgtgctactaatactatgaaagtatgcactccttcgtccaaaaaaaaaaaatcaacttgtagtgtttaaattttgtcccatagaaactaaattctaccatcctacgtaccatagcaagtaaaatgagaaattttatctctttaatatcatttagctacataccattcttattgccttttccaataattaagggtattttagtcattcttcatctccactaaatctagtttgggatgatatgaatgaattttctatgggaggggggaagtagtaactaacaacattgttcgacgatcgatcggacaggatttgtgaatacacgatgctgcagaactgaagcgttcctgattctttgcgcatgcaggaagtggacaacctgacgctgaggaggttcctgcgggcgcgagaccacaacgtggagaaggcgtcggcgatgctgctcaaggcgctccggtggaggagggaggcggtgcccggcggctcggtgccagaggagaaggtgcaaagcgacctcgacgacgacaaggtctacatgggcggcgccgatcggaccggccgccccatcctcctcgccttccccgccaagcacttctccgccaaacgcgacatgcctaagttcaagagtacgtctccgttggattcatattctcctaccataatgacactaccattacaatcactgacgtgtgggggaatagaaggttggaacccatataccggtaactgtaatgatagtgattgatattatggtagagaatcctcgcccatctctactagctatagagtttatatactaattcctcatttctaaaatatactaccttcatctcataataagttaatttagtatgtgatgtgatataaccaaatactacagatttgaataaaattaagatatatcatattctatactaaattaacttattctgaaatgaagataataagtgacagaaccagtagttatacgtgggaggtcataagagtcttggaggaggcctaatacacattacttagattaattatttaattaattaggtggttatgtgtgaaaaaagttattggagggggcatgccactggccacctccttgtctccgtcattggaaaacatgaaaaaaaatacttatattttagaaatatagtactccttccgtttcgaaatgtttgacaccgttgactttttagcacatgtttgaccgttcgtcttatttaaaaacttttgtgaaatatgtaaaattatatacctacataaaaatatatttaacaatgaatcaaatgataggaaaagaattaataattactcattttttttaataaaacaaacggtcaaacggcgtcaaacattttgaaacggaggaagtattaatcttatgtacacatagcctgacttatcgagtatgcatccatcttaactatttcgtcttctgcaccgcaggttattgtgtctacttacttgacagcatctgtgcaaggtaatcacaatggaaaatgctctgatcgatcgagttttgttgatttactgcttgaattaattactgatgaagaacagctaatgcacaagactgacattaagagtagttactgaacgctgatgatgcatatgggtaaattcaatttgcaggatccccagaggccaggagaagttcgtctgcatcgtggatctcaagggctggggttactccaactgcgacatcagagcttacatcgcggccatagagatcatgcaggtaatatgaaagatcattcttcagttaattcagctaattaaacattactgaacaattaacaagcattcttacagattgatgatgattagttacatatttttcgttgcgtttgattaattccccctcgcagaattactacccggagaggctcggcaaggccctgatgatccatgtaccctacatgttcatgaaggcctggaagatgatctaccctttcatcgacaatgtcaccagggacaaggtaatgaaatcgatcaaagaacttgaaatcaagtgccaaacaagctctcgcacattagcactacgttttaatttcgttcttacaattctctccttgattaattttggttcaattttctgtctgaaaaaaaaatgcagttcgtgttcgtggacgacaagagcttgcaagaggtgctgcaccaggagatcgacgatagccagatcccggatacgttgggcgggaagctggcaccggtttccctcaagaacaacgcgcgaattaaccttgattagtagcgaggctcaattagcacgcagttataccgataatcaagcacaagattatacacacacgtatactatacatggatcgatgggatgaacaaaagatatgtgtaattgtgaaaaatgcagctctcatatcacagctggtctcactgtttgtagcattgccatcgtcatttatctcagtaacaaaagcttctgatcagtaattacatgtactactgtcactatgacaagtaaagactccaatactccatatcgaaaaaatatgaaaaagggagccacgtggctaagaagtataaatttataataaagtatgcaccattccttctaatgctatttgtttaatctaacatctctcgatcgctaacaagtactccttcgcaaataacaactgaacttgcaatgaattgttgtaagctcgcattttaaatttttgaaatattaaaaactaatcaacgtcgatggccgtcctagctcagtggtagagcgcgtggcttttaaccacgtggtcgtgggttcgatccccacggacggcgttttttttttctctcatgtgctccctcccctcccttttagttctcacgtactcccaccccacgtaaaaaaaaaaactcaaatctaaatattcaaaacaggatttcccttttagttctcacatactccctccccacgtaaaaaaaaacttaaatctaaatattcaaaactggatttgaatctaaaattccaaaaattcttccattgcaacaaatcacttatattatagatcaaatgttgcagtgaattgaaacatcatgtcgctatttgctgaaacattgtattaatatatggtgaaacagtttgaaaaatcgttgttttataagttgtagcaaaatattttatgagatgatttggttgtgtttcagctttttaaatgattgaaacattttctatctacttagtgaaacaattctgatctacttggtgaaacaaggcccgatttttgcaaaaaaaaaggcaaaaatgggcgcccgatttgtaggcgcctcgctaaaattcagaacacaacaatttagatcatctctagaatttgaatcttccaaatctaaaagtttaaaaaaggatttgaatctaaaatttagaacacatgtgtttagattcatctctagaatttgaatctgttgatgtaaaaacacgaggcataagagatctgcttaactccagtgcaggtccaaaaagcttaccttccggttcgtgagcgtacaagttgatttgatcctgcaatcaacgagaaataaagataaaaaaccgcggttaaatccataaacgatagccgatcggctagttgccgatgacatatcatttatctttgagccgatatcatatgtagatcaatcagcgatcatgaataaataagaaagaactaaatctactcgatcggctatagatattaacaatatataatccttatgtcgatatatacttaaatcaagcgattgggatacatcggtcaccatgccgagacaatataaatcacttggatcgaaatatatataaacaacaaaactatatatattaatagcatagccgatcagatagatctagtatgtatcggctaatactccgataccactatatattaagatatcaaagcaagtaaaatatacaaaacaaaagcctaatatacttaaatgcagcaagattttaacataaagggcagatttaacatgccaatcagacatatagggtatgaagtagttaaatcaggtaagatcggctgaaaccccgatgctaccctaattggcaactaaaagcaggctatagatagagattctaatcacgactcataagatcaaactcaactaatgcaactataagtatgaaaagaaggacaatatctagacaatcaagccgttggatgtttcatagagtggtagatatcatatataatctaagtcaacgtcagtatttaacctaatcggctgccttctagcaacagacgttagccgattgaaggttagatagcgatattgtcaaagattatataagatatgtgatatctcgacgaattacatgaacaagactagagtatcataaagatggaagcactaatacagagaatgcaagccgccataacaagttttacctctagttgaagatcaaaaccgatgcagctcaactcgaaagcaagaactcatcgaaacaaaacgaaagtaaagggtggcgatgcaccgagattgtattgaacgtgtgttctattaattacatggggctcagggtctatttatacccgagtttaaaaaatatgtccatgtcggacacgactcttatctctaacaaactctaagatgctacaagtctttgcggcagactcttgcccaaacatatctataaggaaattacataaaatatactaattaatagatacaattgccttctcaggactctatccatacgtggcaatcctcatgaagcacatcaacccaatccgacaacgtatgtcgtgtcatattgtcggattcggctcaatcggctgaccttgtccaactcggactctgccgatcctggtcgcagccgattcggactttagttgatccttgctctgtttccggaacgattccatcttgaattccactccgatcctatcttcatctccgatactcagattatcaaatttggttgttaacagaatctttcaaatctaaaaattcagaacatgatttgaatctaaatttcagaacgcatgtggttaggctcatccctatgattcaaatctatttaggacagaggtttaacttttgcttgcctttaatgaaacccatttctcctgaagaaaaaaacaaattccattttacgcccccgactttttgaaaggaacggttatcacatatttacgttttgcttcctttaataaaacctatgttcctaaacaaatgaaaaatatcattttacgccccaactttttcaatggaatgcttagtgtaatttctcggtttattttacaccgtaaactattaaaaacgattcaccttactattatcacttatgtcttaatgtttcttgaaattatggttgtttatataggttggaaacactcagatgaatttaaacatagatgttttaaattttaagtaaatagttatgattcttttaaatatgttagaacttttatagtggtgccatctataactctataaaattttagtttgaaatacgactagtatatagacaaacaaagaatagaaatgctaatgctagtaaagtgaattatttttaatagttcaaggtaaaatgagaaaaaaaaagtttaggggttaagtgatacatacgagcattcaggtgcacatactaactaactaataccttcaaaatatattttaaccatatttttctataattttcgctgatatttgttagttggtgtgtacacagtaaggcatggtctaattctaaaagaaaatcatcgtaatattatactacaacctttctaattgctgggaggtatcaacaattgtctagttctaggtcaaggacatgcaaaaagccaaatatatgtacgtagttgatggtagtttggtggaaatataacattctgtaactgtatatactacatagttaatcggaatttggtggaaatttaacattttgtaaatatatgtgcatagtagtttttttaggtaaatgtatacagctacatatattgaatacgtttctactatgcttaaataagaacaaccacaccatcatataatgcgtagtttgcatgaaaatagtgataggttctgttcacagtggattgggtcttttgtggctgggcctttgtcatcacaccgattatacggcaaggtagatggaaacatccatttttttcgaacacacataaatcttgcatgccaatatattagaagaaaagtagcatatatcagtaacacacctagacggttagaggggataggagggtacaatatgacattgaagagcatgctaaacttaatgtgactcgtgtgaggaaggtgagagaaacaaaactaagggtctgtttggttcacagcccaaaccagtcatcaagttgtggcgtcgccagagattgtggcgagagaaataatcgccacagctgtggcggaaataagcatgcaaatgaactagcaaaaagtgtggctgccacaactcacgtattaaccaaacatcagccaaactgttgtggcagccgcatgtttggcgaggcaatgtgtggcggggatccaaacaccccctaagtaaactaagctatgtgactaacagccttgtctcaacccattgccgcccttcttgcacaatctgctccaccaccgtcggcacccgtgacagaacacgggccaaagataggttattcttttctttccacaagtgctaggcgaccatgcttcaaatgactaataaactgctaatgataggattcatgtgttcgtgactaagtaatgaagaccatattggcgtaatgcgacatatgcttgccgtataggatttaacttattttgagatggaggatgaccattttctacaatactggtgttaggtacacttgtcttctcaccctcagcattcaagtctgctaatgagcaaggctagagacactcgcattcaagtttgcttaagagcaaggctagagacaacaacagtggtgtttgtttatgaggtcagcacgtaaagcgagaaaaatattagcgtatgattaattaagttgtagttattataaacatgaaaaatgatttttttttgatattttaaagtaatttctacatagaaaaatttcgtacggaacacacaggaattaaaatcgaggaaaaatctatatcttaatagaaaaagaatgggccaaagtgtgttcactggggattcaaaaggaaggataaggctgagttcgctaggaagttaggattatgattttccacatcaagcaaaacgatacaggtaattaatatatgattaattgaatagtaattattataaacttataaattaggtttatttgtttttatataaataaacatctatatttttttttaaaaaaacgcgtctgttaacagttttaaaaaacgtgcccagagtaaacgggagagctgcaaaagccaaactctctactgaacccaacctaaagcattaatgtttctctccttttgcacctcctgacctagggtgtgttcggaacttctagttcccaacccctttccctcattttccacgcacacgcttttcaaactgctaaacggtgtatttttgcaaaaagtttatatacaaaagttgctttaaaaaatcaaattaatccatttattaaaaaattagctaatacttaatcaatcatgtgctaatggacagctctatttttcgtgcgggaagatgggtttccaacccccaagtaccgaacacagccctagtgacctagagtagctatgaggaatgggtatgcgtttttcctattatacccttaccagtcaaaccacgtaaatctaaatcatgctttacctataaatgcgagttttgttgcaatgcctattactgtcgtattttttagacattgatttagtaataacagatgcaaagttaaatatgagtagtttagatgatactagcatgattcaagtttctattaaagatgcacatcttcagtccctgacccagcggtgcagctgaacactttaggttgaattttcccctctaggtaaaacatctggttcaaaattcaaattcaaaacaaccaacaacaagcagctctatctttccaagaatcaaacactatgcaaaaaggaaaggtgagtcctgtctacctatggaatagccccatgattcatgaacaacgaagggaaacaaaaaatctcaaatcgaagattgccctccgtcctgaccactgcgaactggcgcgctgatttgacttccggtttgaaataccaccacaccaatcggacggcgcagccgacgcctgcaattcgaatgacgagctcccagccgtccgatctcctgacggcgtgaatcccacccaaaattcaaactggtggcagtgcccgtaaattgatgcgaacttccgggggtagcgtggtaattaacctcagctcgcaaaaggcgaggaggcgcagcgcagccatctcgcgtgctattttgctctgctcgctcgctcgctcgtctccacaccttctcctcctcctcccacactgctgcgcggccgccgccgccgccgccgccttccgcatcgtcgccgtcggtgaggttctggatcctgcgccgttcgtactccctgccatgttttggttgtcgcttttgttggggttgatttggtgtgaagactgcagagttgggggtagagtggggttttgttcatctggcgcgcgagtttttgggaaggtttttggtgggttttttttttgttgtttttgttgcttttggtgttggcgtcgattgggtgaagagttggtgtcccccaaaaaaaggggcgaaaaattggtggtggaatggggttttgttcatctggcgtgcgagcctttgttttggggtttttggtggggttttgtgttgattgttcccccatttctcgcggattgttgcgtgtgattttgtttagagcaatttgttagcgatggcgtgtggaatccgaacgagcgaggtgagagcagagtggctgatgcagcttggtttgtcgtgtttgggtagattttgcggagctccagtggatggaggtgatggattcggtggccgtgatggaggtctcgccggtgccgaagccgccactggaggcggcgcttgcgctgcgccgcagcgttcggtgcttgaacaggacgcgccgtcccacttacgtggagcaggaggagcccaaggagagtgctggccggcggcgcggcggcaagaggaagcgggaagaggagaagaaggagccggtggcgcagcacgccatgaagccggtcaggatgggcgatgcagcctcggagaggaagccctcctcggaggggaagccgatgcccgcaattgcggcggagccggtttcttgtgccgggttcgcacgacctgctgccgaggatgatgtccttggcaacgggaagagtgcgaaactgcgggtgaaggaaaccttgagggcattcaccagccattaccttcaccttgtccaggttatcttttgcacctgaatgttcagctccattttaatcgttttaattttagaaccagtttggaaagcacagaagaatcacattatttttcagtaggctagcagaatactcatgcgttgcaactggaattaaacaagaaacccaccgaacaatataaagcctagtaaaataaaattatttctattgtaaaatcttcaggtcgtatctgtaaccattttgtaccccactttgaaataaatttaccttgttagatggtttagggtgcccatctacctcatggcattggtgattggtgtggcggattcaccactccctaccactattgagatcctttaaaagagtagtatatttgccatcattttctgccttacgttaaaataaattttccttgttcgatggtttgggatatctatctacctcagcattttggagaaccacatggtagctgtggttggtggtggcatattcaccacctccaccaccattgagatcctttaaagagtactacacagatataggaactattcagatatcattgcatctggtgaaaaaaattattgcaggaacgtatgttatctgacaatgcacttgtggaatttcaggaggagcagaaaagagcacaagcggtgttacaggaaggccagaagcgtccatcaaagcggcctgacttgaaagccattacaaaggtgctgtgttgctctttgcgttttgaattttgggtgatatttgccatacacagatatccccaaaaatgcctctcttccatacggtgttttagagaaaacacatacctgttttgcttgggttacacttacaactattgttataattctagatgcaagaaagcaatgccgtgctttatccagagaagataataggggaactacctggttagtatattctcttttcctaacaagggaaccttgtggtgtagtgattcgaactagagatacctggtctattctcattttatgtttgccccatatgtatgtatcctaaagcaaggattttcaatataatgtcgttcttcttccttgccaggtgttgatgttggggatcaattttattctcgtgccgagatggttgttttgggcattcatagtcattggctgaatggcattgattatatgggaatgaaatatcagggaaaggtaaatactgtacatttccatatcaactaaaataaatcatgttgtacaatattttgttcatctgataatggaactacaacttacactagtatacttagttgtatcgttgtagcttgttattcagacatggcatcattggttcaagaaggccctaaacactggatggttagcagttctagagcctagcgcctaggagtgcctagacaccgcatagaaccaacttgactaggggcttcctagcaatcagcaagcatatgacagaaaaagaagacaattgaacataaatataatagcactagagttcccacggtagggcaagcccctaatgccaaattgcggtggttatccagcaccaagcgctgacttttagaacacacatagcattctcttttagctttctctcaggtttatagttctttgttgctgcatttggttttaattactttcttagacctcctttggaacatagtacttagatttctgcagaaattagttcaattcctataaaaacaaaatgatagcaaattcaaagttccaaaataaaaataaaaactgcttacagataaatgttactgtttctttgggtttttctgctgaactaattaatttagcaattctcctttaaacaggaggagtatgcaaacctaactttcccactggcaacttgtattgtcatgtcgggaatatatgaagatgatcttgataaggcagatgaaattatttatactggtcaaggaggaaatgatttactcggtaatcatcgccaaattggctctcaacaactgcaacgtggaaatttggcattgaaggttagttatggtggttttcttttactactgtatgataattatttatgttgtttgaagggtatccatttatttcagtgatgatatatccttttttaaaaattatagccaattaattgtccactatacgaataccaactatttaagatgtaaatttcagatttgcatagtttccatgagctgtcattgtggataatctattccttttcagaagatataggatttatatgcatagacggtgcttgttttcagaatgctttttttttgtgctggattataatacattccgattgtggcttgtttgacgtatttttgcttgcatctttgagtaaaggcattctattaaatatgtttcaatttgttcgtatctttcagtttgcaaaatgttgttccttagtatttatgccaatggcattatttttcttctgaactttgtttcattttgaccctttctctgttttggtaatattgcagaacagtaaggataatggcaatcccataagagttatccgaggacatatatcaaagaatagctacactgggaaggtctacacctatgatgggctgtacaaggtagtatcttttcttaatctcttcagatatcatgttacttttttcgataatggaagctttattaaaactcagttaaatacaccaagatgatacatttcaactgagcccactaccagcctctgcataggatgcacacagccagacacaaagaaagacctatctagacccccttcatgaaacaaagatattagtggctatcaatccgtagactagatcgtgcctcggtaaaaacctcccgtgccacctggtccaaatgtcgcgataccaccgcaatagtatcccgaagactggtttgtggatgatagcctagtcgaagccccgggtgactaaagtaatatcatgttactagctaaaggcctgtgcattgcaatggatattataagagataaaagcaaaagcaaaaaaaaacatgtttatagcattgttagttgattaggcatataatgtcatctctaaaggcagccatactgaaatatactgctagatcacctcttttcatcctcttcatctatttctacaagccatatggttggataatacaagataggacgcttatagttcatcagtgagtggcaagtaatttgaaggttttgtttgtaaccccttacaatttctagattagcaattccagggccattcatgtgttgtgaggaccttatgcttatagccccacatgtcagtttgtggtgttggaggcagacttggacaccaccagtagcatcatttaaaggagtatagatgttctagataagttcatacaaatgtgttgctgactgttgcatgcttggatatctgccaaactacctgtctaaacagttgcttgccttttattatgcctgacggtgtcccatttgttaatacagagatagaaatgaatttcctgaaacacactatttacactgcctccggtgattatttcttcaaccctgtattgcaaatatgctaaagaatacattcaattaactaaatccttatccaaagatagtctattggggacacaataaaaatagttttgccaatacctcttcttttccatttcttcatccctgacgttcatattttccaatgttccataggttgtagatgactgggtgcagaatggagtacaagggcacgttgttttcaaatataaattaaagcggcttgagggacagccatcactgacaacttctgaggtatgcttgagcttggttaaagctatttttttttgagtaaatttcacaaaactacatatattttgatcaaattatcacaaaactacagatttaaagtgatgtatcacaaaactacagatttagcactaaatttatcgcaaaactacagatttaaggtggagtatcgcaaaactacaaatttaataacaaaattatcacaaaactacaaatccttagcactagtgttatgtttgagttataaacgtgtaggttttgtgattaaattatcactaaacctgtagttttgtgataattttattactaaatctgtagttttacgatattctaccttaaatttgta

SEQ ID NO: 59988 - DNA, 1092 bp, Oryza sativa
ccaggttgtttgtgatgtatgatttctccttcatgttgtatataaacgttgagatatcaacattactaaggcactgacaaagataatctgttgcacagacttttcttgttggaccaggcacttattctagagaatcgattgacgttgagagcaatgtaagctacagctgcatcttgcattcacgtgttcttctatgttgcattatttggctgagcagttattattttttcagatctgagtttggaggtcatctgctttacttttacatatgtgatcgcacaaatctactgggagagtctgcgaaggtgctattacattgatgtttattacaagcctgatttcacgtttgaaaagtagttgcaaaaatattgtatctagttgagatatcttttacgaatacattctaagccttactaatatttcatggaaagtgcctatataatgtgctgttctttcaatgggacattttttgttctgaccttttctgttatcctgtatctgcagaattacagccgagatatgttccttttcctttactttcttcttattatcgtagcagctatgacttctttcaaggtccaccaagacaagtcgtcattcacggggaaatctatactgtatctgaataggcaccaaactgaggaatggaagggttggatgcaggtatcttttttggggaaaaaaaactccgtcttccttttcatatatttatggggtatcttatactagttggcttctgtttgtgcataacactaatttatcataagtcagaactatgcaaagagggtataaatgcattcagtattaaacatcttttgtcatattgttggtttccgtttgtgcataatactaatttatcagaactcagaactcagaactatgcaaagaggatataaatgtgttcattattaaacatcttttgtcatattgttctacatgtatgcttacctagtcttcattaatgaacctctcttagttttagtaagttaattagtcaatgctcaatgcctcaatagcatacatgtgtggttagtaagtttttcatctatgttcaagtgcatgcatatcacttgttttcagcattgatttccc

SEQ ID NO: 59989 - DNA, 6267 bp, Oryza sativa
ttctattgggaaatttaagacagaggggagcctgaaaactatgcaatccttcctccttcctcatgaatattcgcatgctgacaagctattatttctacgatttctactattaacattttttttattaacatgattttacttctgaaaaaacattttcatcttgcgcggttccgcttctctaatgtggtaataaagctcatgaatattcgcatgctgacaagctattatttctacgatttctactattaacatttttgtttttttattaacatgattttacttctgaaaacacattttcatcttgcgctgttccgcttctctaatgtggtaataaagcaacaagcagcatatcttgattctctttagagcaaattgaatggtacagtcaactatcaactccaaatcatctataactaatatatctcctacatcattaatacatgatctcatctatcatacactcagcgttttgaaatatgtatctatcatacactcagcgttttgaaatctgtgttccgggttgtagttggctgcaaagtgtaacaaagataaaattacctggtccaaagtgaaaacccaatcaagtaaaaatattagtttaaaggtgattcaaaatgaaacatcggtaataaaatgcgacctaaagtaaaatttcctttgatttgacactatcgaaagaaagtcgggctaaggtagcaatgatgcacatttcacttttaagactaaccaaacacgaaacaaatatgccgaaataaaagggtgccagaaccatcaaaatatgggagaccggtacataatatcctgcgtcacaggctacaacttctaaaagaaacaaaaatatgatcctaggccattgctggtagattgtacggctagagagcagcatttggcatgtcatacgtagtgacgagcatccatcaagccaaatcatacgataggatgaggaagcatccattgttggcgccggcacgacaagctgatatacccgaatcttctcgagtggaaggctagcgcaaggggaaaacgccatcaacttcagttcctattagcagctctttccctctcccgcttgttgtacagcctctcaaggacgcgctttgcctcgcacgaggggaaattactaagatcataatagtgtggagccacatcaatcagcctgcacatgaaggacaaacatgtcagaaattctttcaaatcttcaatactcataaaaggactagctgtctgccagataatgactaaccagtcaccacggatatccatgaccgtgcggatgaaatttctggtggtcaaaacatactcattgtagatgacccactccggcttatggtctagacagttcgaggggtgaagatggacaacctgagcacaacaaagagtaagaaatctgcaatttcatcatcctgtacacaaagagactgggcatcagaaaattaataccaacctggttatctttgacggtcaggtaatgtcctgttcgctccaggtgagcaacctgcatgaagtaccctgcaagcatggctttcctgatattgacgtagtactcccgactattgaagtctgtgctgcacatcttgaggttaaatctggtcatgatgcgaacaagctgttgtctgacattatcagctgactttagagctctggcattgatgaagttctcataacaccactggggatcttcatctgcattgtcgaaaagacaactgttaggcaatgaaatggatatcagtgtagattgaacgaaaatggtcatgaacttactgttctgcttgtatgcatggtatacattcagaagtgtcaggtggtccccgtcaatgtggccaaatcgagccttcgcttcatcagcagccttctgtgcctccctaggccggagaaagcaattgggtactagagaaagaatacggcaataacagacgaagtccatggtggtcagcagatgcaaagaggcgagacgataccatttgctttgtcagaataactcaacaaacagcaactatctgcatcagcctaaactgtatgatcattttgatcaatagctcaagaagctaggtgcacgacagttgctgattacagctctgaaagaattaataaagcatattggaagagcaaatgcactaaagtggatgcaaactctcatgataagaagcttgtaagctttctacaatgtgcaattgatgcaagcaaaattgtgcgggtgttattattacgcactatataatttagctgacaaaccatatggcgacatgaagttttgtttgacatacctgacagcatggcagatattgaaaggatctcatttgaacagttgtattttggactgatgacaagcatctttgacatctggggatctagaggaaattcactcattgtttcacctaaaggcgtgaggtttccatcatcatcaagtgcccctaagtagttcaaaacttccaaggccctcatcaaagtttctggtgcaggaggatccataaagtcaaaatgcactaaatcatcaattccaagcttcttcaaggtaagaaccgtattcgccagatttgacctaagaatttctgggtatgtctgtggctgtaaatcatcgttaaaactcttctctgtatataacctgaaacacttcccaggttgcgttcttccagcacgaccagctctctgatgtgcacttgcctttgaaattggcgacaccagaagggactccacccttatccttggattgtaaaccttctgtttggaaaaccctgggtctatcacatacactataccatctatggttagggatgtctcagcaatatttgtggacacaacaattttccttccagctgggcctccctctcttgatggggctggagcaggttcaaaaatcttctgctgcattgctggaggcagcgtagaatacaaaggcacaactttaactgggccaacctgatcccccatgttattaatttccttatttatcttccgacaggcatcctcaatctcctcctctccagtaaggaaaacaaggatatctccagcaggttcacacatatgtatctgaacaactgtcctgatagcagcttccaggtagtccctttctggttcttgtgtatagaacatctcaaccggatgaagtctcccaggcaccttcatcaacggtgcaccactgaaataggtctgaaatttctcagcctcaagggtagcactcataacaacaagcttcaaatcaggtctgttctttagaacctccttcagaagcccaaacagaacatctgttgctaatgtccgctcatgggcctcatcaagaacaatcaccttgtacctctctaaaagtgggtctgccatagcttctctcagaagcataccatctgtcaaatatctgataggaagcaatagtgttcaacacaacatgattagatcagaatacctaaaaaagaaagaaacatccgcaccatatcaatctgccaaaggatgtgcaactaatcatgttcttccattaaacataaacaaactaaggcttacttgagaactgttttgtgactgctgcaatcctcaaaacggatgctgtaaccaacttcctccccgatagtaacatccatctcctccgcaacacgccgggaaactgacatagctgccaccctccgcggctgggtgcaagcaaccattgagcggttgctcaagccttgacctcaacactaattgccgaatctgatcaacagaaaaaccaataactccccaagaacaaatcattaataacgaacccatataccaaccaaaaacctcgacacagcctcacacatcaatacataaacaaaatctaaccaatttaccataactccatgccactaatatctaggggaaaaatatcccctaatcatataacacaatatcatcacatctcaatacacaaacaaaacctaaccaataacgatcccctaataaacaaccaataacgacaaacctaaaatacttttacagttcaatgttgagatgtacaggcacagggacagattcaatacctgagtggtcttgccgcttccggtttctccgacgaggatgagggtctggttgtcgcggaggacggcgaggaaatcatccttctgctgccacacgggtagcgtgcggcgcttctggaggatctaaaggtacctcgccgagtagggcctccccgtccaccgattgatggacgggttggccgcggcggcggcggccgagccgttggtggtggcggcgcggccgagcttggcggagacggaggtctcgttgaccacgttgaagaggctcaccttgcgcttccgctccgtccccatcgcggctgcggttgcggcggcggcggcgaagtgggggtcgggtcggttcgcgcggtgcggaggaggaggaggcggggcgggcgaggcgaaaccctagctcggctctgttggggtcgccagatttatatttgggaattgcgcgattggaagtcggtttggaaggggcgaaccgcgaacgggcttcttttccgttaaccggttcagaaggcgtatttccttttactcagtatacgtgttgtagtcatattctacatttctacctggctctttacgtggagtccggtataaactcgtatatagttggggttaaggcaagcacaatgttagctgccgacttcggcaatactgtgggctaagaggtcagacggtattaaaccatcgcacccttcacattgtttatgcgcgttggagaggaataagatgggcccagctaaaaaaaaatcaccgatagtaaaattcccgtgactgctgcatgactccttcccacgagttctgtcagaaacactgtacaaataatattgtttatctcttgttcatcggtagtagctgtatgaccaggttttaactctttgccactctcacaatgcttcctaccgggtaggaagagagcatgtattgcttattaccggctaaaaagcaacaatgtggatgcccttataaaaagttagctcgattttttaatatttttttagcaaatccatctatttcactcatataagattgaaaaagatagtaaagtttagtttagctctatcttcaattctaactctaaggaacaagaatcaagagttaaactgttgctaaatagacattaaggcaataatatatatctaggtttttttatttatttttttctattgaatttttaagatttttaaaatgatatttttctttacaattacggttcgattgtaacttgtaagaaataataataataataataataataataataataataataataataatagagtaaagtccgtcacctgtccctaaacttatactgctgtgtcatctcggtacctaaactcgcaaatcgatcgtttagattctcaaacttgttcgattgtatcatctcgatccctaaacttgcagattactcgtttaggtcctccaacttgttcagttgtgtcaccccggtccctaaacttgaatttgaatatcatctgggtcaaataggacgatctaaatactttatatttaaaaataattcataactttttcatgtgaactctaataaagacaaactttatatcaaacttgtagccctcgacgcgatctacaactttgttgttgaatttttttttattttaagtaattttttgtcccaaaatgtaattttaaaattaaaatttcaaaatctataaacatgcaacaatattttgggaccctaaacagttttaattcaaaaacttttcaactacaaagttgtaggtcgcatcgagggctacaattttgatatcaagtttgtcttcattagagttcacataaaaaagttatgaattattttttgatataaagtttttagaccatcctgtttagggaccggggtgacacaactgaacaagttggaggacctaaacgagtgatctgcaagtttagggattgggatgacacagtcaaacaagtttgaggacctgaacggtcgatttgcgagtttagggaccgggatgacccaacgctacaagtttagggaccggtgatagattttactcataacaacaacagcagcagctctatgtagggaaataaaaaagggagacaagagttctcctaactaaatagccacggtttgattcctctgaaggcttcaattcctttttacttcacattctctataatgtatacatgaaaatataattgcaaaattaaatggtttctaaggtgaaatgggatggaaaaaggcaccaatttagccagtttcgcaagatggcttggtctctttctttgctgttacatttatatggttttgtttagcaaatgg

SEQ ID NO: 59990 - DNA, 4249 bp, Oryza sativa
  unsure (1)..(4249): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaacttgcaagccctcgagtagcatgcatatgcacgagcatgtactttcggttttatggtagaccagctgcatgctggtccacttccagttcccatgcatgcattgcgcgtacggtctctagatgttttttttaaaaaaaaaacctaagccaacattgcttgttttatattaagagagggagaaactgtataaacaagagacaatgacccagtttataagagaaatcaggccagaaaaccatacagctacacggttaattatggagaaccggctgaaacccaacagacagaagaaagcatgggacctaactacacaactaacaacaacagtggagcccaaatgcaggacatcgttgccatgctaagcacaaaaggggcacaacagctccgacatcacagaagaggtgttatcgttaccgagctagccgcccaagcgacccagcagcgccgacttcaccaccgcagcgacactgaagccacgaaagccgccaaagcgaaagcagctccgacatccacaatggacatcagccaagccaccaaagagccacttccttcacatagccagcaccaactctttgaaagagactacaacacgtcatcgttgccaagcgtcgcagcaccccaacagcgagcagctccaactttatccgcataagcaaccgaagagtgtgtcgcccaccacagaacgaagtggacccaagaggcttaggcctcgccgaacaccaaggaaagaaagcttttgaaccgaagagactatcaatatcatcgatgtaaaggaacttctccgaagcgacgcccccaaggagaacacgacgtgtaacgccaccgccgctcgtccggagaacacgacgtgtaacgccaccgccgctcgtccgaagctggagcaaggtttacacccggagatttgtggggcaaatgggagagcgtcatgacaacgccttcaagaagggaaacggtgccaacggcgtcgtcgtcatcgaaccggccaaaggcacggcaaggctttagccagcgtctgcacattacccacaagcaccctcacatcgacggccacacgatagtccacgacgtctcacaagcagtcaaccctcgaggcaacctaccgtcacccacactcatctgctgcaccgaccagaaccggccaaggcggccaagggaccggtcatcgaaactcggctagccaccgtcgccacaaatgcccacagcctcactgcatcgccgccaagacgccggtgggagttggaggctgccaccgcgccgacaaagggcctcccgcaaccgcctcctgtcgcagcaccagacccccgcctccgccacgccaccgaactggcctccatgccgccggccgcatctccacgggccgcgccggcctcgcctccacgctcctccacgcgccaccatcaccggagccacgcctcctctgctcccgctgccgcctgcatccccgtcgcctgccgccgccactgcatccccgccgccaccccgcctcctctcccgcacctggctccagatccggcgatggccgacgcggatccggtgatgcccgaggtcgcagactccgccgccgccgccttcaccaccgcggcccacaccctgccaccagtcttcgcctccgcctgccgccgccaaccccgtgcccctgcgccgcgtgtcaccaccacgtccacctgctgccgtcgcctgcacgccctgcacgcctccggcctcgacgacggcgccactccgaccggcctccaccctcagatccgcccacgccggatctagggtggccgccgccacgagccccgccgctgccatcctagcaagctgctggctttgctggccgtttgctcaggcggcggcgaggtagaggagaggggggaagaacggcggtggcggtggcttgggtcgccgcccgagtcgcctgagcggaggcgactcgggcgtccgcgtcctcaagttcttgtttcttctgattttcacggtctctagatgtgttcgtgtaaaatatatccatctgttttttttcactacagaaaacacaaatattccaccaagcttgagctttctcttatacatacgaagtagtaataaacagtgcatcagttctcaattctcatgaatcctagctagacagtgacatgcacaaaagcacgactttcacatctccaaaaagtgggcaatggtaacgcattgtagacttgatcaggtccgggtcgattgctttggaaccatttacagcagggagcacgtactcgcgcgttcgcaaaattggagcgcgacacgcgccagcctttcattcagcacggctcgtcccaccccccccccccccccctgtcccgctgcacgtacggccgcggctgcacgacctgacccggcccgcgcgccgtgcagtggcgcggcgcagctagcgtccgctcgctcgctgccatgcaccctccgtcctcgcgcgtgctcacatgcgcgtttccgcgtttgcgctcgatcgctgcaggcgcatgcactcggtcgatcgatgcagctgtaaacccgcgctgcgcgcgcgcgcgcgcgcccccacacacgactacacgagacgagcactgaacacaagcgccggtccgtcctcgtcgtgtgcgattgatcgctctcgctcgtacgtacagcgaaccaaccaaagcacatatagctgcaagcatctgaccccatctctttctcttcactgtcttacattaagctcggctggggacgaaatgacagtgcgtttgccttgcctttacttggctcatgtgttcctgcagcatgcatgctgaattattactgggtactactactactatctagttactgtgcgggcgttatcatggcgtatgtgggggcatcgtccaggagggaatctggccatcgatctctcttcacctgcctgcctgcctgcgtctctctgatcctaccaaccaatcgagtgtacgtttgatccctcattgcatgcacacatctgcgttggcttggacgcacgatacgcacgcaatttgtcaactgttgaactggcggtgagcgagtgatgcgtgcgtcagccccgtgcctgattaggcacgtaccctgcgtctcgtctcgtctcgtctctgcgttcgatcggcacaggcccgtggattgatatatatctgctgcagtcaaccgatacacccggtgggagcacatgcagagccgcaggccatagggaaaaggcgcagggttttctattggtgctttgatctgtgccgtcggttggttacaacatcagacgacactgcaaggagataccataattgattacaacagcctatccctgattcactgcgagtgtgtgacgatggagcaaaacaaattgaaggagcaccatgcatttaccatcgcctctgcctcagctaagctgtggatcaagctgtccccctgtttgcaacgcaagtgcacagcactggtagtacttttgtactagcagtgccactagtaaatacacagtctaagactctaattagaggttagcagcggcttagtacgtgctaacacggaagcaaacaagcaagcatgcagcctaagtagataggctttcaaatttaaaacaaggcccggcctggcagagcacgctagctgacggcttaaaaaacagtcgaatcgcgacggctacctacaacgcggcttgctttcagcttagtttacgcttaccgagacgagcatttgacttttggcggccattaaaaggttgggcagccgcctcataaaacgggggcgagcatctgcaaggacacagccatgcatgcacgcatcatttttacacggacaatcaaattaatgaccatatactcccgttaattccaacctgtttaacaagtttttactgcatggcactgcacgtgtttaatttggacagacagagataaggacgtgttgagcggtaataatctaaatccacagaatctcgtaggaattttatttagaccgaaccggggtaaatccatagttttatttggaccgaaccggggtacgtactaacgtacgtaaaaaacatgtttgtttcactcaaagaaaacgacatgtgatcgatcgacaggataagcacgtacgtctt

SEQ ID NO: 59991 - DNA, 19993 bp, Oryza sativa
catgtgaccctctccctggctccatgttagtgttagtggctcatcactggatgcccctgaggaacgtgcatgcttgcttgcctgtgctatagctcaatgcataggagtatgctagattggtagtaccaccgtggttatggcctgcatgtagtactgccctaatgatggccactagcatcggatcactcgctcgctgcatgagcaaagtactccttgtttggagctcccccgtttttagtatacctcacctacaccccggaaatgcgatgcctaggctgtactggcgctacaactgaagttgtggatccgccggccacatctcacagtgaaagattgttacttctgcggttcatctcataatttaatagtactacttcagtctaaaatataagtgattttattcatgtgatggatgtagggtgtgtttagttcacgctaaaattggaagtttgattgaaattgaaacgatgtgatggaaaagttggaagtttatgtgtctaggaaagttttgatgtaatggaaaagttggaagtttgaagaaaaagttggaaactaaaccaggccttagttcacgcaaaaattagaagtttgattgaaatcgtaacgatgtgacggaaaagttggaagtttgtgtgtatgaaaattttgatgtgatagaaaaattgaaagttataaaaaaagttgggaactaaaccagaccgtactcagaacaaaatttagtgactctttctattcgcaatttacacatgatattttttatattataagtggctgagcccggatcgaatttcaaagtgcccgcgagcatatctaagtacattacatatttgttacgtaaaaattcagttttcaatcccttcaacaacattaaaattttcaatggccccgacattgattatacaactgataaaaaaaaacatgcaacttcttcatacaaaagcacctatggcatacaatattagaggtgactaattaacttatcttcttgtgcagttttgcacggagctataatttgaatattgaatcagatattatatataactgttatgagtaagttcataagaactgcagataatttgatcaatctatcataaaactataaaactacatatatgtttgagaatgtatataacaaaatacatatttagcatcattttaccctttttcaaaaaaactatagattttgattgtactagaaaattataagtttaatattaattttatcataaacctacaacttttgtaacctcaacagtgctatggataaaaactttaaaacatgtagttctttgataatttcatcacaagttctgtagttttgtgatatgatgatttaaatatgtagttttacataaattttacaccgaacctatgaattcgtgatatacgctcttaaatctgtagttttgtgatactttgacgaaagtatttatagttttagaaatttactcaacttttatccctatagaattgtgttatatatgtaatatatttgaaagtgcaacttgatttgatatacagtacttatctttccctttttttctatgtaaaattatacttcgtatacaaataaataaatatatacctatctatctatctatatatattgtcaatatagatctaaaaggagctaccatattcgttctagagacatacaaaatttcacattaattaaatatttgtgccgttagatcatgatgggttcagatgatgtgtagattgtttcgtacgtaaatcataagttgtacacaaaatacttgtatatatatataaaaaaatcataattgcatatctaatcgaactctactttcaaaactattgtatacaaactaaaaatatgaatattagggaatgacataatatcaaataattaaaaagagtagggctttgaacccaagtcgactagcccaccatcttttgaagctagccggaagatccctgagtgtttttcattgtatacaaaccacactgtatatatgaaaacaaaagctaacaattgtatatgatatccaattatgtttttttttcaaaatacattataaaaaatatacttgtatttattaaaatagaagctaagagttgtatatcaaattcaattttacttttatatagctttgcaaaaaatttgcataaaaaatcactagatgtcataatatggaccatcacgatataagggggtgttcagaaggttacggctgcacaacccaacgtttatatgatgcttgcgacaccgttggcgttgggctacaccccaaccgcagctcaagctaccgaatagctcaagttggcctaagtgtgcatcttctttctttttctaattcgattaatatggtaattttcagatcttcatgataaacatgttccgccccaggaataagctaaacgtcatatttgcaaacgataaataattgtgaataaaacttttatttacgtgttcttagtgacctaaaagcaaaggttgaaaaataaacttcgatgaaaaacctcaaaatcagcttcaaatttaatgttgaaaatttaaattttggttgataagcataaacataagcgaaaagatgggaccaattgtattcaaacctcgctcgatagtgcataatattggagcaaatgaggacacacctgaatcataacaggttaattaactaaatcgaaaatgagcacagtcacaactttataattatgctttttaattaagagttaaatcccatttatttattcattttaaatttataaattattgaattgggggaaaaagttgactccaaagccgagtacctaattatgatctttttaaaatccactcttaacgcttttttcggtaactttcttttttaaaagtactaattatattgatttttgaaattgttgatgagattaaattatttttgttcttagtacctaattataaaatttgcatatatgcaaggccaatagagaaagcatttgatattccacattcattccgttggattcgtaattagaacagatcacgcctaaaaatacatgtacatcttccttgtttgcttcatactaagatttcggttgttcaagctttcggtcgattgaacaaacagatattgtccgctctctttacacactcgcaccctcttgccaccctgaaccaaccggtggacaccgatctgaaaaagtccaaacctggtggacctcataattagctggttactcccagtgtcacacatgcaaaatggatagaccatagggatataaaaaaaattacaagaaatgggacgagcaaaattacacttatttaactaacacacacagcagcagcacagagaagagaaaaaaactcggaaaatccaaaaggatcacaggactaatgggagcaccatcagtgttggcatttgcacatgccaccaccccctttatattccccaacctcccaactcccctcctcccccattccttccatccatctcaccacccctctcctcctctgcacagcaaccaggtgtatgctccatgaggaggagggaatcttgagaggtcacagatatcctgatcctgctgttttttggtggtctctgtgctgtaagttgggtttgtggcaagaattctttgctgcgcgaggcaatggcgtccacctcgggctcggcggcggcggtggaggagagggggcttagtgagcggaagaggaagcgtggcgcgacgggggagtcggaggggtccgaggcgcagccttccaagtggcggacgcggcgggcgcacgagatctactcgtcgaagctcctcgacgccatccgcctcgtgcgttccgggtcgccctcctcctcggcggcggccccgccgcgcagccgggccgtgcgcgaggcggccgaccgcgcgctcgccgtctcggcgcgcgggcggacgcgctggagccgcgccatcctcgcgtcccaccgccgccgcatccaggccgcgcgccgcgcgcgcctccgcgaggccatctccccgccgtcgcgccacccatcctcgtcgtccggtaaagggccgaaggccccagctctggcgaggaaggcgaaggtgctcgggcggctggtgcccggctgccgcaagctcccattcccggctctcctcgccgaggcctccgactacatcgccgcgctggagatgcaggtgcgcgccatgaccgcgctcgccgaggtcctttccaccgtctccggctcaggctcagcctcctcctccggcggctcctcttcgccggcgtgacccccaagcctcaagattcgtgcattcgttgtaaatttgttttttctttctttcattttttccttgggattagttagcctcgagctgtctgctctctagtttgtcctcttcttttccatgagctgggtgagcggttatggcggtggtggtgatggcattgcggtgattaacccgcgctgtaatgcagtaggccacatttgttttgttctcttctttctcctcaggattcttttgtaggatgcctcgtttgttcttcttccatctctgataaatgcaccatgaatggttcacatcacttctctaccactgtgttttctctcgtgcgcccagtgcgtggggatgaatgtctttcctcctcctgtcgacgaaaggcctaattaaccatcttgttactgtatctaatactgtcttcagtgtggttcaagttatatgccatcatctcctaatcatacttactgctctcgtgaaggacagaggcatggtcgcatggagaaaggacgataaagcaatgaattctctgctacatctcggtaaaagggaacggagtatcccaaatgtggatcccaagcctgtagtagtctctctcaaactacaattaacggtactaaattagtggagtatactactactgctaactttacgaaatgccaacgcaaggaagtaggcctctcgtgtttgcagtttgcttcatctcgagctgaggcaggagtaacatggaacgggaaatgtggcgatggattcagtggcacgtggccgatctgatctgaacggcgcgccgggttaaaaacccgcgggccccacggtgcagccacgaaccgtgggtccggctccggccagccggacgcggccgtccttcgcacgcggtaaattttttttttttaaaaaaaacatccctcgtctctcatctgcacggtgcggatgagggcacggccgtgccttttctttttcttcaccgtcgttgtaatttatcatcggggcagcgtgggtaggggaaagtacggcgctgcccccgcgctacgcgacactggccgggagcagcgctggtgctccgtcgcgcgagcgcggcaggcgtgcgggcgggcgaggccaccggtggtggttcggtcggtcggacgccataggctaatgcctagctgtctcataatgaagggcagggcccacctgtaagccagggctcctcctccgggccgacggggggaggcgtccacgtggtccgtacggggttgggcagggggatggatggacggtggtgatgtggcgggcatgattggctggctggccccgtcgccatccgcattcaggtgtggggggttgtgtgtgcggtgtgccgctgcaatgctaggctgtgccgtgcctgcccgggctacgtgacaaaccgtatgtatgtatgtactgatggtgtacagtggtagtatgcgcgatttgtattttgtatcatgggcgcgcgcccctgtgcgcctctctgtccttctcgtctcctgtatgaagcgacccggcgatctgcgagatgctccggtccctgccgtgtcgtgccatccgtttacctgtttcctgacctgaatcatatcctgacctctacgttgggtaccgcctatcgctgcaaattgttactactatacctgcatgcggcgtcatccaaccaccgagcagttttcagcccgacagtgagggtagtgctatattgaacttggcaatttctccttttttaatttttttttgctttgcccactgttttgtttagctgattaactgagatatacccttccatcacaaaatgcatgtcgtcttttaaatagggttttggataaaacctttttgagtaaacgtccaattgtacctaaacctaacctcgatatctctatctcaaaaaggaaaatgagctcaagatcaactcgtactttatctaaaaaactgaacttacccaacgacagaagctaggagctcctaattaggggctgatcctgagtcagggcagccgtgattctcacataatctgcaacggccaggggcagcggtaaccggggcccctggattgttttcttccgagtgacggttgggcccccgacgcatgagtccacgacgcaacgtgccatgtgggatgcccataaaaaacgtggggtcccgtccagttctacgttcccgcccttttttcgtcgggtcggagtggcgatgtgtggcatggcatgggtgtggacgtgtggtggcgtggcatcgcgccgcttttactttcgtccgctttctccgtcgctgcaggtggggtcgccatccccctattagctgtttctctctgtgtttttcttttttctcttcctaaacggaacaggaaacggaaaccgtgaagcagcccagcacgtgggtgtataattttttgccgggcccaccgatgggccagctataaaacgtccggtgctctggcagcttttgcgagtgacgtggccgcctcacctgatctcctctcgttggcgtcactgggatcgggcgccgagatctcctctcctgatctctgggcgctgaaacgaacgggcagatcaggcgcgcggccgtactggaatctcaccggctcgtcgccggtgacctggagcaggttgttcagggcgtggtggtattaattggggtggaattatggtcttcgcctaatcccttcctctgttgtcgtctcgggctttgtccagaccagattcagccacgcaatctgtgttcggatttatatgtctctcgcattcatcaaatgcggttgcaggtgctcgcccataagaccataataagtactatacgtacgtacgtacagtcgagacggtccatacctcagtcgcaaagccagatgcgtcggccatgcgtatgtaagctgtcggtcatatagttttggtatgtgtatgcatgtacgtgccctgtgccccacccgtgtccgtccgccgatctctgagacgtagttaatttctgttgcgcgtcgcgtgcatccttgatgattcctaattaactgagctgttgcgaagccacggcgcgtgttgctttcgcacgcacgttggatgttggcgacccgccgcaagggggccggccggggcaggcaggcacgcgcatgaaagcgggtacaggcgcaatcattggtgttcgccggcgagagcgaccacacatggacacggccgggcgtacgtcgcgcaggtcgatcggttttactacatcctccagctctcttccttgcgctaccttcttcatgccccgtgaattcgcgacagagcgaggcccggggaaacgacgtgacgcgtacggatcgtagccggtaatcattgtgcccgcgtgcgatcggcgacggcatctgtactcgccgggttggctagcctaacgacacaacgtactagtagtactaagcttcgacgtcgaattaaggccggtgctgtgcggtatagctgtttctttttcggtcgtcgatgctgtagagagctcgtctagtttgagagcgaagggacatggaactccgactgtgattgtgggtccgatccgagagacgagggcaaacagatgccaagtgcgtcaagttgtggtggcgccaacttgccgaaaaagagctccagtggcagtgaggagtgacgacgagccatgtgggatggctgctacggttgggtcggttacaaaggcggatcgattaatttggctggtcctacgtaaccgtgtatgggccggagcggaggggcgcatgccgccacttcgcgtagggtatggccgggtatgaatattcatggccgagcagttaaaatttcctctttgcgattattgtctaccaggaataaaggggagaaagaaaaagacaaacgtcgttgttgccgtgttagattctgtcaatcagtatgtgcttgggttaatttaccaatcgctattcttagtggaacctttttgtgttttctctggctcagttggtctggttttgttttgtcggcacatgaagacatgcaaatgttttgaagcaattctcctacgtactgttggaattagatggtcgcaaggtcgcttctcccaatagctagctataacacgttgcatgccgggctaccatagttagtttgtaatacaaacaagaaagatttttgcacgttcttccgaatattgcgtttctttatggactaacgataagaaagaaaaaaaaagaaaaaaatgcaatgtgaaaaaaaatcaatatattggtaaataaaaatagtcattgatcagcataagggaaaatggatcctctaagtctgtgttcgctaatggggttgggaacccatcttctccgcacggaaaacagattagtctattagcgcgtgattaattaagtattagatttttttaaaaaaaatagattaatttgagttttttaagtaattttcgtatagaatttttttttttaaaaaacgtatcgtttatcagtttgaaaagtgcgtgcgtgaaaaagagggagagtggttgggaacccaggacaaagaatacaaccttagctagctagagtaaccgtagcagagctctgttactggttacttagttgtggattgcgttagccgttggatagatctccaactgaccataccaagcatggtttatatattttctcgcaatgacatgatgtaaagccgtagaggtatgtgtttctctcgtcctccctctacctttccgtctctaattagttgcttgcatcactagatctgccagttcccaatccacacagcaccaatacatttgtattttactgcaacaattgttgtttctaaatacgcaaacgacacaataatgatgagcaagaagaggaacaaatattcatcaatcatgacagtaggcaggctgcatgctattgatggagaagtcacgcgcttttcgcaattaggcgactgctcaatccgatgatcatatattagacattttccattacgacaaatgccagaaaaaactagaatagcattctcacgtagtccaccaagccggtaggtatatatgaatgttaattagtagctgccatttagctaggtacttaaataaaataattattgtgcattaaaattgagatgagctaacgcatcatgcactaatagaaaaacgatttttccaaacattacgatttatttttccaagcgaccataaaatcaatgttcataaaaatacctaaagataccataaacctagtcccacttgtgaaaatcgattttcacaggcgaggtcttaatatgtctgcctgtgaaaaggtcatacctcataaaaatcatcacctagctacctagcctaattttcaccaagtcctctcccctcccatcgctcatcccatctccctcacctcaccctccacccctctcagcaggctgtgtggccctcctagatccgaccggaggaggggagggcggtggtgtggagcgatactcccctcctctccctccttccccactcctagatctgcctggaggaggtggagtgacggccactgcatgcaacagcggaggcaacacgcatggagggaacaatggtggcggtgctctactcccctctctccctcctcgctcatggatccgataggaagaggccaggggagcgaccaccgcaagcggtggagggggcggtgtggaaggagatatggtggccaccacatgcagtgtggcggagacgggagcgtcagtggaagcactcccctcccctagttccctccctccctctcatatccggtcggcggcactcctctcccctccccgacctctcagattcggttggagggggagggcggcggcggcggcgtagagggagcgacggtggcggcgctcccatcccctagcttcctcccaccctcccagatccggcttccctcccttccctctcccacctagatccagcggagggcgtgggccacagcaggcgacgatggcgggtaggggtggtggcgggggtttttttcatagagtatattttcgcaggcgggtggttgtaccgcctgcaaaaatgaagaggcgcctacaaaaatcgtgcattttcacaggcctttatgtgcaggcggggtggatggccgtctggaaaaatctattttgcatgtttacaaaatatatgtttttttaatagtgatggttagtcttcttttaaattacttgtcattctagtgttatataggagacggctatacgagaacccgtctcaaggagatgataccgagaaggtatcatatcctgattcctatcggtatcatttctggtaggtactggccctcatcggtaccgaccgatacccgttacttaccaactgatacctcgtcggtactggccaatatctgccatataccaaccgataccttgtcaggtaccaacttaaacctcattggtatcacacatgtacttgccgatacaaatcctgtacctatctggtatcaaatctaagcggagaggggagagaggaagggatggagatggttaccggcacaacggtggtagtgtttcccatcctcccttgacgtgatggtggcggtgttttccatccttcttcggccactcctcaagacctagacctcctcatccctctcctctgtgtgtggccatggtgacccggtgaagcagccgttgcagccgcttcactcctgtgcaatggttaaaacaaaattttgatagctctatcaatccctttaccatttccccttcctttctcttttcatttttccttcctccttccaatcttctttctgttcaagttcttctagaccaagagatacccgactcctcccttctttgcaccatgtggctaggaggcgagttgcccccatctctcggcggctccgtcatcaccgccattaactcgacctagccttgcatgcacccgttccgacccccatatgcgaagaagcgacgccgcactaaagcactgaatggccaacgccacgccacaacctttccgcaaaatccatatgcctctgtgctacaatagccccagcaaaatccagccgcatctgcattttttttattgctgtagtcgcgtgagggagggagaggatcccgtgccaatctcttggaacgggataccgactaaatgcattttcgattatatatcctggtatgtatatcctaagtaaattgatactgttttatattataagattcagatttttgatttatcatgatttatccttagtattaatacttccatgacatatatatactcacatgttgataaactttacgaactttttataaattaatattaaagatagaaatgttttattttacgacaaaactagaataaaacaagtgatttgaaatggagggagtacaaataatttttcacaaacgcaagttcaaataaagaattttgtgtcacaaaatttgactgtttgggtgctaattaagttgattgcatgaatgttccaacagggaatttttttttttgcggggatccaacagggaaattaaatattcttactagtttcttactgaacttttgtatgtgaccatcacacatccaaatgtctcgatccatatatataaagttacgcaagatttttgtgctggtaccgcgtccaataattgggtgtgtcacatcgatcatttttttcgtcataccgtaaatgtggttgggagctaaaatatatggcagccagaaaggcacgatcggattgaaaaggccaaattgggtggaaagaatgtctttaacacatgcgcagggggcacgcaattgaaaaatgcacgagcaagcgattggaggggctccggccacgacggctccaagagaaagggagggctgctgtataacctgaccctgaaagcatgcgtgtacatgtggctgcctgtaccgacaagactcgcaaaatggggcagagtcgccatgcaaccttgccggcgcatgcagggtttggactgaccggccggccggctggccacgagcgcgatcatcacgatcatatattcatattcaggggtcaaagccacttctggcagatgctgagagttactagcatatgcatttcagcgtatgcatgtgctcttttgatcaggagtaagtattttttttaaaaaaatcttcttgcgggggacacgaacagcccacaagaaatgcgtcaccgtccaatggatatgctgatatgcatgcactggccggctgcacgccgcggtggttccgagatcactcgagaaatgacagccatcactccatcaaacgtgtgtcatgcatgcatgcacgcacattcaacacactcacatcctcaccagtcatgcatgattgagaaataattggagtgcataactctgactcgtacgtacacgtagagacgagagagtatgaagagtacttcagtaagccgcacactgtcacgtcgacgcgtcgacgccttcatttatacggcaggctggcctgagcctgacgagaggagagagggagtagaccggagttgcacatggggatggggggacacgacacgatgcccgggacacacacatacggagtacacggctcgtcgagcgcggcaatgcacgcacacctgtacactaccacaccaccccggcgcaccaaaatggcaaagcgaattgggtcgcaaaagccgcgagctactactagctagcttagcagggaagaagccgggatgatgtactttacgtggtgtgacatggagtcccctcgatcgatcgcaagctttctcggttcgttttacatcgctcacatgcacgctgagccatccagcccggccgggggcgggccgacctgcaaagtggcctgactgccgaccggacggccgggccgtacgtacgatacaccacgcactactagtttatctgtgcacttacgagttttatctcagcatgtcccgcatgcgacgcgtacgggagctagggccgcagctgctttgctttgcctcgtggtggtcgtggaccgtggtggtatgatcgatcgcgtcgcggcgcggagcttagagctaaggctgtatttagttctaaccaaagtttagaatttgattgaaattggagacgatgtgactaaaaagttgtgtgtatgaaagatttgatgtgatggaaagttagaagtttgaaaaaaaactttagaactaaacacaccctaagataagctctgtctctgctgtgtggcagcgcgcatgcatgtggcctgtccggccagccgttacggtagcttagctaaagaccagagagggccaaccaatgcgacacaaacaacgcggtggagcgagcgagagagcgagcgcgcgcgcgatcgatcggcttcgctaccgctggctctggctgttgagcggagccacagcaagtagcgtggaccaccaataataagcgcgcgcgtcgctggtactgctgctgcctgcgtgccatgagtcgatcggttgcgcgcgcgcagggggggactttgcacggcgtcggcacatgcgcgtgctcgctctccggcacggcagggccctacgatccagccggacaccgggagcagcttgcagctttgttggagcaagcaagccagcaagccagccagccagcccccgcctctggcccccagagcgtacggatgcagcctgctgcagcgctcgtggattcccccgtgcggaagggacatatctccaaacgcaatgccgcatttttttcactttgccctcgtgcatgtcacatgcacatggcaggtctcgcggggcgggcttgcaattgacttgtatgcttttgatagttttagctttcaccgttctaatatctgtctctgatttattgaaagagataaaagtaatgataacaaaccgtgctctctgtgctctcagcgctctcagccgctgatttgagcagggaaaaagatcgtcgaatcatattcgagtgtacatttggagcaactgtcacgggacagcggggaatgtggttactgttagagttttgggcctaagcccaaatagaaattgtgaacggcataacatgagctaaacactccaggtaagacgttatccacggacagtacagtaaaatcgaaacggaaagattgttttcacgatccaagttcatgtgcaacatgctgaaccattgaatgcttttgttaagattcgtcctgtactgaaaagaaaagaaagtacaataatgtgatttatgacatatatacatgaatctcaaaaatctcaaagtaagcgacaaatgttcaacttagaatgacaacatgacatcaacaagggaacacactgatcacacaccctcgtcaagtcgatccgtcgaccgatgaccgttgatcgataaaacgtactactacgatggatggatggttaggagccacggagaataatactcccccgttccataacatagtaacctagctgtcccattcaatattaggttgctatattaagagatggagggagtaatttcctcgatcaccagacatctggccaacccgcggctaatcgcaatcgcaaaataaagaaacaagaagagattatcgccccgacaacgggagaagatttgggagttggtgattccacgtatatatacacgagagaactggccggagagcaatagttgaagtcactcatccatgcattgcgcttgcgcatacgcgacaccgatcgccggtggattgacggcttccgctgtagtcgacgcgattgatagatagctcggcagtgggcagataaagcggccacacgtacactaacgtaggtgcgcttgaatgggcaaaacacgcacactgcagtgcagtactctctcccttacattaaaaaatcaatctagctttaaacatgatatatctgagtaatataattttagacagagatatatttaaatttataatagtattaagttatgtcatatttaatactattgttttttttacgaaagagattgcactaggaatacgagtagtagtactagtttggttgacagggcacccgatggatggagacatacacgcatgcgcctgcctggatcctgtcgacgcagtcgctcgcacatgcagaggaggatttcccggagggaagaaacgacagcatagctagagagcattactagatgattttgattgaaaatacaggaaacatgcacgagaaaaggtgaaaaggccggccggctcagctcaagctgcgcgctgggcttctacagatatgtgtgcatttctctggcccagttttgttttgcatgttctcggcacgaatttctgccggatgaaacttattactatgtagtacttctattatcctataatataaaacacaaccacttttttctcatgttttataatatataagacgtgtatgcatacatacttaactaacagctctgatcttgtaaaattaatttgttttaaatcctataccatcaaaaccctcaatcacattgttcgcattattgaggtgatccaaccgagaaagtgattaaattatttcatgttctttgtattaggagtgttactgcgagtaagataggcctgatgtaggtggaggtacaagttgtcacatcatatttttacttatgtgaaggagagagaaaaagtgggctacaaattttagccaattgcagcacaagctccaataaactatgggtgtgtttggataataggaaatagggagtgggattgggattggaaaatgaatgaagggttagaattaaatggaagagggagaatgaatggttatgatttaagtatgtcttttggttggtgggaaattatttccctatcctattagccaaacactgactatgtgagagagatagatggattagatattagtgatacaatatatatatctacaactaattagagcaaaatcaataatatagttaactactggcttcaaaaatctaaatatcatatatagccaacataatagtacactcatataatcgttagttggagatatatactgcatcattaatatatcattcacccatctctctcacatagtttattggaactcacgctgaagctggctataaatctatagtccgctttgtttctctctcatttccttacctatccacataaatacaaatgtgatgtggcaacttatacaatatgcttatggcatcttattgtacttgctcttattgtatgagtggactattagattatctataaataatatttcaatttttggagctagtagttaatcgttatattattaaactccttcaaggagtaacactactacaaaagccctcatagggaccgaccttatagatttatagataaataatgtaggttttaaataaaccgacacctatgagcattttcccacctccgcacgataaaaaaaagttaaaattggcacctttaaacattataggtgtcggttttattaaaaaaaccggcacctacactgtaggtgtcggttttttgtttagaaccgacacctataatataaatataggtgtcggttctatttaaaaaccggcacctatatttaaaaaaaccgagccggctcttcttgaccacccacagtgccagcctcatcttaatccatccatccacctctgacctccctccctctctctcgctcgctcgcccctcctctcccattgcgcagcgacggtgacagagtagtggcggcggccgacggagaagaatggcgcggcggtcctctctcggcctgggggccctcccccgttctctcctcctccagggtggctcgacagtggagaaggccgaccgacgcgggcgaagagacggtgcggtggtggagaaggttggccggcgtggcggctgacagctggaggaggctcacccctctcggctgcctctcctcgcggtggcgatagcgcgaaggctggcgcggcgaggtggcggcgacggcagtggtggtggagtaggcctggatctcgccagcatcctctctcccgggggacctcgcctcccttcccttcttctcctctagcatggcgtggggtggcggccgccgcggcgaggtggcggcctttctcccaggggacctccccccttgataacaatccggccccggcgaggtggcggcctctctcctaggggacctccccccttgataacaatccggccccggcaaggtggcggcctctctcccaggggacctccccccttgataacaatccgtcccaggtgaggttggccgaggcccaataacttaaggttgcccggaccccaacagttcataggcacacccactcggggaaaggcccaatctccagttcataggcacacccactcggggaaaggcccaatctccctaaaagactagtccggtaggggaagggtggctctcccttttaaggtggcttcctcctcccaagctaagcaaggtgggattattcagaggctcacacggtcgccgcccgaattttgcatctttgccagcgggtaatagtggaggatgtcctcatcatcctccagcgcgacgttgggtggcggcgcggaggcgggcatggctaggtggagactcacccctctcggcttcctctcctcgtggcggtgacgtcgtggaggccggcgcgaaggttggcacggcgtggaggccgggcgaggtggtggtggcggcggtggagaaggccggcagtgtaggtgccatcgtttttttaatttttttgatagtataggtgtcggttttataaccggcaccaataagattgagataaaggtgccgaccaataggttccggcttagaaaccggcacctatagccagttcccaaccggcacctataggggtttctgtactcgggagtactacttcttactattgatccactggacacggaagccctttttctcgccagatcctttgtaaatttcaggcggggtatagtgtaaacatggacaatttgaaaaaagaaactatacacatcgacgagttctttcgggctattattgtcagattttcccaagtcagggctttgtttcaggctatttgttagtagtatcattagtactggctaactagcttgtttgctggtgtcaagtataaagacctcgtttgttaaattaatatacggtaggagttcatattttctgcggttttgagatacgctgatacgggagtatatcaggaagggaccctgtacacatgaggctatgtatgcagcctttgaaattgggatcttagcttagacagatttgaactcatgactgatcttagagtgttactcaggccactgtaaccagtcggctatatgttctttcacagaacgttggattatgctgagatctattttgggtgagatatggatcgttccccaaactgaactaatcaggaagcacgtgaatttatatatggtggttaaccgcaacgaggctacttcagtaccttttgatatgcatgattacgaagaaatgctgctgggatatctcgctgactgattcgttgttttttcgaacacgcaagaaccttacatgttaatattacgagaaaattcttttgtacaactataatctactgtaacgggtatggaaggtttacacggggagaaaaggagatcaacagctagctaagctagatagaaccaaaccctgaacaagcaaaatcgcatggaaaagaaaagaaaaaactaaatgactatatatgccaagaagaactccagaaggactcagcttcgctttcacccagagcctcccctcctgcacgacgtgatcaataaccgtatccacttgggagaggaccccatcaaaaacgcgagcggtcctctctaaccagagattccaggtaatgagaaggatcaggaagccgaatcctcttctaaggtgatcaggcagctatcgacgagtgcactcccactagacttagagtgtgaactatcggcggggcaaggagaaggaagagagcaaataaatacaccttcaagaaggaggatgacgcctatgggtgtcacagcgtcattggcactagtaaaaaaacatgtgcggctttcagccagttccccctctttttcaactacactaaagccgccacaagtccataacggtgccgagacaaagcagaaaagggttatcattgctgattttgccacttccgacaagcagcttcgacttcgtcccaacacgccaccacacaacctcgccgtggaagccctctgcaaaacaccttttgtagtgtaaaaaggaatatatactttgtagttctaatcaatagatatatacctcctagtagtaatggtatgcacctctcaaagactaacgaaaaactcaagagcggatacaaaggtgaatttccaattctatttctacttctggctacatcctttcttaaaggaatcccttaagtaggttatataccgttcgaagcataacaaaaaaaaaacctttttaatgcctcatcaatcatatgctctctatagaaacacgtgtggctcagcctcggactttttttaagactcataaacatcttattaataaaagaatccttattaaaaggggttaattggatcatgccattgcaaaattactatattataaaaatgctattactattcgtgatatctcctacgtgccattggaattttgtgaaatagaaccataccatcgtcgtcacgtttttcgtcatcgttgttagatctgcatcctctcctgtagcccgcgctgcatcaacctccctggcttctctgactccgatgccgacgttgaaagtgcatctaaccccctagtgggttttggtgattaatgactaaatggttaaatgaactaatgcattttattgagcttaagtacaagagattagtcccaggttgcttacgaggtggctaggacgcttggagaccccccccaccagttcttcagattcaatgtggtgagaagaaccggagccggtttaggctagttttatttttcgcttcgagtttaggaaaaaaactgtactattaagaggggtttcaa

SEQ ID NO: 59992 - DNA, 11228 bp, Oryza sativa
ttctttatcattggatatgctcacgccgcccatcacctctactggcgacctcctgacagtaaggatgagtagctcatgcatctcctcctgagtgagaaaagagaggggagattagcgtcaattgcgtgtcgctcgtccggctacttccatgtgcaacaccatcgacatctcaaagttcctacttgccctcggggagctcgcacgacggctccatccatagagcaaatttcgacgacctctacttccctcgccaacaaggtcaccattgcctcgctctctagccacccgtgccacacacccatggcccacccaccgccacattctttgaccaccgagggataactggaaagagataagagggaagggtggaggaagaagataaaactgacatgtaggtcccacatacagaagcattttggtctatataatgacataaaatgtgacagcgatgatgcggttttaatttcaaaaaattccgtgacatgtaactaatcacaaatagtattaatatttttcttatatggtaattttgaatgacatggattcagttaaccctattaaagatagcttcctaccgcatccaatggcctcagcttcgtactctcgtgagctcagagtagtcgcatgaatagggaaaaaaaacgttacagaacttccgagattacgtactttagatttcgagagtggtttttaaactctcgagaaaatattttcttattgtttacatgttataaaaatataattatgaaaaaaataaaaataataataataagatgtattaacatgtgatatatcccttaacaaacgtacaacctaaaattcaactttacgagctgtagaaaacaaattaaattatagctagttgacatatatttaaatgtttgtggagtgacataccacatattaatctatctatcttattttttaaaattattttagaactatttaagtgacatataaataacgagatatcatcttctcgagagtttacaatagtttccctccagactttagagaagaaaagcaagatctgcaaaacagagtaaacagaaactagtacacaagttaggcttgtgctaagagtgtctctaattgatctcttcaataatatgatggagtgttcatgatggttaggccggcctaatgccccctgtctcctcgcttaaacggcttgcgctggaagaagatacgtgcgggtcactccagtgccgtttattacggttttgctgctattggatgcacgtgggatcatgatgcaaaggcggcacacctagcttgttctacagatgctgcctctttgagctcttatactaactaaactatattttcgttgcaacgagatgatcacccacccacatccttatcctagcaatgagaatctaggtattatataactctgcagctgtttgtttacgtagacattgtcaagttcgcacgcgtatgtacatgcaagggggcatcattggagcataatcataagctacttgatcactggtttcttgtagggaagcacaaagagccatctctcgtagtacaaggataatgtatactatagctagaaaaaaaatatgatacattgaacagaagcgtaatttgggaatacccgtataacgctgacccttagaaaacattcttatatggagtattatccagcaaagaatttgcaatatatctttcaatcggagatgttaattgtcagactttaatttgtttcgtccattggctttcttgcaaagccgatgtgctgtatgatgggagttcctttttggattttttttccgatgctactgaaaattgaaccatacttctctagtgatttaaagctccttaccaataatttcattgggcaaagcctttgtctacatatgcccgtttcgttgtcacacattattacatacaccatgagtatgtctctctaatacaagcttgacaaacaaaagcctagtactagctaacgcggtgaaacttataagcttatatgttaactagaggcatagagcacactagaagagaatgcgtggcgcaacaccacgctcagctgtgaactcaaattcggcttaagcaaaaatacccggtaaataccaattaaactgaatgttcttctgtattaggtacataactagaagttttgtaattcgagtgacatcaatgaataatttgttcctttgaagattggtatccgcaccgaacgacatccctcatcccgttgcctacctagcccatcgttggcatccatctcccatggctttggtatcgcgcgcctctcccactaccacgccaccatctctgattgacatccctctaattaaggccaacaatattctttcctctttcgcaatccctctcatcctaaccctaaccacaaactcaaactgatcagaccgtcgccatctcgtcggagacatcgtcatctcgttggagctggatcgaagaagaagggtaatataaatcataacatggattaaaatggtagaggatacgacataaatccaccttaatgtgttcttcatttaaggttaacagttatgtatatataatgttcatatgtcatttgacgactaagaaagccataaaggagacggcactatagggttggaatagctaaaccgacatttataatgttttttccacacgcacgcacactcgcaagggtgccaatggcaaaaatcgacaccttttttataaataggtgtcggtttttaaatggtaccggcacctatcttttctgtcaaagaaaggtgtcaatttctattaaaaaacgacacctttatacaaggtaaaagtgctggtttttaatacaacagatacctatctcccgtcctcctgtccttgtctcttcagtctcttcgctttcttcttattctcttttcttccttcttttcctttctcgtccagcccgtgctcctctccctttccttcctctttcccaagccaccacctccctcacctctcctcccttctcgtctcttctcctccctaaatcactagtcgtaattcaccatgccgcctcctcccttctgcctccagggccaacggagccgcaaggggaagcgtggtgccgacggggttgagccgacgtaggggcaccccacggcgatgttgtcctcattgggtgggggagtgggagagtgccggcgcccgtcaccgtcaaccacacctcctgcgccacggcgccgttgccatcctcgcccccctcgctgcacgctgacgctgcagcgccctcacaagggaaagcacaatgccgatgtggccgagccaacgcggtgccgtcgtccttgtcgtgtgagggagcaggaggagtgccggcgcccgtcaccgtcaaccatgcctcttgcgtcacggggccacagggccggcccttggggggagggggctcaggccgtgcggccgcccaaggcccccaaaatctagggggcccctatacacatatagtatatatactacgtattggataattctagtccatgggtcataggtctatattaagctagacaactgaatagtccaatacagaaaataaattttagtccatcgtcaggcctattttagcaaagccgaagcgatcttcatctgactccagtcgcttcgcctcgatctcttcatctgactccagtcgcttcgcctcgatcacatcacgccactcgccatgtcgccttgatcacatcacgccgctcgttgctcctgcgctctcggtgacttctcgacttctcggtgtctcacaaacggaaacagcaagtcggagaatcacggttcaccagtagccacgctcgtgtcgatcgttcgccggtcgtcttctcagctcggtactgctatttatttctttttttaaaatgttatatatagataattttatcacatcgaatgttgtgtgtttataagactatataaatatacatatattagttatgtttatatatatatatataggggcctctatataagtttttgtcctagggccccaaaaccccaggaccggccatacggggccgtcgccgtcctcgcctcgctcgtcgccactgctcctcaaggcgctcctgctaccccgtgacgttgccacggcggaccgctggggctcctccgccgcaaatttgttgattctttgatgtgaatatttgattttgttatcttcctccacaaacttgttgattctctgatgtgaatatttgattatgtgatctatgaaatgttgattcttttatgtgtcttgtattttttttgttagattttttgatttatttttttttttgctttgaagcatcggttcggctcgaattgagccgagctggcttttttttatttgcaaaccatataactcaaaggtatcggttcttaaaccagcacccacctttaagtcatcctcatcaatactacctccatggcgcctgttgggatatctgacatctatatatggaggtttctcaaccggcaccaaatgaagtagtgttttctttatcctcttgcattcggaatgcgaaatactaatgtctgccctgccgatgcttctggatggcctttggtcagttgagaatcagctaaaaatcagggcccaaattattatgatcaactcaacaaccggttgccttttccgaacataacatgatgacttcgaaacttcacttatattagcagtatgtttagagtttgccggaaggtgagcacagacgtcgtccaataatgcacagcaaagttaattggccagctaatataaaccacctccctttctctttctctcgttgcaacaagaagagacctagctagctcgctctaaaactgcactacatgatcagtacacgcagactgagctggaatgacggtgtcatgagggctacctgattaggagcccatcccaaggagcccatcccaagccttccttcctaacgtgctaaaatatactcgcgatcggtgcaaggaacagaaaggtgcagtaggcgggcgaataatccagggtgttcccagcgacgaacgggcgccacgtacggatcgctcgcttcgctagttaggcacaaaggcgagcgattgacgcaccatgcatgaatgaatgcctgcattcatatgcctgagttggtgtgtgttcggtttgttggcccggcgtggcgcgcatagcccgaatcatgtgggtgcatgtgcagagacctcccctctcgttgcaacgccgagcgaatgaattaaaactggtggctacctagctatacactacgctacaagcctagctacaccaagcggatgcatgcatatgcatgcagcatactgacatgcaagtgcaagccagccgtccgtcgtccgtccggccagctgagctgcttagtttctgcgaaggcgccgggcgcggccgacggatcgatcgatggagagatcgagtgtgtgcggcgcgaagcaatatactagtagtagaacgttgcttgcctagctaggatcactattagaatcggcgggtgtctggccaaccgcagcaacggcgccattagaataagccgcgctcgtatccttttgtaggtggttcgcggtgacggccacggacatgcgcatatggaggcgcaccggcaacgccatgattgatcatcatcatcatcgatcgatcgatcgatcagctaacgcctgcacgttctatcgtatcaatccgtgcatatatccaaacaaagattgcggctatatatgcgcgcactcattgctactgcgcaagagtgatgcggccggcctctcccgtcctcgctggctgctgcgctcctgcttcgttagctcgctgctgggcgagagagaagagaagaactgaagaagctgtgagcagagccgatcaggaggaggaggaggatcggaggatgaaagggcggcatagcggcaaggcggcggcggcggcggcacggtccatggccggtgggagcgagaggggcggcgtggtggaggaccctaggctggtgaagcaggttcgggagctgaggaggctggtgccctgccgccgcgagccgtgcgggctcggcgagctgttccaggacgcggcgagccacatcgaggacctgcaggtgcaggtgaagctcatgcggatgctgctcgagaagctctccgaggagtgatcgggcgtcgcggcgtcgcgcgcgcgcgcatgtgcatatgacattcatgctagctggtttacacgcaggacagagtatatgcgtgtggtgatcagttctgtccatgcatgggtcgatcaaccggccggtcggcaggaacacatcctgatcctatacatacatatatatatatatatatatatatatatatatatatatatccaattcatccgtataccagatttcctagtatgaaaaattgtgttatttatttattatttattattgttattgttgttgtttgattcatttattatgcatttttaaccatgtctgtgcgttttcattgtttccttctttttatatgtgtatctgcgattctgcatggcctcctggaaaactcaaatcgggatatcccctcgtgtcacttaaaaagtcataaaaagttttaaaaaaattagtacgatatatcaatatatgatatgtcacttcataaacatgaaaattcaaattcaacttatacaaatacaaaaaaataacaaatttgactatgaattgaacgcgtaattcacggtcaaatttgttatttttgtttcgaattgtataagtcgaattttaactcgcatgtttgcggcaagatatatcatatattgatctatcttaataattttttttatttttttgataacttttttaacgacatgtataaaacgagaagatgtcccttcaagggacaaaaattcacttccatggcctcccaatatattgcattcaagacgagcattccgagtaacttatcctgggccttatcctgatgagatcatcacacggtgagcagcccatgtgatttccctctcactggaacaagatcactttaactccctcaactgaccaccgaatctaaatcgtatccctcaaccgcaatatcagtaatcttgacccccgaacttgcaaaaccggtgcaatttgactcctttggtggttttggagggcggtttcgctgacatgactcacacgtggcagtgttgacctggtctttgttccacgtggcattgacgtggtgcttatgtggcattaaaataaaaaatatatatgcgggacccatttgtcattcacaccaaaaaaaaattgtggaacccactgacatgtgggtcccacatgccaccctctcttatcccttcttcctcctcccttctctatctctccctctttctcttcgtgcgtggggagtggcgtccggatcggcggcggcgacggtgggcgatggacggagcggcagccgacagtcttcgcgtcgcctctgccgcctccgctgctgcagtagcagggattcaggttcggcggtggcagcgctcagcaagggtgtggcggtgagggcacaacagcgacgagcgggatgattccagcgatgatggcgcggggcggccgcggcggggagggagcgagcagggagcggtggcacgaaggaatgtgcacggcggaggacaccgagtgcaccgaggatgaggaggaggaggaggagcgcgagaaccccgccgccctagtggccaccgagccccctgctcctgccgccaacttcctcagccttcgcgaggtcgccacgggcgcggccggcggcaagtccaagaggaagaagggggtggtctcgcgacggacgtggttggggagggggcccgtgtcggaggaggaggaggagctccagccgtcgctacgcatcatggtcaggtcgacgccggagcgctcgaggccagttcgccaccgcgcattggggggcgcgagtgttgacgaaaaaatcgaacacactagcctgggagatctgcttagctccagtgcaggtccaaaggttgttgagatgcgggcgtgccagtcagtttgatcctgcaactgacaagatatgcaaatagtagatcaaaacagccgatcagctgacaagccgatgccgataatagccgatgccgataccagctgatagcgatagggtttaagcaatcggctatacgtccaatgtagataatggtataaaggcaatcggctaccgataataaaatataacaataatatagtccagtataaaccaatcagcaaataatgatatgataaataaacatcgatccgaaggtcaaagcacacatcggctggaggtccgatgtcatgaaatccacaagactagattaaacagtgaagcctttgttgtcatcggctaaatccaacttatatgtatatgcaatccttatgagctgatgcaacgtctagataactcaccgactgaaaccccgatgaaacccttattggcaatcaagaagcaggctagagattatggttctaagcacgacttagtagatcaaacttaactgatgcagcactaagtataaaaagaaacataatatctagacaatcaagccgttgactgagttttcagggtggtagatgtctaagctaatctaatctagcaacgcgatttagccgataccggcagaaaccctaaaacgggaagcagccgatagagctaaattgatatgctaagactagattaacagagacatatgataaataggtaggcaaatatattatccaaagcagagtaatccaagaggtcgaatgtactgatgcagccttgaacgacaccaacgtagacgatacaattgcctggaccgacggaacattggacttatcccttcgccggagatcgaagacgatgcagccccacgtcgggtgccaagtcccactgggcgataaaataaagtagaaaaggtaaaaggtggcgatgcgccgaattgtattggtcatagagatagattacatagaccccgggtgtacatatttatacccatgggttgatacaagtccttgtcggacaagaaagaaactaaaaaggaaaagataaagtccttatcggacactaaacacactttcctaaagataaaaggaaactaacaaactattcctaattaatagataaactgacataccgcatcctctttaaactcggtcacttagggataagcttcctttagtagattgatttccttaaccgaatatagcaggaatccgactattggcgacttgataactcccatcggctgattccgagatgctgcagccgataatgattctaagccgatgacgtctttgccgattaccaaatttcactgttaacagcgagctatcgctctctttccaccgcggccaccgcccacctcgccgtcgacgctgcggccgccacccaactcactgcccacgacacagagctgggacgaggagcgttctcccatctcccccgacgcattccgtcgcacgtcgcctgaggtccaccgcccatttcagggaggagctgctcccacgctcgtcgcccgaggtccaccgcccaccgctgccaccactccggcacccgctcgccgccgtcgccgactcatgtcaaggggagagagagagagagataagggagagatgaggaagaagggtagtgagagagaagatgacatgtcggtcccacatgtctgtgggtcccacaattttatttttgtgtgaatgacaaatgggtcccgcatatatttttttattttaatgccatataagcgtcatgtcaatgccacgtggaacaaaaaccaggtcaacactaccacgtgtgcgccacggcagtgaaaccgccctaaactaccaggagagtcaaattgcaccggttttgcaagttcgggggtcaagatttctgatattgcagttgagggatacgatttagattcgatggtcagttaagggagtcaaagtgatcttattccccctctcactctcaccgtctcacggcgattcgggatgacaagctggctcacaggtgtgaagcctgtatgtttgggcccagagcacggttttactaacgggcaggtcgaatatccacggcctcagagtcacagttaaaacccatgaggtttttgttttttgttgaacaaaaacccatgaagttagcaagacatcgatgtgtagtagtggttggggtcttaggagaggagacactcaaacacgggaggtagacaatgtgcaagaaaaatcaaagaattataagagacctcgtcctctagaacttttttttacttaactctagaaccatttcaaatcgtggcaaagaggtcatataagatctcacccacaaattaattatatgtatattgctacgcgttacaacataatcctttacataactagttgtaaacttaattatcagtgcacaacgaccttggtgtacttcgtcatgtcagtggtggctcgcccgtcagtcttgagcggaaaatagaaggggtaaatctcgtagcgcacccaacaggtgctgtattcgatctgacatccctccgcggcgttgcagatgtcgccgaagtcggacactgccgtcgacaggcattgggcacatgccagcggtgctagatcccgcgtgcactgcgacagcccgtagatgttcacaaacgtcatgtatttttccttcacccttcccaatgcggcactccccgcggtcgccaccgcctggggtatttgtccatcgtcttcgccaccaccttttggaacgtcttagggttgtccatgttttcttctttcctaattcttacgctggcgtccaccctcgtgtccacctgtccaatgaagttggcgttcttgtaccgcatgaagcagtagtcatacctgaaattacatatgtatgtacgtcacacacaacacatgatataagttcgtcataaaaaaaacagtcgtgcataatcgtagtttttaaaagaaaatcttataggccttcttatatttaaactaggtgataccaagtgctttgctgcgaaacgcatagatgaatatatgttaaatattatataaataatgaatattgaaatattgtgaaaatgatgtgagaaagatgatttgacatatttacatgttaaacactacaatattatactctagaatagtacttgtcggtgacatggggctgggggtatcgtgactagaggcttggatagccgcggtcacccacgtggcctgaccccctcgggggggtcgggcccgaggatgacgtggccacccctccctctgtctccccgaggggtcggaccgctcccgtttcggccccgagggctggggcgcccccgtttcggccccgagggctggggcgccccgaccccctgcggttttggcgccacatgtgtgggt

SEQ ID NO: 59993 - DNA, 5461 bp, Oryza sativa
tattccttcacgcacagatccaccagaacacaggagtagggtgttacgcttctcagcggcccgaacctgtctacgtcgcccgtgtcttgtgcactttctctctcgctgacgttcctcagatcgagggcgaagaacctcacttagcgcccccggccgaaccggcaaaggggggcctgcgcggtctcccggtgagaagccccacgctccgtcagtactggttaataggcgatgctgtggaatacctctatattaagtgttagcttgtaatatttgctagtgggtaccaaatatatatatagaaggtatagattaaaagaagcaaaatttttagtgcaatttgatcaaaccaagtcactaaaaggaacatacatatagttttctcatcacgtaaatctcttatattttagtacggagggagtaaaagagcaaacttgaatcagtatatatatactccctccgtttcacagtgcaagactttctagcattgtccatatacatatagatgttaatgaatctaaacatatgcatatgtctagatttattaacatctaaataaatatagtcaatgctagaaagttttacatcgtgaaacggaggaagtaaattattcacgggacaaagatacagtaccatattaaagcctacggcaaaaggctgagttttaaacggtaacttggaacggctacttgtaaattaaataacatttttcagttagcaatcatgaatactcgattaagtatgtgctaatgtttttattttatttgacgtggaatcgaaaagcctacccaacagccaattgaacgtaaaatgtataaccaagaacgcagccaggcaccatttgtttttaatgaagatgaagatgacgggtatgttcactttgatgaaaaaaaaaaccttaccaaattttgataatgccaaaattttggtaacttgtcaaaattttggcaggattttttatatagttatcaaaatttggcagcaaactaggggccgttttggtttgatgccaaaaacataccctaccaatttattggcaaattgaatagtttgtgtgttagtttggattgagaccaaatatttgatagtgcccctaaaatatttggtcatagtctagaagtttcttcactatgctataagaatttggctttaaattgatagcaatccaaatgttagctaaataattggccctaccaatattttggtagtgccaaaatttgcctagactttggtactaccaatgaattggtagggtaaagaaccaaacaagccctaaatgtagccactttttgacaacattaccaaaatttgataaggttgaaaatgtcatcaaaatgaaccggcccaatgttagggcatgaaaaataacgaaaccaattgacacatggttaatttatttaatatttcaagcaactttttatatagaaaagattttcataaaatatatcattcaaccgtttaaaaaacatgttgatgaaaactgatgtaaaatttgtatcttaagtggaataaaatctgtcgaatattgacgcactggaccgtagctagcgtagctgcataccacatcctggagtccgatgcatagtggcagaaggagagggtgtaattggcggcttcgacgaggcatgccttgcagtcgctggcggagacgtcgccgcggcactgcgcgaggccgtagaagacgttgttgcccttgccggcggaggacgtggcaaagccaccgttggaggccgccttggcgacgaggtcggagacgacggagttgatgctgcgccgcctcgtcttgccgttaatttcagcatcgctcgtccccgactccgagcagtagccgccaatgggatccgtagccatgcccagtgggagcaatgccaaggagacaagtagtaataccaggcaatggcgcgttctcctgcttaacgccatagcgccaattacacagacaagttattagctagtacgagtagctgtacagatgttagatgcgtgttgtgtcttcggttcgctggttggagcttataaagatgagtggatggggaaggagagatgtgcttgcaggggaaacagctagccaaaacaggagcgtagtatcaaaatccttgttcttttatttctcgccgggccgtcgaaagtcgttcgccggccgcaaagaatctttgttcttgcttgcagaccttatttgactgttcaggtggttgcattcagagattgtgggcaaatccatatccactgcacgccgaatttgccacaagggatgcatgtccattcgccggcagcgtgggcacgattatctggcaggcttgcgaatatcgcgaacttgctagctgctgatgctgctggtggtggctggttgcttgctgcctagaattattgaccgtaaatctatatgttgacgcaaacagttgtgtagaaagagaaattccggatttgtttggtaacatgagggaagaaaattgatagtgatcacttatcttttttggataatcaccggataggagagattccccacttgaatttttttttgataagaggtttcattacaaagagggttatatgggacgggcagaacgacagtgccgttgccattacatatgttggagttgcataggacgggagaaaatttctttccaggctgaaactacaatctgatcagggcgccggatacgctcagcccacaagttagcttcatcaaaacagcgttgaaggagtagtcgtagggaaggttgctcatttctgaagatgacatcgtgtcagcggttccacatacaccaccagcagagcaagaagaaggtccgatggttctcaaaaaaaaaaaaaagaaggtccgatggtgcgccaccggtatggttgcagttgcagggggcaaatgcagccgacatctcgtacatcagagattccagggtcaataaagagggctgcccagaagttgcaggtgaaagggcacagcaggtataaggtggctggccgttccatcgttgagtccacagatatcacaagttggggatgagacaattgtcttagcatgcaggttcttttttgttttgttggtaggcgctcttttgatagaagccaacaaaaaaatgtatcttcgggggtggggggggggggggcagttcttgtccatttgagatgaaggtagcaggagctcataggcttgcttggtggtgagagctccagtaaatctatcggggacagctattttttgagatcttgttgatctgtcagggtttgggcggcgtgtcaattgctgctctacagccgaagaaaggcgtggcaccgaggattcgctcagccccatttgaattgtcactacaacagagacaagtttgtgcatagagtgaaaatgcagggcttgaaattgttagcagagaggcttgtttagcagccagtaatcattccaaaaattgatagtgaccagtgagattaacatgaaaatttaatttttagtctcaacctcttctttaatagaggtggcgggactcgataagaagtttattgaagattaaattttaaataaaaaatgaatggttgagatttaaggattttgcttccaattaccatccctactccctcaattctctatcttatcctaccaaaactctcaagtctcctaaccaaacagaatcattaatagtcccatccctttgaactcttagggtgtgttcgcatatgttggttcccaacccggaatagtaacacgaaaaacagagcagtccattagcacgtaattaattaagtatttgctatttttttaaaaaatgaattaatatgatttttaagcaacatttgtatagaaacttttttgcaaaaagtacaccgtttaatagtttgaaaagcgtgcgcgtggaaaacgagagagatgggttgagaaaaaggggtgccaaagacacccttaatccgtcctacaaacttcctccaaccacaacgaaccctttggtcataaaattttgatgtaagatcatattaaacttttagaactttaagcactctagcactaattaactccgaaaaacgtccattagtcttctggctagcttcataaggtgatgggctagacgacctgggtttaaagacgacctgggtttaaagtctcaccccttttaattatttaatattaggtcattcctaatactatttgctagtagtaattaactccttaatctgatcttacgtcgatgggaatgcttaaaggcatgcttaaagtttcatgatttgcaaaaattcatgagatgttggttcgacgccgatcacgatcactccgatatttcttagatgttactaagccatgaaatggcgagacagcggggggctcctagctagcgcgtgcgtgtcgctagcgagcactcccctcttaagtcttaactacctctattagtaatatacttaacactaatgatagtaattaggaaagattctggagatttttttttggagatttttttactaacatattgaaaattttttaagttagatttgaaaactttcgatttaagttttaaattctaaagtcaaattttgaaaactttcaactcgagaattgagattcaaaaactttcaagtccagatttgaaaaattgaaaactttcaatttgagatttaaaaattttcaactcgaaatttgaaaactttcaactcgatattcgaaaacttttaagtccagatttgaaaattttgaaaactgtcaacttgagatttgaaaactttcaagtcgagatttaaaaactttcagctcaaaatttaaaaactttcaaactcaaaacatgctaaaagattaaaaaaatattcagaaaaaagtgggtaaaaaagaaaaatatcggtaaaaaaaagacgtgggaggcgtgcgctagcgggccggcactgggccttctgggcctgatacgcgcgtgagagaattagcgattctggagacagcgcgtggtaccccggaacaacagtattatttcggcggaataagttcactttgtgaccctcaaaagtgatcgaaatctaatccatggccctaaatcagaaaaccggatatcttgacccccccccccaaactcttaaaaccggtgcaatttgactccctcggcggttttggagggcggtttcgctgacgtggcgcctacatggcaatattgaccgagtctttgttcctcgtggcacttacgtggcagtagaattaaaaaatatgagtgggacccattagtcattcacacaaaaagaaatatgggcccactgatatgtggggcccacgtggcagtgctttccttcttcctcctccctctctcccttctctctctttctctccccttcttccccttcggccggcgggcgggagggcagtgagaacgagcggcggcgggcggcgaggccggaactgcggcggcaggcgggagggcaggcgagggctgggagcccggaatcctactccccatctccggcgcccgccaccaccaccgcccggaggaggagagcttctcgccgg

SEQ ID NO: 59994 - DNA, 6083 bp, Oryza sativa
gcggctgtcctggcactcatgctctgctccctcatcgcgctctccatcatccgcgccaggttctcccccatcctcctcttcttcctctcgccgccgccgccgccgctgttaattgttttgttggatgctgctatggcgagaggcgagagctgatttggaggttctccttcgcagctagtgatggaggcgaggccctcaagctcgtggccgacgaatccaagctcgtcgtcaccaccaatcacgtcgtcgtcaacaccgaatccggcgactagtcctcgtcgttgtcgtcggcagctggtaattacgagatgtgtttcttggatctgctcgcgcgtgagcggcgcagtgcagcgcattgcttgagctggcttggctgattcgttcttggcgatttcatatccgttctttcgatttggctttagttcaaacaaggactagaggagaagaaaaaaaggaaaaggaatcgaagcatccataatttatttcttgaatttttttctcccggcgagttgctatcctggttcataatttatttcttgggctttctggagttttgcgctaaagaatggcgtggattcggctgcgagattccgcgaccagatctaattaaactgattctcctcgtgatgctgcagcggaggaggtcgccgctccggcgaagcccaccgggcggcggcgatggggccaagccggtgtgctacgagacgagccgccgctccgacacatgcgaggccgccggcgacgtgcgcgtggtggggagcagtcagataatgatgccgtgcgcgttcgtcgccgcccgccgccgctcgctctcgttgccctcccgcccgccggccgaaggggaagaaggggagagaaagaaagagaagggagagagggaggaggaagaacgaagcaaatgtcagtgggcccacatttattttttttgaatgactaatggttccatatatattttttaattctactgtcacataagtgccatgtcaacgccacatggaacgaagaccaatatcgccacgtagacgccacgttaacaaaaccgtcgaggtggttaaattacaccggttttaggagtttgggggtcgagatatccggttttgtggtttagggttcgatcacatttgagggtcatgaagtgaacttattcctatttcggcgagcatatgcggggcctactcgaacttttccatgtctcttttatttcctcctgacgggcccggccattccattttgggccttcttcgtctgatcaagcccaacgattcttcccggcagatccgctcagttcgtcggccccatacgggaacagaaccggggtgccggaattggaaaaagtacaccgaaggtccctcaacttatcatcgggattaacaaacgtcctcaaaccacaaaaacaaatatgcgagatcccttaactatacaaaaccggtcacccgagttgcttcagtggttttgtccccgggtttggcctacgtagcgcgtgagacccacgtgggccccatatgtcagcgtgccacgtcatcactatctctctctttcccttcgtccttactctctgtctcactttacctctctctaggctggcgacaggcgacgcggtggcggcggcgacgtgggaacaggcctcccatcccgacaaccaacgcctcgctcttcttcacctacgacgaggccacgcacccgctcacgccgccggcctcctctgtttgtgtttggtgagtggtgtttaatcggtgtcggtgtttggtggatgccgtgcaagccgagcggatgcacgcggggttggaggaagcgcagcgacggcacgtccgggcgctggtggcggccgcggcgcgcgccacaacagggaggacgcgtgcggcggaggccaagctggatcgcgcacgctgccgcaacgcggagctggaggagaagctccgccagatgagcgcggaagggcaggcgtggatgggcgttgccaagagccacgaggctgtcgccgccggcctccgcgcgatgctcgactagctcctccagtccccctatgccgtcgccgccaccgcgggggagggcgacgccgaggatgcgcagtcgtgctgcttcgagaccccaggcggcggcgccgccgccactgccaccgacgcggtgtccggggcgacgtcgtgcaaggcctgccgtgtcacggaggcgtccgtgctgccgcctgtgcctgtgcggcgcctgcgaggccgccgttgacgcttgccccgtttgcgccgccaccaagatcgcctccgtccatgtcctcctttcctgaagtcactcacatgtgccacaccagctactgcatggagtaggagatttcgatagcgcaacagctgtggccagaccgaaaccaggcatccgtcagccaactccggtgtcaagcaagctaacaacaatcatcctgtcccaagttacatggaaattcatgctagggaagccacagttctgtgcatcagcgatctccgggccatgcgagttttgtcggtggaaacaacagtgttcggtgcggtgaattgaatggttgattgcctatctcatcttccgcaggtaccattgcttcgaatatttggcagcccggataggcatgcacgccgtcccgtctccccgtcggccgctgctcgtcggttgtcctccccatcagctgcctcccgtcctggcaccccttctccccgccgatcctcgcctgtcgacgacgtcccggcgccgctccccatccgccggccaccgcagctccgcgcctccgcttcgccggccgccgcgcgctcacacgctgcctccgccgtccgccgctcaacccccctcgccgtccggtcgtctgctccctacccgtcggccagcctgcaagagaagagtgcgagagagaggggggaggaagggagagaagaagaggggaaaggggaattgacgtggcaagcccacatgtgggtcccacgcgccacgtaggctaaaacagggtcaaaaccactaaaggatctcgggtgactggttttgtatagttaagggacacctcatatctggttttgcggtttgaggatgtttttgtatccgatgacaagttgagggaccttcggtgtactttttccgccggaattccccggggtgcctcagccctcatgcctaggcccaggcacggcacggcacggtacgccagcctgtgggtcatgccggcacggctcatttgccactaccgtgcttgggccggcgcttcagatgatgggccggcacgaaaccttgtgggtcagcccgcaaaatttgatgggccagcatgggtcaactaaagtcggtaagtccaaaaccttaaagcatgttcacactgccgagtactgaccatctcccttcccatccacgttcggccacttcctcctttctcaagctctctctcctctcctcgcagtcgcagcgcagtagtctctagggttttagcgggcggttgtcctccacccgctcgccgcgtggccgccgccttctccccgcgccaccgccgatggacgtcgactccgacccagccgccgcgggcaagcccacccagatggacctcgaggaccaggcatgccgccgccgccgccgcccgactcctccccacggggattctaccttcagtttttgattgtgactgttttttttttgcccctgatgatggaccctgtgcagactgacgcgaaggggaaggggaagagcgaggagctcgcggactccatcgggagcctctccatcggcccggagcgcaccaatttcaagaagaagccggtgatcatcatcgtcatcggcatggccggtacatcgatttcgcatgctgattggttcatcctttgatgtttagtggcaaccaacctgtcatacaatgagctcttgttgagtaattttgggattgggagctcaggcctcaagggtctcggtttatgtgatgtagggacggggaagacaacttttatgcaccgactggtatgccacacccaggcttcaaacatgaggggttatgtgctcaaccttgaccctgcggtgatgacgctgccgtttggggccaacatagatatccgtgataccgttcggtacaaggaggtgatgaaggagtatggtcttggccccaatggcggtatcctcacctctctcaacctattctccaccaagtttgacgaggtgtgcttttcgatcatcatatatttcatctccgtatgtgtttagatcaagtggttgttaggattgggttacttgaatgcacactatcaggaagtacttcaataccaagttaggcaatacttaggcaatttaatcacttcaatggtagtttgtatgcaacgatagttagttagggagcaacagaaatggacagtgaagagttcagcgataagtttcgacagttcaatttcattaatagtttctaaatagttcaagatttcacatatacacgcgtaatattcaattagaagtgttattgtcatgcagcacatagagattcccaaataaacttgcctagattgagtcctgttcccttaaaagatacaatgtaatgaatgctaatttaatttggtttataggaagattatcgtgcatgtatgctactaattggttctgcataggtaacttttcaattcttacctggagatgcttgcacagtgtctaattatggttctaatagctgtatggaatgtgtgtagggaaacactaaataatggtcatttctcaacaaactagcttattgatactgttggatggtcaacataatataaaattataatgtttaacaaatatgtcaataatgatataaaataaacataagggtagaaaatatgcccctagcccgtgcagatgcacgggttgatgactagtctagtaaatttgttaaaggaatgcagtctgcttatcatgttgatgggataatatttccacaattccatgtaaagtggttcagaaagcgagcttgctttttgcttactgcagtgtacagataaatttggttgacacatgatgcaattctgctaatgatcatatgtaacacctaataattgtctttacaggttatatctgttattgaaagacgagccgaccagctggattatgtcctggtggacacgccagggcagattgaaatcttcacttggtcggcttcaggagctatcataacagaagcttttgcatcgacatttccaacagttgtcgcatatgttgttgacacccccagatcaacgagccctgttactttcatgagcaacatgctttatgcctgcagtattctgtacaagacccgcttaccgatgattctgacatttaataaggttgatgttgccaagcatgagtttgctcttgaggtatgtttgccatctatgaatatctaattcctttgttgttgattctggacaccataagtgttgcatttcagtaatgcggtatcggcattatgcaacgactctctttggtatttaatcaagttgaaactgttgcacttgattgatatttgctcaaatttgattgggcctgttagttaattgtcttatctgtttttttccctacatcttctgtaaccagagattatgttgtttattttatcagtggatggaagactttgaggcgtttcagaccgccttggattctgactcatcatactcctctacatttacccgaagcctctctcttgtcctggatgagttttacaaaaatctgcggtctgttggagtatctgccgtatctggcgctggagtcaattcattttttgaagctattgaagcaagtgccaaagaatacatggagaattacaggtgttttaacttgcgatgtagtgctgctatctctgactgatatatgcatagcaaaaattatataagtggttgttataaaaaaacttttcagggctgatcttgacaagaggattgctgaaaaagagaggttagaggctgagcgtaggaaggagaacatggaaaggttgcaaagagacatggaaaactctaaaggacagactgttgtgctcagcactggtttgaaggacaaaaatcgtgctacggatatgatggatgatgctgatgaggaggaagaggaggcggcattagaagatttcaggatttctgaggactgatgaggatgaggat

SEQ ID NO: 59995 - DNA, 2346 bp, Oryza sativa
taactctaataaataggtattttaagaaccagttggtcagtagtcagcttctgagaatatgaaaaagctgaattttctaccttctgagtttctagttcattttataggttctaagaatcggaacgataggttgaactgtttaaaaaaacttctaattctggtgaaaaatctcccttagggcacccgcaatggttatctataagctttctataaaagatccatgtcagcatattttcctacttggaagagattaaatgaaaagagagagagtaaaactatctactaacttggagatagtctatagataaaaagaggcaattgatgagagagctatagatacctatgtagacatactattgaggtggtttactattaatcagtctattgctgagatgtacatgttttataaagagcacattactttaccgttgcgggtgctcttgcgcggccctcgaattcgcaattcgctcggcaggatttcaacattgcggcctactgcttctgcagcccatgatccacacacacactccacagcccacagcccactccatcctctctcccccaattccccatccgctgctcatcagtcgcacgtaccacaccagcatcctcgcacggtcgcgacccctcccgcacctcaccaggtagagagagagacgacggcggtggtggcgggatgttcctgcggcggatcctgagcggcgggggaggggtggcggcgctgcgggcggcgcgcgccgtgaaggagacgacggggatcgtggggctggaggtggtgcccaacgcgcgggaggtgctcgtcggcctctacacccgcaccctcaaggagatcgaggccgtccccaaggacgagggctaccgcaaggccgtcgagtccttcacccgccaccgcctccagatctgccaggaggaggacgactggaagcgcatcgaggaccgcatcggctgcggccaggtcgaggagctcatcgaggaggcccaggacgagctcaagctcatcgccaagatgatcggtccgcatttctccccctcccctacgccccatctccattcctgtcgcttatttagttacttcttgtattaattccttattcctcctactgatctgtcgacaagaatcagggtagttgatgtgtagatgtggccactggctacccatttctttgattcaaccagttatttgatccgatatacaactgatccgtggacaataacatcgtagcgattggtatttgattttcttttggctccctttaatagcactggtagggcaaattatcagcgttgacagtatggtgtttgccagtttgttgattggggagggggggggatggaatgctttttaggttgtctgctgtgctgcctattagtaaaatgccttaattatttttcagcgcttatttaaggatcatggatgttccattttaccttttggtcactaacctaagattttttgtgaactgactggtgcttgtaacttaaccagagtgtgttcattgccatattcaccatactgttgctttgtgtatgtctggtggagtgccatgtatgtaaaatctggctggtctggaatctagttcaggcgttgggctggtgctatgcattgcatgtagtaatgtactggtgtattacttcagtgctttaaaatttcttctttgctagaatcccagtgagtcagtgtaatatttgttttgtgaaaattcaaatgaaatacataggtttccattttacatgatatggcatagagagggaattaggaatatggtgatgttacttgcgtgagtaagaagaaatatgctccacaatcttcgtaattgtagagcatttctcttctatctaaagtctattcatcacacctaattgaaataaactttacaaataccatgccgaacgactggggaaaaaaaggctgaaccaaataatcactcacccatgtcccatgcacatcttaccaatccagagcactctcactgatcgatgctctctcaaatctcaatacagtgtattgttttttgtatagaactatgaatgaatgtaactactccctccgtttcacaatgtaagtcattctagcatttcccacattcatattgatgttaatgaatctagacatatatatctatctagattcattaacatcaatatgaatgtgaaaaatgctagaatgacttacaatctgaaacggaggaagtatattataatttgcatggcattagcaacttaatagtgattaagaattcacgtaaccatgccactaccctttacactgagtatctaataagattacgacataaggtgcacaactatagctgtctagatcagtcctgttgctgccattagcaactg

SEQ ID NO: 59996 - DNA, 2674 bp, Oryza sativa
cccgacatcattttctttttctctgtattaatctatggtgacgaaaagcaaacgttttactgttatctacggactgcttgatgtgctctaaaatcgtgcgattcttttgtacccatcactgtctttcctgtgcttctaatctgcagtactgtcccggcaagctctgaagcgttgttgctcagatttgctgctcgttacagccagtgcaaatgaaagctttgatgttctaggctccggctgatagaacaaaagcaggtctgctcgaagcagcagccacgggataggttgccgcgccacgaacccatagatgagcaggtcgaggccatccggtgtcgcagaattactcgcgaacttaaaaaggatacaacatggtagaaagctatgaaccacttttgttcaaaataaaccattaattaacaactaagcatatctggggcataccacaagctcattttgagcttagacccactgttgttgtaacgagcatagtcaagttcactactccagctgttatctatgttcaggttgttagtccatggcagcagcaaaagccaaaagacccccttcctatatccacccaaaatctcactccctcggaatctccacaagaaccacacaacaccagcaattgcagacgctgggatcagttggcagcattggccagatgaagaaagccaccactagccattccaaccatgttgctgttgagctgaaccttctgctcctccccatcgccgtagggccagtagaagcctactggctctgcaaagttgtacgatcctggcagcggaagagcctgtggtggtggtggtggtggtggtggtggtggtggtggtgcgtatgggggaccacatggctggaactgcaggaggttgtggatgagatacggtggcgcgctgctcgactgctgggagatcggcgggctgctcatcagagtgatttggcctcctgcttctggtgctggattgttgctgttgctgctgctgttgtgccgcctcccggacacgctgatcgggaggtcgctctgagagatcgcttccaggttgtaccggcttggctcgaagttggtgacggcgttggcgcccctgaacttcagcgctgcaacgtcatacgcctccgctgcttcttcttcggtcgctgcaaggaatgtgcaagtatgctggtttagtatgcatcacagagtgcaaaatatagtggtttctgaatgtcgccacagtaagggaattagagcgagattgaatagtgcatagcttgtagattatctgtaaaaccagtaacaaatgaaatggtacacagatgataataattgtgtcaagatgacagtaacttatttgaaagggaacaacaaagcattaacagcacttcaagaaacagtaaggtatctatgactattctgccatataacttaactacttaagactataatatggtcacttgtccatatatgactatgagcatactttcttaagaaaaaaagcatactgtcatactactttttcgatataaggggcatcagaacaacaggctcctaccaaaggtgccgagatacaagtccttgttgcctgcaacacgaccaattcttgcctgccagcggccatgttggtggtgcctggggaaaatagcaggaagttgagcagattgtaactgacaaagaagatgaccattggttgattggttcatgtagttgaaaattaccttgttacacctctgtagatcgatgcacctctagaaaagccactgctcttcctgcagatttgcatgagaattgagaaagttgtaaacacgtatataagcctgaacttcctgtggttgtagcacagcaaaagaacgtggttttaaatacaaacctccttagtgaggctacaagctcctgcttgctcatcttttgcatctcctcaatctctttcacgtaactttctttctaagaagagaacaagttccatttcagttgcatcatgaccaactatagcaatacatgataatagttctgaatgcatcctaaaataaagagaccaatctaagcacacagctccacataaaggtgagcacatagtgatgtgtttttttttccttttttcttttgcgacgataatgatgtgtatctttctattaagaatacatgagtatgtctcagtccacaaccagcataaatgaatccaaatgaacagttgaaggttgacaaagatctcaaattttaaggctatggattaactgtaaataagacattagaagtacactaagatcactacaatatgaggtgcgggataagggcacacattttaggaggcacaaaaaaactgcttatatgacctcagtaggatatttgcagtaactatggggggctgtttaggaaatcaggaaagcgtgacacttacagggaagttagtggtagcattagcaccccaatatttcagagcagcaaggtcatatgccctagcagccttatcttctatgtcatagccacctgcaatttaccacatgtttatttacctttacttacccaggaaaaggcatacgaaatgatacataagacaggacttagttgctcatacccaagtaaactgaagaaggcccccatgcagttggcaggataaaaagcacatacagagtagacattataaaccaggttagttccaacaaataaacaagattatatattaaaaaatacagggat

SEQ ID NO: 59997 - DNA, 8869 bp, Oryza sativa
cctgcagccccattgtacatatctcacacaaactctcctcctttatcaacatataacttataaggcatgattctttttttctttttcaaaaattaagataactatatcttccaaaataaaaggacagcaacaagaggatgctagcttacataactcgaaagcaatgtatctctccacacaacaaagaatgcccccaacatttctattcacgtgattcatcctgttaatatatattatttcccaaatgcaattatatgtatggaatctttaattgcatgcaatgatttttctcctcagaactggagttttgcttgcacgatgcaaaagaggcaagggtggctcaaatctaacgatagaatctgcacatatgaatgcatcagcatgtgtaaggagttatttgtgtaatacgtattacttattacataatgcagttcaaaaccaaacagcagaatatgcaatgttcacttgatgaaattgcattttgcactatgcacgtgattttagagtagctatcctcggatgatcggatcaaccgatagatttttttttactgatatcccagcatatatgtaccatctgacagtaaaatataccattacatgtagctatatatccaacagtaaattgatccgtggaattctgatttctgggtgtctcatatagtaggcattaatatatgaaatgcagccatatcatacaagatcgtggacactctctattgcggaattgccgccatggccaataatcacatctccactatcgatcgacgcaactttagaccgctttgctatttcagcagtagtctggaactgctttggctcgaggccatgagcccatgacgtcgtagacaccagtagcacgcatgtctacctgtgcaactctgcaagcgtatcgagtaaagtacaaaagtttgttgccaaatgccaatcaacaaggacggacagtagaaacaactctactggagtcgtaactggcaaagcaaaaataaaataaaattcaaacgtgcgttccaaaaccacttttggtcacaccttagctgtcccctacacaaccctggtagcgttgcaaagttgcgactcgtaataaatttttcagaaacaaaaactctcgccgtgtgtaatgcagaagaaaacaaaaaaggagaaaagaaagacttgcaatagaaggaagaaagaaactgacccaaataaaaccatctaaacatgcagtacatcacccatgaactactactaaaaccaggaaaaaagcaaaagctgcatgcaccacagcagcagtcctgccatggcaaagctgtcatacagatacacgacgtcactctaccaaccacgggaccagttaatctccacgcctacaagattaaccaacataaatcgccttgctaaatcgctttaggctctagccgatctattgcatcagagaaatggccacaagaaagattaaaaaaaaaagagatactactagtagtagacagaacacagaggtatactaggcagcggctacaataccccctacctacggttgcacggtcaaagaggggtgacccaccggggcccggcaccgcagagaatccgggaactgttgcgagtctaacggagatgctaatgtcacctcaacttgatgcacacgatggccgacgcgacccgtctctcgatctccccccgaaacggcgccggcaccccatcccatcccatcccatcacggcgaactcatcaccgtcccctcgccgccgtcgatacccctccccgccggcgaggcctcctcgatcggtgacagaaaaatgacggtacagaaagggtaatggactaatggtgattagcggtaattttaattagtaaattaccttggcggcccttgcgcttctggccttctcgccggcacgtgttgtcccacaggtgcgcctcgtatcgccccgtccacctgtgcctgcgccacacgtgcggtcctcgtgattagcgcgtgtgaaaaatcacgtggcgattagtcgttaatcacactccctaaccatgcacttattattatcactctctctagtctatctctacgcgcgtggtatagtggtagtaggagtagtattacctggtcacgccgcggtagcaggaggtcctctggccggtgccctgcaccagcggcagcaccggcgacggcgagcgcacggcccgcgcggaggaggagccgccgccgccgccgtcgctgccccagctggtgggggtcatcacgctgccgtcggtggtggcgcccagagccaacgtgcgcggcgcaacggcgcccatgccgctgctggccccgtctgcaggtgcaggaggacggcggcggcaggaggaggaggggcgcggggtcggcgacggcgacggggagcgaatgctgcggtgcggcggcgacagggaggacgaagtcgtcgtaggagaggccgtcgaacgggtagatcagcgcgtccgccggcagcggccccatgggcgggaacgcgagcgagatggcgccgttcgtcggcggcgacatcgtcgtagacctatcaacggcgcgtcgcggcggcggaagaagaggcggaggagtggaggaaaaaaaaacgaaaggagacgagacgaggcgaggcgggcggtaggagtatttataagggagggggtgaaaacgatggcgagaaggtgtgtgtgtcgcacttctcttggtgatctggtctccgcttcgcttcggcgcgggcctgggttggggtggggctaatggaaatgggaatggaatgtgtggtggtggggtaggtgggtcagggcgctgcgtcgtcctcttgtactacgatgcctgccacggccagtgtctcctctcttctcttctcgagttcgaacagtgagacagacacagagtggccctggcctttcagtccggtggttccggttctaaattatttgaaaatggaattggaactttggaagggcctgatagtggatatgtacagaagggagaagcaattttttaaaaaggagaaagctcggcttgtcttccaacctaaggaaaagggcaaagacatgtttttgtgtgggggtcaaagtcccttatttgaaatttttcaggtgcaaagaaaaaaaatctgatgaaaaatgcagttgttttgtctaacatgaccagaatgcccctagcgtgtgtggtacttttgctttcttatggacgcacgaagggcaaaagagagatagtcacattcgtaaccgtcgtggcgagtattttttaatctggaaattggtcaaactcatgtaaacaaaaacggagatagcattgaatacaataccaagttggttgtcgtggcttggacggcatgatctcatagttgacggttctgtgcacgaactaaagtcttacttattgagaagatattgttacatatttactatgttagttttatctttacatagtttactacaatatgtagttgcgtttaccatgcaatgctatagatcctaacaaaacaagtgccagaaaacaacgaatcaagaggagcaacatgagaattgatctgagagcctgatcatgatgatccctagtaacactaaaataggatcaacaatccaaaaaggaagaaggttcgacatgtgccttaaggtaaaatcttaaaatagtagtaaggatttctttgggtcaagctccctttaagaattttcagttgcagataaaaaaaattaagaaatgaacattggaggatgtcatggttatcgtggcgagtatttttttaatcccagaaattggtcaaactcatgtaaacaaaaatagagatagcattgaatacagtaccaagttggttgtcgtggctcatggacggcatgatctcatagttgacagatttgtgcacgaactaaagtcttacctattgagaagatattgttacatatttaatatgcttgttttatctttacatagtttactacaatacgtagtttcgattaccatgcagtgcaatagatcctaacaaaacaagtgccagaaaacaacgaatcaagagaagcaacataagaattgatctgagagcctgatcatgatgatccctagtaacactaaaataagatcaacaatccaaaaaggaagaaggttcgacatgtgctttaaggtaaaatcttaaaatagtaataaggatttctttgggtcaagctccctttaagaattttcagttgcagataaaaaaaagttaagaaatgaacattggaggatgcatggttatatcatgggtctcatggtttaaaatatatggtgtgcataaaagaatactatatattatttataaagaacaaatattagccttgcataacatcagtttgaacttgtgaccgaatttatgtttccgttatgatgtttacggtaacctcagtgaacccatccctttatgcgcccccctgacaaacactctaagagatagaaattagcggcacatctcttatatcactacaatcctgttgaaagtctacctgcatatgcataatattttaaaatcatgttaaaaacccatacttcaacaaatatatcttgtagagacattttcctaatactatagagacatttaaaaaatgcctttacagtgttatagagacattttgaagagtgtctcataagtgccttttggtgaattgtatctatgaactaagaggcattttataagatgtctttatacaaatagaggtactttgtagaggcattaatatgttgtggcaactatagcaaatcaatatgaaaaaaaaagaaaaaaaattatcccttatcaatccttaaactcatgacctgttgagtttaccatttttttcctcaatgcactaaccatctcaacctcatataattacatataagtatgtgatttgtgttacttatatctagttacttgatatatattaatatttggaaaaaatgcctttacatataaggcaaattttaaagtgccgaaaagatggctctacaagataaatttaacaaagtatgttaaaaatgtctctaaagtgtccctaaagtaaaaatattttaggcgattttgagagtgtctttaaaaagtgtctctagactatagagctttaaaacttacaggcattttaaaaattctctacaaatgagcctctacgtgaggtttttgttgttgtgccatatgcatatgcatgtacttaatattcgcaaatagcaggatttaaatactagtggatggagtcatgcacctatgtcatcactaatgacaagtgcttcccctttttctttgtcatcatatcatgaatgctttacatcgaaacatcttgaagcgttctattgtattttgctgaccctttatttttttttcatttttaccatgaatataaggaacaagtagttttacgaaccgcaacaaatgtgtacattcatggacaaatgttttcccccggaatgtgtgatggaattttcagtatattttgcattgtgctactcctacatgataacatgttgtagtacgcaattaaccttgttctgcttcgtggtttggaacattggatattctcctgtgtaccgtggagcaaataaggtcgcgaccagctcggatttatctcaaaactgcagtgggtatgaaaccagaccagctcgcgcgatccacgaccctttttttttttttttgaaaactctccacgtctaaatccgattgactctttgtttcttcatagtagtgtcatgaacagtatgtcgtcttatcgggacaaaagcaatgcgggcggccggggccggtgctcatcttaaatgaatgatatcatagctatggactttataattcactgcatacagctcactgcaacaagttgtttcggttttatgtgcatgactgataagaaaatgatcgagtaagtgaataactttgttgccatttatgcatttcatagaaaatgatatactaaagaacatatcagatttaaacaaaaaactagtatacgaaatgtgatatactcttagcttttaattcaataaatatttttctaatatttatataacatattttaaatttaaattggacttgatatataatattagcttatatttttcatcgatgcaattgtattttctacgcaattatttctttaaaaatattattagatttcatatacatttcctgtgactcctttgaaaccaagtatttttcttaggaacttcatccaagaattgaaatcctataaaaatatttcctataaagccctcaaagaattgtatatataggaaggtattccaaaatttcaataggatttcttccattcatccacttggaggattccaaaatttatcaaaggtcgtgttttacatttccttcaaaaagtcgaaggcagcatgtccatatgatgcatctaaacatatcttttaccagattttgtgttttcccccatattgtgttttgcattttttttttatattcctacttttttttccaattttccattccaaagtagcccttaatttttttctagataaaatcataccttctatacaatcataataaaaaaataacatttcaattaatatgaaaatttctagtctcgagagtgaccatgtcaataccttctttttagccatccaagagagcaattcttatgacagtactactgttacatgaccacacatggtgcaaagctcccaccccatgagatatgttcatgcctcctttcaaatggggtaatttcaaagataagaaattcctatatttttttcgttccacaggaatcctcaaacttaggcgggggctttggagagtcaacaacaaattatcaagcgattttcacatttcgcatagtggtagatcagttttgtttcactaaaaactctagtagaagtaaataatcacatagaaacaaaatggatctacatcaggaagttacgtgatctttctttttaaaatacagctcaattaaacactatcattctcctatactgttttttttcttctcaattaaccacaatatttatctaattattcacacctacctttttttcatacacgtctgaacccaaaaatacggatcattgcaagcccctactgtacaattgcactccggattttgagtttttgcttacactatttgaccactcgtcttattaaaaaaaatttaaattattatttattttttgacttactttattataaaaatactttaagcataacttttcgttttttatatttgtacaaattttttaaataagatgagtgatcaaacagtaaaaaaaacttaaaatgcttggacggagggagtacatacactgcggacaccccgtgggtttcgggggttctcctgggctctcctgctgccgtgcacgtagtcggcgctaggcgcagccgcgcaggttagtcgaggtcgacccgtcccctcccccgcggggcccgccgccgtcgtcgtcgattgatggccgcacgccgacagggaggccgctcagtgaggagatgcgctgcatgcagccgcgacgtacgacgtgattgaggtgagagatcgtacgtgctatgctactcctcgatatcgcttcggacgcacggcggtagccgggggcgtgcagcggccaccgggaccggggtagcaagcgggggcttcttctcccggtcaaagggccactcaatcaagccggccgcctttcttttcttctcccttttcattactgcccccctcctcctctcctgccgttgtccagggcttttcgattagttgtttggcacgtgacacgagtttgctcttcttcccggctggatatgcagatcggcggcgattcactgtgtattgcactgcacggttatactatgggaaagcaaaatggtcgtttcatatccctaaatttttacgtaggctatatttagttcacaccaaacttttctccaaatctcaactttccatcacatcacatcacatctaaaactttcctacacacataaactcccaacttttttttccaaactaccaatttttcctaaacttctccccaatttcaaaaactaaacacagccacgaaaacgaaactcagtaaactttagttaaccggaaactgatcatccttaaatttccgataccgcgtttacttacataaataaagttcagggatgaaaagtgtcagatttccaagcttagagataatctttagactttcatggaaaatttagtgttgtaccttttcctatagaaaactaaaatttaagtttgtaatgataaaattttggcaatcaagcaatgttgctacaaattaacctttcggttagcctggttggtaggacagcattgtatttggtctgttaccaacaacaatggcagttatataatttgatattacatgggtttggtttaagaataattattataataaatagccttaccaaattttgattagcgttttcatttagccattatactagtatacatattatatataagagagaatcccttatatgtcactctaaattaactggctctcttatatgccacttcaaattggcttctcccttttatgccaccggttcaagtttctcctcccttttatgccattgccgtcagtccaccgtcagttaaccgttaacttcattgtaaaaatacgcatttgcccttgagaattagtatacaaccaataataggtattttagtactaatatagctactggatacaacatataaaaattgatttttttctgcatcacatgcaattttagccattaccatcacaaataaattttcaatataagcatgaaacatgcagttttccaacaatatttttaatataaagagcatttttcactggttctgacaaaattttgttcactcaaaaagaagtttacacattttttagttgagagggcatattggtcatttacgaaaaaaaactaacctttgactaacagtcaactaacattatagtggtgggagtgggctgc

SEQ ID NO: 59998 - DNA, 1681 bp, Oryza sativa
tagaactcgtgtaggcagaaatggtccattcagtgacgtccatgctaacatcatatagaacgttcctctaacactgctatagttgtctcaaaatctaaatattattttttttatttgatcatatactcatgttttgttttcctgtgttcaaaaccgaggataaacatacattataatattattataatattatgtaatcaaaagatgctaagacacacccactcgtgtgtgcaaggacagacccaggctcctgtgttacaataaaatattatcgtgtactttatccatcctaaaataaacaaatttagtacgagatgtgatatattttaataatacgaatctgagcatgcatttcgtgctagatcgatccatagtactatgatgggtggcatcatgtgctataccgggctcatgtcagaacactataggccaacataggtcttaggttagagtttttgtttttaaaactcaaaactttatttatatagatcaaggacagagtttaagggaaacaacatccccaatacattggcaacaaagatagaatatacataacaacaccattcaaacagaaggcaaagccgattgaactaagaagactgtcctccaagctaaacaaaacaatagtaattgatgagatcgatggggagctatggcattgccaaggccactacgtccacaagccactactaaagatgtgcacaccgctcgatagatcggcgaccccttcagttgcctccacgagaacttcgttgttcaaggtttaatgttgagccgtagatttttcttaggcttgatcggactcaacaatggtttgccaagaagttctctaccaaatctgaggagcactaactgtaatattatcaacaaaagtcgaacaaacagtccgcactcatccagaaacggagttctcatcttggatactgttgcaaggaaaattggaagacaatcccaaaccccagcctgccttaaacacaaaatgattaggaatggtagcaactgaacttaagccttggaacgattaagcgaaagcggaacacagtagcaacgatggaagagatgattcgatcaagcctccccaccatgcattccactctaaccttgcgactacagatcgctagatgaccactaccacgaagagcaatggtgtttccagaagtgacacccccatgaaccccagacactacaccaggcatcaagcaataagcccaccaaagacttacttgaagaaattgatgaacttattgagaggccacctcgcttgacatccagaaccacgagtacttgaggctggaggatcaagcgaactataccagctctaccttttaaataccaacaagtaggagccgagcacacccattttgccccacctccagccatcatcaccatggagaatgggctgaccaccctagatccgccatctctagctccgttcaccaggctgaccgacaagcaagatccggttgtgtcggatctagcccctccacctctcgtcgcaacgcaaatcacgccgaccctcctagatccgtccacactcatcgcggggaccattgatggggaggatgagcttgatgactgatgagaaccctcttcctagaggcaaagggacacccaaacctacaactacagctaccaacatcactttcttgacatggcaacttcaccaatgagacccaaaaat

SEQ ID NO: 59999 - DNA, 5152 bp, Oryza sativa
cgactaaggacttgcatccgtccttcacctaaaatgatgttattgctctccatgtgcgtatcttatgagatcttaatacttgctccttctacatcaacggcggtttgaagttttaacatgtgaatttaaaatctttacgggaaggttccaatataagtattgttttggaaaatgggagtttcacaagaaaacattttaactcaacgtgaaatgagaaagttccccacatatgctaaacaaggctttaacaatttaggggtgttttgatgggttgtgaagggtgggattgagaaatagagatgaatgaagggttaggacgaaattagctgagaaatatggatagttcatattaaaacttgctatagtgggtggttatttattcgaagaacccattaaccaaacatgccatcatttatgtgaaaatcggaaaaacaaaattgtaagatcgttaaaatgggccaaactatagtatagaggcaagggtaaccgcaatgcgaaaagggctatagcacaaaagggctatagcacaaacatttgcttgactaggccccacacgaacacacacgcttttaatatttggcaccacatgatttctatttctaataagtttgtatacctaaaagtttatactcccaaattttatagggactaaaaaaatgcccgtgcgttgcaacgggtaaaatgcccgtcatccgtggcgggtgccataactaatctcgtttgactcatatgctgggccaaacctatctatgatgggccttatgcttagtccgattgagataattatcattcgtgacggtcaaatacccgattaagataacttctcacatcagtgacttttgcttagcgatggtagcccttcctgacactgattgagacctatcccgtgctagtgaatccaacggctcacagaaggtcgcagcacaatcggacctctgcatcgtgactccgtggccgtgggatgagcaacagccagtcacctccccattgcagaaggttgctattgatccgatccgatttatcaaaaaatcggagagaaagatttttttttttctgaaacaagatggcatccagtaatgaacttcaggggaaaagttgatatttcacatgaactgtaccataaaaacagttttgcaaccaaaaaagactaaaatttgctcaacaattaacccaccgtacaacaaaatcgcaatcagttccttcaagcaaggttgtcccgattcgtatcctagtatcttacgatactacgatcctatcaagccgaaacgataccgatcccacctagtatccaaattttcgtagtatctcgatcctactattcattactacacgatccaacaaaattttaggtggtatcccgattctacaatccctacgatactacaaaatattatttaaaataacatggtttgaaaataatgtaactaaatatgctcaaatttatataaaaatcagttaaatatatcaaaaccaacgtggtttctcttgataaatgtctctatttgcatgatatatatcatcactatatttttctatatagaatggctatatataattaatataaatattaattaaacttaaaaaaaataaaatctcatagtatcccgatactacgatacgatcctacgatacgatattactttgagcaaaacgatactacctagtatcccgatcctgacaaccttgccttcaagtaaacaagctcacagccattgcgtacaaggatggagcagcatgctcaccggaggtcatggactcctaccaaggccggtgcagctacctggcctcatccgaggatagattctaatatctcgggtggacgtccacccgagtgtttaaaacagttccccggcctcgtcctccttggccaaacatgaaaagagaccgtgcgattaatgaaacaaccctgatttgggcgttgttacgtggaggcagtgagacgctagagatcagttcgaattgagaaagaggagacgacgagatcgagtcggaaaagcatgggacgggacagacaggaaaggacgaggcgaagctgacggatcaacgtgcacgcctgaaaggaccttgatgtcgcctagaggggggggtgaatagtcggttttaaaaataaatgcggaagctaaaacaaaatagggtcggattgtctgatatcaggtcggatagtcctatgtgatcagatagtctgaactgagatcagactatctgacctgcacaacaacaatacaaacaagagaacaacctaagagatctagattcaatccacaagcaaagaggagagctcgaccaacaacaatattagcatagcacaaagcaatggaacaagaaggtaaagagagtgaggatatcaccgaggtttatccgccgatgtatttcccggagttcaaatccttgaggggattctagtctccgttgaggggctcgcaaagagccggatctttttcaaccctatcctcgtgaggttgcacaaatgcactcctccttccactaagggtatctctttccttgcggaggcaagatccggccttcacaaacttctcttggccaaccacacgtagatcggtggcccaagaacgacacctagccgtctaggagtcctcaacctccaagagtaataaacaccacacaactcttggacaaatcctagtgctcaagattaagagaaacacacactaggctcccaaactccaaattcacacacaaagatccaagtcataaagaacaagggggatttgagatagagagggagagagctcaaaaatccaaagcacttagcacaaagctcaacccaaagcaagataggaatgtaatcagtttgggcagccctagaaaagggttggtggggggtttatatagatccccaaaatgtgaccgttggaggggaatctttcagcccacgtcggatagtccgatacgagatcggatagtccgatattttaaacctccaaggcaacgagaaatagagaatgaagttccatgaaatttcggactttccgagacatcggactatctgatgttaaatcggagtatgtgatattttagaagcaaaaacttcgtcctcaaacagagactcaagttctatgaaatttcggagtctctgtatcatcggactatctgatccaacatcggatactccgacacttagaaaaactcactcgaaaggatttttcaaacaaagacagagagtgaagttctgtgaaaaatcggatagtctgatgttgctcaagtaaaaatgcaataactttttactccgaactccgatttcgaagatcttggactctatggaaagctagtttcatgggctatcaaacccaacataaaacatggtccaaaacctttaagagattatgaaaaacttgcaaagaaacccggtgtaagtgttgtgataagtgaaacaactcggaattgaaattttggcttagtttttcaactcacacaaagatgaagcattttgagcactagtgttcaaccaattatatgcatgtggtatccctcttaatagtacggcatcctaaactcaaatttaaaaagcaaagttaaaccaataggagtaccttcacaccatattgtttcttcacttggagggttaccaacgtcaaggtcaattgattatcgggaagatctcatcttcttgatctttgacatttcatctttcatttctcaaatgattgatgcggataatccatggcttcaaatggcctcgcacggttcatcacgacacagtcttcactcacccttcaccaccggtttcggttcgtcggccccaagccccttgcttgcccttcaccaccgcatggtccatcgcagctgagcgtcacttgcgcttcaccgtcttgccataggtagtcacttcatacccgcatcttcaatattttctctttaattctcatccatctataagtccatttcctagcttcttcatcggactaatcatttgcttatacactcaataagcgcattagtcccttaatcgcttgtcatcaattaaccaaaacccactaagggcatagatgctctttcaatctccccctttttggtgattaatgacaacacgattaaagcttacaaaagattgataataaatgattttgaatccaaaggttagtttgagctcccctaaatgtgtgcatacaagtttatgaagtgaacacacatgcacatatttttgaaaatgtgagagctccccctaactctttgcatccgtggggtgtattgtgtgtgaaggagataccaaaattaaaacaacacacacaactcaaattcttggcaccaattcaaaatgtatcaaatgaaattattgatgccaattgcaaaaacttgattctatgccaattgattccggtaccgattgagaaagcatgagtaatcaagttttgtagacaatttcaagtatcaaaagataatcttaattgcatgtggcatggtgatcaaataataagcattcacaccaattgataaacactttcaaatattctctccccctttctcatttactctttggcatctttaaagcattcattttgataatttctcacaaatatctcaccctttgatcaatattttctttatcccctttagtatacttctccccctttgacatctaacaccaaaaagggcataagtagggaaagaaaagcaaagggatccttgatgagggatcatcgagtacttacctctcaattttatatttcatcacttgtgattaggaaatgaagcaatttcacataaagatcacaagaaaatcaataagcattgagatacaaattttgcgcatagaaagctcacatgcaaagggtttaaagcatagatgaaaaagaatctcacctaagattttcacaaaacatttcacaaatgagtttcgcatgtatgaatctcatagtttgtgctaagaccaaaaattcacataaacattgattcacttagaacaactttgtgattaatactcgcttaatgactaaacaagcatgtcgtcacaacattttgcaaattaggctaattagcaagaaatgaaacttggcctagatgcccagacaaggcaagtgatccaatcataccaatttaaataacaagctatggatcatcaagttaccttccttgtcgatttttgagatgcccatcaataaaattgatatcttgaacccaattctgaatttgg

SEQ ID NO: 60000 - DNA, 2082 bp, Oryza sativa
tgtatggtgtaactttgctcttgagttgcccttggtatcaatcccatccatttgtgccggaaacatgtcttcatgttcttcatagacaattgcggtaggttgacttgagttgattgaggttgatcaagtagtccaccttggtcatcatggacttattgtggtctcaccttccaaactatcttcgaagatgtttttgatctcctatgagactaatcacaaaaatacacttgataacaagttagtctcaaaaacacaaaacataggatatactccccctaaatgtgtgcttcaaagtatttgaattacttgtagaaatgcatgtgtttaatgaaaaacaaatggggagtgtagcctatattttggagaaaggcacatcttcccggagtctccggggtatgtacccagagcctccgggctcgaatgcatggtgatagatgagcttgattgcaaaccgagcggtcttaccgaagcctttggttccactataaaatctgcaataaatcttgtagataggtcatagaacattgcatatttttcattttgggagttttacccaattctcaaacaattagaagccacaaaaaaacacaaaaatttagaaaactgaaagtttcaggattttcagaatttggaactcaaaaagagcttggaaagggcatcataaaaatattcaaatgactatagaaaaatccaagtaaatttagatgtgaagtccaaccatagaggaacaaaagtcattatataaactcattccagtttgcaacctattttgagatgtaaaaatcacaaatcagtcaaaaaccatgaattttctgaaaatttcagcaacttgagcaaggtgagaaaaagtcaaattctttccaatttaaatcgaaaccttgcagaaatgatcttttcacttaatagaaaattttccaaaaagaatttctcaaaaaagatttttctttcaagagaaatgtcaaagagagttttgtaggccattcaagtcaataaatctcaaccaaagtgtcaaatcacatccaaataagatttttatgaagtttgacatttggaaagccttagatgggttagagatactaattcatgccattattcacaaagaattttggctcaaattgttcaacccaccatatgcaagttttggccaaatatggtcaaatcaagatttttgatgaactttgtaaggctgcaacattagaatggttggtcttttacaaaagctttgaactaaagatatgtttgaaatgaccaaccctaaaagttttaaataggcaactttttcaaaaactcaatagatttagatttgaggtaaaatctcacttttagcaaaaacaagattgcaagtaggcggttttaaaaataaatgcggaagctaaaacaaaacagggtcggattgtctgatatcaggtcggatagtcctatgtgatcagatagtctaaactgagatcagactatctgacctgcacaacaacaatacaaacaagagaacaacctaagagatctagattcaatccacaagcaaagaggagagctcgaccaacaacaatattagcatagcacaaagcaatggaacaagaaggtaaagaaagtgaggatatcaccgaggtttatgctccgatgtatttcccggagttcaaatccttgaggggattctagtctccgttgaggggctcgcaaagagccgggtctttttcaaccctatcctcgtgaggttgcacaaatgcactcctccttccactaagggtatctctttccttgcggaggtgagatccggccttcacaaacttctcttggccaaccacacgtagatcggtggcccaagaacgacacctagccgtctaggagttctcaacctccaagagtaataaacaccacacaactcttggacaaatcctagtgctcaagattaagagaaacacatactaggctcccaaactccaaattcacacacaaagatccaagtcacaaagaacaagggagatttgagatagagagggagagagctcaaaaatccaaagcacttagcacaaagctcaacgctcttaatagtacggcttcctaaactcaaatttaaaaagcaaa
